United States Patent 10,696,975 (GENES AND USES FOR PLANT ENHANCEMENT) - sequence listing, part 20

SEQ ID NO: 90041 - protein, 474 aa, Salmonella enterica subsp. enterica serovar Paratyphi A str.
MSTEIKTQVVVLGAGPAGYSAAFRCADLGLETVIVERYNSLGGVCLNVGCIPSKALLHVAKVIEEAKALAEHGIVFGEPKTDIDKIRTWKEKVITQLTGGLAGMAKGRKVKVVNGLGKFTGANTLEVEGENGKTVINFDNAIIAAGSRPIQLPFIPHEDPRVWDSTDALELKEVPKRMLVMGGGIIGLEMGTVYHALGSEIDVVEMFDQVIPAADKDIVKVFTKRISKKFNLMLETKVTAVEAKEDGIYVSMEGKKAPAEAQRYDAVLVAIGRVPNGKNLDAGKAGVEVDDRGFIRVDKQLRTNVPHIFAIGDIVGQPMLAHKGVHEGHVAAEVIAGKKHYFDPKVIPSIAYTEPEVAWVGLTEKEAKEKGISYETATFPWAASGRAIASDCADGMTKLIFDKESHRVIGGAIVGTNGGELLGEIGLAIEMGCDTEDIALTIHAHPTLHESVGLAAEVFEGSITDLPNPKAKKK

SEQ ID NO: 90042 - protein, 355 aa, Arabidopsis thaliana
  misc_feature (96)..(96): Xaa can be any naturally occurring amino acid
MDEWPEPIVRVQSLAESNLSSLPDRYIKPASLRPTTTEDAPTATNIPIIDLEGLFSEEGLSDDVIMARISEACRGWGFFQVVNHGVKPELMDAARXNWREFFHMPVNAKETYSNSPRTYEGYGSRLGVEKGASLDWSDYYFLHLLPHHLKDFNKWPSFPPTIREVIDEYGEELVKLSGRIMRVLSTNLGLKEDKFQEAFGGENIGACLRVNYYPKCPRPVLALGLSPHSDPGGMTILLPDDQVFGLQVRKDDTWITVKPHPHAFIVNIGDQIQILSNSTYKSVEHRVIVNSDKERVSLAFFYNPKSDIPIQPLQELVSTHNPPLYPPMTFDQYRLFIRTQGPQGKSHVESHISPR

SEQ ID NO: 90043 - protein, 593 aa, Chlamydomonas reinhardtii
MASRLGGLFSSLKEDGKNLLTAKAWGFSPREFIEMAKQYPSIVQQRTFKLKTAAEMERDAALRGTLKRTLGPFGLTMVGVGFMLGAGIFMAPGTIAVDMTGPAVCISYLIAALSAFLSCFCYAEFACDMPLAGAAYNYIAASLGEFFAWVVTSNLIFEYILADAAVIRGFAPYFATLIGKDPDFFVYTTVTGGKTYVMDWWAFAITLAMTAFVSIGAKESTTANTIITVIHLVVMAFIIIAGFTQADSANFHPFFPNDQPQQWKQVFNGAAIAFFSFIGFDAVATAAEEVKKPSKHMPWGILGSMSIVTVIYFLMCVVLCLMVPRDMINPDATFAAAFVYVGLPWASHIVALGALLGILTGILIGIYAPARILTGCCREGMLPPVLAWIGPKQTPWVATWVIGICIAVIALLTDFAELANMVSIGTFVVFWFVAVALLYNDQWKWLLAMALCCLAVPVSMCFFCRPAYVPSGFKVPLYPFVPCGSIFVNTFLLGQLDEQSYKRFGWWTLAVVIVYLVYGIFAAQAQDNRRIADESVETGTSGDLSGKAAALELELPKVAASRADSASSASAEAAAKQVVPLKAEAADAEATRA

SEQ ID NO: 90044 - protein, 477 aa, Rhodopseudomonas palustris CGA009
MDQPIGGFGGNALHDSFHRMFEISRAEPPPTLEQRQDRLARLRALIKDNEKRFEQAISADFGHRSSTETLIAETLSLLGDIKHTSRHLKRWMAPRKVSTQLQFLPGKNRLLPQPLGVVGVIAPWNYPLQLTVAPAIGAIAAGNRVMIKPSELSPHFAALLQETVAAKFDASEMMVTGIEAGVAEAFARLPFDHLMFTGSTRVGRIVAAEAGKNLTPVTLELGGKSPTIVDRSADLDEVAPRIAYAKLMNAGQTCIAPDYVLAPQDRVEALAGKIWGAMQQMWGTDPANPDYTSIIAEHHYARLKSLVDDAVARGARLLQPASADDAAWAGKRKFPPTLVLGATHEMKIMQEEIFGPLLPILGYSEPTEPINFINGRDRPLALYWFGTDDTARDQVLERTVSGGVTINDCLVHFAQANQPMGGVGASGTGAYHGEWGFNTFTKMKPIFYRSPYNRFADLYPPYGAKIARLSKVLRLMS

SEQ ID NO: 90045 - protein, 393 aa, Pseudomonas aeruginosa UCBPP-PA14
MSSLPLYFDYAATTPVDERVIRAMVECLGYQACFGNPASNFHAYGRQARRAVERAREQVAALVGASAGQIVWTSGATESNNLALKGVAQALDAPGHLITSRLEHKAVLDTVQQLADDGWSVTWLAPGTDGLIRPEQVEAAWRADTRLVSLMRVNNELGTLTDIAAIGERVRERGALFHVDAAQASGKVAIDLGRLAVDLMSFSAHKTYGPKGIGALYVGPRAERRLKAQIHGGGHEQGLRSGTLATHQIVGMGEAFALAGELFEEEGRRIAGLQRRLLEGLAQIDGWRLNGSADARIAHTLNLTFDNPAFVPQALESSLAVSSTSACNSARPAPSHVLLALGHDAASAGRSVRLSLGRYTREADVDAAVAALKAAADSGAPAWQPFLGVSRAG

SEQ ID NO: 90046 - protein, 522 aa, Bradyrhizobium japonicum USDA 110
MSGLIDIKVPDIGDFKDVPVIEVFVKPGDKVKAEDPLVALESDKATMEVPSPRDGVVKSVVVKVGDKVSEGAVIVQFEGAGAEQAETRPVVSAPPSPVSAPAGVAEVRVPDIGDFKDVPVIEIFVKPGDSVKAEDPLIALESDKATMEVPAPLSGTVREIKVKTGDKVSEGAIILVLATGDASAAANAAAPALAPASQATAAALAVQAAGVDEQAFALAYAGPAVRKLAREMGVDLGKIKGSGNHGRIVREDVEASAKGGAPAAKPQAAAASGGGVGSIDLLPWPKIDFAKFGPVERKELGRIKKISAANLHRNWVVIPHVTTHDEADITELEQFRVKMNKELEKSGVKLSLLPFMVKAAVAALKKFPEFNASLDGDTLVYKNYWHIGFAADTPNGLMVPVIRDADKKSLPEIANEMNALAKLAREGKIKPDQMQGGTFSISSLGGIGGIYFTPIINAPEVAIMGVCKGYWKQHSPDGKTWASRLTLPLSLSWDHRVIDGAAAARFNVYFASVLADLRRVLF

SEQ ID NO: 90047 - protein, 606 aa, Pseudomonas aeruginosa UCBPP-PA14
MHRTSRRTFVKGLAATGLLGGLGLWRAPAWALAGPGQQNLLAGDSFDLFIGETPVNLSGSPATAMTINGSLPGPTLRWREGDNVTLRVRNRLAEDTSIHWHGIILPANMDGVPGLSFEGIAPGGLYEYRFKVRQNGTYWYHSHSGLQEQAGVYGALVIDAREPEPFSYDRDYVVLLSDWSDEKPQRILAKLKKQSDYYNFHKRTVGDFIDDVSANGWAATLADRKMWAEMKMSPTDLADVSGYTYTYLLNGQPPDGNWTGLFRPGEKLRLRFVNASAMSYFDVRIPGLKMTVVAADGQHVEPVSVDELRIAVAETYDVIVEPGGERAYTLFAQSMDRSGYARGTLALAEGLSAPVPTPDPRPLIGMDDMGMGGMDHGAMGHGAATRPASEMDHSKMSGMDMNGMDHSKMAGMDMSGMDHSRMGMGAMPMQSHPASEDGNPLVDMQTMTPTPKLADPGLGLRDNGRRVLTYADLRSRFADPDGREPGRTIELHLTGHMEKFAWSFDGIKFSDAEPLRLTYGERLRIVLVNDTMMTHPIHLHGMWSDLEDEQGNFLVRKHTIDMPPGTRRSYRVTADALGRWAYHCHLLFHMEMGMFREVRVDEGDNA

SEQ ID NO: 90048 - protein, 581 aa, Bradyrhizobium japonicum USDA 110
MAQQIEVKVPDIGDFKDVAVIEVMVKPGETVAVDTSLIMVESDKASMEIPSSHAGIVKEVKVRVGDKVSEGSIILVLETAGAAAAPPPAPASKPAATSSAAAPVPASHSGKADIECEMLVLGAGPGGYSAAFRAADLGMKTVLVERYDTLGGVCLNVGCIPSKALLHTASVVDEVKHLPDHGISFGAPQIDLDKLRGFKDGVIKKLTGGLAGMAKARKVEVVTGVGAFLDPHHLEVVTAGGKKTIKFAKAIIAAGSQAVKLPFLPEDPRIVDSTGALLLKSIPKRMLVIGGGIIGLEMATVYSALGARIDVVEMLDGLMQGADRDLVKVWEKMNAKRFDKAMLKTKTVGAKATEAGIEVSFEGEQAPSGSQVYDLVLVAVGRSPNGKKIGAEKAGVAVTDRGFIDVDKQMRTNVAHIFAIGDIVGQPMLAHKAVHEGHVAAEVAHGEKSYFDARQIPSVAYTDPEVAWAGKTEDECKAEGIKFGKSVFPWAASGRAIANGRDEGFTKLLFDTATHRVIGGGIVGTHAGDLISEVCLAIEMGCEPADIGKTIHPHPTLGESIGMAAEVFEGHCTDLPPQKKK

SEQ ID NO: 90049 - protein, 303 aa, Physcomitrella patens subsp. patens
MDNYEKLEKVGEGTYGKVYKARDKRSGQLVALKKTRLEMEEEGVPSTALREVSLLQMLSHSMYIVRLLCVEHVEKGGKPMLYLVFEYMDTDLKKYIDLHGRGPSGKPLPPKVVQSFMYQLCTGLAHCHGHGVMHRDLKPQNLLVDKQTRRLKIADLGLGRAFTVPMKSYTHEIVTLWYRAPEVLLGATHYSLPVDIWSVGCIFAELVRKMPLFTGDSELQQLLHIFRLLGTPNETIWPGVSQHRDWHEFPQWRPQDLSLAVPGLSAVGLDLLAKMLVFEPSKRISAKAALSHTYFADVDKTAT

SEQ ID NO: 90050 - protein, 298 aa, Aspergillus oryzae
MASLQHTKKTYTLNTGDKIPAIGLGTWQSKPNEVREAVKNALLKGYRHIDTALAYGNEAEVGQGIKDSGVPREEIWITTKLDNTWHHRVSEGIESSLKDLGVSYVDLYLVHWPSSTDPNDKSKHLPDWDFIKTWQEMQKLPATGKVRNIGVSNFGIKNLEKLLNDPSTKIVPAVNQIELHPNNPSPKLVAYNTSKGIHSTGYSCLGSTNSPLYKDPTLLQLAEKKGKTPQQCLLQWGIQKGWSVIPKSVSKERIDTNFELDGWNLTDEEVNQLDNLKDRRKVCGDSWLPIKVFFGDDE

SEQ ID NO: 90051 - protein, 193 aa, Oryza sativa Indica Group
MGSGSFLKLLANNFDVLAGPLVSLAYPLYASVRAIETKSPVDDQQWLTYWVLYSFITLFELTFAPVIEWLPFWSYAKLFFNCWLVLPCFHGAAYVYDHFVRPMFVNRQIVNVWYVPRKENLSKPDDVLSAAERYIEQNGPEAFEKLISKSTRPSTSKRSTKRSILEEVESEHMARAERESWGENPFYDKNYRC

SEQ ID NO: 90052 - protein, 202 aa, Magnetococcus sp. MC-1
MSLVPMVVETTNRGERAYDIYSRLLKERVVFLVGQVEEHMANLVVAQLLFLESENPEKDIHLYINSPGGSVTAGMAIYDTMQFIRPSVSTLCIGQAASMGAVLLAAGEAGKRLVLPNARVMIHQPLGGFSGQASDFEIHAREILRIRENLNQVLSHHTGKPLEQVQLDTERDNFLSATEAVEYGLVDKVISHRELPEAEAES

SEQ ID NO: 90053 - protein, 758 aa, Bradyrhizobium japonicum USDA 110
MDQDLKEAALEYHRLPTPGKISVVPTKAMATQRDLALAYSPGVAEPCLVIAEDPLQADVLTARSNLVAVVTNGTAVLGLGNIGALAGKPVMEGKACLFKKFAGIDVFDIELAEENPDALVETIARMEPTFGGINLEDIKAPECFYIEKKLRERMKIPVFHDDQHGTAIIAAAAILNGLKLVKKDIADVKLVCSGAGAAALACLDLIVSLGLRRERIIVTDAKGVVYAGRAESMDDNKARYAVKTEARKLDDIIQDADIFLGLSAGKVLTPEMVKKMTRDPLIFAMANPIPEIMPEDALAVRPDAIIGTGRSDYPNQINNVLCFPFIFRGALDCGATTINEEMKLATVRALADLAMAEVPEVVATAYKGEELRFGRNYLIPKPFDPRLIEMIAPAVAKAAADTGVARRPIVDMDAYRQKLSRFVYQSGNAMQPVFSVAKGSGKSLVLAEGEDERVLRAAQVIADERIAKPLLLGRPATIEQHIKAFGLRLRPGQDCEIIDPHDAQVYSKCADVYHARRKRDGVSAALALSETRSNATVLASILLERGIGDAMLCGVIGRTADHLAAIKNVIGTRDDVRTLAVMQMLILPQHQLFICDTHCNLNPTAEQVADIALLAAAEVKRFGITPRVALLSHSSFGSSAVPEAHKMREARTIIRERSPDLAVEGEMRGDAALSQSVRDHEFPESGFAGPANVLVMPNLDAANISYNLLRMAAGQGLTVGGILLGAAKPAHILTPSSTVRRIVNMAAVAAADAVSERA

SEQ ID NO: 90054 - protein, 589 aa, Lactobacillus delbrueckii subsp. lactis
MKKTKIVSTLGPASNDIETITKLAEAGANVFRFNFSHGDHEEHLARMNMVREVEKKTGKLLGIALDTKGAEIRTTDQEGGKFTINTGDEIRVSMDATKAGNKDMIHVTYPGLFDDTHVGGTVLIDDGAVGLTIKAKDEEKRELICEAQNTGVIGSKKGVNAPGVEIRLPGITEKDTDDIRFGLKHGINFIFASFVRKAQDVLDIRALCEEANAPYVKIFPKIESQEGIDNIDEILQVSDGLMVARGDMGVEIPFINVPFVQKTLIKKCNALGKPVITATQMLDSMQENPRPTRAEVTDVANAVLDGTDATMLSGESANGLYPVESVQAMHDINVRTEKEMDTRNTLALQRFEEYKGSNVTEAIGESVVRTAQELGVKTIITATSSGYTARMISKYRPDATIVALTFDEKIQHSLGIVWGVEPVLAKQPSNTDEMFEEAARVAKEHGFVKDGDLVIIVAGVPFGQSGTTNLMKLQIIGNQLAQGLGVGTGSVIGKAVVANSAEEANNKVHEGDILVAKTTDKDYMPAIKKASGMIVEASGLTSHAAVVGVSLGIPVVVGAADATSKIADGSTLTVDARRGAIYQGEVSNL

SEQ ID NO: 90055 - protein, 843 aa, Frankia sp. EAN1pec
MRAVVMAGGEGTRLRPLTANLPKPLLPVVNRPIMEHVLRLLKRHGFDETVVTVQFLAAMIRNYFGSGDELGMHLSYATETTPLGTAGSVKNAEDALRHEEFLVISGDALTDIDLTDLVAYHRAQGALVTVALKSVPDPLEFGIVITGEDGRISRFLEKPTWGQVFSDTVNTGIYVMEPEVLDHVPAGEAVDWSGDVFPRLVAAGAPVFGYVAGGYWEDVGTIASFQRAQADVLNRQVDVSIGGFEVSPGVWIGEDADVHPDAILKGPLVVGDYSKVEAGAELREFTVLGSNVVVKRGAFLHRVVVQDNALIGPRTNLRGCVIGKSTDVLRAARIEEGAVIGDECVIQEEAFVSHDVKVYPFKTIEAGAVVNTSVIWESRGQRSLFGPRGVSGLVNAEITPELVVRLASAYATTLKKGSTVTTARDGSRAARALKRAVISALTAGAINVRDLEVAPLPVARFDVRTSDAAGGIMLRSKPGDAERIDIVFLDADGDDLSPAAQRKLDRVFTRQEFRRAFPGEIGDLRFPARTADVYTQDLLDRVDTSGLAEADLKVVVDPSGGAASLLLPTLLGRLGVDVLTVNGRLDETYPEPGAEQERRALDRLGALVASSRAAFGVRFDHIGERITIVDERGDLISDERALLVMLDLVAAENRGAQAAVPVTTTRVADQVGRFHGLTVRRMSMSGSELSRVVQAEPIVFAADGRGGFVVPEFAPVIDGLAAFVRLVALVARTRLTLSAIDARIPPVAMVRASVPTPWAEKGTVMRRVVESVDVDSGDQVDTTDGVRVVGPDGSWVLVLPDPSEAVTHLWAEAADLGGAQKLVRRWSAVVETVPPEQAPVTRS

SEQ ID NO: 90056 - protein, 158 aa, Haloarcula marismortui ATCC 43049
MNPRAVPHYFARPKTEGQSLTGRGSNNQVMPTVEYLNYEVVDDNGWDMYDDDVFGEASDMDLDDEDYGSLEVNEGEYILEAAEAQGYDWPFSCRAGACANCAAIVLEGDIDMDMQQILSDEEVEDKNVRLTCIGSPDADEVKIVYNAKHLDYLQNRVI

SEQ ID NO: 90057 - protein, 359 aa, Pasteurella multocida subsp. multocida str. Pm70
MQTFNIAVLSGDGIGPEIIAEAIKVLDVVQQKYAFKLNYRTFDVGGIAIDNHGTPLPEATLKGCEESDAILFGSVGGPKWEHLPPAQQPERGALLPLRKHFALFCNLRPATLYKGLEKFCPLRADISAKGFDMVTVRELTGGIYFGQPKGREGEGANEKAFDTEVYHRYEIERIARVAFETAMKRSKHVTSVDKANVLISSVLWREVVCDVAKDYPEVTLDHIYIDNATMQLIKQPEFFDVLLCSNIFGDIISDECAMITGSMGMLPSASLNEKGFGLYEPAGGSAPDIAGKGIANPIAQILSAAMMLRHSFNLNDAATAIENAVKNVLAEGHRTADLADESQPLSTKQMGDLIAQAVE

SEQ ID NO: 90058 - protein, 406 aa, Physcomitrella patens subsp. patens
MACSSGVGLISNLCSVQSSVSSTKSSSPAPRSNSISYWKSSPSPTSSLESSFRPSFPAGSSSLTIRKGATSPRSNRIVAQAINELVACFGELLIDFVPTVGGLSLADAPAFKKAPGGAPANVACGIAKLGGKAAFIGKVGDDEFGHMLCDVLKDNHVITNGVRFDSHARTALAFVTLRHDGEREFMFYRNPSADMLFQPDELDIELLQQASIFHYGSISLITEPSRSTHLEAMRIAKEAGALLSYDPNLRLPLWPSADAAKEGIMSIWDQADIIKVSDEEVIFLTGADPKDDAHNLKMMPAGCRLMLVTEGAEGCRYYTPKFHGQVGGLKVQVVDTTGAGDAFCAGLLSQLAKSPSIVEDEEKLREALTFANACGAITTTERGAIPSLPDNETVSRLLSTAHRLPA

SEQ ID NO: 90059 - protein, 421 aa, Magnetococcus sp. MC-1
MKLVVVGLNHKSAPVSLREKVAYSSDTLPRSLQALTRLDAVHEGTILSTCNRVEIYMASRDPDAAAAQTSQWIARDHALDPADVTPHLYTKAESEAVRHGFCVASSLDSMVLGEAQILGQMKQAYQDALSAGSTGVVLNRFFQHAFLTAKRVRTETSIAENSVSVASAAVDLAKRIFGDLSGHSCLLIGAGEMCELAARHLVTHGVKEVLVTNRTFSRAVDLAQQFDGHAFPIEALAENLHRADIVISSTGSTVYMVGPDMVKQALKSRRQRPIFLIDIAVPRDLDPEIGQVDSAFLYDMDDLNKIVNDNRQDRAEAAQAAMQIIEGETPLFIQWLDTLDVVPTIKQMRRKAEAAKDQLLQKHLAGWDLSDTDRQRVENLARQLVNKLMHDPTERLRSLTNEHDGDRYIDAARKLYKLDDD

SEQ ID NO: 90060 - protein, 434 aa, Xanthomonas campestris pv. campestris str. 8004
MFISTRGAAPAVSLSQGIAAGLAPDGGLYVPQTLPPARTLQAGATLADTATTLLQPFFEGDALAGELAAICAEAFDFPAPLVPLATPGDYALELFHGPTAAFKDFGARFLAACLTRLRRAEDRPLTILVATSGDTGAAVAAAFHRQPGLRVVVLYPDGRVSPRQAHQLGCFGDNIQALRVAGTFDDCQAMVKQALNDGELQVQVPLSSANSISLGRLLPQMSYYAHAALQHHAGSGAALNLVVPTGNLGNGLAAILARALGVPLGQIVLASNANHVLPDYFAGDDYAPQPSVATVANAMDVGAPSNFERLRWLYDGDDAALREAFRALSVDDTAIRHTVQQRFARYGEVHCPHTATAVHVLEQLRAEGPEGGTGDWAVAATAHPAKFEAVVEPLIGRAVEIPPALAALLQRPAHAEPLAPDYQAFRQRLLADAP

SEQ ID NO: 90061 - protein, 485 aa, Leuconostoc mesenteroides
VSEIKTLVTFFGGTGDLAKRKLYPSVFNLYKKGYLQKHFAIVGTARQALNDDEFKQLVRDSIKDFTDDQAQAEAFIEHFSYRAHDVTDAASYAVLKEAIEEAADKFDIDGNRIFYMSVAPRFFGTIAKYLKSEGLLADTGYNRLMIEKPFGTSYDTAAELQNDLENAFDDNQLFRIDHYLGKEMVQNIAALRFGNPIFDAAWNKDYIKNVQVTLCEVLGVEERAGYYDTAGALLDMIQNHTMQIVGWLAMEKPESFTDKDIRAAKNAAFNALKIYDEAEVNKYFVRAQYGAGDSADFKPYLEELDVPADSKNNTFIAGELQFDLPRWEGVPFYVRSGKRLAAKQTRVDIVFKAGTFNFGSEQEAQEAVLSIIIDPKGAIELKLNAKSVEDAFNTRTIDLGWTVSDEDKKNTPEPYERMIHDTMNGDGSNFADWNGVSIAWKFVDAISAVYTADKAPLETYKSGSMGPEASDKLLAANGDAWVFKG

SEQ ID NO: 90062 - protein, 430 aa, Oryza sativa Indica Group
MEEKKQQQQRPQRGRDGILQYPHLFFAALALALLLTDPFHLGPLAGVDYRPVRHELAPYREVMARWPRDNGSRLRHGRLEFVGEVFGPESIEFDRHGRGPYAGLADGRVVRWMGEDAGWETFAVMSPDWSEKVCANGVESTTKKQHEMERRCGRPLGLRFHGETGELYVADAYYGLMSVGPNGGVATSLAREVGGSPVNFANDLDIHRNGSVFFTDTSTRYNRKDHLNVLLEGEGTGRLLRYDPETKAAHVVLSGLVFPNGVQISDDQQFLLFSETTNCRIMRYWLEGPRAGQVEVFADLPGFPDNVRLSSGGGGGRFWVAIDCCRTAAQEVFAKRPWLRTLYFKLPLTMRTLGKMVSMRMHTLVALLDGEGDVVEVLEDRGGEVMRLVSEVREVGRKLWIGTVAHNHIATIPYPLEEQSSSSSSNVLGD

SEQ ID NO: 90063 - protein, 497 aa, Arabidopsis thaliana
MEMLLGGQATNGALRSKTKIVCTLGPASRSVEMIEKLLKAGMNVARFNFSHGSHSYHQETLDNLRTAMDNTGILCAVMLDTKSPVIRTGFLKEGKPIQLKQGQEITISIDYKIQGDSNTISMSYKKLAEDLKPGDVILCSDGTISLNVLSCDKYLGLVRCRCENSALLGERKNVNLPGIVVDLPTLTEKDKEDIMQWGVPNKIDIIALSFVRKGSDLIQVRKLLGEHSKSIMLMSKVENQEGVMNFDKILENSDAFMVARGDLGMEIPIEKMFLAQKTMINKANAHGKPVVTATQMLESMTVSPRPTRAEATDVANAVLDGTDCVMLSGETAAGAHPETAVLTMSRICKEAEDFIDYDILHKKTLGMVSLPLSPIESLAASAVSTARSVFASAIVVLTRGGYTAELVAKYRPSVPILSVIMPEIAECSDSVAHVARRGLIYRGIIPVVGCSARDSTEEMIRLAIGFAKTKGICKTGDSIVALHKIDGSSIVRIVSVE

SEQ ID NO: 90064 - protein, 250 aa, Solanum chilense
MVCIGQKQFRKALELLHNVVTAPMSTLNAIAVEAYKKYILVSLIHLGQFSTSFPKYTSSVAQRNLKNFSQPYLELSNSYGTGRISELETFVQTNKEKFESDNNLGLVMQVVSSMYKRNIQRLTQTYLTLSLQDIANTVQLRGPKQAEMHVLQMIEDGEIYATINQKDGMVRFLEDPEQYKTCGMIEHIDSSIKRLMAVSKKLTSMDELMSCDPMYLGKVGRGETEIWILMILTVSLRNSLSETSKVQFSE

SEQ ID NO: 90065 - protein, 344 aa, Aspergillus nidulans FGSC A4
MPATTADTLSLVTRTVTVAPLVLLSVADHYGRSAKGTRKRVVGVLLGEHIGGNVRVSNSFAVPFEEDEKDPSVWFLDHNFVESMRDMFKKINAREKLIGWYHSGPKLRASDLEINELFKRYTPNPLLVIVDVQPKEVGVPTDAYFAVDEIKDVGTTAPQPRHTLTLEAEEIGVEHLLRDIRDVAVGTLSTRITSQLQSLQGLHLRLRDIGQYLQKVLDHELPVNHAILGNLQDVFNLLPNLSTPSTTARVGGEPEQSTDNAELARAMSIKTNDQLMAIYLSSLVRAVTAYHDLIENKIQNRQQQEEVEQKREQEANSAKNEKEGAKKVTNTSEPKEESKEKTKR

SEQ ID NO: 90066 - protein, 101 aa, Zea mays
GRGRGRRRRRAAAAGLSRSRRWGDVAAEGNTYLIAGAVAVALVGTAFPILFSRKDTCPECDGAGFIRKAGATLRANAARKDEAQIVCPNCNGLGKLGQIDK

SEQ ID NO: 90067 - protein, 693 aa, Chlamydomonas reinhardtii
MDAYQELKLIGKGTYGKVYQVRSKVDDDICVVKKVQFDGTPQSEAEAALREGQVLSLLRHPHVVPYKEFFKHTDGDLCLVMAFCEGGDLFKYIRELRDKGQTVPEPQVWAWLVQLLLSLSYIHSKRILHRDVKTQNIFLSGGKVLLGDFGLAKQLQRTFEMARTPIGTPYYMAPEIYEEQPYSFKSDVWALGCVMYEMMTGRAAFAADNLSRVVLRVIRGQYDPLPDSYSSALRMVVTSMLCKEVKARPDANQLLTVPAVVPHVQSYLESLTAEGPSGWATWRMKLPLAAMVQMTEALEAAGVPFGGRRSHTGGGGVSAPSSNRTSVSGATPQLSVEPEPLQEEPSLSPEPPAAAGGGLAPATPDQKLGAPGVVAGQVVKLPPLPGAKPVRTPYGLATPFMGGAVSPPQHYAELQVLAHQVMAIRTSQCGDGSEAGGAGPDPEGAAAGGAAGTNAGPAPGEVPDVVKALDRTLIKTLEVARRATEADGCGPDAGGGGGGGGGGGGGGGGGIDEAWLSAGLPQGGFGFGGGGFGAPPPPAPAPKPSKPSDVVSLPPIAPRRPVSAKALSQAATPEPPTPSANAPARAVPYEVPDEGFASISQVSLHAQSLVNRRANLEVYCGQLLGPELMEQVMQAVSEAQKTSDALGGKGGVAAAEAALARQLDRLLAGHEQGPQLRAEVGPLLEELALLRVG

SEQ ID NO: 90068 - protein, 120 aa, Candidatus Pelagibacter ubique HTCC1002
MKKLTCHCGEVEAEINVPDNLEKVLKCNCSICKRKGAIMSMVKNENFKIIKGEDKLKLYQFHSKIAKHYFCSNCGIYTHHNPRANPAMTGFNLGCVDEINTFELENVAVNDGQNHPLDNK

SEQ ID NO: 90069 - protein, 160 aa, Glycine max
MASPPPPAPAAAAAHSVFVYGNLMAEEVVRVLLGRVPPSSPALLPNHQRLSIRGRVYPAILPVDGSKVPGKVWKGITDRELDVLDIFEDEEYVRETVGISLTDSADTMIAYTYIWGNVDDPDLYGEWDFDEWKKVHLKDYLTMTQDFKEELEQLESETHD

SEQ ID NO: 90070 - protein, 1498 aa, Aspergillus oryzae
MSFLGTVNPNIPQQQSVVSHNNALRSHGDTDDDTPVYETPSTAATQYGDREKSEEALTLQEDNEEKMEARVGDLARRLTRQSTRVSAKGALENPFFVEDPESTLNPDSPNFKPRDWLKMLLAIRSRDPEQYPDRTAGVAFKNLNVHGFGSPTDYQKDVLNSILEIGTIVRKLMGIKMQKIQILREFDGLVKSGEMLVVLGRPGSGCSTFLKTISGEMNGIQMSDDSTLNYQGIPAKLMHHAFKGEAIYSAETDVHFPQLSVGDTLKFAALARAPRNRLEGVSRQQYAEHMRDVVMTMLGLSHTINTRVGNDYVRGVSGGERKRVSIAEATLSQAPLQCWDNSTRGLDSANALEFCKNLALMSKYAGTAACVAIYQASQNAYDVFDKVTVLYEGRQIYFGRTTEAKQFFVDMGFECPDRQTTADFLTSLTSPSERKVRPGFENRVPRTPDEFAAAWKRSDARAKLIIEIEEFEKQYPIGGASYQSFIDARKAMQAKHQRVKSPYTISIWEQISLCVVRGFQRLKGDSSLTVTALVGNFIIALIVASVFFNLQDNTASFYSRGALLFYAVLLNAFSSALEILTLYAQRPIVEKQARYAFYHPFAEAVASMLCDTPYKLVNSITFNLPLYFMTNLRRDAGAWWTFWLFSVVTTYTMSMIFRTIAATSRSLSQALVPAAILILGMVIYTGFVIPTRNMLGWSRWMNYINPISYAFESFMVNEFHDRHFECSQIVPSGGIYESMPMQNRICSTVGADTGSTIVQGSVYLEQSFQYVKGHLWRNLGIMIGFLVFFAFTYLASTEYISEQKSKGEVLLFRRGHQPKVALDKTDSESPEPGGAPKTDESAPQASAGIQRQTAIFQWKDVCYDIKIKGQPRRILDHVDGWVKPGTCTALMGVSGAGKTTLLDVLATRVTMGVITGEMLVDGRPRDQSFQRKTGYVQQQDLHLATSTVREALRFSAILRQPAHVSHQEKLDYVEEVIRLLGMEAYADAVVGVPGEGLNVEQRKRLTIGVELAAKPQLLLFLDEPTSGLDSQTSWSILDLIDTLTQHGQAILCTIHQPSAMLFQRFDRLLFLAKGGRTIYFGEIGQNSSTLSSYFERNGAQPLSPGENPAEWMLDVIGAAPGSHSDIDWPKVWRESPEHAKVKEHLDELKSTLSVKPAENSDSEAFKEYAAPFYIQLWECLIRVFAQYYRTPSYIWSKTALSILTSIYIGFSFFHAKNSIQGMQNQMFSVFMLMTIFGNLVQQIMPHFVTQRSLYEVRERPSKTYSWQAFMTANILVELPWNTLMAALMFFCWYYPIGLYNNAKPTDAVTERGGLMFLLIWVFLLFTSTFAHMVIAGIELAETGGNIATLLFSLCLIFCGVLATPENMPGFWIFMYRVSPFTYLISAMLSTGLSGTDVQCEAVELLHFNPPANQSCQQYMAAYIQGAQGYLQNPEATTGCAFCTISKTDTYLAAISSNFDDAWRNFGLMWVYIAFNIGAAVFIYWLARVPKGKRASGAT

SEQ ID NO: 90071 - protein, 182 aa, Bartonella henselae str. Houston-1
MAQKERSERDERESEFVDRLVHINRVAKVVKGGRRFGFAALVVVGDQKGRVGFGHGKAREVPEAVRKATESAKRGMIYVPLRSGRTLHHDLEGHHGAGRVLLRSASAGTGIIAGGPMRAIFETLGMQDVVAKSLGSSNPYNMVRATFDALKRQMHPRDIAAQRGIKYSTLQARRQHLVDAEG

SEQ ID NO: 90072 - protein, 516 aa, Magnetococcus sp. MC-1
MEDLHCPFIQRLPMSEQLFRHILTSRVYEAAVETPLEQSAWLSAQLRNQVFIKREDLQPVFSFKLRGAYNKMAQLTPEQRARGIIAASAGNHAQGVAFSARQLGLSATIVMPCTTPEIKVGAVKQFGAQVVLHGDNYSIAADHCKELAQHNGMTFIHPFDDELVIAGQGTVGLEIMRQSGNQLDAIFVPVGGGGLIAGIATYVKNLLPQIRIIGVEPTDSDAMARALEAGKIVSLDQVGIFADGVAVREVGTRTLALCEQYVDEMVRVNVDEICTAIKWTYQATRAIVEPAGALALAGLRRYVAEKGITGQRLVVINSGANMNFERLRYVTERTMVGEQREALFAITIPEQPGALRHFCQEVVGDHNITEFNYRLSGRDAAHIFVGIDLREPAERQLLAHRLQSFHYQFVDLTENDLAKTHLRHMVGGRSHVVQHERLLRFRFPERPGALAHFLTTMQADWNISLFQYRLHGGEYGRVLIGLEVPPEQHDQLQSCLDKLGFRYVDESENPAYKLFL

SEQ ID NO: 90073 - protein, 363 aa, Pisum sativum
CINSGINKVYILTQFNSASLNRHIARAYNSGTGVTFGDGYVEVLAATQTPGEQGKKWFQGSADAVRQFHWLFEDARSKDIEDVLILSGDHLYRMDYMDFVKDHRESGADITLSCLPMDDSRASDFGLMKIDNKGRILSFSEKPKGADPKAMQVDTTVLGLSKDEALEKPYIASMGVYVFKKEILLNLLRWRFPTANDFGSEVIPASAKEFYMKAYLFNDYWEDIGTIRSFFEANLALTEHPSKFSFYDAAKPMYTSRRNLPPSTIDNSKVVDSIISHGSFVNNAFIEHSVVGIRSRINSNVHLKDTVMLGADLYETEEEVAALLAEGRVPVGIGENTKIKDCIIDKNARIGKNVTIANSEGVP

SEQ ID NO: 90074 - protein, 528 aa, Trametes sp. C30
MSKFQSLAAFIALSLSTGRLAAAAIGPKADLTISNANISPDGFTRAAVVANNQFPGPLITGNKGDNFQINVIDNLSNDTMLTSTTIHWHGFFQKGTNWADGPAFVNQCPISEGNSFLYDFSAADQAGTFWYHSHLSTQYCDGLRGVMVVYDPNDPHQSLYDVDDESTVITLSDWYHTAARLGPRFPLGADTVLINGLGRFATGDPDAELAVITVTKGKRYRFRLANISCDPNFTFSIQGHTMNVIEVDSVNVTPYEVDSIQTFAGQRYSFVLTADQDVDNYWMWAIPNVGTINTDGGVNSAILRYDGAAEIEPEAASPSVNNQLVESNVVPLTDVAAPGNPTVGGVDYALNLDFSFDGTNFAINGESYTSPSVPVLLQILSGAQTAPDLLPNGSVYVLPSNATVELSFPMTATNAPGAPHPFHLHGHTFYVVRSAGQTDYNYVNPPQRDTVSVGAAGDNVTIRFRTDNPGPWFLHCHIDFHLEAGFAVVFAEDTPNVASVNKPSAAWEDLCPTYNSVYPNGDSGDARR

SEQ ID NO: 90075 - protein, 394 aa, Aspergillus oryzae
MPPKKAVVQEKVLLGRPGNNLKSGIVGLANVGKSTLFQAITKSNLGNPANFPYATIDPEEARVIVPDDRFDWLCEHYKPKSQVPANLTVYDIAGLTRGASTGAGLGNAFLSHIRAVDAIFQVVRCFDDAEIIHVEGDVDPARDLDIISEELRVKDIEFVEKALEGLTKQTKRGGQSLEMKKLREEEATVAKVLEHLKSGKDVRKADWGPKEVEVINPLQLLTAKPVVYLVNLSEKDYIRQKNKRLPDVLEWVKKNSPGDPIIPFSACFEERLTRFETEKEAIEECKNLNTKSALPKVITTMRTSLNLASFFTTGADEVRQWTIRKGIKAPSAAGVIHTDFEKTFIQAIVYNYSTLREYGDEAAVKAAGKVMTKGKDYVVEDGDILLIKAGAARG

SEQ ID NO: 90076 - protein, 224 aa, Magnetococcus sp. MC-1
MIKIAPSILSADFARLGEEIRMVEAAGADYIHVDVMDGHFVPNLTMGPPVVASIRKVATKPLDVHLMISPVDPYIEAFAQAGSDIITVHAEATHHLDRTLNLIKEYGKKAGVSINPATPVSAIENVMHLVDMVLVMSVNPGFGGQSFIPHSLNKVRQVREMINRQDRPIELQVDGGVKPDNIAKIAEAGANVFVAGSAIFSQPDYRAVMDSMHKNVRDSQKNPD

SEQ ID NO: 90077 - protein, 331 aa, Bradyrhizobium japonicum USDA 110
MNSLGRKFAVAPMMDWTDRHCRVFHRQLTRRALLYTEMLTTGAIIHGDRERLLGFDACENPVALQLGGSDPSELAQAARIGEAFGYDEINLNVGCPSDRVKDGRFGACLMAEPELVARCVDAMKRAVAVPVTVKCRIGIDDQDPEVALDTLARAVVAAGCDALIVHARKAWLNGLSPKENRDIPPLDYERVYRLKRAMPDVPVIINGGIPGIDEAKAHLEHVDGVMLGRAAYQEPWRLLSVDSDIFGETAPHATMQDALEAMMPYIEAQLARGTRLHAITRHFVGAFHAVPGARAFRRHLAEQGVKPGAGLDVLRDAIARVGVRAPAEAAA

SEQ ID NO: 90078 - protein, 699 aa, Oryza sativa
  misc_feature (94)..(94): Xaa can be any naturally occurring amino acid
GFFPASFFSSKADGEFTPTSVFKGLMKSTRKHAPKLVVGIVLLGAGAFFLNRAEKSSQLFQQQEITTSIEEVTSTAKPIVREMRKIPQRVKKLXLFDILYLLLASVVFVPLFQKIPGGSPVLGYLAAGVLIGPYGLSIIRHVHGTKAIAEFGVVFLLFNIGLELSVERLSSMKKYVFGLGSAQVLATTAAVGMIAHRFAVLPGPAAIVIGSGLALSSTAVVLQVLQERGESTSRHGRATFSVLLFQDLAVVVLLILIPLISPNSSKGGVGFQAIAEAMGMAAVKAIAAITAIIAGGRLLLRPIYKQIAENRNAEIFSANTLLVIFGTSLLTARAGLSMALGAFLAGLLLAETEFSLQVESDIAPYRGLLLGLFFMTVGMSIDPKLLLSNFPAISVILGLLIIGKTMLVTFIGRVFGISTIAAVRVGLLLAPGGEFAFVAFGEAVNQGLLSPQLSSLLFLVVGFSMALTPWLAAGGQFLASKFEQHDVRSLLPVESETDDLQDHIIILGFGRVGQIIAQLLSERLIPFVALDVRSDRVAVGRALDLPVYFGDAGSREVLHKVGAERACAAAITLDTPGANYRAVWALSKYFPNVKTFVRAHDVDHGVNLEKAGATAVVPETLEPSLQLAAAVLAQAKLPMSEIAATVNEFRNRHLSELTELCATSGSSLGYGYSRVMSISKSKTVTSDDESETVDGALAI

SEQ ID NO: 90079 - protein, 336 aa, Sinorhizobium fredii
MLHTTVTQLIGQTPVMSIDVPGRNATLVLKIEKNNPGGSMKDRMARSMVIAALEDGRLAPGGTIVESSSGNTGTGLALAALEFGLRFIAVVDHHAAPDKIRMMRALGAEIRYVEGDFREDEVAVVERQRLAAQLGAQLPGALFMNQSDNPANPAGYTGLVDELVAQLPDGIDAFVGCVGTGGSMTGISQRVKRNNPAVRTIAVEPAGSIVFGKPGHPYYQSGTGTPAGDEVGKVLDYGCIDEGVQVTDTQAFETARYIARRKGLLVGGSTGGAIYKALEFIGAGKLTGTVVTTVADGGEKYLGTIFDEEWMAKRRLLDPAIAAQLDGWLFGKARAA

SEQ ID NO: 90080 - protein, 105 aa, Zea mays
FLNFMLAGSTSALRFGIILGLALLALGISSLRSQRDGGRRPRLLVKGQAAIASVIFFREFSVLLQNGWFPKIFMVLLSGVVAGFYFYRIAAGSPKELSSNSDSVN

SEQ ID NO: 90081 - protein, 492 aa, Triticum aestivum
  misc_feature (378)..(378): Xaa can be any naturally occurring amino acid
MPHPSSSSSSASVDAAAKGVKLERYASGGGALLMRRAGSSKIVAASSHLLFRATVLATLALVCLFAVHYPSLLSRSFRLSAAAAASSSSSPPRQTSRHRNLLGSSSAYAGAAWEREVRRSATPRRDGGMSVLVTGAAGFVGAHCALALRARGDGVLGLDNFNAYYEPGLKRARQRLLASRGVVVLGADINDAALLERLFAAVPFTHVLHLAAQAGVRYAMRAPQTYVASNVAGLVSVFEAAARHADPQPAIVWASSSSVYGLNTDAPFSEDHRTDRPASLYAATKKAGEAIAHAYNHIYGLSITGLRFFTVYGPWGRPDMAYFSFARSIVAGEPITLFRAADGTDVRRDFTYIDDVVKGCLGSLDTAGKSTGSKSGKXRGPAPLRVYNLGNTSPVPVTRMVAILEKLLGKKANKRVVTMPSNGDVPFTHANVSHAARDFGYHPTTSLDAGLRKFVEWFLQYYKIDPAKLAKGSRVGTKTTKKKSMGAISAAS

SEQ ID NO: 90082 - protein, 89 aa, Physcomitrella patens subsp. patens
DTTFTKVFVGGLAWETQRDTMRRHFEQFGDILEAVVITDKNTGRSKGYGFVTFRDSESAKKACEDATPIIDGRRANCNLASLGAHRHRP

SEQ ID NO: 90083 - protein, 328 aa, Physcomitrella patens subsp. patens
MSRTSLHETHDGEFKRKESEFRHFISREPGAEFPPEADRYHLYISYACPWASRCLAFLKLKGLDHAIGVTVTKPKWGETKPSVDDHHGWMFLEDGEDVPGAMKDSLNNAKSIRDLYEIASTGYTGKYTVPVLWDIKTMRIVNNESSEITKMFNDEFNDIAKHPEVDLFPEHLKASIDSVNSWTYNAINNGVYRCGFATKQKPYEEAFNQLFEALDRCEEILSKQRYIAGNELTEADIRLFMTLIRFDEVYVVHFKTNKKFIREYPNLFNYTKDLFQVPGIGATVNMYHIKHHYYGSHPSINPFGIVPVGQKIDYSAPHDRDRFSKESA

SEQ ID NO: 90084 - protein, 520 aa, Moritella sp. PE36
MSIINKPDSSNYKLAGIDSLKCDNHYATLPAHFYNKQMPDGISDPKMVSLNPQVLALLGLDNVVADSDALLQLCSGNYLPSGFDPLAMKYTGHQFGHYNPDLGDGRGLLLAQVKGNDASGDGSNSNSSKNTTWDLHLKGAGKTPYSRQGDGRAVLRSSIREYLCSAAMQGLGIPTTQALSVVVGSDAVMREQVEQAAMVVRVAESHVRFGHFEHFYYTQQLDDLKLMLDYTLTKHFPDVLTAEVPYLAFYKQVMTTTAELMAHWQAVGFVHGVMNTDNMSILGQTFDYGPFAFQDNFDPAYVCNHTDYSGRYAFNQQPQVGYWNLMALGRALTPFMDVEPLNTVLQTYDDIFLAKFRELMRGKLGLQQVQDTDGELIKNLLEILAGSAVDYTYFFRSLSDFDSAEDAENSTNNEKNSAIRDQFIDREAFDGWAVKYQQRLVLESSVDEVRKVRMNQVNPKYILRNYLAQQAITQATDYDYSLVNELLEVLTNPFSEHPEFETLAALPPEWGRKMVLSCSS

SEQ ID NO: 90085 - protein, 125 aa, Zea mays
MAGRLTAAGFRVLGGGGARAAAAAAALRHRAGMGLPVGRHIVPDKPLPVNDELVWDNGTPFPEPCIDRLAPHIGKYEALAWLCGGLGFFAALGVAAVVNDKASKIPYTPKVYPYDNLRAELGDRP

SEQ ID NO: 90086 - protein, 657 aa, Gibberella zeae PH-1
MWIADACKAFVFSFVAVFHSPGHPDEGPHQDVLKFTHNSPGDKIPYPRFPAPNGPDKDGVEFQCKYPELKGWEKCTSADDRSCWLKGPYHQVFDINTDYENFWPEGVVREYTLNVTNQDINGDGVNNPYGKVFNNQYPGPWIQACWGDIIKVTVHNTLAYNGTTIHWHGLRQLESFEMDGVNGVTQCPIAPGDSFTYTFRAVQYGTSWYHSHYSLQYADGLAGPITIYGPSSANWDEGRDPILITDWSHRSAFQSWQRELVPNSPTRPMMNGVLINGVGNFAGSFPRERFNMTVTKGKKYILRVINTSVDTTWIFSIDNHNFTVMSTDFVPIHPYDVDHVVIGIGQRYHIVLDATPTNTSVLPASPDGNYWIRTVGADGCKAFEAGNEPDERQGILRYNASSTFVPTTFRTPYVTACRDENYTMLKPIFPWKVKPVELDYEKAQFDIGLKKYKDRPEKGDGFQWWAFGENPLWLNFSNPTILNLNNDTWDPNYAVDLVVPDSKKDEWVYIAITAPPTPLVNKPDRVFAPVAHPLHLHGHDFALLAQGTNFTDLDTGKVKLKWDNPPRRDVALIPAGGYLVVAFKADNPGSWLFHCHIAWHASSGLAIQILEQQERLKWMMNNDRMKEVERVCARWNDWYGNKTNHWNAEVFQDDSGI

SEQ ID NO: 90087 - protein, 159 aa, Moritella sp. PE36
MAAYNLLINREDNKSMNKDMKNTDKSTIKVTKTDAEWQAELTDEEFHVCRKKGTEHAYTGTLLNNETVGVYHCKCCGSELFTSDSKFNSGCGWPSFDKEIKSGAVVYTEDSSLAMQRIEVTCSNCDSHLGHVFPDGPTETGQRFCINSISMGFSQGQKR

SEQ ID NO: 90088 - protein, 681 aa, Vitis vinifera
MRIPILGFGQAGIAIELKDRGSFVQTAAVRHLMGSLTRAEGLRFAVVSFSIPPQFLPFIFISSVYACDSMKLRYCFTMNLRNSAGEHTNKVVARFNEIVTKLLLEGALETFKRYSVKEEDIDVVWVPGSFEIGVVAERLGKSKKYQAILCIGAVIRGDTSHYDAVANSAASGVLSAGLNSGVPCIFGVLTCDDMDQALNRSGGKSGNKGAEAALTAIEMASLFEHHLIHLLFLLTSSANLRPKLPSLGGKQATVPPSLCVSNSQQSEHPASLSRPANRQSVAAIVFGDGSESQLYPLTKRRSEGAVHIAGSYRLIDAVVSNCINSNITKIYALTQFNSTSLNSHLCRAYSGVGLEVVAAYQSPEARGWFQGTADAVRRCLWLVEEHPVAEFLVLPGYHLYRMDYQKLIQAHRQSKADITIVALSAEISRETGLGILEVNSENQVVEFSKRSEKEPATIISVKSPRKSNDNGYKKLASMGIYVVKKEIMIKLLSEHFPKANGFGSEVIPGAISIGMKVEAFAFDGYWEDMRNIEAFYQANMEITKKTDVGYKSRCEIRGTIVGLRTKIGDRAVIEDSVIMGSDIYQACFHLHLPLTSVCFHQPEDELRRDMKGTGNDIPIGIGEDTHIRKAIVDKNARIGKQVLIMNRDNVQEGNREAHGYTISEGIVVVLKGAVIPDGSIL

SEQ ID NO: 90089 - protein, 369 aa, Arabidopsis thaliana
MIENDDSPQHPSLFFTDFTRANSHVRVLHHKFLGKGVYGSVDLIRYTKTDGSSLQAAVKTSYAEDLEEYDALKREIQILSELKGYPNIVICYGDDLEEDFNEHGHKVYKLLLEYANEGSLSSFMENYPDRKLPDPMIRDFTRMILEGLVSMHSHGYVHCDLKSDNLLIFSRKDSASCELKIFDFGNCRQVGEVPDHWKSDYPYVGTPESFFDGVAKKTLDLWSLGCLVLKIYTGEQPWERVTSVDFVNFLSDGEAPNIPEYVPCDAREFIETCFAREHEKRGTASELLLHPFLCQKQPLLVKLKLRIKQASKITMGIREKPLTLKMFLSKPPQLKKLLSKLLRLKKMIHPKPLELDSSFVSYSSDLCLL

SEQ ID NO: 90090 - protein, 326 aa, Escherichia coli
  misc_feature (12)..(12): Xaa can be any naturally occurring amino acid
LPNITILATGGXIAGGGDSATKSNYTVGKVGVENLVNAVPQLKDIANVKGEQVVNIGSQDMNDNVWLTLAKKINTDCDKTDGFVITHGVDTMEETAYFLDLTVKCDKPVVMVGAMRPSTSMSADGPFNLYNAVVTAADKASANRGVLVVMNDTVLDGRDVTKTNTTDVATFKSVNYGPLGYIHNGKIDYQRTPARKHTSDTPFDVSKLNELPKVGIVYNYANASDLPAKALVDAGYDGIVSAGVGNGNLYKSVFDTLATAAKTGTAVVRSSRVPTGATTQDAEVDDAKYGFVASGTLNPQKARVLLQLALTQTKDPQQIQQIFNQY

SEQ ID NO: 90091 - protein, 311 aa, Zea mays
MAAAPSSLVSSHLSRLADLRRAAAPATPTVPQQLRVGFSRRRAQRVVAMAGSGKFFVGGNWKCFLYPLIQNGTKDSVSKLVSELNAATLETDVDVVVAPPFIYIDQVKNSLTGRIEVSAQNVWIGKGGAYTGEISAEQLVDIGCQWVILGHSERRHIIGENDEFIGKKAAYALSQNVKVIACIGELLEEREAGKTFEVCFEQMKAFADSISNWADVVIAYEPVWAIGTGKVATPEQAQEVHAAVRDWLTTNISPDVASSTRIIYGGSVNAANCAELAKKEDIDGFLVGGASLKAPDFATIINSVTAKKVAA

SEQ ID NO: 90092 - protein, 243 aa, Mycoplasma hyorhinis
MSKTIIIGNWKMNKTFTQTKEFFSAFNQLYIENKNKINQNLDFAVALPAINVAAFSKNTTKLELAVQNMSQFEKGAYTGEISAQMLLDLNVKYAIIGHSERRQYFKETDLDVNAKTQQAIKNNIIPVVCVGETLEEYEAQKTSQVIEYQLKNSLKDVDLSKVIVAYEPIWAIGTGKTATPEQAQQVCKFIRKQTNKNLTILYGGSVSQENIEQLLNQADINGALVGGASLKVDSFIKLLTLNK

SEQ ID NO: 90093 - protein, 348 aa, Zea mays
MSSSTSGTREMSSPNSTATSIGQVQKVPGFAKLQGENFVYFMQTYSIMLGRTSRSYTADFDLSKYECGSQCVSRCHACIFYDFELRHFAIEVLGRNGCTIRGVSYLPGSVPIKLNSQDLIEIAGIKFYFLLPSRSIFATLAARDATMLPPQSPSLLHPNYPGNPSANDCGRSNGENGVKISNDMQGKLVKQKRSFSGELDISYSYGTKKNVDRVGTLDGCVNKLHIQIADKDTDNQQILLEEEKDVTTCLTTLISELSGPKEWVPMERLLSEIFKRFGKKWLRDRVSKYLPQKGMSGSSTKVDHRPWCSLWELLRKHPEHFVMTTLTRGEETLDYVGLVHLVSVENEP

SEQ ID NO: 90094 - protein, 256 aa, Moritella marina
MRHPVVMGNWKLNGSKEMVVDLLNGLNAELEGVTGVDVAVAPPALFVDLAERTLTEAGSAIILGAQNTDLNNSGAFTGDMSPAMLKEFGATHIIIGHSERREYHAESDEFVAKKFAFLKENGLTPVLCIGESDAQNEAGETMAVCARQLDAVINTQGVEALEGAIIAYEPIWAIGTGKAATAEDAQRIHAQIRAHIAEKSEAVAKNVVIQYGGSVKPENAAAYFAQPDIDGALVGGAALDAKSFAAIAKAAAEAKA

SEQ ID NO: 90095 - protein, 524 aa, Oceanobacter sp. RED65
MTDIHSQKILILDFGSQYTQLIARRVRELGVFSEIRPWDMSFDEIKEFDPKAIILAGGPESVHEANSPRATEEVFDMGLPILGICYGMQTMAEQLGGKVQGSDIREFGYAQIKVESAGPFFKDISDHIDNKGSTYLDVWMSHGDKVSEMPAGFELMASTPSCPIAAMYHEEKQFFGVQFHPEVTHTLQGGRMLEHFVRDIAGCEALWTPANIIEDQIARVREQVGERKVLLGLSGGVDSSVVAALLHKAIGDQLTCVFVDNGLLRKNEGDMVMDMFAKNMGVKVIRADAEDLFLGKLNGIDDPEKKRKVIGNTFIDVFDEEAGKIKEVDFLAQGTIYPDVIESAASKTGKAHVIKSHHNVGGLPDDMKMELVEPLRELFKDEVRKIGLELGLPYDMVYRHPFPGPGLGVRILGEVKKEYADVLREADAIFIEELHNFDWYHKTSQAFAVFLPVKSVGVVGDQRRYEWVIALRAVETIDFMTARWAHLPYELLEKVSNRIINEIEHVSRVTYDVSSKPPATIEWE

SEQ ID NO: 90096 - protein, 270 aa, Magnetococcus sp. MC-1
MSSQPPIAFLGGGNMASAIIAGLHKVGYPAAKLRVGEPNATQREALIRQFAIQGHAHNPDAVAEAAFVVVAVKPNLVAQVLRDVAPQLAPTAVVLSIAAGVDLTTMAAALPAGQPIIRAMPNTPALVGQGMTVLCPNGHVDAEQLAQAQRLLESVGQVAVVKQESLMDGVTALSGSGPAYLFLIAEALSDGGVACGLPRALADQLAVQTLLGSATLLRESGEHPGVLKNRVTSPGGTTIAGLGVLERQGVRGALMAAVEAAWNRSKALGQ

SEQ ID NO: 90097 - protein, 235 aa, Magnetococcus sp. MC-1
MHTITQRLETIQEHMVQACQRAGRSPHEVQLMAVSKRQSSSAVSEAIEAGQLLFGENRVQEAKEKQPTVSMPAGVQPQWHMIGPLQKNKIKYIGELFHMVQTVDTLTLAQAIGARMQAEQRQMPILLQVNVGGEAQKNGMTAEALEEQVRHIAQIPGVRIQGLMTVPPYLEDPQQVRPYFRALYTLANHVQQMRLPGVAMETLSMGMSHDFHVAIEEGATMVRVGSALFGERRVA

SEQ ID NO: 90098 - protein, 372 aa, Psychrobacter arcticus 273-4
MAEIHNNPTKLRLVVLGGGSFGTAMANLAARNGCDTTLWVRNKRTVKAMAKSQMNKKYLPGYKLDDRLKYSHELQAAVKDTDIIFIAVPGLAFRETLKSIAPFISGQSIVSLTKGMEKDTFALMSDIIKEELPEVNFGVMSGPNLAIEIMKNMPSATVIASESEPLRHAVQAALHSAFFRVFASDDIRGVELGGALKNIYAIAMGMAAAYEVGENTKAMILTRGLAEMSRFGVHAGANPLTFLGLSGVGDLYATCSSELSRNYRIGNMLGRGMTIDAAVKKLGQTAEGVNTIQQVHEKATKEGIYMPITHALHAVIYEDKAALGVALHLMEAGFRSDVEFVMEHDHSNASLTAQMQTANNQAKNEKTKPDNK

SEQ ID NO: 90099 - protein, 346 aa, Sinorhizobium fredii
MREVPIGPDLLGRVIDSRCRPLDGKCEVKTTEVRPLHGRVPNPMTRRMVERPFPLGVRALDGLLTCGEGQRIGIYGEPGGGKSTLISQIVKGAAADVFIFALICQRGREVREFVERHLGEEGLRRAIVVVETSDRSATERAQCAPMATALAEYFREQGLRVALLLDSLTRFCRAMREIGLAAGEPPTRRGFPPSVFAALPGLLERAGMGERGSITAFYTVLVEGDGTGDPIAEESRGIVDGHIVLSRALAARSHFPAIDVLQSRSRVMDAVVSETHRKAASFFRDLLARYAECEFLINVGEYKQGGDPLTDRAVASIGELKEFLRQSEDEVSDFEETVGWMSRLTS

SEQ ID NO: 90100 - protein, 491 aa, Colwellia psychrerythraea 34H
MNNKHYINGTWVSPATSETFSVINPATEAVIAEIPAGNSVDIDAAVKAARTAFDQGPWPRLSGAERAVYLRKIAAIIIRRLDELAKLEVLDNGKPYPEAKWDIEDTAATFEFYAGLAEQLDNTSEQVIELPEPGFSSKAIKEPLGVAGAIIPWNFPMLMAAWKVAPALAAGCSIILKPSEITPLTALALAEIADEAKLPAGVLNIVTGLGKDAGQALVEHPDVDKLAFTGSIPTGSKIMATAARDIKNISLELGGKSPFVIFEDSDIEKAVEWIMFGIFWNQGQVCSATSRVLVAKEIYPALLERLVEETKKITIGPGDQDGVLLGPLVNSDQYKKVLAAIERGVSDGATIATGGQRPPGLDVGYYLEPTILTDIDENSWVWNEEIFGPVVCIKPFQSESEAIRLANDSRFGLAAAVMSKDEDRCDRVSRAFRAGIVWVNCSQPTFVEAPWGGYKQSGIGRELGQWGLNNYLETKQITRFNSSEPWGWYLK

SEQ ID NO: 90101 - protein, 193 aa, Pasteurella multocida subsp. multocida str. Pm70
MSVIPMVVEQTARGERSYDIYSRLLKERVIFLGGEVEDRMANLIVAQLLFLESEDPEKDINIYINSPGGSVTAGMAIYDTMQFVKPDIRTLCVGQACSMGAFLLAGGTAGKRIALPSARVMIHQPLGGFRGQASDIQIHAQEILKIKQTLNERLAFHTGQTIERIERDTDRDNFMSAEEAKAYGLVDEVLASR

SEQ ID NO: 90102 - protein, 455 aa, Medicago sativa
MASSSLLSSVPSHSASLSILDTNIKGKLKLGINNFSNLRSSGRICMAVATNVSRFEGIPMAPPDPILGVSEAFKADTNDVKLNLGVGAYRTEELQPYVLNVVKKAENLMLERGENKEYLPIEGLAAFNKATAELLLGADNPAIKQQRVATVQGLSGTGSLRLGAALIERYFPGAKVLISNPTWGNHKNIFNDARVPWSEYRYYDPKTVGLDFEGMIEDIKSAPEGTFVLLHGCAHNPTGIDPTPEQWEKIADVIQQKNHFPFFDVAYQGFASGSLDEDAASVRLFESRGMEVLVAQSYSKNLGLYAERVGAINVISSSPESATRVKSQLKRLARPMYSNPPVHGARIVANIVGTPALFDEWKAEMEMMAGRIKTVRQALYDSISSKDKSGKDWSFILKQIGMFSFTGLNKSQSDNMTNKWHIYMTKDGRISLAGLSLAKCEYLADAIIDSYHNVS

SEQ ID NO: 90103 - protein, 447 aa, Escherichia coli CFT073
MDQTYSLESFLNHVQKRDPNQTEFAQAVREVMTTLWPFLEQNPKYRQMSLLERLVEPERVIQFRVVWVDDRNQVQVNRAWRVQFSSAIGPYKGGMRFHPSVNLSILKFLGFEQTFKNALTTLPMGGGKGGSDFDPKGKSEGEVMRFCQALMTELYRHLGADTDVPAGDIGVGGREVGFMAGMMKKLSNNTACVFTGKGLSFGGSLIRPEATGYGLVYFTEAMLKRHGMGFEGMRVSVSGSGNVAQYAIEKAMEFGARVITASDSSGTVVDESGFTKEKLARLIEIKASRDGRVADYAKEFGLVYLEGQQPWSVPVDIALPCATQNELDVDAAHQLIANGVKAVAEGANMPTTIEATELFQQAGVLFAPGKAANAGGVATSGLEMAQNAARLGWKAEKVDARLHHIMLDIHHACVEHGGEGEQTNYVQGANIAGFVKVADAMLSQGVI

SEQ ID NO: 90104 - protein, 353 aa, Picea sitchensis
MKIVNDDEWLLCMELGNFSCLPMAMKAAIELDVFQIIANAGNGVQLASTQIVARIPTTNPDAAISLDRILKVLASHSVLSCSVTMDENGKAEGLYGLTPLCKYLVKNRDGISLAPWVLMNQDKVFMESWHYLKDAVLEGSQPFTKAHGMNVFEYLAMDRRFNKVLNRTMSEHSTTLMNKILDMYQGFKDVQKLVDVGGGVGSTLNLIVSRYPHITGINFDMSHVVSEAPHYPGVTHVEGDMFDSIPTGEAIFMKWILHDWSDDDCVKLLKNCHKALPEKGKVIVVDTILPMAAETSLYARHAFHLDLLMLAYAPGGKERTEQEFRELGHAAGFTGGVQLICCVDGVWVIEFHQ

SEQ ID NO: 90105 - protein, 417 aa, Glycine max
TTTTNTDRSKEAVGMMALHDALRRVCLNSDWTYSVFWTIRPRPRVRGGNGCKVGDDSGSLMLMWEDGFCQGRGSGCLEDIDGEDPVRKAFSKMSIQLYNYGEGLMGKVASDKCHKWVFKEPTECEPNISNYWQSSFDALPPEWTDQFESGIQTIAVIQAGHGLLQLGSCKIIPEDLRFVLRMRHTFESLGYQSGFYLSQLFSSTRNTSSSTSVPSKPSTIPIRPPPPLFNWGQRPLSSATSMLSSPNFQQHEARLGFPKDEAHMFLMPHASSEGARIEDMMGEHENDIKWPNGLSFFNALTGRTDDAKLLFNPESLGNKPGDQNQHHTIGQNPNSDGSNMQNASGGTNPNEFLSLDSHQDDARKMDKFKRSFTLPSRVASSTSSTSMDQHQQQQQQGVEYTNSEGGMYPDVMETFLE

SEQ ID NO: 90106 - protein, 305 aa, Triticum aestivum
  misc_feature (255)..(255): Xaa can be any naturally occurring amino acid
MDSFFQRAFGDPMCSEDSNVVQQGIEKCPFLRNINEPTSFSLTSVNFPAPATGAKAKGPIFEDGPNFDTAFRVFHGRDGVVPLSEGAFAHIEKPLPKPTPEFNPLAAKAATISLSGFGGFFSFGDFSNKRNKQNSNKKNPNNLPQNKGQSNNNHEAMSNDWLENGQCPLAKSYRAIGGVVPLVAKLLTPPAGMKLTCPPAIVAARAAISRTAFAKGLRPQPLPTKVVVIALLGMAANVPLGIWREHTTKFSVQWXAAVHAAVPFIGMLRKSILMPKSAMALTIAASILGQTIGSRAERIRLKRAN

SEQ ID NO: 90107 - protein, 211 aa, Bradyrhizobium japonicum USDA 110
MRDPVETYMNLVPMVVEQTNRGERAYDIFSRLLKERIIFLTGPVEDGMSTLVVAQLLFLEAENPKKEISMYINSPGGVVTSGLAIYDTMQFIRPPVSTLCTGQAASMGSLLLAAGEKDMRFSLPNARIMVHQPSGGFQGQATDIMLHAQEILNLKKRLNEIYVKHTGQTYKTIEDALERDKFLTANDAKEFGLVDRVIDKRAEEPAAAKTQ

SEQ ID NO: 90108 - protein, 503 aa, Hordeum vulgare subsp. vulgare
MDLRVAAPASVAAAARRGALGCARVRPLQGRRQCRPSVRVSVATTESAAAAAAVSASADEDAETTNPRTVVAVILGGGAGTRLFPLTKRRAKPAVPIGGAYRLIDVPMSNCINSGINKVYVLTQFNSASLNRHLFRAYNFSNGVGFGDGFVEVLAATQRPGSEGKRWFQGTADAVRQFAWLFDDAKSKDIEDVLILSGDHLYRMDYMDFVQSHRQRDAGISICCLPIDDSRASDFGLMKIDDTGRVISFSEKPKGADLKAMQVDTTLLGLPKEEAEKKPYIASMGVYIFKKEILLNLLRWRFPTANDFGSEIIPAAAREINVKAYLFNDYWEDIGTIKSFFEANLALAEQPSKFSFYDASKPMYTSRRNLPPSMISGSKITDSIISHGCFLDKCRVEHSVVGIRSRIGSNVHLKDTVMLGADFYETDAERGDQLAEGKVPIGIGENTSIQNCIIDKNARIGKNVTIANTEGVQESDRTSEGFHIRSGITVVLKNSVIADGLVI

SEQ ID NO: 90109 - protein, 207 aa, Zea mays
KETSSTSGMRDSVETSPLLQYRAQTVVPGRVLKMEEAIKNRDFESFAKLTCADSNQFHAVCLDTSPPIFYMNDTSHRIISLVEKWNHSEGTPQVAYTFDAGPNAVLIAQNRKTAAHFLQKLLYYFPPQDNDLSSYLVGDKSILGDAGLHSMKDVEALPAPPDTKIPDQKFKGDVSYFICSRLGAGPKVVVDEGQALIDSVTGLPKGV

SEQ ID NO: 90110 - protein, 389 aa, Xylella fastidiosa Ann-1
MSRDLPVIRLKNAWRSSHPWLFQKLLEKPSVRLKPGTIVGVVGVDGEWVGRGFYNGHSRIAVRILETRQDVVVDEAWFVRRIAEAVGLRREVLKLDAVSDAWRVVHSEGDGLSGLVVDRYGDLLVVQFFAAGMFRHREWIYTALRQQFPGAGFHSFADEHVQKQESFDFHSTIDTESVVITEHGVKFLVDPMGAHKTGFFADQRENRQWLSQGVAGKTVLDLCCNTGGFAVYAALRGAADVVGVDIDQDVIQIAKANAKLNSVRPKFLQADIFPYLRDAAVRGDQYDVVILDPAKMTRDRDQIINALKKYLDMNKLALGVVKKGGLFATFSCTGLISEEQFLEMLRRAAFYSGRTIQILKVAGAGPDHPFMAHVQESRYLKATFCRVLD

SEQ ID NO: 90111 - protein, 2144 aa, Aspergillus nidulans FGSC A4
MGLNLEEIYGQTIVEEQRPNEYSEYQPKKGYGWANTLPERQGLYDPEYEKDACGVGFAANIKGKASHKIVSDARNLLCNMTHRGAVGSDARDGDGAGVMTSIPHKFFIKNFAREVGVDLPPLGQYAVGNLFFKPDEEALKESIKQFEEIATSLGLRVLGWREVPRDSTILGPAALSREPTILQPFVVLKSAYGEGNKPDITDPEQFDTKTFELQLYVLRKRATHIIGLANWFYLCSLSNRNIVYKGQLAPIQVYQYYHDLVNVDYEGHFALVHSRFSTNTFPSWDRAQPLRWAAHNGEINTLRGNKNWMRAREGLLKSDIFGEELESLLPIVEDGGSDSAAFDNVLELLMINGVLSLPEAVMIMIPEAWQDNPAMDPAKAAFYEWAACQMEPWDGPALFTFSDGRYCGANLDRNGLRPCRFYVTDDDRIICASEVGAVDIDQERVVQKGRLQPGKMLLVDTVAGRIIDDSELKYTVAHRHDFSSWLNKELVKLPAITEKLVEQNMDLRHDLDNTTVQNDPRLKAFGYSFEQVTLLLGPMGADSKEALGSMGNDAPLACIAKQPRLLYEYFRQLFAQVTNPPIDPIREAVVMSLECYVGPQGNLLEMDPSQCRRLLLPSPILSIPEFNALKNINTVHKDWTVRLIDITFEKKKGVPGYIEALDRICDAATEAIQQGDKILILSDRATSADRVPVSALLATGLVHHHLVRNKWRSLAALIVETAEAREVHHMCVLVGYGADGINPYLAMECILKMNREKLIRKELSDEKVIENYKASCDGGILKVMSKMGISTLASYKGAQIFEALGIDDSVIDRCFTGTASRIRGMNFELIAQDAFAIHERGYPSRAIVDIPGLNESGEYHWRDGGEDHINDPVSIANIQDAVRTKNDKSYEAYAKAAHEQIKNCTLRGMLEFDFDQRTPIPIDQVEPWTEIVRRFVTGAMSYGSISMESHSTLAVAMNRLGGKSNTGEGGEDPERSKRMENGDTMRSAIKQIASGRFGVTSHYLADADELQIKMAQGAKPGEGGELPGHKVVGPIAHTRYSTPGVGLISPPPHHDIYSIEDLKQLIYDLKCSNPRARVSVKLVSEVGVGIVASGVAKAKADHILISGHDGGTGASRWTGIKYAGLPWELGLAETHQTLVLNDLRGRVIVQTDGQIRTGRDVAVACLLGAEEFGFATTPLIAMGCIMMSKDPCPVYVSLQPLIWCIGKCHLNTCPVGIATQDPELRKKFEGQPEHVINFFYYIANELRAIMAKLGIRTINEMVGRAELLKVRDDLTNPKQENIDLSLILTPAHSLRPGVATYNVRKQDHRLHTRLDNKLIAESELALEKGLPCRVECDVVNTDRALGATLSYQVSRRYGGEGLPQDTIHSNIKGSAGQSFGAYLAPGITLELEGDANDYVGKGLSGGRLIVYPPRGAAFKAEENVIVGNTCLYGATRGTCFFRGVAAERFAVRNSGATAVVEGVGDHGCEYMTGGRVVVLGSTGRNFAAGMSGGIAYILDMNQDFLSKVNMEMVECSGLEDPAEIAFLRGLIEDHHHYTGSELAARILLDFTRALPHFIKVLPTDYKRTLEEEAAKAAAAKKAETTIPQLPSVPVEKQKPKAEGDAKKAELLDIEDSVTDSKVEKKRTALILDKTRGFMKYNRRSEKYRNPATRTRDWAELSSRLTEDELKYQSARCMDCGVPFCQSDTGCPISNIIPKWNELVFQNQWQDALNRLLMTNNFPEFTGRVCPAPCEGACVLGINEDPVGIKSIECAIIDRGFEMGWMVPRPPPVRTGKTVAIIGSGPAGLAAADQLNRVGHSVTVYERADRIGGLLMYGIPNMKLDKKIVQRRVDLMAAEGVKFVTGVSVGPDSEVSLDSLRKSNDAVIIATGATVARDLKVPGRELEGIHFAMQFLHKNTKSLLDSELADGAYISAKDKHVVVIGGGDTGNDCIGTSVRHGAKSVVNFELLPQPPPERARDNPWPQWPRIYRVDYGHSEVKTHMGKDPREYCIMSKEFVDDGNGRVKGINTVRVEWTKSATGGWDMKTVEGSEQFFPADLVLLSMGFLGPEDRLLGEEIERDARKNVKTPPGHYGTNVPGVYAAGDCRRGQSLIVWGINEGRQCAREVDTFLSGISSQLPVTGGIVRRPAVDAVRQATETVTIAA

SEQ ID NO: 90112 - protein, 324 aa, Mycobacterium sp. KMS
MYAIEVSETGGPEVLTHVEKEPPSPGPGQVLIKAEAIGVNFIDTYFRSGLYPREVPFVVGTEVCGTIEAVGDDVAALQVGDRVVTDKAVGAYAEYTVAPADFVAYVPDGVAPAVAASSLLKGMTAHYLIKSTYPVQQGDTVLLHAGAGGVGLILTQWATSLTAKVITTVSTPQKAELSRQAGAIEVLDYPHDPQEFGARIRDLTGGNGVAAVYDGVGAATFDASLASLAVRGTLVLFGGASGPVPPVDPQRLNSAGSVYLTRPSLVHYTRTPDEFSWRAGEVLDAIAKGAITVTVSEHYPLQEAERAHRDLQGRKTVGSVVLVP

SEQ ID NO: 90113 - protein, 887 aa, Candidatus Pelagibacter ubique HTCC1002
MNKLILNFKSKDSKKIKNPKNFLGGKGANLSEMGRMGLPVPPGFTISTKVCELFYKDKKKLNSKIVNIIKKELKIIEKDVGKKFGDLKNPLLLSVRSGARVSMPGMMDTILNLGLNDKTVLALSKKTSNSRFAKDSYRRFIQMYGNVVMGVEGYHFEELIENYKLTKGVLLDTDLDADDWEGLINDFKKVIKDQTKKEFPQNVYNQLLGAISSVFLSWESNRAKVYRKLNQIPAEWGTAVNVQSMVFGNMGNDCATGVVFTRNPSDGVNEVYGEYLINAQGEDVVAGTRTPQYITKKARKDAKAKEASMEEAMPKVFKQLDKILKILEKHYKDMQDVEFTVENNKLWMLQTRSGKRTSKSAVRIAVDMVKEKLISKKEAVMRIDPASLDTLLHPTLDEKNTLNVIANGLPASPGAASGKVVFTSEEAERLNNVMQDTILVRVETSPEDIHGMHAAKGILTARGGMTSHAAVVARGMGRPCVSGSSEIDINYEAKTFKTSSIEIKEGDIITIDGSTGRIILGEVPTVKPEISGDFSKLMSWADNFRKLKVRTNSETPLDTKTARDFGAEGIGLCRTEHMFFDEERILSVREMILSKTVEDRNRALAKLLPHQKKDFVQIFKIMNGLPVTVRLLDPPLHEFLPKTEKEINDVAKVVGLPLKEIESRINELHEQNPMLGHRGCRLGISFPEIYEMQCRAIFEALSELKIKKIKSAFPEIMIPLVSTEAEIRIMKDLVVRVAKEVQKDKKIKIDYLVGTMIELPRAAIKADDIAKHAEFFSFGTNDLTQTTFGLSRDDSGKFLNDYLENKIFSIDPFISIDDGVGDLIEIAVEKGRKTNKKIKLGICGEHGGDPKSIHFCANAGLDYVSCSPYRVPVARLAAAQAELSKKN

SEQ ID NO: 90114 - protein, 337 aa, Pseudomonas sp. 7A
KEVENQQKLANVVILATGGTIAGAGASAANSATYQAAKVGVDKLIAGVPELADLANVRGEQVMQIASESITNDDLLKLGKRVAELADSNDVDGIVITHGTDTLEETAYFLNLVQKTDKPIVVVGSMRPGTAMSADGMLNLYNAVAVASNKDSRGKGVLVTMNDEIQSGRDVSKSINIKTEAFKSAWGPLGMVVEGKSYWFRLPAKRHTVNSEFDIKQISSLPQVDIAYSYGNVTDTAYKALAQNGAKALIHAGTGNGSVSSRVVPALQQLRKNGTQIIRSSHVNQGGFVLRNAEQPDDKNDWVVAHDLNPEKARILAMVAMTKTQDSKELQRIFWEY

SEQ ID NO: 90115 - protein, 234 aa, Oryza sativa Japonica Group
MAAPPQPVPAPAAASPEVFRLGFIGPGNLAESIARGVAASGVLPATAIRTAPHRRPERAEAFSSIGAHILETNAQVVDDSDVIVISVKPQIVRQVLVELKPLLSEEKLLVSIAAGIKMEDLQGWSGHRRFIRVMPNTPSAVGQAASAIEAMADGGVAAGLPRDLALGLASQTVLGAATMVNKTGKHPGQLKDMVTSPAGTTITGIQELEKGAFRGTLINAVVAATKRCRELSQS

SEQ ID NO: 90116 - protein, 494 aa, Gibberella zeae PH-1
MTSSVTLQGAQGRQITVQTGLFIDNEFVPASNNATLDVENPNTATIIAQVSAAQASDVDRAVRSSQKAFATWGRSDPGTRRTLLLKLADLVEAHGPELASLEAIEGGLLYRDSLGLHVTQSVDNLRYFAGWADKLDGVSLPIPSGVAYTRREPIGVCAAIVPWNSLMILFWKLAPAIAAGNTIVIKTAELTPLWAQKAAELIKEAGFPPGVINIICGLGREAGQALAEHPVVRKIAFTGSSVTGRQIMQSAARSNLKKVSLELGGKGPSIVFADADWENALLWTTMGITASNGQICAAGSRIYVQDTIYEKFIQEFSRRSRDAVHGDPLLDETTKGAVASKAQLDKILSYVGKAKQTKARLLHGGQPLPGKGHFMANTAFVDVDQDDTIMREEIFGPFASIAPFSTEDEVIRKANDSDLGLNSAVFTNDVSRAFRISEAIETGTVTVNCWAMLNANTPFGGVKESGFGRDSGQEALDNWTVTKTVKFNILPPKL

SEQ ID NO: 90117 - protein, 407 aa, Oceanobacter sp. RED65
MALYVHKYGGTSVGSIERIEGVAQKIKHFKEDGHDVVVAVSAMSGETNRLIGLAKEITDTPSAREMDVLVSTGEQVTIALLSMALEKIGVPAKSYTGSQIRMLTDSAFGKARIEHIDTDSIRSDLDEGKVVVVAGFQGVDAQGNITTLGRGGSDTTGVALAAALKADECQIYTDVDGVYTTDPRVVEKARRMEKITFEEMLEMASLGSKVLQIRSVEFAGKYQVPLRVLHSSKEGNGTLITIEDDNAVEKPVISGIAFNRDEAKLTVMGVPDIPGVASKILGPVGAANIEVDMIVQNVAADRTTDFTFTVHRNDFAKAQGVLNEVAQELGAREVAATDDIAKVSLVGVGMRSHAGVASKMFEILANENINIQIISTSEIKISVVIEEKYLELAVRALHTGFDLDDEK

SEQ ID NO: 90118 - protein, 218 aa, Magnetococcus sp. MC-1
MDKSKLDTGFNAEFVVGAVKPEQYPDDGLPEVAFAGRSNVGKSSLLNKLLNRRQLARVSNTPGRTRELNFFRINQAYYYVDLPGYGYAKVGRGQREVWDRGIGLYFNSRRDLRAVILLLDIRRGMTEQDQAMLDFIFKMGLPVLPVLTKSDKLNANPRREAIKAMRLMVAEKVPLAVAPLLVTSSSKGDGILELRQTLATLLQRELGVGDPPPPDPCP

SEQ ID NO: 90119 - protein, 241 aa, Bradyrhizobium japonicum USDA 110
MNMDQLKRQAAARALEEVRDGMQLGLGTGSTAKHFVELLGERVAAGLKVIGVPTSEATRLDATRCGVPLTTLDEIDHLDITVDGADEIDPELNLIKGGGGALLREKIVAAASDRMIVIADDTKWVPTLGRFPLPIEVIPFGLGATRRAIETAFAQCGVSGQMAVRKAKGGDKDGHVFVTDGGHWILDAQLGRIVDPPSLAKALSAIPGVVEHGLFIGLASSAVLAGGEGIRVIERRKPKGD

SEQ ID NO: 90120 - protein, 462 aa, Bradyrhizobium japonicum USDA 110
MAEFDVDLFVIGGGSGGVRAARIAAGHGARVMIAEEYRMGGTCVIRGCVPKKLFVIGSHVRHEIEDAAGFGWTIPSMSFDWATLIANKDKEIARLEAAYTTNVEKSGAQIVKSRAVIEDKHTVRLLENDRKITARYILIATGGAPNHGASIPGIEHVISSNEAFHLKTLPKRIVIQGGGYIALEFAGIFAGYGSDVTVIYRGDNILRGFDEDVRTHVRSEMEKQGITILTGCTVAKVDRHGEEFTTHLSNGSSVASDQVMFAIGRHPSVANLGLEKACVAINPKNGGIAVDHFSKSSVDSIYAIGDVTHRHNLTPVAIREGHAFADTVFGKREVRVDHAYIPTAVFSQPEVGTVGLTETEARAQFSHVDIYKTTFRPIKATMSGRDTRVLMKLVVDGTSDRVLGCHIVGDAAAEITQAVAIAVKMKATKADFDATIALHPTAAEELVTMRTPTARHVRQAAE

SEQ ID NO: 90121 - protein, 485 aa, Oryza sativa Indica Group
MSVQEYLEKHLLSRKIEEAVNAAVRAKAPDPVLFISNHMRRAAPAVITSVRARQILDGRGEPAVEVSLHTNKAVHRASAAAADAPEGAAADAVRDAEKRKLLARAVADAVRVINDKVSEALVGMDPQQQSQIDQAIMDLDKAHHKAEIGVNSMLAVSIAACKAGAAEKEVPLYKHIAELVGKSATTLPIPAITVINGGTHAGNSLPIQEIMILPVGAKNFEEAMQMGSETYHHLKDIILEKYGSNSCNIGDDGGFAPNISRQWNYAIQYCWSAINLMAYINRTTLNHRSRELEQQLECVVCYGNKYDMEFKFAEKSGQGFKTADDLIEIYSQLCSEYPLVSIEQPFDKDDWEHSKKFTTLELCQVVGDDLLMSDPERIKRAVNEYTCNALVLKANQVGTVTEAIEVVRQAKDAHWGVMVSHRSGDTDDSFIADLAVGAAAGQIKAGAPCRGECLSKYNQLLRIEEELGSDGVYAGENWRTTASTS

SEQ ID NO: 90122 - protein, 266 aa, Zea mays
MSQGQPRRRQGEEGMHAQDKPVKFGDVLDVSGELADQPVAPRDAARLQAAEQSVLGGTQKGGPAAVLQSAATVNARAGHVGRAQTACPVADAGATVTETELAGRRVVTESVGGQVVGKMVSPAPVAMTDPPGALEKDAVTIGRALEAVGAMVGDRPVEQSDAAAVQVAELCATGSDSTVPGGLAAAAQSAADQNARATRDEDKVKLRNVLSNAREKLPADKGATREDAERVVSAEIRNKLDMATTPGGVADAVTTAARLNQERPRP

SEQ ID NO: 90123 - protein, 399 aa, Clostridium perfringens str. 13
MLSYEFLFDLALILISTKLFGLITKKIRMPQVVGALVAGVVLGPAFLNVLSETEFIQNLAELGVIVLMFTAGLETDINQLKKTGKASFIIAVLGVIIPLVGGFFIASIFNKGNDVNTILQNVFIGIILTATSVSITVETLKEMGKLNTRAGNAILGAAIIDDILGIIALTITTSLADPSINVIIVLIKIVMFFIFAGFAGYLFHWAFIKLDERYQRDLRRFVIIAFVFCLLLSFCAEEFFEVADITGAFIAGLVISDSNRSKYLNSRFETLSYMLLSPIFFASIGIKVQLTAMTKTIFIFSILLLLVAILSKVFGCALGAKLCRYSNREAIQIGTGMISRGEVALIVANKGIAMGLMLPEFLAPVVIVVVVTTIVTPILLKVVFNNKSKSVDLNVKANV

SEQ ID NO: 90124 - protein, 305 aa, Desulfococcus oleovorans Hxd3
MKKDITTLYDMEKEDFQILFDSALELKKRQRMGIYDAVLSGRVMGMIFDKHSTRTRVSFEAAMTRLGGTVIYMSSRDMQIARAEPVKDTARVLSRYIDALVIRTYSQSLIEEYAQYADIPVINALSDKYHPCQVLSDLLTVIEHKGGYQGVRIAWVGDGNNVAHSWIAAAAVLGLDLVLGCPADYMPDPDILENARQKGNGSVTVVNDAAEAVAGADVIYTDVWASMGQEEEHRERLAVFEPFQVNDALAGLAKKDAIVMHCLPAHRGEEITEAVLEGPRSVVWDQAENKMHMHKAILKALILRA

SEQ ID NO: 90125 - protein, 248 aa, Picea sitchensis
MAANFWTSSHCKELLDAEKVGIVHPLDKEHGLTQEDVKIIKIHMSNYIRTLSQSVKVRQRVVATAITYFRRVYTRKGFTEYDPQLVAPTCLYLASKAEESTVQAKLVIFYMKRYTKHRYEIKDMLEMEMKLLEALDYYLVIYHPYHPLIQLLQDANLAELKVTAWSLVNDTYRTDLILTYAPYMIALACIYFACIVMEKDAHTWFEELRVDMNEIKNISMEIVDYYDNYRSIPEEKINSALNKLPQRF

SEQ ID NO: 90126 - protein, 379 aa, Bradyrhizobium japonicum USDA 110
MTKPTASPASCRQRRTSMLAIPLLSFALWSGGIGAAAHAAEPGKDASAGGLPRILVLATGGTIAGQADARATGAYKSGQITGEQLMQSVPGLDKLAKLNAEQISSIGSQDMNDKVWFALARRIQEAFDKNEADGVIVTHGTDTLEETAFFLDNVVRGDKPVVIVGSMRPASAVSADGPGNLYEAVQVAADPRSRGRGVMAVLNDKIEGARSVTKTNTTSIETFNSPNGGPIGYVDTAGGIRFMAQAAGLKRAAYQLPAGEQLPRVEIVYSHANMDAVPIEDAISHGAKGIVLAGVGDGNTSKPALDALEAAAKKGILVVRSTRVRSGFVTRNVEVDDDKNGFVVSEDLNPQKARVLTQLLIASGVTAPAELQRAFTATW

SEQ ID NO: 90127 - protein, 570 aa, Oryza sativa Indica Group
MGSFLRKQPSFLLILLILHLGAREARALSSDGEALLAFKKAVTTSDGIFLNWREQDVDPCNWKGVGCDSHTKRVVCLILAYHKLVGPIPPEIGRLNQLQALSLQGNSLYGSLPPELGNCTKLQQLYLQGNYLSGHIPSEFGDLVELGTLDLSSNTLSGSIPPSLDKLAKLTSFFIGNRGLCGKQINSVCKDALQSPSNGPLPPSADDFINRRNGKNSTRLVISAVATVGALLLVALMCFWGCFLYKNFGKKDIHGFRVELCGGSSIVMFHGDLPYSTKEILKKLETMDDENIIGVGGFGTVYKLAMDDGNVFALKRIMKTNEGLGQFFDRELEILGSVKHRYLVNLRGYCNSPSSKLLIYDYLPGGNLDEVLHEKSEQLDWDARINIILGAAKGLAYLHHDCSPRIIHRDIKSSNILLDGNFEARVSDFGLAKLLEDDKSHITTIVAGTFGYLAPEYMQSGRATEKTDVYSFGVLLLEILSGKRPTDASFIEKGLNIVGWLNFLVGENREREIVDPYCEGVQIETLDALLSLAKQCVSSLPEERPTMHRVVQMLESDVITPCPSDFYDSE

SEQ ID NO: 90128 - protein, 397 aa, Desulfococcus oleovorans Hxd3
MMSTNIKEQADTVFANTYKRLPLVIERGEGCTLWDADGKAYTDFFAGIAVCGLGHAHPAVAEALYKQAGTLCHVSNLFYTTPQTELAALLVEKSFADRVFFCNSGAEANEAAIKLARKHFHDRGEHDRYTIVTMEKSFHGRTMGALSATGQAKIQKGFEPLLSGFVTVPFNDIDALKKQMSPRICAVMMEPIQGEGGVVCPSPGYLEAVRKLCDESGALLIFDEVQTGMGRTGKLFAHEHFGITPDIMTLAKALGNGLPIGAMLATEAAASAFVPGAHATTFGGTPVICAAALAVLRTMDQEKIVARCETMGTYFKEKLSALVSKHGCVTGVRGMGLLLGMELTGEGGPVVSACMEKGFLINCIQDRVLRFAPPLIVTKQEIDQLIACLDEVLGDLS

SEQ ID NO: 90129 - protein, 366 aa, Glycine max
MSQNGKLMPNLDQHSTKLLNLTVLQRIDPFVEEILITAAHVTFYEFNIDLSQWSRKDVEGSLFVVKRNTQPRFQFIVMNRRNTENLVENLLGDFEYEVQVPYLLYRNAAQEVNGIWFYNARECEEVANLFSRILNAYAKVPPKSKVSSTKSEFEELEAVPTMAVIDGPLEPSSSTTSNVADVPDDPSFVNFFSAAMAIGNTSNAPINGQPCQSSATISSSSVPTNAATPTVPTLQIPTLSASTPLIPQLDAAELISSSNRTAKLVKPSFFVPPPSSAMMIPPVSSSTPSAPPLHPAVNVQRPYGAPLLQPFPPPNPPPSLAPAPSPSPSYGPVISREKVRDALLVLVQDNQFIDMVYRALLNAHQS

SEQ ID NO: 90130 - protein, 452 aa, Escherichia coli
DSRFGAKSISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 90131 - protein, 291 aa, Desulfococcus oleovorans Hxd3
MDPHVADILIESLPYIRRFAGMTIVIKYGGHAMVDEQLKNDFARDITLLKFIGIHPVVVHGGGPQINRVLEQMGIKTSFVRGMRFTDAATMDVVEMVLGGKVNKDIVAQINRHGGRAIGLSGKDGGLISARKLTILGDKKGDAPPEIIDPGLVGDVTRIDPDIITTLASQGFIPVIAPVGVGENGETYNINADLVASKVASALGATRLILLTDVDGVLDSGGNLISSIDAGAIGEMIGNGTVSGGMIPKIEYALDAIYNGIEKVQIINGKRRHSVLLELFTDKGIGTEVVA

SEQ ID NO: 90132 - protein, 470 aa, Pseudomonas putida KT2440
MSCIPFQELAMHTTTSTAHSPAPHAPSQPGTSTGRFRKSMSMTALVLFGLAYMVPLAVFTTYGLVTQMTKGHLPTAYLLTLAAMLLTAYSYGRMVQAHPYSGSVYTYTRKAFGSHIGFITGWTLLLDYIFLPLLSYLLIGIYMSEYFPTIHAWVWVAGSIALVTFLNLIGIESITRVNWILVVVQLVFIIVFVALSILKLSGQAEPVSLLAPLHHDGFSVPLIMTGAAVLCLSFLGFDAVSTMAEETSNPTYRIPVAILAVSLIGGLLFLVVSYCAQMVFPDWGSFADPDSASVDVMRRVGGELLVTAFTATYVAGCFASAMVSQASVSRVLFAMGRDGALPRAFGQLVTKKRVPATAILVVSLLSLIALVITLDTVANMISFGALFAFSAVNLAVVKHYLVDQKLRGCRNCLLYGAIPGLGFLSTLWLWSSLTSLSFTIGLCWMGLGLLVLLGLTRALRVKLPELQMAE

SEQ ID NO: 90133 - protein, 131 aa, Oryza sativa Indica Group
MQMGSETYHHLKDIILEKYGSNSCNIGDDGGFAPNISRQANQVGTVTEAIEVVRQAKDAHWGVMVSHRSGDTDDSFIADLAVGAAAGQIKAGAPCRGECLSKYNQLLRIEEELGSDGVYAGENWRTTASTS

SEQ ID NO: 90134 - protein, 520 aa, Streptococcus pyogenes MGAS315
MTEISILNDVQKIIVLDYGSQYNQLIARRIREFGVFSELKSHKITAQELHEINPIGIVLSGGPNSVYADNAFGIDPEIFELGIPILGICYGMQLITHKLGGKVVPAGQAGNREYGQSTLHLRETSKLFSGTPQEQLVLMSHGDAVTEIPEGFHLVGDSNDCPYAAIENTEKNLYGIQFHPEVRHSVYGNDILKNFAISICGARGDWSMDNFIDMEITKIRETVGDRKVLLGLSGGVDSSVVGVLLQKAIGDQLTCIFVDHGLLRKDEGDQVMGMLGGKFGLNIIRVDASKRFLDLLADVEDPEKKRKIIGNEFVYVFDDEASKLKGVDFLAQGTLYTDIIESGTETAQTIKSHHNVGGLPEDMQFELIEPLNTLFKDEVRALGIALGMPEEIVWRQPFPGPGLAIRVMGAITEEKLETVRESDAILREEIAKAGLDRDVWQYFTVNTGVRSVGVMGDGRTYDYTIAIRAITSIDGMTADFAQLPWDVLKKISTRIVNEVDHVNRIVYDITSKPPATVEWE

SEQ ID NO: 90135 - protein, 460 aa, Pseudomonas putida KT2440
MNAPFAPQRQTRDYQAADAAHHIHAFLDQKALNAEGPRVIVGGERLHLWDSEGKRYLDGMSGLWCTQLGYGRRDLTAAAATQMDQLAYYNMFFHTTHPAVIELSELLFSLLPGHYSHAIYTNSGSEANEVLIRTVRRYWQVVGQPGKKIMIGRWNGYHGSTLAATALGGMKFMHDMGGLIPDVAHIDEPYWYAEGGELTPAEFGRRCALQLEEKILELGAENVAGFIAEPFQGAGGMIFPPESYWPEIQRICRQYDVLLCADEVIGGFGRTGEWFAHEYFGFEPDTLSIAKGLTSGYVPMGGLVLSKRIAEALVERGGVFAHGLTYSGHPVAAAVAIANLKALRDEGIVRQVKDDTGPYLQRILREVFADHPLIGQVQGAGLVAALQFAEHKPTRKRFANENDLAWQCRTFGFEEGVIIRSTLGRMIMAPALIANHSELDELVEKTRIAVDRTARLVGKL

SEQ ID NO: 90136 - protein, 497 aa, Pseudomonas putida KT2440
MYTLEFWQQRASDLYLPAHALIDGKPVNAQDGATFAAINPATNNVLAQVAACGHAEVDLAVASARRAFEQGPWPRMAPGERKKVLLRLAELIMAHREELALLDSLNMGKPVMDAYNIDVPGSAHVFAWYGEALDKLYDQVAPTAANALATITREALGVVAAVVPWNFPLDMAAWKLAPALAAGNSVVLKPAEQSPFSALRLAQLALEAGVPEGVLNVVPGLGEQAGQALGLHPDVDCLVFTGSTQVGKYFMQYSAQSNLKQVWLECGGKSPNLVFDNCQDLDLAAEKAAFGIFFNQGEVCSANSRLYVQRAIHDEFIERLQAKARQWLPGNPLDPASRAGAIVDAGQTGRIEAAIVRAGQEGARLVCGGRRLTIEGSDNYIEPTIFAGVEGRMSLAREEVFGPVLAVSAFDTEEEAVRLANDSIYGLVASVWSDDFNQVHRVARALKAGTVSVNTVDALDVTVPFGGGKQSGFGRDLSLHSFDKYSQLKTTWYQLRG

SEQ ID NO: 90137 - protein, 637 aa, Candidatus Pelagibacter ubique HTCC1002
MQNYKFLKDINFPSDLRKLSENDLQEVSNEVRKEMIDAVSETGGHLGAGLGVVELTVALHYVFDTPNDRLIWDVGHQTYPHKILTGRKSKIKTLRQGNGLSGFTKRSESEYDPFGAAHSSTSISSALGMAEANKLSNKSSNIIAVIGDGAISAGMAYEAMNNAGASKTKMIVILNDNDMSIAKPVGAMRTYLAKLLTGKIYFSLRETFKLIVSAFSKRFSAKAGKAEDFLRSAVTGGTLFNSLGFYYVGPIDGHDLSTLIPILKNARDSKHQGPIMIHIKTQKGKGYSYAEKASDHYHGVSKFNVVTGEQVKSGTNLPAYTKVFANTLVKHAERDSKVVGVTAAMPGGTGMDIFAKDFPKRMFDVGIAEQHAVTFAAGLATEGYKPYVAIYSTFLQRAYDQVVHDVAIQSLPVRFIIDRAGLVGADGSTHAGSFDITYLSTLPNFIVMAPSDEAELVKMINTSMSINNKPCAIRYPRGNGIGVELPSIDENIEIGKGRVIQEGKQVCILSIGTRLEECKIAAAELKNKGIESTIVDARFAKPLDQELILKCAREHEVMITVEEGSIGGFGSHVENLLSEKGIFDKGLKFRTMILPDIFIEQDSPKKMYDVAGLNASQISKKILDILFTKESIKVVKN

SEQ ID NO: 90138 - protein, 290 aa, Candidatus Pelagibacter ubique HTCC1002
MQNKLARIAKDTNLFLKQFIKGQKRTELIAAMEYGLFPGGKKIRSKILIDIGAIFKINYKTLISIGAAVECIHAYSLIHDDLPCMDDDKIRRGKISTHIKFGESTAVLAGNSLLTMAFEILVSSSLKLNEKIKVDLIKKLSETSGHLGIAGGQYLDLSFEKKKVSKSKIIDMEIKKTGKLFSFCCTVPVIIKRKSNTQIKFFENIGSNIGLLFQIADDLIDFKGSTVIAGKLTGKDKKKGKATLISLLGYQNAIKYADKIKSKIIKDLNKYSSNTNSLNETLDYILKRNK

SEQ ID NO: 90139 - protein, 596 aa, Arabidopsis thaliana
MSQSIQFSSPSHTPHLLHLPHSQFNRPLSSISFRRFPLTTIKYTSIRASSSPSPSPDLDSSSSSSSSQVLLSPNGTGAVKSDERSVVATAVTTDTSGIEVDTVTEAELKENGFRSTRRTKLICTIGPATCGFEQLEALAVGGMNVARLNMCHGTRDWHRGVIRSVRRLNEEKGFAVAIMMDTEGSEIHMGDLGGEASAKAEDGEVWTFTVRAFDSSRPERTISVSYDGFAEDVRVGDELLVDGGMVRFEVIEKIGPDVKCLCTDPGLLLPRANLTFWRDGSLVRERNAMLPTISSKDWLDIDFGIAEGVDFIAVSFVKSAEVINHLKSYLAARSRGGEIGVIAKIESIDSLTNLEEIILASDGAMVARGDLGAQIPLEQVPAAQQRIVQVCRALNKPVIVASQLLESMIEYPTPTRAEVADVSEAVRQRSDALMLSGESAMGQFPDKALTVLRTVSLRIERWWREEKRHESVPLQAIGSSFSDKISEEICNSAAKMANNLGVDAVFVYTTSGHMASLVSRCRPDCPIFAFTTTTSVRRRLNLQWGLIPFRLSFSDDMESNLNKTFSLLKSRGMIKSGDLVIAVSDMLQSIQVMNVP

SEQ ID NO: 90140 - protein, 394 aa, Ralstonia solanacearum GMI1000
MDAHRLHTAARLANIRAFHVMELAKQARELELAGRSIIHMGIGEPDFTAAEPVVRAAEAAMRRGVTQYTGALGIRPLREAIARYYHTVYGLDIAPERIIVTAGASAALLLACAVLVEIGGEVLMPDPSYPCNRHFVPAFDGVARLVPSGPQTRFQLSAEQVEANWTDRTQGVLLASPSNPTGTSILPDELRRIVETVRGRGGFSIVDEIYQGLSYDQAPVSALSFGDDVVTINSFSKYFNMTGWRLGWLVAPTELVPQFEKVAQNLFICASAVAQHAALACFEPEALAIYEGRKAEFHRRRDFIVPALESLGFQVPVKPDGAFYVYADCRGVNHPHAGDADALTQSMLNDAGVVLVPGLDFGPYTAHHYIRLSYATAMDHLEEAVARLARLFRR

SEQ ID NO: 90141 - protein, 460 aa, Arabidopsis thaliana; identical to SEQ ID NO: 1429

SEQ ID NO: 90142 - protein, 353 aa, Citrus sinensis x Citrus reticulata
MDSIVDGERDQSFAYANQLAMGTMLPMAIQTVYELGIFEILDKVGPGAKLCASDIAAQLLTKNKDAPMMLDRILRLLASYSVVECSLDASGARRLYSLNSVSKYYVPNKDGVLLGPLIQIVQDKVFLKSWSQLKDAILEGGIPFNRAHGVHVFEYTGLDPKFNKHFNTAMYNYTSLVMSNILESYKGFDNIKQLVDVGGSLGITLQAITTKYPYIKGINFDQPHVIDHAPPHPRIEHVGGDMFQSVPKGDAIFMKSVLHDWNDEHCLKLLKNCYKSIPEDGKVIVVESMLPEVPNTSIESKSNSHLDVLMMIQSPGGKERTRHEFMTLATGAGFGGISCELAIGSLWVMEFYK

SEQ ID NO: 90143 - protein, 121 aa, Oryza sativa Japonica Group
MAAASAAAQAEGTVIAIHSLDEWTIQIEEANSAKKLVVIDFTASWCGPCRIIAPVFADLAKKHTNAVFLKVDVDELKPIAEQFSVEAMPTFLFMKEGDVKDRVVGAMKDELASKLELHMAM

SEQ ID NO: 90144 - protein, 322 aa, Escherichia coli CFT073
MAKRNNNMDNLDVICIGAAIVDIPLQPVSKNIFDVDSYPLERIAMTTGGDAINEATIISRLGHRTALMSRIGKDAAGQFILDHCRKENIDIQSLKQDVSIDTSINVGLVTEDGERTFVTNRNGSLWKLNIDDVDFARFSQAKLLSLASIFNSPLLDGRALTEIFTQAKARQMIICADMIKPRLNETLNDICEALSYVDYLFPNFAEAKLLTGKETLDEIADCFLACGVKTVVIKTGKDGCFIKRGDMTMKVPAVAGITAIDTIGAGDNFASGFIAALLEGKNLRECARFANATAAISVLSIGATTGVKNRKLVEQLLEEYEG

SEQ ID NO: 90145 - protein, 347 aa, Escherichia coli CFT073
MKNSKAILQVPGTMKIISAEIPVPKEDEVLIKVEYVGICGSDVHGFESGPFIPPKDPNQEIGLGHECAGTVVAVGSRVRKFKPGDRVNIEPGVPCGHCRYCLEGKYNICPDVDFMATQPNYRGALTHYLCHPESFTYKLPDNMDTMEGALVEPAAVGMHAAMLADVKPGKKIIILGAGCIGLMTLQACKCLGATEIAVVDVLEKRLTMAEQLGATVVINGAKEDTIARCQQFTEDMGADIVFETAGSAVTVKQAPYLVMRGGKIMIVGTVPGDSAINFLKINREVTIQTVFRYANRYPVTIEAISSGRFDVKSMVTHIYDYRDVQQAFEESVNNKRDIIKGVIKISD

SEQ ID NO: 90146 - protein, 294 aa, Magnetococcus sp. MC-1
MPMRNQVEKVKVLIEALPYMRRFEGKTFVIKYGGNAMVDEDLKSAFAQDVILMRQVGINPIIVHGGGPQIGLIMKRMGLEPKFIDGLRVTDEDTMSVVEMVLAGKVNKDIVNLINLNGGRAAGLSGKDGYTIQARKRTHVRKGPDVQVPEIIDLGWVGDVERIETNLLDRFRASDIIPVVAPVGVGANGETYNINADSVAGHIAIAMQAEKLILLTDVPGVQDKNGTLINQIDETDVDKLIRNGTVTGGMIPKLETCRTAHTGGVNASHIIDGRVEHALLLEIFTDSGIGTVLR

SEQ ID NO: 90147 - protein, 561 aa, Oryza sativa
MINKLSDTTGDDTVKDLHDPRREDAEGDGWEEVHEGPESDPEEYIALVSEDAGTHLPVRTEPRRMDPSKKEPDFFTEYGEANRYKVSEVIGKGSYGVVAAAVDTQTGERVAIKKINDVFDHVSDATRILREIKLLRLLRHPDIVEIKHIMLPPSRREFRDIYVIFELMESDLHQVIKANDDLTPEHHQFFLYQLLRGMKYIHAASVFHRDLKPKNILANADCKLKVCDFGLARVSFNDTPSAIFWTDYVATRWYRAPELCGSFFSKYTPAIDIWSVGCIFAELLTGKPLFPGKNVVHQLDLMTDLLGTPSAESLAKIRNEKARRYLSNMRKKPRVPFTKKFPGVDPMALHLLERLLAFDPKDRPSAEEALTDPYFNGLANSEREPIAQPISKLEFEFEKRKLAKDDVRELIYREILEYHPHMLQEYLRGGDQMSFMYPSGVDRFKRQFAHLEEGVSKGEKSSPQLRQNASLPRERAIGNKHGDDEYHAKLNVGEKPCHASVTDGISKPLMSARSLLKSESISASKCIGEKPKQDRDQEDSLTESMDETADEVSEKVAQLKT

SEQ ID NO: 90148 - protein, 260 aa, Colwellia psychrerythraea 34H
MKIKIYQVDAFASHVFEGNPAAVCPLNEWLDDEVLQKIAEENNLSETAFFVSSAAGIQLRWFTPRGEVDLCGHATLATAHVLYEHLGFKSPKVEFQTKSGELVVTKNDSGFSMDFPASHPAVIDAPINLLAGLGDVIPKQVIASFDYIIILDSEEAVKNLDPDLSKWLKLDLRGVVVTAVGTDVDFVSRCFFPKLGVDEDPITGSAHCELAPYWNSKLGLSLLTGRQISKRSGIVHCELKGDRVVLTGNAVDYMSGEINI

SEQ ID NO: 90149 - protein, 459 aa, Escherichia coli CFT073
MEQITKPHCGARLDRLPDCRWHSSMFAIVAFGLLVCWSNAVGGLILAQLKALGWTDNSTTATFSAITTAGMFLGALVGGIIGDKTGRRNAFILYEAIHIASMVVGAFSPNMDFLIACRFVMGVGLGALLVTLFAGFTEYMPGRNRGTWSSRVSFIGNWSYPLCSLIAMGLTPLISAEWNWRVQLLIPAILSLIATALAWRYFPESPRWLESRGRYQEAEKVMRSIEEGVIRQTGKPLPPVVIADDGKAPQAVPYSALLTGVLLKRVILGSCVLIAMNVVQYTLINWLPTIFMTQGINLKDSIVLNTMSMFGAPFGIFIAMLVMDKIPRKTMGMGLLILIAVLGYIYSLQTSMLLITLIGFFLITFVYMYVCYASAVYVPEIWPTEAKLRGSGLANAVGRISGIAAPYAVAVLLSSYGVTGVFILLGAVSIIVAIAIATIGIETKGVSVESLSIDAVANK

SEQ ID NO: 90150 - protein, 459 aa, Physcomitrella patens subsp. patens
MGIFLSSARSPEHETSIANSDSTKRQRMSVENEQQPAIIPGLPEEIALQILARVTRGNHPLLRCVCKSWYRILSTSEIFNLRKELGVMEEWLYVLMKDEEDHLGWHVLDPVEGKWRKLPPMPEIANIAKKTDAPETSWGWRIPLGPLRMMRLTGLFGGWFQRKGFLDKTPFCGCSAGAINGSLYVLGGFSWASAMRAVWRYDSRTNTWASSAGMEVARAYCKTGVVDNKLYAIGGVDRGRGGLTPLQSAEVYDPETDSWSQVAPMPFRRAQVIPTAFLADMLKPIATGMASYNGKLCVPQSLYSWPFFVDVGGEIFDPATDTWAEMPNGMGEDWPARQAGTKLSVVVGGKLYALDPTSSMDGSKIKVYDSEQDVWKVVLKKVPILLDLSDSESPYLLAGFDGKLHVITKDINDNVTVLRAELGDNSQSQNAKESVCGWKTISSASFGPVELVACQVLDL

SEQ ID NO: 90151 - protein, 147 aa, Escherichia coli CFT073
MSTIKVRCEQMANKPSAEELKKNLSEMQFYVTQNHGTEPPFTGRLLHNKRDGVYHCLICDAPLFHSQTKYDSGCGWPSFYEPVSEESIRYIKDLSHGMQRIEIRCGNCDAHLGHVFPDGPQPTGERYCVNSASLRFTDGENGEEING

SEQ ID NO: 90152 - protein, 283 aa, Kluyveromyces lactis NRRL Y-1140
MSAETELLGMPESLKDIKHIILVLSGKGGVGKSSVTTQTALTLCLKGYKVGVLDIDLTGPSLPRMFGLENKQVYQASKGWIPVSVPTTSGGELKLMSLGFLLDDRGNSVVWRGPKKSAMIKQFIKDVDWGDLDYLIIDTPPGTSDEHISIAEELRWAAPDGAIIVTTPQGVATADVRKEINFCKKVNFNILGVIENMSGFICPHCAECTDIFSRGGGFKLASEYNVPYLGNIPIDPTFVELIEKQTGFKESLVDLYKDSGLYVIFSKILDNVLNGEVKSGTDQ

SEQ ID NO: 90153 - protein, 460 aa, Lactobacillus sakei subsp. sakei 23K
MTQAKKIPSSFIYFFGSFGGILFGYDIGVMTGALPFLQHDWHLENNAGVVGWITSAVMFGAIFGGALAGQLSDKWGRRKMILLSSLIFAIGSLLSAFSPNDGQVYLIAVRVFLGLAVGAASALVPAYMSEMAPARLRGRLTGINQTMIVSGMLLSYIVDYLLKGLPEQLAWRLMLGLAAVPAIILYFGVLRLPESPRFLVKHNRLDEARQVLGYIRSKDEVETELTNIQTTAGMESNVQQSTSMKTLLSGKYRYLVIAGIGVAGFQQFQGANAIFYYIPLIVEKATGKAASSALMWPIIQGVILVLGSLLFLVIADKFKRRTLLTLGGTVMGLSFILPAIMNALIPNFNPMMIVVFLCLYVAFYAFTWAPLTWVLVGEIFPLAIRGKASGLASSFNWIGSFLVGLLFPMMIASMPQEGVFAIFGVICLLGVLFIRTCVPETMGHTLEEIEAQGTNKAHKA

SEQ ID NO: 90154 - protein, 473 aa, Treponema denticola
MVDLFDKYTNAVSETDPIKFTGRVVRVHDKLIESEGPVASVGELCQIITDDNPDGLKAEVVGLNGTIVQLMSYTDVQGVKIGTLLLQAEKFYRPGWKYFTGPCVDALCKSADGKPEPYSAKRYPVVASPPDAMTRKPIRQRIVTGIRAIDSLLAVGRGQRLGIFAGTGIGKSTLLGMIARNTNADVNVIALIGERGREVLDFIEHDLGPEGLKHSVIVSATSDRKCLARIRGAYTATAIAEYFRDQGKDVMLLFDSVTRFAMAQREIGLAIGEPPATRGYTPSVFSSLPKLLERSGTSEKGSITGFYTVLVEGDDMNEPISDAVRGILDGHIVLDRNLAERGQYPAVNVLKSISSIIQQSIGTKHKDASKRMRTLLKDYTESEDMINLGAYQKGSSAAIDDAIDHYPRIYDFLTQEVDDPAKLKDTLQKLSDITGIDIPPEEFDEAGLGVGAIKKYAQSSEASALYKPDREVN

SEQ ID NO: 90155 - protein, 334 aa, Escherichia coli CFT073
MEYMTIKVGINGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDNETGYSNKVLDLIAHISK

SEQ ID NO: 90156 - protein, 168 aa, Halobacterium sp. NRC-1
MRTDAGGLICVALGDAVADAFALPFIADELDHPAADHGHLGYDDRSSFSLTVNHRDTYTGITDDDRALTIAELGQAAADPAAVDFPATFRAPGHVHVLRAAPSLSARQGHTELGIALAGAAGVPPAVVVCEMLDADTGGARSVADAKRYASRHDIPYVEGSDLVAAFQ

SEQ ID NO: 90157 - protein, 399 aa, Prochlorococcus marinus subsp. pastoris str. CCMP1986
MTPERLGLLWGITVFAGACARLISSVSGFPSVVILLISGLFIGRSGFGLVEPLDLGQGLETIVGLLVCLVLFEGGLNLKLPEGNIRNTVLRISLIRLFISLSAGIFIAHWLAGLSWPVAGVYSAIVLATGPTVVSPLVDQIKLVSPLSEVLKAEGLVLEPIGAVLALLLLELILGDLHGIKEVFIALMQRLGGGVLIGISSGWLLSEILKKIKNEASFGIELQVTLGFIFLVYGICEYILPESGLPASVAAGFIVGKREIIDKERLDNLIGELAQLSITVLFPLLASDVSWGELSPLGWGGIICVLMLMIIVRPISISLATLGGELDVKQRVFLSWLAPRGIVTAAVASLFSIRLEQAGVLGAGRLQGLVFLTILMTVGIQGLTARPLANFLNLIDKEI

SEQ ID NO: 90158 - protein, 171 aa, Nicotiana tabacum
VWHAITGYWGGVRPGVKGMEEYGSVMKYPEITKGVMENEPGWKTDAIAVQGLGLVNPKSAYKFYNEMHSYLASAGVDGLKVDVQCILETLGGGLGGRVELTKQYHQALDASVSKNFPDNGCIACMSHNTDALYCSKQTAVVRASDDFYPRDPVSHTIHIACVAYNSVFLGE

SEQ ID NO: 90159 - protein, 111 aa, Chlamydia trachomatis
IEESGADLIHIDVMDGHFVPNITFGPGVVAAINRSTELFLEVHAMIYTPFEFVEAFVKAGADRIIVHFEAAENIKEIISHIQKCGVQAGVAFSPETSIEFVTSFIPLCDVI

SEQ ID NO: 90160 - protein, 355 aa, Blastopirellula marina DSM 3645
MVVAPQTAALVQGEMTVAVRVAINGFGRIGRLTFRNLIARGKEFEVVAINDLTDNKMLANLLKYDSTHRRFPGTVEYDSEGLTVNGVKIRVFEERNPAALPWGDMGVDVVVESTGVFTSRKTDAKAGYDSHLDAGAKKVVLSAPAKDAPDLTCVLGVNDHELTADMKTVSNASCTTNCLAPVAKILNDSFGLKNGLMTTIHAYTNDQQVLDLPHADPYRARAAALNIIPTSTGAAKAVGLVIPALKGKLTGISMRVPVPTGSVVDLVANLDKSVTKEEINAAMKAAADGPMKGILCYTEDPIVSSDIIGDPHSSIFAAPQTEVIDGSLVKIVSWYDNEAGYSARTADLVSKLGNM

SEQ ID NO: 90161 - protein, 390 aa, Mycobacterium smegmatis str. MC2 155
MTLQSRWEAVMMNNYGTPPLSLVSGEGAVVTDADGREYLDLLGGIAVNLLGHRHPAVIEAVTTQLDTLGHTSNLYATEPGIALAEALVGQLGTQARVFFCNSGTEANEVAFKITRLTGKTKIVAAEGAFHGRTMGSLALTGQPSKQAPFEPLPGNVMHVPYGDVAALEAAVDDQTAAVFLEPIMGEGGVVVPPAGYLVAAREITSKHGALLVLDEVQTGVGRTGAFFAHQHDGIVPDVVTMAKGLGGGLPIGACLAVGATGDLLTPGLHGSTFGGNPVCTAAGLAVLKTLAAEDLVARAGVLGKTLSHGIEELGHPLVDKVRGKGLLQGIVLTVPSAKAVETAARDAGFLVNAAAPEVVRLAPPLIITEGQIEAFITALPAVLDTAAEDS

SEQ ID NO: 90162 - protein, 164 aa, Ralstonia solanacearum GMI1000
MDHGFYPTNLEGEGLRIGIVQARFNEPVCEALREACVAELEQLGVAGEDVLLVTVPGALEVPLALQKMAESGQFDALIALGAVIRGETYHFELVSNESGAGITRVCLDFNIAIANGILTTDTDAQAHARTREKGRDCARTAIEMANLTAALDGLQDHGQDDENE

SEQ ID NO: 90163 - protein, 399 aa, Ralstonia solanacearum GMI1000
MGSHFCRRAAANALAGGPLQLPAMSIATVEEIIAEIRAGRMVILVDEEDRENEGDLILAADFVTPEAINFMARFGRGLICLTLTAERCRQLDLPLMVTRNGTPHGTNFTVSIEAAEGVTTGISAADRARTVQVAVARSASPDDLVQPGHIFPLMAQPGGVLMRAGHTEAGCDLASLAGLTPASVICEIMKDDGTMARLPDLVEFAREHGLKIGTIADLIQYRSRTESIVERIGERNMETQFGTFRAVAFRDHAAGRAHLALVKGTPTPATETLVRVHEPLSVLDLLECQRTTHSWSVPAALRAVQAAPTGVVVLLNCGDSPERLFTQFSALDAPQERPRSKPDPRIYGIGAQILKDVGVGKMRVLASPLKLPSMAGYDLEVTAYQSMADTPQATTAATH

SEQ ID NO: 90164 - protein, 436 aa, Bacillus anthracis str. Sterne
MNTMQPSAPPHLESTKTIFSNSITKLVVFICWLAILADGYDLGIYGAVLPKLLEDNSWALSPAHAGTIASYALFGMFIGAILVGTITDLIGRKWTLICCLALFSITMGLAALAPSPELFGLWRFIGGIGLGGVIPTASALTVEYSPKKRQSFIYALMFTGYPLGIVLGAILSMFMLEDFGWRIMFGIGMIPLLLIPFIIRYLPESIQFLLSRNRQEEVDKILNRFQIEFYAKDETHQAPSNIRKKNGFLTLFSKEYIKATLLFWITYIMGMFLIYGLNTWLPQMMRQAGYPLGSSLSFLLMLNITAAIGALFAGAIADRIGAKIVISISYLMAAICIGLLTIKPSVSIIYLLIGLAGIGSVGITQILNAYVTQYFPSHIRATSLGWGLGLGRVGAIAGPILVGIIMTMQYDLAWNFYLFSFAGLLAAISVFFIPTK

SEQ ID NO: 90165 - protein, 627 aa, Arabidopsis thaliana
MKYKRKLSLSVVFLFVFYLAAVTSDLESDRRALLAVRNSVRGRPLLWNMSASSPCNWHGVHCDAGRVTALRLPGSGLFGSLPIGGIGNLTQLKTLSLRFNSLSGPIPSDFSNLVLLRYLYLQGNAFSGEIPSLLFTLPSIIRINLGENKFSGRIPDNVNSATRLVTLYLERNQLSGPIPEITLPLQQFNVSSNQLNGSIPSSLSSWPRTAFEGNTLCGKPLDTCEAESPNGGDAGGPNTPPEKKDSDKLSAGAIVGIVIGCVVGLLLLLLILFCLCRKRKKEENVPSRNVEAPVAAATSSAAIPKETVVVVPPAKATGSESGAVNKDLTFFVKSFGEFDLDGLLKASAEVLGKGTVGSSYKASFEHGLVVAVKRLRDVVVPEKEFRERLHVLGSMSHANLVTLIAYYFSRDEKLLVFEYMSKGSLSAILHGNKGNGRTPLNWETRAGIALGAARAISYLHSRDGTTSHGNIKSSNILLSDSYEAKVSDYGLAPIISSTSAPNRIDGYRAPEITDARKISQKADVYSFGVLILELLTGKSPTHQQLNEEGVDLPRWVQSVTEQQTPSDVLDPELTRYQPEGNENIIRLLKIGMSCTAQFPDSRPSMAEVTRLIEEVSHSSGSPNPVSD

SEQ ID NO: 90166 - protein, 241 aa, Prochlorococcus marinus subsp. pastoris str. CCMP1986
MRKSVIAGNWKMHMTCADTKKYLEEFLPLIEEIPNDRKIVIAPPFTAISTFSNYTNFDYLNIASQNIHWEDKGAFTAEISPNMLIEHKVKYAIVGHSEPRKYFSESDEQINKRAVFAQSSGLTPIVCVGETLEQRERGEADRVITRQVEQGLENTDPSNLIVAYEPIWAIGTGKTCEASDANKICALIRSLIGFSDVIIQYGGSVKPNNIDEIMSMSDIDGVLVGGSSLDPISFSRIANFE

SEQ ID NO: 90167 - protein, 473 aa, Vitis vinifera
  misc_feature (56)..(56): Xaa can be any naturally occurring amino acid
  misc_feature (91)..(91): Xaa can be any naturally occurring amino acid
  misc_feature (304)..(304): Xaa can be any naturally occurring amino acid
MDNAANSLHLRDASFSAYLSTAEENFAVKLAESIQSPYLPLTSTQEAAYPVNLGRXMSVEEGELRVFGAEKYFNMKMDDGRRRLTTSSSLXHRQIKEDRADLHCTKPKIRPGTPSASSEASWNSHAALLPRLLRNPSPSKQRKANAKMIFAGFGCNGSCSDKKSVYVDTNAEPGGVHGKEIRKKVAQNDPNPLMLDRTRLSQPGFPVKNEIHSRSFDKASIGCKREEYYGYPIINSGLESLTVKGESVDKRAEEEGRKSLEVFGSHMLKKGDVATNLERKLSVLTWDAIPKVQTVPTTSEGTGXYEDNESDASSDLFEIENLSGSAHPLFNRQASDGMSSCTRYEPKSEASIEWSVVTASAADFSVTSDFDEKKQVESTENSREMNFASTPTRPSKTKSSVGKEAQRSRPTGLLGCRSDKAVRVSEPAYRTNDKVKSDPGWHHRLDSSMPLGKSQGENKVKDFEFPQAQHAFA

SEQ ID NO: 90168 - protein, 364 aa, Nicotiana tabacum
MESSTKSQIPTQSEEERNCTYAMQLLSSSVLPFVLHSTIQLEVFEILAKSNDTKLSASQIVSQIPNCTKPEAPTMLNRMLYVLASYSLFTCSIVEDEKNNGGQKRVYGLSQVGKFFVKNENGASMGPLLALLQNKVFINSWFELKDAVLEGGVPFDRVHGVHAFEYPKSDPKFNDVFNKAMINHTTVVMKKILENYKGFENLKTLVDVGGGLGVNLKMITSKYPTIKGTNFDLPHVVQHAPSYPGVEHVGGDMFESVPEGDAIFMKWILHDWSDSHNLKLLKNCYKALPDNGKVIVVEAILPVKPDIDTAVVGVSQCDLIMMAQNPGGKERSEEEFRALATEAGFKGVNLICCVCNFWVMEFCK

SEQ ID NO: 90169 - protein, 495 aa, Bradyrhizobium japonicum USDA 110
MMSVAYDFAHSPASEFMARPQHLLIDGRRVPASSGRTFKSLNPATGQVIATVAEGNEADVDHAVAAARRAFEGPWRTMRASERGQILLRWAELLKANAEEIIELESIDAGKPISATLRQDFPAAVDTLIYYAGWADKISGDVVPVRDDALTYTVREPVGVVAAIVPWNFPLMIGMWKLAPALACGCTIVMKPAELTSLSALRIAELALQAGLPAGVFNVVTGPGRVVGDALVNHPDVDKVTFTGSPGVGRGIMKGAAGNFKRVSLELGGKSANVIFDDADLEAASKAAASGIFFNAGQVCSAGSRVLVQEKAYDEVVERLAARAKSLKIGDPLDRKTALGPVISEKQMKSILDYVDIGQKEGASLVTGGTRVGERGYFISPAVFANVEHEMRISQEEIFGPVVSIIKFRDEADALRIANGTAYSLAAGVWSRDIGKLQRFAKRARAGTVWMNTYGYTDVRLPWGGERDSGLGREHGTAALDNFTEPKAVWMNLAV

SEQ ID NO: 90170 - protein, 449 aa, Colwellia psychrerythraea 34H
MVDSSRLTERLKNNQQFIHDFKAPVAGRLVRVVGLTLEAVGVKAHVGSQCLVETAHGDLLAEVVGFAQDITYLMPEESLRGVMPGARVLPISSKAKVPLSMGLLGRVINGVGKPLDSKGPIKADNDYHHDSKPINPLSRRAITEVLDVGVRSINSFISVGKGQRMGLFAGSGVGKSVLMGMMTRGTTADVVVVGLVGERGREVKEFIEEILGEEGLKRAVVVAAPADNSPLMRLKGCETAVQISEYFRDQGLNVLLLLDSLTRYAQAQREIALAVGEPPATKGYPPSVFSKLPQLVERAGNGGEGQGSITAFYTVLTEGDDLQDPVADAARAILDGHVVLSRELADAGHYPAVNIEGSISRVMPMVTSADHQELAKQLKQMYALYQQNKDLIAIGAYTKGNDPRIDQAINVLPVINFFLQQKINEVIPYDQSIAQLKEIIAAAHAHNNQ

SEQ ID NO: 90171 - protein, 362 aa, Glycine max
  misc_feature (41)..(41): Xaa can be any naturally occurring amino acid
APPPHCHLLLKTHMDKEGSSLRTSCDDDTTNNISVQNSFPXSICEDAVVADKKQNLMNFVLALRSGEWSDIGERPYMEDTHICIGDLAKKFNYDVPFEEAVSFYGVFDGHGGKSAAQFVRDNLPRVIVEDVNFPLDLEKVVKRSFLETDAAFLKTYSHEPSVSSGTTAITAIIFGRSLLVANAGDCRAVLSRHGRAIEMSKDHRPSCINERTRVESLGGFVDDGYLNGQLGVTRALGDWHIEGMKEMSDRGGPLSAEPELKLMTLTKEDEFLIIASDGIWDVFSSQNAVDFARRKLQEHNDEKQCCKEIVQEATKRGSTDNLTVVMVCFNFDPPPPVVVERTRVRRSISAEGLQNLNWLLKE

SEQ ID NO: 90172 - protein, 279 aa, Prochlorococcus marinus subsp. pastoris str. CCMP1986
MKHFADLLLNKNNSKSNDQVPFIQRRRGIEIKSAREINLMKKSSRIVGTVLREINDLIKPGMSTKDLDDFAEKRIREMGAVPSFKGYHGFPSSICSSVNNEVVHGIPNKNKIINDGDLVKIDTGAYLDGFHGDSCISICVGEVSNQAQKLSDVALKALFAGLSKIKSGNTLLDIAGAIEDIVKSNGFSVVEDYTGHGVGRNLHEEPSVFNFRTNELPNVVLREGMTLAVEPIVNQGTKYCKTLNDKWTVITKDGNLSAQWEHTIVVMKDGIEILTDRDF

SEQ ID NO: 90173 - protein, 444 aa, Lactobacillus sakei subsp. sakei 23K
MKTHFDTIVIGGGPGGLAAAYRLAEQQSVLVVENDLWGGTCPNRGCDPKKMLYSAVEAIDHQHTLQSSGLVGTSYINWPQLMAFKRQYTTQIPDGTLNGLQSAGIRTVTGTAHFIADHHLRVGETDYTADHFIIATGQTPTLPAIEGRDLLQTSNQFLDLDHLPAKIAFIGAGYIAIELANIAATAGAEVHIIQHNKRILRDFPEAMTTELITSLQNKGVQFHFETTVTKVYETTKGLVLNNAGGFTLTVDAAFAALGRHANIDELNLPAADIATGHHGIQVDEHLVSSNPRVYAIGDVVDRPQPKLTPVAGFEGRYVANQLLQTNSDPIAYPLIPHTVYASPQISQAGVSVQTAQENPDQYRLNQQTTTNWYTFNRIKEPNAIVTTIFDRQTNQLVGAAAYTTIAEELINYLTPLIKNHTTAAELTDTIYNYPSPASDLKYYY

SEQ ID NO: 90174 - protein, 248 aa, Listeria innocua Clip11262
MNKVALVTGSSRGLGREIAIALAKEGYDIAVNFSRNRKKAEEVQQEIEQLGRKCTIFKANVGDVEKVRALFKAVDEEFGRLDVFINNAASGVLRPIMELEESHWDWTMNINAKALLFAGQEAAKLMQRQKSGKIISLSSIGSIRYLENYTTVGVSKAAVESLTRYLAVELAPFGIAVNAVSGGLIETEALNHFPNREELLKDAVSKTPAGRMIEPNDLVNAVLFLASEKADMIRGQTILVDGGRTLLV

SEQ ID NO: 90175 - protein, 475 aa, Ustilago maydis 521
MLAPIRNSMLQRAGARLMRLGSIRSLATHASAAPITYTEAPASKPATLHLKTGEAFTGRSFGAPRSVFGETVFTTSITSYTESLTDPSYQGQILTFTQPLMGNYGVPDNGSGQSPVEHPADVDVGAFLESNKVQAAGVVVSNLAERFSHYLAKESLATWCARHNVPGIFGVDTRAITSLLRDQGSTLGAILVGDGHDKAPAVGDYVDPMAENLIAKVSTKQPYVLHPVGGAKAARAHVALMDFGCKANILRSLLRRGASVTVLPWNFDFNKVRDGFDGLFLSNGPGSPYSIEPALDMARKAIAEWDRPIFGICMGNQVIGIAAGVEAYRMKFGNRGHNQPVVALKSAGNFVKRGRVYITSQNHGYALTPDESKWPEGWQPWFVNANDSSVEGIIRTQLNEQRAMVWGVQFHPEHAGGPEDTNGIFEDFVEEVVRIKRSQGRDVGAGLPEHMHVNQGAPAFPAHEFGVVGQSPAHL

SEQ ID NO: 90176 - protein, 499 aa, Ipomoea purpurea
MRINPTTSGSEVSAVEKKNLGRIVKIIGPVLDVAFPPGKMPNIYNALVVQGRDNEQTNVTCEVQQLLGNNRVRAVAMSDTDGLMRGMEVIDTGAPISVPVGGSTLGRIFNVLGQPVDNLGPVDTNTTSPIHRSAPAFIQLDTKLSIFETGIKVVDLLAPYRRGGKIGLFGGAGVGKTVLIMELINNIAKAHGGVSVFGGVGERTREGNDLYLEMKESGVINEENIPESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQSILSGELDGLPEQAFYLVGNIDEATAKAMNLKNLEMESDLKK

SEQ ID NO: 90177 - protein, 159 aa, Clostridium tetani
MNITIISVGKLKEKYLKLAVEEYSKRLSRYCKLNIIEVTDEKTPDNASEKEELQIKEKEGDLILKNIKDNMFVIALDLNGNELTSIDFSNFINDLGIKGESNLTFVIGGSLGLSSKVLSRSNYKLCFSKMTFPHQLFRVMLLEQIYRGYRIMNGEPYHK

SEQ ID NO: 90178 - protein, 162 aa, Blastopirellula marina DSM 3645
MRHVLSAVVQNVPGVLAHISGMLASRGYNIDSLAVGETDVPNLSRMTFVVVGDDQVLEQVRKQLEKIVTVVRVLDVSSQDFVERDLMLIKVSTAGGKRSEIRELADIFRGRIVDVGAEEVVIEMSGTENKIIAFIESVRPFGIIELVRTGRIAIVRSGCNLE

SEQ ID NO: 90179 - protein, 361 aa, Oryza sativa Indica Group
MKALILVGGFGTRLRPLTLSVPKPLVDFGNKPMILHQIEALKEVGVTEVVLAINYQPEVMLNFLKDFESKLGIKITCSQETEPLGTAGPLALARDKLADGSGDPFFVLNSDVISEYPFAELIQFHKSHGGEATIMVTKVDEPSKYGVVVMEEETDKVERFVEKPKVFVGNKINAGIYLLNPSVLDRIELKPTSIEKEVFPRIAADNGLFAMVLPGFWMDIGQPRDYITGLRLYLDSLRKKAPANLASGAHVLGNVLVHETAVIGEGCLIGPDVAVGPGCVVEAGVRLSRCTVMRGARVKKHACISSSIIGWHSTVGMWARVENMTILGEDVHVCDEVYSNGGVVLPHKEIKSSILKPEIVM

SEQ ID NO: 90180 - protein, 268 aa, Prochlorococcus marinus subsp. pastoris str. CCMP1986
MSTSFKNVTPTGPGGTATLLIVLSFTGFLLLTQSLFVVPSGQVAVVTTLGKVSGGSRRAGLNFKVPFVQSVFPFDIKTQVQPEKFETLTKDLQVIRATATVKYSVKPNEAGRIFATIASRNSDVYQKIVQPSLLKALKSVFSQYELETIATEFNVISEKVASTVAEELNSFDYVDVKSLDLTGLEIAEEYRAAIEQKQIAGQLLLRAKTEVEIAGQEALRYETLNKGLNDQVLFKLFLDKWDGSTQVVPGLPGTSGSMPPVIVGGQSR

SEQ ID NO: 90181 - protein, 168 aa, Avena clauda
VMASSATSVAPFQGLKSTAGLAVSRRSNAGLGSVSNGGRIRCMQVWPIEGIKKFETLSYLPPLSEEALLKQIDFLIRSKWVPCLEFSKVGFIFRVHGSTPGYYDGRYWTMWKLPMFGCTDASQVIKEVEEVKKEYPDAYVRIIGFDNIRQVQCVSFIAFKPPGCEESG

SEQ ID NO: 90182 - protein, 369 aa, Brassica napus
  misc_feature (95)..(95): Xaa can be any naturally occurring amino acid
  misc_feature (127)..(127): Xaa can be any naturally occurring amino acid
MATVWRRLLKTETIPRISQSTRKLFSTDASSSFADRLRNLPKDFPSTQAKRDASLLIGRTPLVFLNRVTEGCEAYIAAKQEHFQPTCSVKDRPAXAMVADAEKKNLITPGKTTLIEPTSGNMGKISXAFIAALKGYKIIMTMPSYTSLERRVTMRSFGAELVLTDPAKGMGGTVKKAYDLLESTPDAHMLQQFANPANTQIHFDTTGPEIWEDTLGNVDIFVMGIGSGGTVSGVGQYLKSKNPNVKIYGVEPAESNILNGGKPGPHAITGNGVGFKPDILDMDVMESVLEVSSEDAIKMARELALKEGLMVGISSGANTVAAIRLAKMPENKGKLIVTIHASFGERYLSSILFDELRKEAEAMKPVSVD

SEQ ID NO: 90183 - protein, 526 aa, Lactobacillus sakei subsp. sakei 23K
MITVSEMSLTLSGRKLYEDVNLKFTPGNCYGVIGANGAGKSTFLKLLEGKLQPSSGHISMGPNERMSSLNQDHYAFEEFEVLETVIQGHKKLYEVMQAKDALYAKAEFTEEDGMKAADLEAEFAEMNGWDAESEAAQLLQALGIDESLHHVKMSELMEGQKIKVLLGQALFGKPDILLLDEPTNGLDSASVEWLENFLADFPNIVIVVSHDRYFLNQVCTMMCDVDFGRIKTFVGNYDFWLESSKLAAKLQSNVNAKKEEQIKELQDFIARFSANASKSKQATSRKKQLEKITLEDIQPSSRQYPFIKFDFERELGNDLLRVENVSKTIDGVKVLDNISFSVKPDEKAAIVSRNDVATAVLMQILAGEVEPDSGTVTWGVTSQQSYLPRDTNSAFNDDQLIILDWLRQFAAKGEDDNTFLRGFLGKMLFSGDEVTKEINVLSGGEKVRCILSKIMLQKSNTLLLDDPTNHLDLESITSLNDALIDFKGALIFTSHDHQFIQTIADHIIEVSANGLVDRAETNYDDS

SEQ ID NO: 90184 - protein, 415 aa, Mycobacterium smegmatis str. MC2 155
MHSDPSHIDLLGPATFTSRDRRPIGFPPLRCSRHKISWKEPSEMKTKAAVSLGVNRPFEIMELELDGPKEGEVLLKNVAAGLCHSDLHLTDGDMPPRYPIVGGHEGSAIVEDVGPGVTKVKPGDHVVCSYIPNCGTCRYCATGRSNLCDMGATILDGRFPDGTFRFHKDGVDYGSLCLLGSFAERTTVSQHSVVKVDEWIPLETAVLVGCGVPAGWGGPVYNNGIRPGDTAVIYGIGGLGINAIQGAVMAGARYVVAVDPVEFKRDMALKFGATHAFATAEEAHEAVREITWGQMADGALIFVGTPDEKVVSDAFNVIGKGGTVSLASLADPAKLTVHVSGMEMTLMEKTIKGCLFGSSNPQYDIVRLLRLYDEGKLKLDELITTRYRLEDINQGYDDLRAGVNIRGVIIHDPEA

SEQ ID NO: 90185 - protein, 302 aa, Thermoanaerobacterium thermosaccharolyticum
MKGIILAGGSGTRLYPITKAISKQIVPIYDKPMIYYPLSVLMLSGIRDILIISTPRDIDTFKELFGDGSQLGLHFEYAIQEVPRGLADAFIIGEKFIGKDNVALVLGDNIFYGYGFTERLERAASRKEGATIFGYHVSNPSDFGVVEFDDNFNVISIEEKPKYPKSNYAVPGLYFYDNDVIEIAKNVKPSARGEIEITSVNNEYLRRGKLKVELLGRGMAWLDTSTPAGLLNAANFVEAIQTRQGLYVACIEEIAYRKGYIDKEQLIKLAEPLKKVEYGKYLLNLLNDENTVQEVAAANVGL

SEQ ID NO: 90186 - protein, 335 aa, Candidatus Pelagibacter ubique HTCC1002
MTIKVGINGMGRIGRMVIRAIIESQNKNIEIKHINNRSNSEASCSLIKYDSIHGKFNADLNYDEKHLIINNDKITFSQESNIKDINWKKFDVDYVFECTGKFNSKEKLLTHIKNGAKKVIVSAPCKNADKTIVYGVNENILTKDDQIVSAASCTTNCLAPVANILNETFEIEKGFMTTIHAFTSDQRILDNSHKDPRRARSASQSIVPTSTGASKAIGEIIPSLKGKLEGIAMRVPTPNVSLIELVFCTKKEMSKETINEAFTIASKEQSKKVLEVTLEKLVSIDFNHNSASAIVDLSLTNVVGKNMGKISAWYDNEWGFSNRMCDIAEHLHQVS

SEQ ID NO: 90187 - protein, 147 aa, Zea mays
  misc_feature (29)..(29): Xaa can be any naturally occurring amino acid
  misc_feature (107)..(107): Xaa can be any naturally occurring amino acid
KDKGVSLMVPFDLVVADKFAPDASSQLSXVVPASAIPDAWMGLDIGPDSISAFSSALETTQPVIWNGPMGVFEFDKFAVGPKAIAKKLAELSGKGVTTIVGGGDSIXAAVEKVGVADSLSHISTGGGASLELLEGKELPGVAALDEA

SEQ ID NO: 90188 - protein, 180 aa, Oceanobacter sp. RED65
MVYALDDRQIQVHGEEYFIADSADLIGSVELHNNASIWFNVVVRADNDLIIIGEDSNVQDGSVLHTDPGFKLTLGKGVTVGHKAMLHGCDIGDYTLVGINSVILNGAKIGKHCLIGANTLIPEGMEIPDGSMVLGSPGKIKRELNDAQKKQLEMSAGFYVQNFKRYKAKLKAQQDFARQK

SEQ ID NO: 90189 - protein, 454 aa, Pseudomonas aeruginosa UCBPP-PA14
MSFSLWLLVLGCILLTLGLASAYLRLLPVSTSFLYLLFGLAIGPAGLHAWRSGLADISGWFEHLAEAALLISLFIGGLKLRLPLRSPAWTAAWLLAGPVLLGCILGLTLGAHFLFGLDWGLALLVAAILAPTDPVLASDIQVNHAGDDDRLRYAVSGEAGLNDGIAFPFVIAALLLIGQGGGLPGEFDRSGLDWLLRDVLWAIPAGLLVGYCLGHGLGRLAIHLRARHTDTSVSANDFLALALIALSYVGADALGGWGFLASFAAGIGLRHAEVATLGHASAPAEAQAAAADVREAGQASGAIEYGADRSEHPKVAAGAVMLDVLSFGNLLERSLEVLLVTLLGAMLYQHWDWRALPLALLLFCVCRPAMVWLLVGRRLMHPAQRRLLGWFGIRGIGSLYYLSYALNQGLPTALAHTASDLVLSLVALSICVHGLSIQPLLMRHARSVSRRDRE

SEQ ID NO: 90190 - protein, 337 aa, Triticum aestivum
MGKIKIGINGFGRIGRLVARVALQSEDVELVAVNDPFITTDYMTYMFKYDTVHGHWKHSDITLKDSKTLLFGQKPVTVFGIRNPEEIPWGEAGADYVVESTGVFTDKDKAAAHLKGGAKKVVISAPSKDAPMFVVGVNEDKYTSDINIVSNASCTTNCLAPLAKVIHDNFGIIEGLMTTVHAITATQKTVDGPSAKDWRGGRAASFNIIPSSTGAAKAVGKVLPDLNGKLTGMSFRVPTVDVSVVDLTVRIEKGASYEDIKKAIKAASEGPLKGIMGYVEEDLVSTDFVGDSRSSIFDAKAGIALNDNFIKLVSWYDNEWGYSNRVVDLIRHMFKTQ

SEQ ID NO: 90191 - protein, 277 aa, Oryza sativa Indica Group
MAAAAETSAKVGAPRRWSLQGKTALVTGGTRGIGRAVVEELAALGATVHTCSRKEEELSERLKEWEARGFRVTTSVCDLSVRDQRERLLRQVADLFGGKLDILVNNVGTNIRKPTTEFSAEEYSFMMATNLESAYHLCQLSHPLLKASGSGSIVFISSVCGLVAVFSGSLYAMTKGAINQLTKNLACEWARDNIRSNSIAPWYIRTSLTEGLLANKDFEGAVVSRTPLRRVGEPEEVSSLVAFLCMPGSSYITGQTISVDGGNRYKSSVRMMVLAEQ

SEQ ID NO: 90192 - protein, 308 aa, Oryza sativa Indica Group
MAEAVASGAAGRWTLRGKTALVTGGTRGIGYSPQHPSLVLPSRYPVRSETSTAEPLLLFHDQRGEFMRRHAVVDELAALGAAVHTCSRKEAELGERLREWEGKGFRVTGSVCDVSVREQRERMLREVAGLYGGKLDILVNNVGTNFSKQTTEYSADDYSFIMATNLESAYHLCQLAHPLLKSSGSGSVVFISSVSGVVAVSSGSVYAMTKGAMNQLAKNLACEWAKDNIRTNSVAPWYMKTSLVEDELARKDFADSVVRRTALKRVGEPEEVSSLVAFLCMPGASYITGQTISVDGGMTINGLYPTQD

SEQ ID NO: 90193 - protein, 340 aa, Vibrio vulnificus
MTKYQQIQQELIESPKTWLVTGVAGFIGSNLLEKLLKLDQTVVGLDNFATGHQHNLDEVQSLVTAEQWQRFTFIEGDIRDYPSCEQAVTGVDYVLHQAALGSVPRSIADPLTTNAANITGFLNMLQAAKEAQVKSFTYAASSSTYGDHPALPKVEENIGKPLSPYAVTKYVNEVYASVYARTYGFKATGLRYFNVFGRRQDPNGAYAAVIPKWTSAMINNEEVFINGDGETSRDFCYIENVVQMNMLAATGSEDALGEVYNCAVGGRTTLNTLFDTLKIELSNNNVNYSKNVTYRDFRLGDVRHSQASIEKANVKLGYEPKYNIQQGISEAMPWYVRFIK

SEQ ID NO: 90194 - protein, 92 aa, Triticum aestivum
VRTEGEFAAGHPAGPVNIPYMHSKGSGMAKNSGFLEQVSPIFRREDEIIIGCQSGRRSLMAAAELCSPGFSGVTDIAGGFSAWKENGLPINQ

SEQ ID NO: 90195 - protein, 443 aa, Kluyveromyces lactis NRRL Y-1140
MASYVAFCDSKGKPLLSRRYQDDVSQSAVESFQHLLLEREQESSVMPPCFHHNGIHYMYVQYNDVYVLALTRSVSVNATTMFAFMYKLINVVEEYVKRVEEESIRDNYIIIYELLDEMMDKGVPQVTETKMLKQYITQKSFKLTRSAKKQKNVARPPTELTNSVSWRPEGIKYKKNEAFLDVIESINMLMTQQGQVLRSEILGTVKVRSRLSGMPDLKLGLNDKGIFTTNDQEDSPEPVVSSKKKNSNIELEDLKFHQCVRLSKFENEKIITFIPPDGEFDLMTYRLSTPIKPLIWCDVKVQVHSGSRIEIHCRAKAQIKKKSVANNVEILIPIPEDADSPTFKYSRGNIKWVPEKNAILWKFSSFQGGKEYSMAAQLGLPSVSDAEPPKLKRPVQIKFQIPYFTTSGIQVRYLKIEEPKLQYNSYPWVRYITQSGDDYTIRL

SEQ ID NO: 90196 - protein, 448 aa, Mesorhizobium sp. BNC1
MTDSTSDVANGWKGRSSAPSMSDVHRSVPVQGMHSSWRRAAAFIGPGYLVAVGYMDPGNWATSIAGGSRFGYTLLVVALISNIMAIILQSLCARLAIASGRDLAQACKDAYPKSVSRTLWVLAEIAIIATDIAEVIGTAIGLNLLFGIPLEIGVVITALDVFLILYLQRLGFRWVEALVIALLAVIAVCFVLQIVLADPNWGDVIRGFAPTTEIVTNPEMLYLALGILGATVMPHNLYLHSGIVQTRNYGDSLPEKREALKFATIDSTVALMFALCVNASILILAAATFNTTGRTEIAELGEAHSLLAPMLGAAIAPTLFGIALLCCGINSTVTATLAGQIVMEGFLDIKLPPWLRRLITRAIAIIPAAAITIWYGESGTAQLLILTQVILSLQLSFAVFPLVMFTADRKKMGELVAPRALVAVAFFIAFAIAALNVTLLFDFLAPPA

SEQ ID NO: 90197 - protein, 325 aa, Corynebacterium glutamicum ATCC 13032
MGTMKAILVSRTGGPEVLEFTDTDAPKPTDDQVLVEVDMAGVNFIDTYYRQGEYHARLPFIPGFEGTGRVLEDPQGLIAAGTKVAWCDAMGSYAQQVCVPRDRLVAVPEGVSSEVAASMLMQGITAHYLTNGVYELEEGDSCLITAGAGGVGLLATQMAAAKGVRVYSVVSTDEKAELALDAGAYEVFRYSDNLAEQVRRHNGGRGVDVVYDGVGQSTFNESLEAVRPRGTVCLFGAASGPVEPFDPQLLNTHGSIFLTRPSIGAWTSEEGEFAKRAQAVTQAIVEGTLRVRVTGTYSLADAYIAHRDLQARSTSGSLVLEIPKD

SEQ ID NO: 90198 - protein, 392 aa, Candidatus Pelagibacter ubique HTCC1002
MRNIQDETNLNQKKVLLRLDLNVPLDNGKITDTTRIDKILPTINFLLKNEAKIIILSHVGRPKGKVVSELSLKPICEDLKNKLNENIRLISKNIKEINSNDLFNEQDEKIVTLENLRFYEEEEKNDNGFAKHLASLADIYVNDAFSCSHRAHASIFEITKFIPSYAGLQLNLEIDALTKITSEIQRPITCIIGGSKISSKINIIKNLITKFDNIVIVGGMANNILKYKECEIGKSIQEDNCDKIIEEIFSLSKKENCKIIYPEDVAVGKSLEGSAEIKELNNISKDELILDIGPKTIKAINLLIEESSTILWNGPAGYFENPNFAKGSIEIAKKIIEKNKNNTIYSVAGGGDTVSLLNGIGAINNFNFVSTAGGAFLEYLEGKELPGIKALN

SEQ ID NO: 90199 - protein, 336 aa, Candidatus Pelagibacter ubique HTCC1002
MSELNKIALKILSNGKGILAADESNGTMTKRLESVNVPSSPGNRLLFRETLFSSSGMKDFIGGVILYDETINQTSNSKQTIPELISKSGAVPGIKVDTGAKILAGSIEEKITEGLDGLRERLKDYYKLGARFTKWRGVFNISDKYPSKLSMHSNAHALARYSALVQECGMVPIVEPEVLMDGDHSAETCFNKTSEVIKRCFEELMINKIDLSGIILKPNMILAGTTADKKISSEEVAKLTLKCLKENVPTDVPGIAFLSGGQTEVEATENLNLINKYNDTNFIMTYSYGRALQQSALKFWSKDINNTSGTQKIFNHRANMCTLAAQGKWSKELEAE

SEQ ID NO: 90200 - protein, 484 aa, Corynebacterium glutamicum ATCC 13032
MVIFGVTGDLARKKLLPAIYDLANRGLLPPGFSLVGYGRREWSKEDFEKYVRDAASAGARTEFRENVWERLAEGMEFVRGNFDDDAAFDNLAATLKRIDKTRGTAGNWAYYLSIPPDSFTAVCHQLERSGMAESTEEAWRRVIIEKPFGHNLESAHELNQLVNAVFPESSVFRIDHYLGKETVQNILALRFANQLFEPLWNSNYVDHVQITMAEDIGLGGRAGYYDGIGAARDVIQNHLIQLLALVAMEEPISFVPAQLQAEKIKVLSATKPCYPLDKTSARGQYAAGWQGSELVKGLREEDGFNPESTTETFAACTLEITSRRWAGVPFYLRTGKRLGRRVTEIAVVFKDAPHQPFDGDMTVSLGQNAIVIRVQPDEGVLIRFGSKVPGSAMEVRDVNMDFSYSESFTEESPEAYERLILDALLDESSLFPTNEEVELSWKILDPILEAWDADGEPEDYPAGTWGPKSADEMLSRNGHTWRRP

SEQ ID NO: 90201 - protein, 246 aa, Candidatus Pelagibacter ubique HTCC1002
MQSISANLNVMIKAAEKASRALIRDFGEIEKLQVSIKGPTDFVSNADLKAEKIIIEELKKARPYYSIISEEEGSETNKDKEHTWIIDPIDGTTNFLHGIPHFAISIALKSGDEIVSGLIYDPIKDEMFYAEKESGAFFNNQRIRVSKKRELNSCLFATGGITKNEVDLPLRKSGSAALDIAYVAAGRYDGYFQNDLNLWNIAAGIILVKEAGGLINEIDLSRNKNIKIRASSMAINDKMLEKLKNF

SEQ ID NO: 90202 - protein, 400 aa, Pseudomonas syringae pv. phaseolicola 1448A
MTTACLMSTYQPLALSFTRGLGTHLWDQSGRQYLDAVAGVAVTNVGHSHPLLVEAIRDQAGLLLHTSNLYSIDWQQRLAQKLTCLSGLDRVFFNNSGAEANETALKLARLHGWHKYIERPLVVVMENAFHGRTLGTLSASDGPAVRLGFSTLPGDYLKVPFGDLAAFDKVCVTHGHRIAAVLVEPIQGEGGAQVAPTGYLKALRERCTRRDWLLMLDEIQTGMGWTGKWFAFQHEGIVPDVMTLAKGLGNGVPIGACLARGRAAQLFTPGSHGSTFGGNPLACRVGCTVIDIIEQQALVENAALQGSRLLERLRNVLGAHPQVLEIRGLGLMIGIELRQAIPELTRIAAEDYGLLINVTRGKVIRLLPPLVLNAAEVEQIVQGLLASLDSALYKSLERSA

SEQ ID NO: 90203 - protein, 294 aa, Burkholderia pseudomallei K96243
MTFDQWMRSVLERVETALGHYLPAGTVAPAQLHEAMRYAVLGGGKRVRPLLCHAAGELTGASEAARDAASAALEMIHVYSLVHDDMPCMDDDALRRGKPTVHVKYDEPTALLVGDALQSQAFVALTDAAALPADRQAALVRELALASGSIGMAGGQAIDLASVGVALTRDALETMHRMKTGALLRASVRMGALAGETPSGDAMRALDAYAAAVGLAFQVVDDILDVTTDSATLGKTAGKDAANDKPTYVSIIGLDASRALAAQLRADAHAALEPFGARAQRLAELADLVVNRVS

SEQ ID NO: 90204 - protein, 803 aa, Bradyrhizobium elkanii
MLLDLASRDGEFKEVTARMRRLMLNLLGGAKDYSVVPIQGGGSFAMEAALSSFVSRNDKPLVCINGIYGERIFKILRLWGVEALKLVKRATEPLEPQEVAEQLSRNPGVTHLCLVHCETTTGIVNPVDAIIEEARRRGVKTIVDGMSSFGAIDIDLSRGGPDVLVTSSNKCIEGPPGVAFVIASRELLEKAVQEPRSFVLDVRDQWLSLERTGEWRSTPPTHIVQATTKALEILEGEGIDARRRRYEKVRDDLVQELEGVVSPLLSAELQSPVCVAFRAPSGIADQAGFDGLYRHLAAHNLYIYSKLHLATRSFRVGCIGEIQPSWIEQLGCAFRTYFRSGPASSMGTPSTRQACERGVEMSSSFAKDSQLPFSAETAVLHAGYRRDPVTKAVAVPIYQNTAYELDGDLNHIADVYNVKADGFTYTRIINPTTRALEKRYAAVDMGSDSLAVASGQAATFLAIVNLSSGEVGDNIVASPYLYGNTWNLLHNTLKRLGISVRTADPRRPETFERAIDDRTICLFGEVISNPCLIPLPVKQLAEIGRKHGVPLVVDNTTTPLVCRPSDLGAAITTYSATKYICGHGTTLGGLIVDNGKFSYRGASRFPLFNSPDEAHGGIIWRNALQDVDDLGKSEVLLKARMTWLRDTGAAIAPFASFQLIQGLETLPLRMKQHCANARIVADVLKEHPKVRRVFYPGLFEGADRETVDQTLNPAYGHGAMVMFEVEDEQAGRKFIQNVDLMYHVSNVGDARTLVTHPVSTTHTTVPREKREAAGIFGGSIRLCVGIEDVDDIVRDLDRALSAI

SEQ ID NO: 90205 - protein, 286 aa, Pseudomonas aeruginosa UCBPP-PA14
MSEQRQTLPAQHQDQRPGHESEMQPKPEFVSADYRPAAKLEGKVALVTGGDSGIGRAVAVAFAREKADVLLVYLDENEDAAKTREIIESLGRQCLAFAGDVADAGFCRQVVDTLRQKWGRLDVLVNNAGEQHPQARLEDISEEQWEKTFRTNIFGMFQLTKAALPLMGKGGAIINTTSITAYKGNPQLIDYSSTKGAITSFTRSLSMNLVNRGIRVNAVAPGPIWTPLIPSTFSAEKVAHFGADTPMGRPGQPEELAASYVYLACNDSSYVSGQVLHVNGGTVVNG

SEQ ID NO: 90206 - protein, 101 aa, Glycine max
  misc_feature (44)..(44): Xaa can be any naturally occurring amino acid
  misc_feature (54)..(54): Xaa can be any naturally occurring amino acid
GRTIPPICTKPAMITRVLFETVFTLIGDHPMYLRPDDIQMCKRXEETRHISRVXSSYNDIIMAPIFAHKDILDLSKYATVSVINGLTDYNHACQIMADALT

SEQ ID NO: 90207 - protein, 341 aa, Bordetella parapertussis 12822
MTNRFETTCAQLRAQPQKWLVTGCAGFIGSNLLETLLGLDQAVVGLDNFATGHQHNLDEVRAAVTPEQWARFTFIEGDIRDLAACQRAVQGVDRVLHQAALGSVPRSLKDPITTNEVNIGGFLNMLVAARDAQVQAFVYAASSSTYGDHPDLPKVEERIGNPLSPYAVTKYVNELYADVFARSYGFSSVGLRYFNVFGKRQDPDGAYAAVIPKWTAAMIKGEDVVINGDGQTSRDFCFVENAVQANLLAAMAAPEGANQVYNVAYNARTTLTELFEHLRRALAGQGVSYEKAPVYAEFRAGDVRHSQADIGKAGKLLGYEPAYDILRGLEAAMPWYKQFLR

SEQ ID NO: 90208 - protein, 183 aa, Vitis vinifera
MSSPSKRREMDLMKLMMSDYKVEMVNDGMQEFYVDFHGPGDSPYHGGVWRIRVELPDAYPYKSPSIGFVNKIYHPNVDEMSGSVCLDVINQTWSPMFDLVNVFEVFLPQLLLYPNPSDPLNGEAAALMMRDRPAYEQRVKEYCEKYAKPENIGAAPEEKSSDEELSEDNYESSDEAVAGQADP

SEQ ID NO: 90209 - protein, 429 aa, Bordetella parapertussis 12822
MPKKFSNPADVHLAVVGLGYVGLPLAVEFGKKRPVIGFDINERRIAALKAGHDHTLEVEDDELAQAGQLSYTAEREELGKANVFIVTVPTPIDEYKQPDLTPLVKASETIGAVLKRGDIVIYESTVYPGATEEDCVPVLERVSGLKFNQDFYAGYSPERINPGDKAHRVNTIKKVTSGSTPEVAELVDQLYNEIITAGTHKASSIRVAEAAKVIENTQRDVNIALINELALIFNKMGIDTEAVLQAAGTKWNFLPFRPGLVGGHCIGVDPYYLTHKAQSIGYHPEIILAGRRLNDSMGGYVVSQLVKAMAKRRIHVEGARVLLMGLTFKENCPDLRNTRVVDIVRELGEYHVDVDVYDPWVDPAEAEHEYGITPVAKPAAGAYDAVILAVSHHQFVEMGAEAIRKFGKAEHILYDLKYVLAPDQADLRL

SEQ ID NO: 90210 - protein, 444 aa, Bradyrhizobium elkanii
MTGICDSCTNSAAAAMIGVSDFDGILRGKHVLGEDLSVGNKVIKFSEAVLAWDCSDRVIPAGFTQEPQSVFGDADLRVLSGTGRSVSYAGDQYLYLAEFAGAHESVCPRGILRKVLQRVADRGYSCSAGFEFEFMLFKENADIIEDKPFGQWAPLTRGPFGYSIARSVAHRELFGEILALCEKSRIPLSGLHFETGPGVIEASLRHCDALEAADRAIIFKSMIKAWAQTRGMMATFMAKVSENWPGQSGHIHVSMSADGQNVFYDSEAFRNVSKLMRQFIGGQLKYMNDFCVLAVPNFNSYKRLVPGCWAPIYPSWGIDNRSCAVRVIPGDPSAHRLEYRLPGADLNPYLALACAIGSGILGIETNAALPASIVGDASAEACLPSGRLPQSLAEATYRFAQSPAANDVFGERFVEAFSCSRRWEWEAVQHRVTDFERRRYFEII

SEQ ID NO: 90211 - protein, 195 aa, Prochlorococcus marinus subsp. pastoris str. CCMP1986
MANLNQPPSRVTPNLLHILDAFTDNTKSIVNTIVELNSNTINKYELITETGHLKLDRVGYSSLAYPFAYGCIPRTWDEDGDPLDIEIVGVTEPLVPGSIVESRIIGVMKFDDGGEVDDKVIAVLSDDKRMDHIHTFEDLGEHWLNETKYYWEHYKDLKKPGTCTVNGFYGIEEAVKVIQDCESRYQKEIEPKLVD

SEQ ID NO: 90212 - protein, 504 aa, Prunus dulcis
CLLLLFNGCLASRQHIFGQNKEWQLNQLEAREPDNHIQSEAGVTESWNPSDPQFQLAGVAVVRRTIEPNGLHFPSYVNAPQLIYIVRGRGVLGAVFPGCAETFEDSQPQQFQQQQQQQQFRPSRQEGGQGQQQFQGEDQQDRHQKIRHIREGDIIALPAGVAYWSYNNGEQPLVAVSLLDLNNDQNQLDQVPRRFYLAGNPQDEFNPQQQGRQQQQQQQGQQGNGNNIFSGFDTQLLAQALNVNPETARNLQGQDDNRNEIVRVQGQLDFVSPFSRSAGGRGDQERQQEEQQSQREREEKQREQEQQGGGGQDNGVEETFCSARLSQNIGDPSRADFYNPQGGRISVVNRNHLPILRYLRLSAEKGVLYNNAIYTPHWHTNANALVYPIRGNARVQVVNENGDPILNDEVREGQLFLIPQNHAVITQASNEGFEYISFRTDENGFTNTLAGRTSVLRALPDEVLQTAFRISRQEARNLKYNRQESRLLSATSPPRGRLMSILGY

SEQ ID NO: 90213 - protein, 85 aa, Chlamydia trachomatis
KIFYSLIPVSRFMIARTKIICTIGPATNTPEMLEKLLDAGMNVARLNFSHGTHESHGRTIAILKELREKRQVPLAIMLDTKGPEI

SEQ ID NO: 90214 - protein, 284 aa, Prochlorococcus marinus subsp. pastoris str. CCMP1986
MMDDSLRVSILSEALPYIQRFSGRKIVVKYGGSIMEDEKLKEAFFRDIALLSSVGVCPVVIHGGGPEINRWLNKLEISPKFENGLRVTDEKTMEIVEMVLMGRVNKQIVRGINKTGSLAVGISGLDGNLIQSRELGDGSHGLVGEVTQINPELLDPLIAKGYIPVISSIGSTADGISHNINADFVAGEVAAAINAEKLILLTDTPGILKEGDNPNSLVKQINLKDARKFIEKNIVSNGMLPKTECCIRALAQGVKAAHIIDGRIEHSLLLEIFTNSGIGTMINA

SEQ ID NO: 90215 - protein, 295 aa, Oryza sativa Indica Group
MSSPMHVRKAIHFVSMKAKLQSFGGLRLLLVGCLAALLLLFAVRTLSFTTSSATATAAREAAEAGCGKLPAAVAQAMVHYATANVTPQQTAAEIGVSLRVLQRRAPCNFLVFGLGLDSAMWAALNHGGRTVFLEEDASWIASVKAGHPGLESYHVAYDTRVTDADELIALRHEPACTSQPDLAAAAAASCRLALRGLPPVFHEVEWDLIMVDAPTGWTPESPGRMGAIYTAGMAARARTPGAGATEVFVHDVDRHVEDTFSKAFLCDGYLVEQVGRIRRFVIPSHRDKDGTPFCP

SEQ ID NO: 90216 - protein, 383 aa, Oryza sativa Japonica Group
MGLVYFWAATATRRWWPICVMSSTARPHGDVTVPDPAGGPHLPGAHNSRHDELYLWGVREVVVDLGAGTLSLISPTDIRPGFLPVFRSGSCADIGTKSYMEDEHVCVDNLIEHLGVRTPVIPAPGAFYGVFDGHGGTDAACFVRKNLLRFIIEDGHFPSSIEKAIRSAFVRADHAIADSHSLDRNSGTTALTALIFGRTLLVANAGDCRAVLGKRGRAVELSRDHKPSCRSEKIRIENLGGTVFDGYLNGQLSVARAIGDWHVKGSKGSISPLTAEPEFQEVRLTEEDEFLIIGCDGLWDVMTSQCAVTMVRKELMTHNDPERCSQELVQEALRRNSCDNLTVVVVCFSSDPPPQIEVPRFRVRRSISMEGLHMLKGALDSNA

SEQ ID NO: 90217 - protein, 252 aa, Listeria innocua Clip11262
MITLKSRREIDEMKAAGKILADTHKELKKIIKPGITSWDLEVFTDEFLRKNGATPEQKGFEGYEYAICASINDEICHGFPRKQKLNQGDIITVDMVVNYHGALADSAWTYAVGEVSDEVKHLMDVTHKALYLGIEQAQVGARVGDIGHAIQTYVESENLAVVREFIGHGVGPTLHEKPDIPHYGKAGKGLRLKEGMVITVEPMVNMGAWKAKMDDNGWTARTVDGSLSAQYEHTFAITKDGPEILTYQGEND

SEQ ID NO: 90218 - protein, 359 aa, Selaginella moellendorffii
MNSCSKAILKPSKDVVPLSTWILISKLKVEYMLTRGADGSFNRNLAEFHDRKASASLAPHDGVASMDVTIDRSSGLWSRIFLPAIAYAQEEQANRDDKVPIIFYFHGGSYAHSSANTALYDMVCRQLCRTCRAVVISVNYRRAPEHRCPAAYRDGLAALRWLRLQAARHVAATWLPPGADLSRCFLAGDSSGGNMVHHVGVAAATARHELWPVRVVGHVLLMPMFGGVERTASERRLDGQYFVTVKDRDYYWKLFLPEGADRDHPACNVFGPGSDAERVLGEIPVPKSLVVVAGLDLTQDWQLRYARGMERSGKSVEVLVLEDTPVGFFIFPNTEQYYRVMDKIRGFVRDEQEPMDSST

SEQ ID NO: 90219 - protein, 274 aa, Oryza sativa Japonica Group
MAEEQFLAVAVDAAKNAGEIIRKGFYQTKNVEHKGQVSLPSSTVDLVTETDKACEDLIFNHLRKHYPDHKFIGEETSAALGATADLTDDPTWIVDPLDGTTNFVHGFPFVCVSIGLTVGKIPTVGVVYNPIMNELFTAVRGKGAFLNGSPIKTSSQNELVKALLVTEVGTKRDKATLDDTTNRINKLLFKIRSIRMCGSLALNMCGVACGRLDLCYEIGFGGPWDVAAGALILREAGGFVFDPSGGEFDLMARRMAGSNSYLKDQFIKELGDTS

SEQ ID NO: 90220 - protein, 138 aa, Gossypium hirsutum
  misc_feature (106)..(106): Xaa can be any naturally occurring amino acid
GAKTNFKDYKKFPFKKLYLSKGKEIQTNLQIMSSAAATTTKGGRGKSKAKAVSRSSKAGLQFPVGRVARFLKKGRYAERVGSGSPVYLSAVLEYLAAEVLELAGNXARDNKKNRIIPRHIQLAVRNDEELSKLLGGVT

SEQ ID NO: 90221 - protein, 227 aa, Halobacterium sp. NRC-1
MLCLPSDHVVGDGFQETAETAVDVAARTDGLVTIGIEPDRPATGYGYIEPGDDHGDHSEVAVFREKPDAETASRLVDRGCLWNAGMFAWTPTAFLDAARSGPLDPLVDALATDADPATAFERVDPVSVDYAVLERAADVRVVPAAFDWDDLGAWNALGRLLDGENAVLGDATTIDATGNVLASDDKHVSVVGVDDLVVAAYDDRVLVVPRADAQRVRDVVAALDAPF

SEQ ID NO: 90222 - protein, 368 aa, Neurospora crassa
MATHNIVVFGGNHCGPEVVLEAIKVLKAIETNSPSACKFNLQNHLLGGASIDKHNDPLTDEALNAAKAADAVLLGAIGGPEWGTSSTVRPEQGLLKLRKELGTYGNLRPCNFASESLVDSSPLKAEVCRGTDFIVVRELTGGIYFGDRTEDDGSGYACDTEPYSRAEIVRIARLAGFLALAKNPPAKVWSLDKANVLATSRLWRKTVTDVISKEFPQLQLEHQLIDSAAMLLVKNPRALNGVVITSNLFGDIISDEASVIPGSIGLLPSASLGGIPDGKGKCNGIYEPIHGSAPDISGKGIVNPVGTILSVAMMLRYSLNLPKEADAVEAAVKAAIDNGTKTKDLGGNATTSDMGNAVVAELEKILKA

SEQ ID NO: 90223 - protein, 463 aa, Mycobacterium smegmatis str. MC2 155
MRIARHISELIGNTPLVQLNSVVPEGAGLVAAKIEYLNPGGSSKDRIALKMIEAAEVSGELKPGGTIVEPTSGNTGVGLALVAQQRGYKCVFVCPDKVSEDKRNVLRAYGAEVVVCPTAVPPDHPDSYYSVSNRLVTEIEGAWKPDQYSNQMGPESHYETTGPEIWADTEGKITHFVAGVGTGGTITGTGRYLKEVSGGKVKVIGADPEGSVYSGGTGRPYLVEGVGEDFWPTAYDPSVPDEIIAVSDADSFEMTRRLAREEALLVGGSCGMAVVAAIEVARKAGPDAVVVVLLPDGGRGYLSKIFNDAWMSSYGFLRTRLDGSVEKTVGDVLRGKSGALPDLVHTHPSETVRDAIGILREYGVSQMPVVGAEPPVMAGEVAGSVSERELLSAVFEGRAKLADAVAEHMSPPLPLIGAGELVSTAAKTLRESDAVMVVEDGKPVGVLTRHDLLGFLSEGGYRH

SEQ ID NO: 90224 - protein, 769 aa, Aspergillus nidulans FGSC A4
MSEVPASILRALSIPNPSKATLSTAGLGSGFTSTGVVRATVPGTDGQNEERKYFVKTSADGEAAKEMFLGEYESLNAISSAVPGFCPRAIAWGPLEEGGKPGKSYFLATEFLDLRAAGHGGPSLAQRLGKLHSTPAPIDPKTGKRLFGFPVPTFCGDTKQPNRSCESWAEFYANERLLTILATSEKRNGKDYGLRSLVEKTADIVVPALLGDGHLGYDTSGKGQGITPVVVHGDLWSGNASRGRIVGSGRKEDEVVGDVVYDPSACYAHSEYELGIMKMFGGFGSAFFNEYHKIVPKTEPVEEYEDRVRLYELIAGSEKRFTVTWQQLLDVPDSNPAVRKSSSGTFLEEIFKLGSRMAPEQQRDSRTAPGSDVALPDPPPIHPSFIQVAKPYIFEQTIQQCLAAMGVNPLREESLRLQGVTWIDNVRRALNLLTVKDAAAAALFMACKIEDTLKKSREILCAAYNLKLPQSEHISSDNQILDEPARGIIGLERLMLESSGFDFRTRHPQKTLIKLARQYRLTPQSEVSNVAYRISQDLYRTFAPLKQTTSTMAFSCLELAGRLLEQRIKEVELGTDYARWRTSREEVMETLLDLLELYTHNRSATTVGPHFPADRFLTVRIPLNKEAEEQNLPRYTNSIDEDKLTKDSRKGPATNSSKTEKGAPTTGALHHPLIPVTANGERPKPGEKGRDAAVRFIVDSEYAAAEKTQVAEYFKVEMEECIHEADTAQLLYATASTTARRIRTFRKRLHRRTACLQYVRIGLISVVSL

SEQ ID NO: 90225 - protein, 389 aa, Brassica napus
MASASFVKLNALSSPRISHRSFAHPSASPPPRVSFAIRAGAYSDELVKTAKTIASPGRGILAIDESNATCGKRLASIGLDNTEENRQAYRQLLLTTPGLGDYISGAILFEETLYQSTKDGKKFVDCLNDAKIVPGIKVDKGLVPLPGSNEESWCQGLDGLASRSAEYYKQGARFAKWRTVVSIPCGPSALAVKEAAWGLARYAAISQDNGLVPIVEPEILLDGDHPIERTLEVAEKVWSEVFFYLAQNNVMFEGILLKPSMVTPGAEHKNKASPETVAEYTLTMLKRRVPPAVPGIMFLSGGQSEAEATLNLNAMNQSPNPWHVSFSYARALQNSVLRTWQGKPEKIEDSQKALLVRAKANSLAQLGKYSAEGENEDAKKGMFVKGYTY

SEQ ID NO: 90226 - protein, 559 aa, Burkholderia sp. 383
MMFLPSRKPQTDRAGMTGTEPLRVNRDEHLARLETDTFDVLIVGGGVTGAYAAFDASLRGLRVALVEKSDFASGTSSKSSKMVHGGLRYIEQGNLGLVRHSLLERQRLRRNARHLVQRLPFLFPVMEREGVFDARLAKAFESLLWTYDIAGGWREGILHQKLTKAEVLSHCPTFNETYLTGGFLYFDARVDDARLTLNLVRTAAFHGAAVANHARVVELTRDGHGKVDGAIVHADGRERRIRARVVVMATGVWLRDWTGARKGDTAALQVRPAKGVHVAIPWLKIRNDCTVTIPVPGRNRRATITRWGNVSYLGTTDEDYDGDLDDVHCTRQELDFLLEGARSALKVDLNADDVVGSIAGCRPLVGPPGGKTIEMKRNHEIHVAPDGLVTIVGGKLTTSRHMAEQTIDTVGKLLGRRTRCHTKSAYLLGAAGYDPQAIVASGGLAAHLGERYGTEARFVGDLADAAPSLLAPIVEGLPYSEAEVLYAVRHEFARSVDDVLSRRTRARLMARDASARAAPRVGEILKAELGLSDAAVASQVRDYVAAVALEKSILMGDIG

SEQ ID NO: 90227 - protein, 448 aa, Arabidopsis thaliana
MGSIVEPWAAIAENGNANVTAKGSSRELRHGRTAHNMSSSSLRKKSDLRLVQKVPCKTLKNILSNLQEVILGTKLTLLFLAIPLAILANSYNYGLTPLAERVSFLTEQLAFYTGPTVGGLLNATCGNATELIIAILALANNKVAVVKYSLLGSILSNLLLVLGTSLFFGGIANIRREQRFDRKQADVNFFLLLMGLLCHLLPLLLKYAATGEVSTSMINKMSLTLSRTSSIVMLIAYIAYLIFQLWTHRQLFEAQQDDDDAYDDEVSVEETPVIGFWSGFAWLVGMTIVIALLSEYVVDTIEDASDSWGLSVSFISIILLPIVGNAAEHAGAIIFAFKNKLDISLGVALGSATQISLFVVPLSVIVAWILGIKMDLNFNILETSSLALAIIITAFTLQDGTSHYMKGLVLLLCYVIIAACFFVDQIPQPNDLDVGLQPMNNLGEVFSA

SEQ ID NO: 90228 - protein, 310 aa, Bacillus cereus ATCC 10987
MKKVLFLGDPGIDDSLAIMYGLLHPDIDIVGVVTGYGNVTQEKATSNAAYLLQLAGREDIPVINGAKIPLSGDITTYYPEIHGAEGLGPIRPPKNLSPNIKPFCVFFDILEKYKGELIIVDAGRSTTLATAFILEKPMMKFVKEYYIMGGAFLMPGNVTPVAEANFHGDPIASQLVMQNAKNVTLVPLNVTSEAIITPEMVKYITKHSKTSFNKLIEPIFTYYYKAYKKLNPKITGSPVHDVVTMMVAANPSLLDYVYRRVDVDTVGIAKGESIADFRPQPDSKALKNWVRIGWSLHYKKFLEDFVKIMT

SEQ ID NO: 90229 - protein, 349 aa, Zea mays
MGKIKIGINGFGRIGRLVARVALQSEDVELVAVNDPFITTDYMTYMFKYDTVHGQWKHSDIALKDSKTLLFGEKPVTVFGISCELVFEPLRVYRNPEEIPWGEAGAEYVVESTGVFTDKDKAAAHLKGGAKKVVISAPSKDAPMFVVGVNEDKYTSDVNIVSNASCTTNCLAPLAKVIHDNFGIIEGLMTTVHAITATQKTVDGPSAKDWRGGRAASFNIIPSSTGAAKAVGKVLPELNGKLTGMSFRVPTVDVSVVDLTVRIEKGASYEEIKKAIKAASEGPLKGIMGYVEEDLVSTDFTGDSRSSIFDAKAGIALNDHFIKLVSWYDNEWGYSNRVVDLIRHMFKTQ

SEQ ID NO: 90230 - protein, 586 aa, Sporosarcina psychrophila
MRKTKIVCTIGPASESPELLEQLIEAGMNVARLNFSHGNHAEHKARIDSIRKVAREKGKVVGILLDTKGPEIRTHSMMNGKLELVTGQKIDISMTQVEGNNDVFSVSYDKLIEDVNEGSVILLDDGLIQLEVTGKDVARGLIHTLIINSGSLSNNKGVNIPGVSVQLPGMTEKDAEDILFGIREGVDFIAASFVRRASDVMEIRALLENNNGSNLQIIPKIENQEGVDNIDEILNVSDGLMVARGDLGVEIPPEEVPLVQKNLIEKCNQAGKPVITATQMLDSMQRNPRPTRAEASDVANAIFDGTDAIMLSGETAAGIYPVESVQTMDRIALTTEAAIDYRSVVSTRRREKHGNMTEAIGQAAAYTAINLKVKAVLAPTESGHTAKMIAKYRPGCPVIAVTSSEMCSRKLSLIWGVYPIVGKKASSIDEILQESVEESVKHQYVGHGDVVIITAGVPVGEAGTTNLMKIHVIGDLLARGQGIGKDVAYGRTVVAKNAAEALAYDTEGAILVTNASDRDMMPAIEKCAGLITEEGGLTSHGAIVGLSLGIPIIVGVENATELIQHGKEITMDAESGVIYNGHASVL

SEQ ID NO: 90231 - protein, 494 aa, Bacillus cereus ATCC 10987
MSQLAVNLHEKVEKFLQGTKKLYVNGSFIESASGKTFNTPNPATGETLAVVSEAGREDIHKAVVAARMAFDEGPWSRMSTAERSRLMYKLADLMEEHKEELAQLETLDNGKPIRETMAADIPLAIEHMRYYAGWATKIVGQTIPVSGDYFNYTRHEAVGVVGQIIPWNFPLLMAMWKMGAALATGCTIVLKPAEQTPLSALYLAELIEEAGFPKGVINIVPGFGESAGQALVNHPLVDKIAFTGSTPVGKQIMRQASETLKRVTLELGGKSPNIILPDADLSRAIPGALSGVMFNQGQVCSAGSRLFVPKKMYDNVMADLVLYSKKLNQGAGLSPETTIGPLVSEEQQKRVMGYIEKGIEEGAEVLCGGSNPFDRGYFVSPTVFADVNDEMTIAKEEIFGPVISAIPFNDIDEVIERANKSQFGLAAGVWTENVKTAHYVASKVRAGTVWVNCYNVFDAASPFGGFKQSGLGREMGSYALNNYTEVKSVWLNLN

SEQ ID NO: 90232 - protein, 122 aa, Zea mays
MAAKLAQLRTQVTRAAEFASKHGCSYYKEVMEKNKQYVVQPPTVEKCQELSKQLFYTRLASLPGRYESFWKELDCVKQVWKNRKDLTVEDLGIASLFGVELYAWFCIGEIVGRGFTLTGYKV

SEQ ID NO: 90233 - protein, 504 aa, Bordetella parapertussis 12822
MANQTAQVAHWIGGQAAYGAEHGLQDIHDPATGEVAAQVGLGGGDTVAQAVAAARAAQPAWAAKSPLHRARVLNRFLALLEDNKETLARMILREHGKVISDARGEVMRGIEVVEFACGAPELMKGAMSINVGGGIDNWVQREPLGVVAGITPFNFPVMVPLWMMPMALATGNAFVLKPSPLDASPSLALAEMLGQAGLPAGVASVVQGGVQAVNALIDHPDVKAVSFVGSTAVARQIYERSAREGKRVQALGGAKNHLVVMPDADPEGAADALVGAAFGSAGERCMAISVAVFVGGAAEAVMPHILRKARALKVRRGMQEDAEMGAIVSAAARDRIAAYIASGVDEGASLLLDGREIAAADCGEGCGNGYWLGPTVFDRVQPSMRIYREEIFGPVLACVHVETLEQAIDLINGHDFANGVSLYTDSGTAARAFVQGIEVGMVGVNVPIPVPAAWQGFGGWKQSLFGDLHVYGEEGVRFYTRQKSVMQRWAAKAAGMSFAMPRSG

SEQ ID NO: 90234 - protein, 162 aa, Glycine max
  misc_feature (101)..(101): Xaa can be any naturally occurring amino acid
  misc_feature (113)..(113): Xaa can be any naturally occurring amino acid
  misc_feature (116)..(116): Xaa can be any naturally occurring amino acid
  misc_feature (140)..(140): Xaa can be any naturally occurring amino acid
MVRSKTAYQTDVSDHSTFAYRYDRTYLARDKIAEESILEEAAYQIIHDQLMLDGNSRLNLAAFETTWMEPERDKVIVADIDKNDDHMDEDPVSTELQNRSXNMIPHLFNAPLXSDXTAIGGGTVGSSEAIMWDGLAFHRXWRNRKTLDGKPYDIPNIVTGAN

SEQ ID NO: 90235 - protein, 458 aa, Pseudomonas syringae pv. phaseolicola 1448A
MLNNGLLQSTTSQKTNANYLDRQSRFESNVRSYPRKLPLAIAKAHGVWVTDVEGTTYLDCLAGAGTLALGHNHEAIMASLDSFLTSGMPMHTLDLTTAVKDAFSETLLSLLPGQGRDYCLQFCGPSGADAVEAAIKLAKTATGRHNIISFSGAYHGMTHGALALTGNTAPKNAVTNLMPGVQFLPYPHEYRCPLGIGGEAGTEALSYYFTQFIEDVESGVSLPAAVILEAVQGEGGVNPAPAAWLRQIREVTRKHGILLILDEVQAGFGRTGKMFAFEHAGIEPDVIVMSKAVGGGLPLAVLGFKREFDAWAPGNHAGTFRGNQMAMATGLATLEVLQRQNLAAQAAKRGDWLKAQLGLLQQRYPMMGQVRGRGLMLGIEIVDERKPADRLGSLPMDPELAVAIQQHCFKQGLLLERGGRNGNVIRLLPPLIITEEQCQLVIQRFEDALKAALAQLRK

SEQ ID NO: 90236 - protein, 353 aa, Magnaporthe grisea 70-15
METVQKREGWQKEPNKDQARGKTVGRAKPRVLLWRRVSADGVRGLSPKQIEGKQKIYEVLGNGTAEGKHAYEHDGPVFSVDYYKDGTKIVSGGADKQAKVCDMNTGQTAQVAQHEKPVRSVRWFDNNGSPMVITGSWDKTVKYWDLRQQSPVATLQCQERVYTMDVRDKLLVIGTADRYINVVNLNEPQKFYKTLQSPLKWQTRVVSCFTDANGFAIGSIEGRCAIQYVEDKDSSSNFSFKCHRDAPQGSVTSVHAVNDISFHPVHGTFSTAGSDGTFHFWDKDAKHRLKGYPNVGGSITATTFNKNGNIFAYAVSYDWAKGYQGNNSTYPNKVMLHPVQQDECKPRPSVKKR

SEQ ID NO: 90237 - protein, 328 aa, Clostridium perfringens str. 13
MAILVCGGAGYIGSHMVAELIENNKEVVILDNFEKGHEDAILGGKLYKGDLRDRKILDKIFTENNIEAVIDFAAYSLVGESMTEPLKYFNNNVSGTISLLEAMRDHNVKYIVFSSTAATYGEPENIPILETDKNLPTNAYGESKLLVEKILKWCDTAYGIKYTALRYFNAAGAHVNGKIGEDHSPETHLIPLILQVALGKRDKIMMFGDDYDTKDGTCVRDYIHVSDLASAHSLALERLMNGGESRIYNLGNGTGFTVKEVVEVARKVTGHPIPAEVAPRRAGDPAILIASSDKAIEELNWKPKFNSLETIIETAWNWHKNHPNGYEK

SEQ ID NO: 90238 - protein, 586 aa, Alkaliphilus metalliredigens QYMF
MKKTKIVCTIGPASESKEVFTELVKQGLNVARLNFSHGNHEEHGERIKMIKEVRRELEQSVAILLDTKGPEIRTGKFKDPEVLLAEGQVFTVTTRDVVGDQNMCSVSYEGLARDVKPGDEILIDDGLVGLRVQKIIQGTDVECIVENAGIVKNHKGVNVPGVQINLPAITEKDEGDIVFGIQMDIDFIAASFVRKASDVLAIKRILEENNADHIQIISKIENQEGMDNLDEIIEVSDGIMVARGDLGVEIPTEDVPLAQKEMILKCNKVGKPVITATQMLDSMMRNPRPTRAEVTDVANAIFDGTDAIMLSGETAAGKYPIESVKTMARIALRTEGAIDYRSLLNKKAQERELTITDAISHATCSTASDLQASAILIATSSGHTARMVSRFKPQAPIIAATTSERVMRKLSLTWGAYCLLVDEFQSTDDIIDATVEHALEKEYIKRGDLIVMTAGVPVGIAGTTNLLKVHIVGDVLVNGTGVGKIPATGKVVVIHQHDELGQETFNEGDILVVSCTDKDLIPLMEKAGAMIVEEGGITSHAAIVGLNLHKPTVVGAIGATEKLKTGDIVTVDTIRGLIYSGKTRVL

SEQ ID NO: 90239 - protein, 182 aa, Prochlorococcus marinus subsp. pastoris str. CCMP1986
MDLSLIPPSPMKGIVNLVVEIPAGSRNKYEYCSQAGIMELDRILHSSVRYPFDYGFVPNTLADDGSPLDAMVIMDEPTFAGCLIKARPIGVLDMHDCGKYDGKLLCVPISNPRQENIISINQIAPNQLEDVAEFFRTSKGLDGRTVQIDGWRDFEVVEELLRKCTPKKKKSFKVLKKSSIVK

SEQ ID NO: 90240 - protein, 707 aa, Coccidioides immitis RS
MALLTVASKANAAYILPVVTAATYVQVSSPDAGIKISFEDEDSVGVQKGKMELKLTDGKLIYDDDVLPYLRANYQVLQMGNKEQIDEWVNRSTELRNPDFKSLDKPMKELDSHLMLRSYIVGYSLTLADIVVWAALRGNKVAVANIRKAANNTSRWFNFIEASYPWVNNGPSELQASAQKKKAAASAAGASYNIGLKDTEHGVVTRFPPEPSGYLHIGHAKAALLNDYFAHEQYKGTMICRFDDTNPTKENQEFEDAIKHDLSLLGITPDKTSFSSDYFQEMYEYCVQIIKDGKAYADDTEKEQMQYERREGIASKNRDATVEQNLARFAEMKTGSPEGQRWCIRAKISVDDVNKALRDPVIYRCNLQPHHRTGSTWKIYPTYDFCVPILDSLEGVTHALRTTEYGDRNAQYAWMQEALGLRKVHIWDFSRLNFVRSVLSKRKLTQIVDQGTVWGWDDPRMPTIRGIRRRGMTVPALREFILKQGPSKNIVNQDWSKFWATNKKYIDPVAPRHTAIDKECMVEAKVQGAEGVTSAEKPRHAKNPDVGMKKVFYSNTILLDQVDAKSFKEGEEITLMNWGNAFVRKIHVDSSSGKVTGLDLELHLAGDVKKTEKKVTWLSKDQELVPVTTYDFDYLITKDKMEKDDEINAILNPKTETRTEVLADCNVASLVEGDIIQFERKGYFRVDRPYKDGQPAVLFNIPTGKTG

SEQ ID NO: 90241 - protein, 454 aa, Moraxella catarrhalis
MSVHTPVIPPQNATNDYYLTRQNEMESNVRSYPRKLPLAIAKAQGCWVTDVEGNEYLDCLAGAGTLALGHNHPATINAIKDVLDSGLPLHTLDITTPIKDAFTEKLLSFFPKDFVLQFCGPTGADGTEAAIKLAKTYTGRDNVIAFSGGYHGMTHGSLAMTGNLSAKEKVGNLMAGVQFMPYPHEYRCPLGLGGEAGVDALTYYFENFIEDVESGVVKPAAVILEAIQGEGGVVPAPKKWLQKIREVTTKHDIVLILDEVQAGFARSGKMFAFEHAEIIPDVVVMSKAVGGGLPLAVLAINKKFDAWSPAGHTGTFRGNQLAMAAGYNVLTQITENNLADNARIQGEFLRGELRKAAEQYPCIGHVRGRGLMTGVEIVDERQPADHMGSYPADGELAAAIQKACFDNKLLLERGGRGGTVVRLLCPITITQEECIEVITRFKKAVGEAVKAVRG

SEQ ID NO: 90242 - protein, 447 aa, Moorella thermoacetica ATCC 39073
MSIAERLERLPLSAFHYKMLFICGIGWLFDAMDVGLVSFVLPAVGKEWHLTATQMGALGSIGLLGMGLGAVFGGSLSDLWGRKRVFNYTLIFYGLATFLAGLSTNYAMLMVLRFLVGLGLGAEVPVAFTLASEFSPVQYRGRMAVLLESFWAFGWIAAALIGYLAVPHWGWRLAFFIGALPALYAAVLRRALPESPRYLEKIGKESEARAIVESIERSCGVDPGKVATSPAAATAETSVKATFADLWSSRYARRTLCLWILWFGINFSYYGIVTWLPSLMVGKGFAIIKSFEYVLIMTLGQVPGYFSAAYLVEKIGRKATLVSYLILSGVAAYMFSLSTTTSQIIWWGLAVYFFNLGAWGVLYAYTPEMYPTAIRATGSGWASFCGRIGAILAPVIVGQMIVVMGQAKAYPLIFVLFTAVFVITALGMLALGIETKGKTLEELAGIR

SEQ ID NO: 90243 - protein, 401 aa, Glycine max
MERLKWAQLGERLKTGGAQMGRMVSGKVKEMLQAPTPESKMVDEATLETMEEPNWGMNLRICGMINSDQFNGSEVVKAIKRKINHKSPVVQTLSLDLLEACAMNCDKVFSEIASEKVLDEIIRLIDNPQAHHQTRSRAFQLIRAWGESEDLAYLPVFRQTYMSLKGRDEPVDMAGGNSPHVPYASESYVDAPERYPIPQAELHDIDDPAAFSSNYQHISVEERKEHLVVARNSLELLSSILNSDAEPKTLKEDLTVSLLDKCKQSLSIIKGIVESTTNDEATLFEALYLNDELQQIVSKYEELDAAQSSGAQQPQNADTDKHDAKAVQNPNEVPENEESEAAQNLDRKLPQKSNTLEVNATEGERDDLAETKIVDGLAETKIVDDGTKEKNAESSFKRDTE

SEQ ID NO: 90244 - protein, 562 aa, Oryza sativa
MAGAVSALFLLDIKGRVLVWRDYRGDVSALQAERFFTKLLDKEGDSEAHSPVVYDDAGVTYMFIQHNNVFLLTASRQNCNAASILLFLHRVVDVFKHYFEELEEESLRDNFVVVYELLDEMMDFGYPQYTEAKILSEFIKTDAYRMEVSQRPPMAVTNAVSWRSEGIRYKKNEVFLDVVESVNILVNSNGQIVRSDVVGALKMRTYLSGMPECKLGLNDRVLLEAQGRATKGKAIDLDDIKFHQCVRLARFENDRTISFIPPDGSFDLMTYRLSTQVKPLIWVEAQIEKHSRSRIELMVKARSQFKERSTATNVEIEVPVPSDATNPNIRTSMGSAAYAPERDAMVWKVKSFPGGKDYMCRAEFSLPSITAEEAAPEKKAPIRVKFEIPYFTVSGIQVRYLKIIEKSGYQALPWVRYITMAGRCAWVGCSRRRRAAAGGDWRRTARPVANGRPPPSPRPLDAHTDMEAVPEVTGVDPGDDEVSEDARGGGGGAVCGEATEAAGDSRRRPYGGGGALCRSWISATTPSTSLRPSGSRAAGVVEFLWRLSTTEVRVRLVEVARR

SEQ ID NO: 90245 - protein, 349 aa, Bacillus cereus ATCC 10987
MITQEQIMNALKHVEDPELHKSIVELNMVRNIQMNGTEVKLEVVLTIQGCPLKAKIQQDIEESLHAIGASKVDLTFGSMTSEERAALTEKLKKNSRTETGMPSMLRPDSGVRFITVTSGKGGVGKSTVTINLATALARMGKKVGILDADIYGFSIPAMMETNQKPTMIDQTVIPVISHGVKIMSMGFFTEGNNPVMWRGPMLNKWIQNFLANTHWGELDYLLLDLPPGTGDVAIDVAAMIPQAKEIIVTTPHNVASFVASRVGVMAKHTKHEILGIVENMAYYEEQDGSKNYLFGKGGGEMLAEQLQTEVIAQVPFAKREENSGSSVYDEDSLVGEVFTSLAEDIIYKG

SEQ ID NO: 90246 - protein, 267 aa, Bordetella parapertussis 12822
MTIPSFGVGTFRLTGQTVIDSVRNAIDLGYRAVDTAQIYGNETEVGQAIAESGVARSELFVTTKIWTDNYARAKLLPSLRASLEKLRTDYVDLTLIHWPAPGNGVALPEYMEALAEAKALGLTRRIGISNFNIALTRQAIAAVGQGEIATNQIELSPYLQSARLTAFLREQGIAVTSYMTLAYGKVLKDPVLARIADKHRSTVAQVALAWALQQGYAVIPSSTKRENLASNLLARGLALDADDMARIAALERNGREVDPEGLAPAWD

SEQ ID NO: 90247 - protein, 491 aa, Oryza sativa Japonica Group
MAVAAPGQLNLDESPSWGSRSVDCFEKLEQIGEGTYGQVYMAKETETNEIVALKKIRMDNEREGFPITAIREIKILKKLHHQNVIQLKEIVTSPVEGNKYKGSIYMVFEYMDHDLTGLADRPGMRFTVPQIKCYMRQLLTGLHYCHVNQVLHRDIKGSNLLIDNEGNLKLADFGLARSFSSDHNGNLTNRVITLWYGPAVDMWSVGCIFAELLNGKPILTGKNEPEQLSKIFELCGTPDELIWPGVTKMPWYNNFKPQRPMKRRVKESFKHFDQHALDLLEKMLTLDPSQRISAKDALDAEYFWTDPLPCDPKSLPKYEASHEFQTKKKRQQQRQAEEAAKRQKLQHPPPHSRLPPIQNPGQPHQIRPGQPMHNAPPVAAGPSHHYAKPRGPGGPNRYPQGGNQGGYNPNRGGQGGGYGSGPYPQQGRGPPPYPGGGMGGAGGPRGGGGSGYGVGGPNYQQGGPYGASGPGRGPNYNQGGSRNQQQYGNWQ

SEQ ID NO: 90248 - protein, 285 aa, Arabidopsis thaliana
MAKDVEGPEGFQTRDYEDPPPTPFFDADELTKWSLYRAVIAEFVATLLFLYITVLTVIGYKIQSDTKVGGVDCGGVGILGIAWAFGGMIFILVYCTAGISGGHINPAVTFGLFLARKVSLIRAVLYMVAQCLGAICGVGFVKAFQSSYYDRYGGGANSLADGYNTGTGLAAEIIGTFVLVYTVFSATDPKRNARDSHVPVLAPLPIGFAVFMVHLATIPITGTGINPARSFGAAVIYNKSKPWDDHWIFWVGPFIGAAIAAFYHQFVLRASGSKSLGSFRSAANV

SEQ ID NO: 90249 - protein, 528 aa, Mesorhizobium loti MAFF303099
MRDFQFPGRSPVRATQAVAATSHPLSTLAAIEMLRAGGNAMDAAVCAAAVQGVVEPQSTGIGGDCFVLYCPKGQGDVLAFNGSGRAPAAATVDWYLDRGFSELPKQGPHAVTVPGAIDAWCRLLQDHGSKDLAEVLAPAIHYAENGYVVHDRVAFDWADPEIDLSADEHAARIFLPAGQAPKAGDIHRQPELAATLRIIAKHGRAGFYEGAVADDMVRRLNELGGLHSQEDFAATKGDYVAPVSTTYGGYDIHQMPPNNQGLTALLMLNVLSGFKLGGLDPNGAERLHLEIEAGRLAYQDRDRYVGDQDQVHVPIKQLLSGAYADRLRAEIHRDRAMMHLPRLELPGSDTVYISIVDRDRNAVSFINSTYYSFGSGVVGPKSGVVLQNRGSSFRLDPAHPNAIAPGKRPMHTIMPGMATKNGRVVMPFGVMGGGYQPFGHVHLLTNMIDFGMDPQLALDAPRVFYNDDTVEAERNVPAEAIEGLRKRGHRVVEPQHPLGGGQAVLIDWEKGTLTGASDPRKDGMALGY

SEQ ID NO: 90250 - protein, 163 aa, Glycine max
  misc_feature (28)..(28): Xaa can be any naturally occurring amino acid
  misc_feature (53)..(53): Xaa can be any naturally occurring amino acid
  misc_feature (58)..(58): Xaa can be any naturally occurring amino acid
  misc_feature (97)..(97): Xaa can be any naturally occurring amino acid
MVSLLSNSAMVRGTYEVYVAAMPLRAIXGPPQLLMSAAYFSYVGPPPFNSWIXQHSSXVCVLVFDFQPKDPEDIYVALAALYGRAVPGTVLVRQLKXLPRNKCWLVGYSKAEADAMEIAREFNKEWETNLRIGLHDCRDYTNSLVRQLTGEKDVLKRLRNVGS

SEQ ID NO: 90251 - protein, 266 aa, Halobacterium sp. NRC-1
MHDTDRVSVAERAARTGGAVALDAFRTGIDVETKSGKTDVVTEADRTAQRRVVDVIDAVYDEDTIVGEEADALKTVPDAGAAWVIDPIDGTNNFVRDTQLWATAVAAVVDGTPVAACNRFPALEDTYIAGADGATLNGTPISVSEKTDPETFVVAPTIWWDFDRRDEYAAACAAIVERFGDMRRYGCAQAVLSMVASGQLEATITNVVANPWDSVAGVHLVRQAGGVVTDIDGTRWTPGATGLVASNGTAHDAVLAAAQEIRAAAE

SEQ ID NO: 90252 - protein, 442 aa, Prochlorococcus marinus subsp. pastoris str. CCMP1986
MSIRLILVRHGLSSFNEKGLVQGRTDDSYLTDKGYEQALKSGEALSGINFDKIYSSPLVRAAETAKTIQKNLKGENNIIYDKNLLEVDLGSWSGLTINEIRKKYPEDYLLWKNDPENLTLESIHNSTYQPIKELYEQANEFIKSIFKIYLEKQEANILIIGHNAILRCLILLLIGKPKKGFRKIKLDNASFSILNIVKQRHSYKTQIECLNQTSHLDKRIPDQIGDSRIFLIRHGETNWNKEGRFQGQINIPLNNNGKDQAGKASKYLEEINFNKAFSSSMDRPYETAQIILQNKSDLEIKKIENLVEISHGLWEGKLENEIKQQWPELLKNWHEKPEEVLMPEGESIKEVSERSVKAWEEICLAQKNKDLTLLVAHDAVNKTLICNLLGIDFSNIWMIKQGNGGITVIDLFKDPQKDNVISALNITTHLGGILDSTASGAL

SEQ ID NO: 90253 - protein, 398 aa, Zea mays
ESWVRVSLGPSRDTLERPRPIAVSFRCSAAARSYNITLLPGDGIGPEVVAVAKDVLSFAGALEGVELRFQEKLVGGSALDATGVPLPDETLDEAKGSDAVLLGAIGGYKWDTNEKHLKPETGLLQLRAGLGVFANLRPAAVLPQLVDASTLKKEVAEGVDIMVVRELTGGIYFGKPRGFGTNDKGDDIGFNTEVYSASEIDRIARVAFEVARKRRGKLCSVDKANVLEASMLWRKKVTALASEFPDIELSHMYVDNAAMQLVRNPKQFDTIVTNNIFGDILSDEASMITGSIGMLPSASVGESGPGLFEPIHGSAPDIAGQDKANPLATILSAAMLLRYGLGEENAARRIEAAVTETLNHGFRTGDIYSPGTTLVGCKRMGEEVLKTVESLKEVAAVN

SEQ ID NO: 90254 - protein, 505 aa, Cicer arietinum
MGSRNIVQQQNRAEAAVPGAMKQKNIAGEKKNRRALGDIGNLVTVRGVDGKAKAIPQVSRPVTRSFCAQLLANAQTAAADNNKINAKGAIVVDGVLPDRRVAAARVPAQKKAAVVKPRPEEIIVISPDSVAEKKEKPIEKEKAAEKSAKKKASTLTSTLTARSKVASGVKTKTKEQIVDIDAADVTNDLAVVEYVEDMYKFYKSVENESRPHDYMGSQPEINEKMRAILIDWLVQVHHKFELSPETLYLTINIVDRYLASETTIRRELQLVGIGAMLIASKYEEIWAPEVHELVCISDNTYSDKQILVMEKKILGALEWYLTVPTPYVFLVRFIKASMTDSDVENMVYFLAELGMMNYATLIYCPSMIAAASHQVYAARCTLNKAPFWNETLQLHTGFSEPQLMDCAKLLVAFHKMAGDQKLKSIYRKYSNLERGAVALLSPAKSLFVFLIELLMNAIEKMQCSLFFTSEIWCRFLTCFGRNISPGCSLVLLQRNFLIPLILYAL

SEQ ID NO: 90255 - protein, 216 aa, Gossypium hirsutum
VYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGV

SEQ ID NO: 90256 - protein, 160 aa, Moorella thermoacetica ATCC 39073
MLHLTIVAVGRVREKYLVAGIEEYLKRLRPYARVRILEAPEEKVPDKPSPAGVEQILASEGRGIGRLIPPSSFTVALDREGVMLSSEELAGRLADLALAGKNEVALIIGGTLGLATFILQQADLRLSFSRFTFPHQLMRLILLEQLYRAFKIQRGETYHR

SEQ ID NO: 90257 - protein, 314 aa, Clostridium perfringens str. 13
MAKKIATREAYGKALAALANENKNIVVLDADLSKSTKTADFKKACPERFINMGIAEGNMMSVAAGLSTCGKIPFASTFAMFAAGRAFEQIRNSICYPRLNVKICATHAGLTVGEDGASHQAIEDLSLMRSIPNMTVICPSDAVETEAAIRAIAEYNGPCYVRLGRAGVNVINDRPEYKFEIGKGIELKEGNDVTLFATGIMVDVAIEAVEALAKEGINARLINIHTIKPIDSELILKAAKETGAIVTLEEHNIIGGLGSAVAEVVGGEYPVPVVRVGVKDTFGESGKPDQLLKAYGLTSEEAVKAAKKAMSLKR

SEQ ID NO: 90258 - protein, 751 aa, Candida glabrata CBS 138
MFQNKARNSDTEMRSGNQMESSIEDIQELEPPPDLDSPPSTIPLKSMHENYEILEELGNGSFGSVTLAKYKINDCFSKDQDRKRMTMMDPKYNNRPENISNSRKQGLVAIKTMLTRLPTLHDYTRVREVKFILSMTANKHLIQVYEIFVDSEKYQLHIAMEYMEQNLYQMMRRRKKRVFSIPSLKSILAQVLAGLRHIHDQNFFHRDLKPENILITPSTRYFDSSWLEKGNYPDNYVVKLADFGLARHVENKNPYTAYVSTRWYRSPEILLRSGYYSKPLDIWAFGCVAMEVTVFKPLFPGSNEIDQIWKILEVLGTPHTLEESKNSNYTPHGGLWELSKAYAAKLNLKFPYVEGSSLEKLLCSNQLTDLLAVIKLCLKWDPNERASVEQLSSMPFFTNTVADNSIYEKENNTNKNTLRSIAEQALLFAGLPSSLSLKSLRGNIKLRDTEELVTDEQPNDREKDTNFENVPLDDRSESLSIRREDRVPLTTSTNKKESQCSAKDICRDSSFMLRSISQSKKRKKLDNNKLQIDSSANSNNNESNKIIGCSTYRFPNFQGNFASKQDQNIELGNCNGSEITKTDFMKSGQLHQCNRINEEIQNELSKPITFEEQNANNIEKEPFSTVPERCPTDYTAFTFNNITGNDYTFGCQFFKTKKETGRLPHESSHSVNELLDNMSIEDLPLKSNQMTELEPRTIPISLVDQFGSDNLNYNIFENNSELRSPNTNEAKASTYEFAFSNPCHAIGNITF

SEQ ID NO: 90259 - protein, 248 aa, Desulfococcus oleovorans Hxd3
MPIEMDTRDGVMILAMDNAPENAFNSEMIAQFNAALDDIKADDAISGVVVTGAGGQFFSSGMDLSYVMGLEAGAIKEFFKELFTFFHRAFVFPKPMVAAVNGHAVASALAFSMCLDYRVMQNQKAVCTFPEIDVSIMPPSGCLAMVKYVIGERMTDLAFLSGRKFDGPAALAVGMVDELAEGRAVIDRAVAVAGELGEKKPRLFAAYKKRFRGETADCMLAEDLRYIDEEMDVTMFQNCDLSCLRSLS

SEQ ID NO: 90260 - protein, 446 aa, Aspergillus nidulans FGSC A4
MSKSRRSVRFQHRSDGRRPSISDASDAASDPGSPSKNGVVAQPATIPEEKTEAPPLDEYQKKKQTFITRTIWTFVMIAGFFIAMFSGHIYIIGLVTAVQIISFKEVIAIANVPSKEKNIRFTKSLNWYFLGTSMYFLYGESVIYYFKHILLVDRVLLPLASHHRFISFVLWIMGFVFFVASLQKGHYRFQFTQFAWTHMALYLIVVQAHFVMNNILEGMIWFFLPASLVITNDIFAYVCGITFGRTQLIQLSPKKTVEGFLGAWVCTIIFGYFMTNILMRYKYFICPVYDLGSNVLTGLECDPNPVFVPQAFEIPEWTGFGRTFYVAPMQFHILLFATFASLVAPFGGFFASGLKRSFKIKDFGESIPGHGGITDRMDCQFIMGFFAYMYYHSFIAVFKASVGDIIEAAINGLTVDEQLEVLRGLSKYLYNQGAVPESCLGDAYNL

SEQ ID NO: 90261 - protein, 158 aa, Polytomella parva
NLVSMVFSRRGYNIQSLAVGNSEREGMSRICMVVPGNGQCIQALINQLNKLVYVRNVTDLTELPFVNRELLLVKVKCSSSQRGELRDLVSIFRGNIVDMGGSTAIVEVVGKEEKLKAFTDLLEPFGVLEVARTGRVAMERDSGVNVEFLERHTINRVY

SEQ ID NO: 90262 - protein, 521 aa, Populus trichocarpa
MLTKNLYFTMNYMYYCLAFFLSSFLVFKLVFQRSRNLPPSPFGFPIIGHLHLVSKPPMHKVLAILSNKCGPVFTLKLGSRNIVAVCSLSAAEECYIKNDIVFANRPQSIFVHYWSYNYAAFLFAPYGHLWRTLRRFSVTELFSRSCLDRSAAISEEVRTLVRLILSKVSDDGAKKVDLNYFFTITSLNVIMKMNAGKKWVEEEKAACIDSGKQCIEDVQKIFPSNPGTTVLDFFPFLKWFGYRGEEESVIKVYKERDEFLQGLIEEVKRKETSSVTSNPAEGVKDQTTVIGSLLALQKSDPELYTDEVVKGTMATLYLAGVDTVDFTTEWAMTFLLNHPERLERVKAEIDREVGHERLVQESDLPKLRYVRCVVNETLRLYPPAPLLLPHAPSEDCIVGGYKIPRGTIVMVNAWAIHRDPKLWEDPESFKPERFEGLNNEGEKQGFIPFGIGRRACPGNHMAMRRVMLALAALIQCFEWERVGKELVDMSIVDALISVQKAKPLEAICTPRPFTTTLISPP

SEQ ID NO: 90263 - protein, 520 aa, Trametes hirsuta
MSRFQSLLAFVVASLAAVAHAAIGPTADLTISNAEVSPDGFARQAVVVNNVTPGPLVAGNKGDRFQLNVIDNLTNHTMLKSTSIHWHGFFQKGTNWADGPAFVNQCPISSGHSFLYDFQVPDQAGTFWYHSHLSTQYCDGLRGPFVVYDPNDPHASLYDVDNDDTVITLADWYHTAAKLGPAFPLGADATLINGLGRSPSTTAADLAVINVTKGKRYRFRLVSLSCDPNHTFSIDGHDLTIIEVDSINSQPLVVDSIQIFAAQRYSFVLNADQDVGNYWIRANPNFGNVGFAGGINSAILRYDGADPVEPTTTQTTPTKPLNEVDLHPLATMAVPGSPVAGGVDTAINMAFNFNGTNFFINGASFVPPTVPVLLQIISGAQNAQDLLPSGSVYSLPSNADIEISFPATAAAPGAPHPFHLHGHAFAVVRSAGSTVYNYDNPIFRDVVSTGTPAAGDNVTIRFRTDNPGPWFLHCHIDFHLEAGFAVVFAEDIPDVASANPVPQAWSDLCPIYDALDVNDQ

SEQ ID NO: 90264 - protein, 729 aa, Salmonella typhimurium LT2
MLYKGDTLYLDWLEDGIAELVFDAPGSVNKLDTATVASLGQALEVLEKQHDLKGLLLRSNKAAFIVGADITEFLSLFLVPEEQLSQWLHFANSVFNRLEDLPVPTLAAVNGYALGGGCECVLATDYRLATPDLRIGLPETKLGIMPGFGGSVRLPRMLGADSALEIIAAGKDVGAEHALKIGLVDGVVKQEKLIEGAIAVLRQAITGDLDWRAKRQPKLEPLKLSKIEAAMSFTIAKGMVAQTAGKHYPAPMTAVKTIEAAARFGREEALNLENKSFVPLAHTNEARALVGIFLNDQYVKGKAKKLTKDIETPKQAAVLGAGIMGGGIAYQSAWKGVPVIMKDINDKSLNLGMTEAAKLLNKQLERGKIDGLKLAGVISTIHPTLDYAGFDRVDVVVEAVVENPKVKKAVLAETEQKVRPETVLASNTSTIPIGELASALERPENFCGMHFFNPVHRMPLVEIIRGEKSSDETIAKVVAWASKMGKTPIVVNDCPGFFVNRVLFPYFAGFSQLLRDGADFRKVDKVMEKQFGWPMGPAYLLDVVGIDTAHHAQAVMAAGFPQRMQKDYRDAIDALFDASRFGQKNGLGFWRYKEDSKGKPKKEEDAAVDDLLASVSQPKRDFSDDEIIARMMIPMINEVVRCLEEGIIASPAEADMALVYGLGFPPFHGGAFRWLDTQGSAKYLDMAQQYQHLGPLYEVPEGLRNKARHNEPYYPPVEPARPVGSLKTA

SEQ ID NO: 90265 - protein, 286 aa, Streptococcus agalactiae 2603V/R
MITLKSAREIEAMDRAGDFLASIHIGLRDIIKPGVDMWEVEEYVRRRCKEENVLPLQIGVDGAVMDYPYATCCGLNDEVAHAFPRHYTLKQGDLLKVDMVLSEPLDKSIVDVSSLNFDNVAQMKKYTETYSGGLADSCWAYAVGEVSQEVKDLMSVTREAMYIGIEKAVIGNRIGDIGAAIQDYAESRGYGVVRDLVGHGVGPTMHEEPMVPNYGTAGRGLRLREGMVLTIEPMINTGTWEIDTDMKTGWAHKTLDGGLSCQYEHQFVITKDGPVILTSQGEERTY

SEQ ID NO: 90266 - protein, 495 aa, Mesorhizobium loti MAFF303099
MATVIVEAREATSESGIPHIENAGQYPRMMELLNRQGRAEAVRRLRQACRFPVYGALSKDGEHLTYDYDVLRHEREAHLGPIWHFYAKPLHITRARGAWMYAADGTAYLDVYNNVPQIGHCHPHVAKAIYRQASALNTNTRYMCDVAVEYAARLTADLPDHLDTCIFVNSGSEANDLAMQIAMSLSRQDGGLIIDQAYHGCTELTTALSNESWRHLPADEHPKRIETLTAPDMYRGPFSRDRQAAAKYAADADRAIAALRERGHRPAAFMVDTALCSSGVLRAPENYFNLVAEKVRATGGFVIADEVQAGCGRMGAFWGFRANGLKDENIDFITMGKPVGNGHPLGVVILSSELMKRFLNGTYPLLFSTFGGNTVACAAGMAVLDVLEREDLIKRGAAIGEYLRQELGRLAEQHPAIGDVRGLGMMAGVELVTDRLTKEPAITLTERLIADMLARNILIGKGTPNTLKLRPPLIWSRDEVDIFVDAFDDSLRKHQ

SEQ ID NO: 90267 - protein, 237 aa, Candida albicans SC5314
MFVNKRLLAYIPKRLYHFKTLPTPNPNALKFISPECNILPMNDKTFEFTTTLQAIHSPLALTLFKIPGVKSVMLGHDFLTVNKQDYINWANLRPEIVEQLDEFLTSKKHPVITKELVDEAQREAEEESELISMIKELIETRIRPAIQDDGGDIELKGFDEETGTVFVKLQGACKSCSASEDTLKHGIESMLMHYVEEVKEVIQILDPEEEIAVKEFERLEQKLKNGNSQGEQAPPSL

SEQ ID NO: 90268 - protein, 226 aa, Oryza sativa Japonica Group
MLETGQEFTFTIKRGVGTETCVSVNYDDFVNDVEVGDMLLVDGGMMSLLVKSKTEDSVKCEVIDGGELKSRRHLNVRGKSATLPSITDKDWDDIKFGVENQVDYYAVSFVKDAQVVHELKDYLRSSNADIHVIVKIESADSIPNLHSIITASDGAMVARGDLGAELPIEEVPLLQEEIIRMCRSMGKAVIVATNMLESMIVHPTPTRAEVSDIAIAVRDRIYGYPT

SEQ ID NO: 90269 - protein, 298 aa, Oryza sativa Japonica Group
MASKFVVGSSHGPQIRSPHSLDRAKMGGGSGVGDEEAEAEAAAAAEVTGRGGARGDVGGGGGGAGEAAAAVRTGGERRRRCGRVGGVEIPGGNTLDVFMDGDTIPIHTTITSSHSLAAQFINEIARERPQGGLIVGIDTEWRTDHLPNGKTCYKVAVLQLCVGRRCLLFQIYQAGNMVPHELAEFLADPSVRFVGVAVNNDMQRLANDCNLRVACAVDLRYAAAAVLGQPELARAGLKRLALTVMGAHMEKEKNITKSRWGEPTLTWEQVNYACIDAYVSYEIGRRLLSGEPILAAPL

SEQ ID NO: 90270 - protein, 509 aa, Bacillus licheniformis ATCC 14580
MPAEKELYERIRRIQEGGAEKYHEANKKKGKLFVRDRLKLLLDEGLDLEDAFFANCMADGLPADGVVTGIGKIGGRTVCVMANDSTVKAGSWGARTVEKIIRIQETAEKLNCPLLYLVDSAGARITDQVDMFPGRRGAGRIFYQQVKLSGRIPQICLLFGPSAAGGAYIPAFCDIVIMVEGNASMYLGSPRMAEMVIGEKVSLEEMGGARMHCSVSGCGDILADTEEDAIKSARRYLSYFPSNYTEKAPVIEAKSARPFDRSLEDIIPKNQNAPFQMMDLIDRIIDEASFYEIKKLFAPELITGLARIHGQPVGIIANQPRVKGGVLFHDSADKAAKFINLCDAYHIPLLFLADIPGFMIGTKVERAGIIRHGAKMISAMAEATVPKISVIVRKAYGAGLYAMAGPAFEPDCCLALPTAQIAVMGPEAAVNAVYAKKIAELPEEERSAFIAEKRKEYQKDIDIYRLASEMIVDGIIPADSLRTELIKRLNAYMTKYMTFTERKHPVYPV

SEQ ID NO: 90271 - protein, 558 aa, Vitis vinifera
  misc_feature (125)..(125): Xaa can be any naturally occurring amino acid
  misc_feature (280)..(280): Xaa can be any naturally occurring amino acid
MLCLASKTRHFKWEVEYMYWSPDCMEGVVMGINGQFPGPTIRAVAGDTIVVELTNRLHTEGVVIHWHGIRQFGTPWADGTASISQCAINPGETFIYRYKVDKAGTYFYHGHYGMQRSAGLYGSLXVEVGEGQKEPFHYDGEFNLLLSDWWHKGSQEQEVALSSKPFRWIGEPQTLLINGRGQYNCSLAAHVTNSSSPQCQFRGNEQCAPQILHVQPHKTYRLRVSSTTALASLNLQIGNHKMVMVEADGNYIQPVAVDDLDIYSGESYSVLIHTDQDPSXNYWISVSVRGREPKTPQGLTILNYQTTSASKLPTSTPPVSPLWNDYNHSKSFSNKILALMGSPKPPTTYNRRIILLNTQNTINGFTKWAINNISLTLPPTPYLGAIKHRLSNAFDQKSPPENFPNDYDVMKPPTNTNSTYGNGVYMLEFRTTVDVILQNANALATGVSEIHPWHLHGHDFWVLGYGEGKFREKDAKRFNLKNPPLRNTAVIFPFGWTALRFVADNPGVWAFHCHIEPHLHMGMGVVFAEGVHLVKDVPNHALACGLTGKMLMSNYSHH

SEQ ID NO: 90272 - protein, 379 aa, Streptococcus agalactiae 2603V/R
MKNEMLALILAGGQGTRLGKLTQSIAKPAVQFGGRYRIIDFALSNCANSGINNVGVITQYQPLELNTHIGNGSSWGLDGIDSGVTVLQPYSATEGNRWFQGTSHAIYQNIDYIDRINPEYVLILSGDHIYKMNYDDMLQTHKDNLASLTVAVLDVPLKEASRFGIMNTDSNDRIVEFEEKPEHPKSTKASMGIYIFDWKRLRTVLIDGEKNGIDMSDFGKNVIPAYLESGERVYTYNFDGYWKDVGTIESLWEANMEYIGEDNKLHSRDRSWKIYSKNLIAPPNFMTEDANVKDSLVVDGCFVAGNVEHSILSTNVQVKPNAIIKDSFVMSGATIGEGAKINRAIIGEDAVIGDGVVIDGSKEVEVIGYKEVAGVPNED

SEQ ID NO: 90273 - protein, 254 aa, Exiguobacterium sibiricum 255-15
MIMRLDGKVIIVTGAASGMGKAMAEIFAAEGAHVVVSDIHGEAARQVAQSITENGGTALAVETNVAEETAVQQLIDQTITTYGKLDVLVNNAGIMDGMEGVGDISDERWERVFSVNTTAVMRAMRLAVPLFQKQGHGVILNNISIGGLNGARAGAAYTASKHAVVGLTKNTAYLYAKEGIRCNGIAPGAVETNIGQSMTNINEFGMGRTMLGMGLNPRSAKPEEIARLALFLVSEESSFVNGAIVIADGGWSAY

SEQ ID NO: 90274 - protein, 198 aa, Zea mays
  misc_feature (117)..(117): Xaa can be any naturally occurring amino acid
  misc_feature (165)..(165): Xaa can be any naturally occurring amino acid
  misc_feature (178)..(179): Xaa can be any naturally occurring amino acid
MANLADSFLADLDELSDNEGYPEEDNAEAAGRDDDEDDDMPDLESLNYDDLDSVSKLQKTQRYNDIMQKVENALQKGTDFSNQGSILEEDPEYQLIVDCNALSVDIENEIIIIHNFXIRDKYRLKFPDLESLVHHPIDYARVVKKIGNEMDLTLVDLEGLLPSAXYMGVSVTASTTSXXSPLSEDNFGKTTEACDRAL

SEQ ID NO: 90275 - protein, 419 aa, Magnaporthe grisea 70-15
MATTQTTQGQIQPCRYKVGKTLGAGSYSVVKECVHIDTGRYYAAKVINKRLMAGREHMVRNEIAVLKKVSMGHQNILTLVDYFETMNNLYLVTDLALGGELFDRICRKGSYYESDAVDLIRATLSAVAYLHDHGIVHRDLKPENLLFRTPEDNADLLIADFGLSRIMDEEQFHVLTTTCGTPGYMAPEIFKKTGHGKPVDIWALGVITYFLLCGYTPFDRDSDLEEMQAILNADYSFTPIEFWRGVSDSAKDFIRRCLTIDPTKRMSAHEALQHPFVAGYLADKGANLLPTVKKNFNARRTLHAAIDTVRAINKLREGQGLNGQRLMAGVKSREPNKAAAAAAAAASIPTSTGEVGTVGAATHKDSGYGSTRPDGDGSGDVAMDEAPPVSHPAALRPGVETNKVVETSKGLWTGVGSRG

SEQ ID NO: 90276 - protein, 385 aa, Methanothermobacter thermautotrophicus str. Delta H
MFMTSVVVMAGGKGTRIRPLTFSRPKPLVPVANRPILDYIIHRVLDSGYSKVVMTLGYLKDQIRSHVLAEYPEIDFRFSVEKKPLGTAGGVKAAASEINETFIVLSGDVIFDLDLREMVKFHRKKNALVTVALTPVEDPSHYGIAVLDDDGKIKRFHEKPRPEEVFSKIANAGIYVMEPEVIEHIPQGSSDFSADIFPVLIERDAGMYGFLFDGYWNDAGKPNTFLRANHDVLNGTVTPEPDGEIAEEVPGRFGKIWIGRDVVIGDRVRIVGPAVLGDGSRVDDGAYIGKNTVIGSRVNVGENSFIRGSVILDGCVIGRGSQLLNCVVDEDCEIGAGCAIDRCAIIGRGAFIGPSTVIRSHCSVSNRLRILSGSLVDSDYPLVPE

SEQ ID NO: 90277 - protein, 96 aa, Polytomella parva
GAGFVPIVLDTKILDEIVQVASDDAIDMARRLAVEEGLMVGISSGAAVKAAIEVAKRPETEGKNIVVILPSFGERYLSTVLFQSLREEAQRMTFEA

SEQ ID NO: 90278 - protein, 586 aa, Triticum aestivum
MDSTDRFDKSPLLDGGSSSQENSTEYTGDGSVCTSGHPASRKHTGNWKVSSLTIVCSFCCYLAYSSIGKNLVSYLTKVLDETNLDAARHVATWQGTSYLAPLVGAFVADSYLGKYRTALISCTIFIMGMMMLLLSAALPLISAGPHAWTLWADPISSRYIIFLVGLYMVGLGYGAQCPCVTSFGADQFDDTNEMEKTRKSSFFNWHYFSINAGSLIAGTVIVWVQEHEGWLWGFTISTLFVTLGISVFFLGSIVYRFQKPGGSPLARIWQVVVAASRNFDKVLPCDSSALYEFSGQGSAIEGSRKSEHTSGLEFFDKAAILTLPDCESPGQLNKWKICTVTQVEELKILIRMFPIWSAMVLFAAVQEQMFSTFVEQGMTMEKHVGSFEIPTASFQSIDTLTVIMLVPIYERVLVPVIRKFTGRANGISSPQRIGIGLCFSMLSMVLAALVESNRLQIAQSEGLVHSKVTVPMSILWQGPQYFLLGVAEVFSNIGLTEFFCDESPDAMRSLGMAFSLLNISAGNYLSSFILSLVPVFTARGGSPGWIPDNLNEGHLDRFYLMMAGLSLLNIFVFVFYARRYKCKKAS

SEQ ID NO: 90279 - protein, 310 aa, Glycine max
MTGGGSTGRLPTWKERENNKRRERRRRAIAAKIYTGLRAQGNYKLPKHCDNNEVLKALCAEAGWIVEEDGTTYRKGCKRPSASEIGGTVANISACSSIQPSPQSSSYPSPVPSYHASPTSSSFPSPTRIDGNHPSSFLIPFIRNITSIPANLPPLRISNSAPVTPPLSSPRSSKRKADFDSLHNASLRHPLFATSAPSSPSRRHHLATSTIPECDESDASTVDSASGRWVSFQVQTTMAAAPPSPTFNLMKPAMQQIAAQEGMLWGSVAERVRGGSDFDFENGRVKPWEGERIHEVGMDDLELTLGVGKA

SEQ ID NO: 90280 - protein, 300 aa, Ralstonia solanacearum GMI1000
MSHVAISAPAHPPALDDEYARRFGGVARLYGPQALERFAAAHICVIGVGGVGSWVAEALARCGIGRLTLIDLDHIAVSNTNRQIHALGDAYGKAKVDAMAERIAEINPRAEISRIDDFVTVENVDALLGHPFDYVVDAIDAVKVKTAIVAFCQRTGTRVVTCGAAGGQLDPTRIRVADLARTIQDPLLAKVRGNLRRQHGFPRDPKARFGIDAVYSDEPLRYPEPEQQACAVEVPAESSHAGIDDLAAAGAIEVVNAPPAPQPSRGPQGLACAGFGSSVCVTAVFGMVAASTALRAIAAV

SEQ ID NO: 90281 - protein, 203 aa, Polytomella parva
KVSSLCKAAPKANMTIANNVTELIGNTPMVYLNKVNEGCYGKIIAKLEIMEPCSSVKDRIGYSMIQAAEKDGFITAGKTTLIEPTSGNTGIGLAFIAASRGYKLILTMPASMSLERRVLLRAFGAELVLTDPAKGMKGAVQKAEELVASTPDAYMLQQFANPNNPKVHYETTGPEIWKGTDGKVDYLIAGVGTGGTITGTGRF

SEQ ID NO: 90282 - protein, 270 aa, Populus trichocarpa
MAQNDSVSEFLETAVEAAKKAGEIIREGFYQTKHVEHKGQVDLVTETDKACEALIFNHLKQQYPSHKLIGEETTAAYGATELTDEPTWIVDPLDGTTNFVHGFPFVCISIGLTIGKVPTVGVVYNPIMDELFTGIHGKGAFLNGKPIKVSSQSELVKSLLATEAGTKRDKSTVDATTGKINSLLFKVRSLRMSGSCALNLCGIACGRIDLFYETGYGGPWDVAGGAVIVKEAGGLVYDPSGKDFDITSQRVAASNPLLKDAFVEVLQQSE

SEQ ID NO: 90283 - protein, 295 aa, Burkholderia sp. 383
MLKVTKAVFPVAGLGTRFLPATKASPKEMLPVVDKPLIQYAVEEAINAGITEMIFVTGRSKRAIEDHFDKSYEIEAELEARGKEKLLELVRGIKPSHVNCFYVRQPEALGLGHAVLCAEKLVHGEPFAVILADDLLHGEQPVLKQLVDVFDHYHSSVIGVETIPREDSRSYGVVEGREWEEDIIKLSGIIEKPAPEDAPSNLGVVGRYVFMPTIFDHLRKLKPGAGGELQLTDAVQSLLANEQVLAYRYFGTRFDCGSKIGYLKATVELALQHPEVSREFEAYLRTCLPALAAVA

SEQ ID NO: 90284 - protein, 509 aa, Arabidopsis thaliana
MMDSALYHPRIFFAHSFINGLYSSPRFANTCWRLVSRSSWEIKASENSDRNVFDENPVRKTDGSLFDSASFETVDAEITPETDDFFVSDAEGDPDCPTQGYSSIELALQALRKGKFVIVVDDETGDVEGNLIMAATLTSPKDIAFLIKNGSGIVSVGMKKENLERLSLTLMSPEMEDEDSSAPTFTITVDAKSGTSTGVSASDRAMTVLALSSLDAKPDDFRRPGHVFPLKYRDGGVLRRAGHTEASVDLMILAGLRPLSVLSAILDQEDGSMASLPYMKKLATEHDIPIVSLTDLIRYRRKRDKLVERITVSRLPTKWGLFQAYCYRSKLDGTENIALVKGNVGNGEDILVRVHSECLTGDIFGSARCDCGNQLDLAMELIEKEGRGVVVYLRGHEGRGIGLGHKLRAYNLQDEGHDTVQANVELGLSIDSREYGIGAQMLRDIGVRTMRLMTNNPAKFTGLKGYGLAVVGRVPVVTPITKENRRYMETKRKKMGHIYISDNNDQPLA

SEQ ID NO: 90285 - protein, 591 aa, Oryza sativa
MAMAMAMRRAAALGARHILAASSTSSSGVLLRRHMSVDAGAAMEKVRAAGLLRTQGLIGGKWVDAYDGKTIEVVNMQFALGNPCEQFVELIYFLQDALYLVQNPATGETLANVSCMGSKETSDAIASAHSTFYSWSKLTANERSKALRKWHDLIISHKEELALLMTLEQGKPMKEALVEVTYGASFIEYFAEEAKRIYGDIIPPTLSDRRLLVLKQPVGVVGAVTPWNFPLAMITRKVGPALACGCTVVVKPSEFTPLTALAAADLALQAGIPAGAINVVMGNAPEIGDALLQSTQVRKITFTGSTAVGKKLMAGSANTVKKVSLELGGNAPCIVFDDADIDVAIKGSLAAKFRNSGQTCVCANRILVQEGIYEKFASAFIKAVQSLKVGNGLEESTSQGPLINEAAVQKVEKFINDATSKGANVMLGGKRHSLGMSFYEPTVVGNVSNDMLLFREEVFGPVAPLVPFKTEEDAIRMANDTNAGLAAYIFTKSIPRSWRVSEALEYGLVGVNEGIISTEVAPFGGVKQSGLGREGSKYGMDEYLEVSIAIRHANCKHLSGFTLILFLITLLGLNMDIEKIGGVKCGMVVIR

SEQ ID NO: 90286 - protein, 1157 aa, Blumeria graminis
MNNDDEALSLVFKKIERERALLNAANQMRQQTQNEQVKARLDTQMREGRRNIQYLEERMQELQMRKMGQDMENMNLSPVGTGPGRRASEGYDGRSGPSTPLAKSPRTHIDAGQGTGYGMQETGGSQGELMPSRHPFAPPGPSSSLPKRPNYTKLDLIKYDTPFLGPRIQLMLSQIEFKLNVEKQYLKGIEKMVQLYAIEGDRKSRADAAGRRIESTQKIQILKQALKRYEDLHIDMESSADAPDDDSINTPNLRKPLTGQLSIRILAVKDVDHATTSRFARGPETFVTIRVEDNVVARTKISRNDKWEAEYHNITVDQANEIELIVYDKPTDHPLPMGLLWIRLSDIVEEMRRKRIEAEINNSGWVSADRMGSGSLPSSAPPQFPLSPSHATFTANPGSVVVAENPALSGSMVASQPIDAWFALEPTGAVQLSINFTKQIKEKRGFDAGLNRKGAIRQRKEEVHEMYGHKFVSQQFYNIMRCALCGDFLKYAGGMQCEDCKYTCHTKCYTSVVTKCISKSNAETDPDEEKINHRIPHRFEKFSNMSANWCCHCGYILPFGKKNCRKCSECNLTCHAQCVHLIPDFCGMSMAVANVIIDGIRNQKRRQTAQVPSVGQSKQNQSGIPTASLVESFGPGSRASFSQEPHRSTQSGSYGSASSSTGAAEAAKVMYNQGHPSQKRLSAPNPALPSSATAAAAAAMSGTKIPNTRESFSTPPTEYSQAGRSSATNYTGHPSPRTDNNLYNASSVPQSPSQVSYNPAAYAQVSGYPTQPLSPAYVQQHPLPSKNLYSSEAQNKAPISEPSSSQTPAMTRKAAPQANEPGTGRRIGLDHFNFLAVLGKGNFGKVMLAETKSTKKLYAIKVLKKEFIIENDEVESTRSEKRVFLIANKERHPFLTNLHACFQTETRVYFVMEYVSGGDLMLHIQRGQFGTKRAQFYAAEVCLALKYFHENGVIYRDLKLDNILLTLDGHIKMADYGLCKEDMWYGSTTSTFCGTPEFMAPEILLDKKYGRSVDWWAFGVLIYQMLLQQSPFRGEDEDEIYDAILADEPLYPIHMPRDSVSILQKLLTREPEQRLGSGPTDAQEIMSQPFFSNNNWDDIYHKRIPTPFKPSIKDETDTSNFDSEFTSVTPVLTPVQSVLTQAMQEEFRGFSYSTDAI

SEQ ID NO: 90287 - protein, 139 aa, Zea mays
MNEGLGKRLAHGYPFLEAEVAYCARYEYCESAVDFVARRCRLAFLDTDAAGRALPRIIEILASEHKWDKARKKAELQKGREFLETFKSSKNAQFHDGKHNGSDTRVSLRMQKGFVSTFLRMAVKIGVLSSRIRCGHGTM

SEQ ID NO: 90288 - protein, 434 aa, Zea mays
MGQKDSKPSNGYGYSSDYGGTSSGYNLRNTGSTSSSYGARYVPSSENNVQPETHARLQRKYSRIGDDYRSLSQVTEALAQAGLESSNLIVGIDFTKSNEWTGKISFNRRCLHDIGNTPNPYEQAISIIGRTLSVFDEDNLIPCFGFGDASTHDQEVFSFYPENRPCNGFEEALDRYREIVPTLRLAGPTSFAPMIETAIGIVDSTGGQYHVLLIIADGQVTRSVDTQSGQLSPQERDTIDAIVRASQFPLSIVLVGVGDGPWDMMHQFDDNIPARSFDNFQFVNFTEIMSKSIAADRKEAEFALSALMEIPTHRRQRITPRIALPPPTRTAYSRTTSFSQQSGVYSRSSSFDQQTSVYQQRSESLKQQQPAAPKGPDTYVSESALEDRILCPICMYKSKDLAFGCGHQTCYECGRDLERCPLCQQHITTRIRLY

SEQ ID NO: 90289 - protein, 226 aa, Populus trichocarpa
MGVAAKIAPSMLSSDFANLASEAQRMLDCGADWLHMDIMDGHFVPNLTIGAPVIESLRKHTKAYLDCHLMVTNPLDYVEPLGKAGASGFTFHVEVSRDNWGDLVQRIKSKGMRPGVSLKPGTPIEEVYPLVEGENPVEMVLVMTVEPGFGGQKFMPETMDKVRTLRKKYPSLDIEVDGGLGPSTIDMAASAGANCIVAGSSVFGAPDSAQVISLLRKSVEEVQKNN

SEQ ID NO: 90290 - protein, 514 aa, Candida albicans SC5314
MNQQQQQPLLKRVAHSVKKYATFIGPGLVVSVSYMDPGNYSTSVSSGSMYQYKLCFIIFMANLFAIILQALCVKLGTITGLDLAEMCRLHLNPKLNLFMYFCAEIAIIATDLAEVVGTAISLEILFGIPLLYGVVITVLDVLIILMAYHKDGSMKQTKFFEILVSILVAATCVCFILELFKCNFEPGSGWKIFKGFLPVNKEIFKESMALFLSCAIVGSTVMPHSLFLGSALVQPRLKEYDETHGTKANVLPVENEDTTRLVPPHQPVEGSRLRRISDGSLLTNKYKPSYAAIKYCLNYSYVELVSSLFIVAVFVNSAILIVAGSTLYGKPDAADADLLSIYEMLSYYISPAAGLVFALSMLFSGQSAGIVCTMAGQIISEGFINWTLEPWKRRIITRVLAIVPVIVVVGILGREGVSKVMNSSQVVLSFILPIVSAPLIYFTSKKEFMTVIDTSSTDESTPLLEENDLDEQIPVKKISFENGSLLRNASILTWVIITGLNVYLIIAFANGADI

SEQ ID NO: 90291 - protein, 345 aa, Yersinia pseudotuberculosis IP 32953
MHEAQTFSSTPATKPQYPLQRFSVAPMLDWTDRHCRYFHRLLTKQALLYTEMVTTGAIIHGKADYLAYSEQDHPVALQLGGSDPQALAHCAKLAEQRGYNEINLNVGCPSDRVQNGRFGACLMGEADLVADCIKAMRDAVAIPVTVKTRIGIDQLDSYEFLCEFVQTVAERGECEIFTIHARKAWLSGLSPKENREVPPLDYERVYQLKRDFPALTIAINGGVKTLAEAKEHLKHLDGVMMGREAYQNPGILTQVDRELFDPHAPVVDSVKAIEALYPYIEQELSQGAYLGHITRHILGIFQGIPGARQWRRHLSENAHKPGAGVSVVEEALALVSPSYYESVGG

SEQ ID NO: 90292 - protein, 208 aa, Glycine max
MAAQGPVVVASLLIFCLAGSCYGKVHFSSLKRTLDVTASPKQEQVLEAGLDKITVTWALNKTLPAGTDSAYKTIKLKLCYAPISQKDRAWRKTEDELKRDKTCQHKIVAKPYDASNKTVQRFEWLVERDVPKATYFVRAYAFDSNDEEVAYGQTTDAKKSTNLFEINAVSGRHASLDICSICFSAFSVVSLFVFFYIEKRKGKASSSK

SEQ ID NO: 90293 - protein, 300 aa, Azoarcus sp. BH72
MPHASVLDSELVPAIRAITGADLSGAAVQATGGGSIHRSFTVEAGGRRHFLKLNAASALPMFEAETDGLAALAACNAFRVPAVLGCGVGGDQAFLLLEHIALRPLSAAAEGERFAEALVALHRDCGEHFGWPRDNFIGASPQLNAQQDGWARFFVQNRLQPQLQMARAKGHGGVLGRDADRVLERVSAMFLDYRPRASLLHGDLWSGNAAVDADGRPVLFDPAVYRGDREADLAMSELFGGFPSAFYAAYRLAWPLAEGYEQRKTLYNLYHVLNHLNLFGRTYLGQAERMIRALDYELRP

SEQ ID NO: 90294 - protein, 327 aa, Yersinia pseudotuberculosis IP 32953
MAKHIQFTTTGGPDVLQYLEFTPSDPAPHEVQVENKAIGINYIDTYVRSGLYPPAHLPSGLGTEAAGIVSKVGAAVSSVKVGDRVVYAQSALGAYSEVHNVPADKIALLPEQISFEQAAASFLKGLTAYYLLRQTHEIKPGEVFLFHAAAGGVGLIACQWAKALGAKLIGTVGSDEKAQLAKAAGAWATINYRTENIAQRVAELTEGEKVGVVYDSVGKSTWEASLDSLKRRGLLVSFGNASGPVTGVNLGILNQKGGIYVTRPSLNVYVANRQELESASQQLFSMITSGAINVDVAQAQQFPLCDAQRAHETLEGRQTTGSSLLIP

SEQ ID NO: 90295 - protein, 146 aa, Citrus sinensis
MAKFICKEVESIDDYDEYCYYVAGLVGLGLSKLFYASGTEDLAPDSLSNSMGLFLQKTNIIRDYLEDINEIPKCRMFWPREIWSKYVNKLEDLKYEENSDKAVQCLNDMVTNALMHVEDCLKYMSALRDHAIFRFCAIPQIMAIGT

SEQ ID NO: 90296 - protein, 175 aa, Oryza sativa Indica Group
MGKFGGAAVLPVYREEEDEDLFETSSSISGDSDDEAQFSDSEEAEAQEDQFAQQPARRMNSDSLYDLSSMKAQLPVKKGLSKYYDGKSQSFACMSEVRCLEDLRKKENPYKKIKSSKSYVALDGNQEACHIPGANSTSIAKKSGSSCANLMARNNTKNMLYRPPPIPVNKSGYHQ

SEQ ID NO: 90297 - protein, 346 aa, Prochlorococcus marinus subsp. pastoris str. CCMP1986
MFGLIGHSTSFEDAKRKASLLGFDHIADGDLDVWCTAPPQLVENVEVKSAIGISIEGSYIDSCFVPEMLSRFKTARRKVLNAMELAQKKGINITALGGFTSIIFENFNLLQHKQIRNTSLEWERFTTGNTHTAWVICRQLEMNAPKIGIDLKSATVAVVGATGDIGSAVCRWLINKTGIGELLLVARQKEPLDSLQKELDGGTIKNLDEALPEADIVVWVASMPKTMEIDANNLKQPCLMIDGGYPKNLDEKFQGNNIHVVKGGIVRFFNDIGWNMMELAEMQNPQREMFACFAEAMILEFEKCHTNFSWGRNNISLEKMEFIGAASVKHGFSAIGLDKHPKVLAV

SEQ ID NO: 90298 - protein, 467 aa, Kluyveromyces lactis NRRL Y-1140
MDLLDDEDYGSVSDEESLDDGLSGVTSGITSGIATESDILPSPSVSNLISDFHAQFWHQGADLDDLIQLAKHETIIRDATNHTTEPYNVIKLGQLMPLFDTELSMVFQCIVDTYKAKFPGLETIVPERKQYVDVVKMLQQDIPNVQLDQVLSKEETLVVSMSLKTDFKEGARIDKDLLSKAIHWFDILYNLRDNVSHYVETRIQMVAPNLCALLGPDTAAKLVTHCGSVKELSVVPSCNLASIGQDKTLHGKSLDISGVRQKGYLFYTDVVQTQPPEFQKQALRMVSAKVALAARADCTMGNQVINPDGNSDGNSDASKLGLKWRHEIVEKLKKIIDPPNISNIKPLPIPEDAPKKKRAGRRFRKYKEQFKMSHLRQMQNRMEFGKEEQTTMDPYGEEIGFGMADSKNVSALSSFNKTKMRKSMRLRLDQETKNTHSFLQDERSEKLKRSAEHPQATDPATSKQPRL

SEQ ID NO: 90299 - protein, 266 aa, Bacillus licheniformis ATCC 14580
MAEGMISGIVQSKKLPASQIYVTNHTNHRRLEELQQKYGIQGVKKEQLDYQNIDCFILAMKPKDAEGALNSMKPHIKPHQLIVSVLAGISISFIENTLHDMQPVIRIMPNTSSAIGASATAMAEGSHVTADLSKTAKQLLQCMGEVYSIEESKMDIFTGIAGSGPAYFYYLMEHIEKAGAEAGLSQKLTREIGAQTLLGAAKMLLESPEDTAVLKDNITSPNGTTAAGLKALEESGGGEAIEQAVKQAAKRSKTISLELEQLVAAK

SEQ ID NO: 90300 - protein, 253 aa, Erythrobacter sp. SD-21
MAERPYIVGNWKMNGTRAMLSEARAIDRAAQRYMKAEVAVAPPYTLIHAVHREAEQIGIGAQDCHDGDDGAHTGDISAAMVADAGAKFVILGHSERRADHKETNTQINAKIEAALEAGLRIILCCGETLATREKGDAVEFVLKQLKASLPKIEDAAERLTVAYEPVWAIGTGKTATPKDIEEMHRAIRGLLDETYGAEQSAEVRILYGGSVKPDNAREILSVPEVGGALVGGASLSAESFLGIVVAASETEDA

SEQ ID NO: 90301 - protein, 567 aa, Kluyveromyces lactis NRRL Y-1140
MFTRDANGRHKEVDALVDDMVNFSFDTDAKVMLDPPSTPTRIRGSPSPTRSIVKNPENSLMDIDDDTQGDLTADITKSPKKLPKDFYKKSSKTKSKRLVSVCQMYFLDYYCDMFDYVISRRERTRQVINYLEEQRRSNLMGTEQITNEWQGYLTKETNILRKRRLKPKHKDFEMITQVGQGGYGQVYLARKKDTKEICALKILNKKLLMKLEGTDHVLTERDILTTTRSEWLVKLLYAFQDPQSLYLAMEFVPGGDFRTLLLNTKFLQAPHARFYISEMFCAVNALHQLGYTHRDLKPENFLIDSKGHIKLTDFGLASGTVSMERIESMKIRLQEVKNLEFPEFRERSMDDRRRMYNKLREEEVRYAHSTVGSPDYMALEVLEAKNYDFTVDYWSLGCILFESLVGYTPFSGNSTNETYENLRNWKHVLQRPKCDNGRYAFSDRTWELITRLIADPINRLKSFEHVKRMRYFSEIDFNTLRTIHPPFIPQLDNEEDVGYFDDFTNEEHMARYVDVFKRQDRLTAMVDDSLSDSKLVGFTFRHRNGKDGSSGVLYGGLEQSDPFATFY

SEQ ID NO: 90302 - protein, 1574 aa, Coccidioides immitis RS
MDGQRQQPYVPGPPPQTIQQTASQGHVMQLPPPPPQPPPPRVTHAASHGGLPPPPPVPPRVSGYGNQPGWQQAWSRQQGMGQSFYLPPPPSMLSSNQVYNQPLAYNPHQPPNSGSLSIQPPPTNDQPLTSATYIPGGSSFGPGVGIPPLDSYDNFSRADRAGYPPDSDTMRYIPQSYADQMNRSHQVPSSFREQSDSGNPLALNQNVHGQSSLQHSQGPTRENSSRHATSAISSGLSIHEADERWPLDRVLQWLVHNGFSTEWQETFKSLDLKGADFIDLGCGGANGMGNLGKMHQDIYPQLAKECVKSGTGWDQSREREEGVRMRKLIRGINSENAPSARFYENLHPSASTDGGVETSPHLRADSFPFDPSSTESGYQEPSSRSELSRNILVNAFGEWRRHSPSASSDHGAGLRASSNSRAGSPATQFASMATAEPAFLTGEFGHAKRNSSDSIISRGLRQAQGSSNPDHSTKQTELSTKDHKGFLNAIRKKIGPSHPSEEPHHDASISPVRNNQSFPYSGKPSLNASETSLVMGMSLPSSESHARKAISNLPPKKFIFVTLDGWNYRLVDVTDVDAADLLRARLCNGVGIKDPSSALIYVTEPGQVDHEEPLSDTMLVVNRRSRSDAQGSLKLYIQSMTPSAFNVSQYAGLGLSFSDRVANGAKPQRNILEDDTRNRTNQPSHTRRVSPSLAHRSSMQNLPSYSPFPEDDRLGENLSEDKERNAAILAAHEEHRRITEQKQQAFLQSRREQLQKKQASTVTTYGIKRGGFIDFDLPRTSPYEDKRTDDLVPRREPPTAPSASSTLTKVNSLNKKPGEKATDNTCHQRRSSKDFLSDNRQRSSSFSPKNASPSMGIAAAIANMGKISGSIAKPLASSTSFGHSPRTPSGSEFGRFSTESVDAGSASPHCGSSSSPRPSAFARSVSANSEIIARKSTPTQAESTPPDKSVHSFSASPSRASAIPPSRLSHGPDFDFQETEVSFVKSPQPAPQDSDEDSDEGLFAIPLANGKNKPQVNKKPPATRSRLAKPALTVNTNSRAAKGLSVTFESPGPCDSFTPLTDHSDSRSGHYSGDPDTDDLSPEDSRSARRRSFVRDDVWASRPPVEGMIEHLDDFFPNIDLDEPYLEAMPLTPPISPTATSSHPDTEPEQSFTLRDRVGQGGPPTTSIPRNASDTLGSDESTLKGKAAPKTVAHRNVGRSTGLSRMKSIREVAKGAHQIRRNQSIAASKNAQSGMLRRKSTKMFGARIMQISPKPGSRLSDLDPLPQHPVPQEKLPQRQATFRIIRGQLIGKGTYGRVYLGMNAETGEILAVKQVEVNQKAAGYDKDRIKEMVQAMDHEIDTMQHLEHPNIVQYLGCHRSELSMSIYLEYIPGGSIGSCLRKHGKFEESVVQSLTIQTLRGLAYLHDKGILHRDLKADNILLDLDGTCKISDFGISKKSDNIYGNDVTNSMQGSVFWMAPEVVQSQGQGYSAKVDIWSLGCVVLEMFAGRRPWSKEEAIGAIFKLGSLNQAPPIPEDVSMNICPAAIAFMYDCFTINTFDRPTAETLLSQHPFCIPDPNFNFLDTELHAKIGHL

SEQ ID NO: 90303 - protein, 569 aa, Coccidioides immitis RS
MTDLATKELKNPVDVAEYLFTRLHQLGIRSIHGVPGDYNLVALDYIPKCGLRWVGNCNELNAGYAADGYARINGISALMTTFGVGELSALNAVAGAFSEFVPIVHIIGQPSTISQKDGMLLHHTLGNGDYNAFANMSANISCAVAKLNDPHQAATYIDSALRECWIRSRPVYIALPTDLVQKKVDGERLKTPIDLSPPANEEEKEEYVVDVVLKYLHAAKNPVILVDACAIRHRVLDEVHDFVKKSGLPTFVAPMGKGAVDETLPNYGGVYAGDGSNAGVKDRVESSDLILSIGAIKSDFNTTGFTYRIGRMNTIDFHSNYVAVRYSEYPGVGMKGVLRKVVQRMGKVNVAPGPKVINEPHEDPSASNPAITHEWFWPIVGKWLQENDIVITETGTANFGIWETRFPKGVTAVSQVLWGSIGYSLGACQGAALATQEGLKRRTILFIGDGSFQMTGQELSTMIRRKLTPIIFVICNEGYTIERYIHGWESSYNDIQEWKFKDLVPAFGAKPENYRTYQIRTKQEVLDLFANKEFAAAEVLQLVELYMPLEDAPAALRLTAEASARRNAE

SEQ ID NO: 90304 - protein, 248 aa, Moorella thermoacetica ATCC 39073
MIILKSRREIALMREAGRIVAGALAKLQEHIAPGITTGELDRIAEEYIRRHDAVPAFKGYHGFPASICASVNEEVVHGIPGLKKLVAGDIISIDIGVVKNGYVGDSAATFPVGDIDSGKKQLLAATQAALQEGIKKAVVGNRLTDISHAIQAFVEARGFSVVRDYVGHGVGRAMHEDPQVPNFGPPGYGPRLRVGMVLAIEPMVNAGTHEVYTLPNRWTVVTRDGQPSAHFEHTVAITENGPEILTLL

SEQ ID NO: 90305 - protein, 398 aa, Zea mays
MLLLVTSKRTLHCWSLERGLSQPGSRGTERQQRKTPQQSTQSTRHPTGNWEVLIGLIRLILVVEFNQLIAIWDSGFVILLPQSSCGPETRITMVPGIATKTAARPVAWAPQPRNMFVFGAGFVGRYVSERLLAQGWQVSGTCTTVTTKRELEMLGMNASVFDGTEDRHVTSSLENIHSLRQATHLLISIPPIPGVGDPAIMLTGFHFMVICTFYPQLLINLDEDLRRILGHGNLEWLCYLSSTSVYGDCGGVLVDEDHTVNPKSESAKLRYNAEKGWLNLIDDPKLSAFVFRLGGIYGPGRRKIFNVVDDDPAPRAEVFAFATSLIQRRYPDMITETIDAKPAGLDYQEMIVPAEKRVSNARMKQELGVNLLHPTYRSGLQSILDAWQIQPPLPNTSQ

SEQ ID NO: 90306 - protein, 391 aa, Arabidopsis thaliana
  misc_feature (250)..(250): Xaa can be any naturally occurring amino acid
MVQISDLPRDLTEEVLSRIPVTSMRAVRFTCKKWNTLSKDRSFTKKHLRGARAAAKKKQTKEFQVIMMIQFRVYLYSVNLLNPSIERIGKLISLDVEDHVDISKIFHCGGLLLCITKDISRLVVWNPYSGQTRWIKPRNSYHRLDRYALGYEEKNKSCRCYKILRFMDDYEDDRALRLIREFEIYDLNSDSWKVVNVTPDWDVEFYHRSLSLKGNTYWFAQEKLPPLPRGRVITISDMADFLLCFDFTRXRFGPRLPLPFHSFVEDTVTLSSVRDKKLAVLFQPCSASTVKIWISRKIEPNAVSWRKVFLAVDMKSLTGFQFDINAASFFVDEKKKVAMVLDKDRFSYKFTRNIAYIIGKKGYFEKVDLGESTVSSCASLVCSYVPSSVQI

SEQ ID NO: 90307 - protein, 427 aa, Corynebacterium efficiens YS-314
MSTPKISDVKIAVIGLGYVGLPLAVEFGKQFPVIGYDINETRIAELKEGVDKTLESSKEELISATQLQFTANPEDLRAANVYLVTTPTPIDEHKKPDLRIILAATRTIASTMNPGDIVIYESTVYPGVTEEECVPVIEKVSGLKFNESFYAGYSPERINPGDKIHRLPNIVKITSGSTPEVAEFVDELYRTIITAGTHKASSIKVAEAAKVIENTQRDVNIALINELALLFNKMDIDTQAVLEAAGTKWNFLPFRPGLVGGHCIGVDPYYLTHKAQAVGHNPEIILAGRRLNDSMGQYIASQLVKAMLRKSTRIENARVLILGLTFKENTPDIRNTRVVDIIAELEDYGISVDAYDPWAAPFEVEHEYGITLKSELEPSTYDSVIVAVAHREFIEMGAQAIRDLGKPESIVYDLKYVLDKAESDLRL

SEQ ID NO: 90308 - protein, 329 aa, Polytomella parva
MALSMRVSSMTSKVGVKNKVVCAPKMNKSIASRSIFSLKATSDKKELTNLDRVTILSEALPYLQKFRGKTIVIKYGGAAMKDPTLKAGVITDLVLLNCVGIRTVLVHGGGPEINSWLSKVGIKPNFKNGLRVTDSATMDIVEMVLGGRVNKSLVSLIQQAGGRGVGLTGKDGQLLKARQMTELDIGHVGEVTKVDPTILNVMVNDGYIPVVATIASDPAGQALNINADTAAGEIAAALKAKKLVLMTDVPGVLRDKNDIKTKIHSLDIRGCRELIKDGIIAGGMIPKIECCIRCLAQGVDAAHIVDGRAKHSILMELLTDEGVGTMITG

SEQ ID NO: 90309 - protein, 479 aa, Corynebacterium efficiens YS-314
MLCRTRIVEIVTEHYDVVVLGAGPGGYVSAIRAAQLGKKVAVIEKQYWGGVCLNVGCIPSKALIKNAEIAHIFNHEKKTFGINGEVTFNYEDAHKRSRGVSDKIVGGVHYLMKKNKITEIDGFGTFKDAKTIEVTDGKDAGKTVTFDDCIIATGSVVNSLRGVEFSENVVSYEEQILNPVAPKKMVIVGGGAIGMEFAYVLGNYGVDVTLIEFMDRVLPNEDPEVSKVIAKAYKKMGIKLLPGHATTAVRDNGDSVEVDYQKKGSDKTETITVDRVLISVGFRPRVEGFGLENTGVKLTERGAIDIDEHMRTNVDGIYAIGDVTAKLQLAHVAEAQGIVAAETLAGAETQTLGDYMMMPRATFCNPQVASFGYTEEQAKEKWPDREIKVSSFPFSANGKAVGLAETDGFAKIVADAEFGELLGGHIVGANASELLNELVLAQNWDLTTEEISRSVHIHPTLSEAVKEAAHGVNGHMINF

SEQ ID NO: 90310 - protein, 1037 aa, Mycobacterium smegmatis str. MC2 155
MAEDAHTEDLSTQTPQQEGLPERLRVHSLARVLGTTSRRVLDALAEFDGRQRSAHSTVDKADAERVRAALTESPAAETPPEEAPAAETPVADLVVVQAEQVEVVTVSEAGPAEPAEPAEPEAPAAEAEAEAETEVADEAETPEPTFRGAVLVGDEPESRLILEHANIPPARETQTERPDYLPLFVAPQPVSFEPAVVDDEDEDDDTETGAESDFDSGADSDSDDDQADRPRRRRRGRRGRGRGRGEQNDDATSDADTDSTEDQTDGDEQESGEDSDDSGDEDSTTTEGGTRRRRRRRRRKSGSGDSDDAVSPDDPPNTVVHERAPRTERSDKSDDSEIQGISGSTRLEAKRQRRRDGRDAGRRRPPILSEAEFLARREAVERTMIVRDKVRTEPPHEGARYTQIAVLEDGVVVEHFVTSAASASLVGNIYLGIVQNVLPSMEAAFVDIGRGRNGVLYAGEVNWEAAGLGGQNRKIEQALKPGDYVVVQVSKDPVGHKGARLTTQVSLAGRYLVYVPGASSTGISRKLPDTERQRLKEILREVVPSDAGVIIRTASEGVKEEDIRSDVERLQKRWSEIEAKAAEVTEKKAGAAVALYEEPDVLVKVIRDLFNEDFSSLIVSGDEAWNTINSYVEAVAPDLMPRLTKYEPAGPDAPDVFAVHRIDEQLAKAMDRKVWLPSGGTLVIDRTEAMTVVDVNTGKFTGSGGNLEQTVTRNNLEAAEEIVRQLRLRDIGGIVVIDFIDMVLESNRDLVLRRLTEALARDRTRHQVSEVTSLGLVQLTRKRLGTGLVEAFSTACTHCGGRGIVLHGDPIDSASSNGGRKSDSSGGGGSGGGRRGKRGKKGAARTEEVHVAKVPDHTPGEHPMFKAMAAANGKHEGDEDHEDHEDHETAEDTTAAEVRDDTRDEHDADERAHVVTAAVGAAGDEDLDDSDEDSDLDSDEESDDESDEDEIELDDDEDELDEDIEVIGDSDDSDDSDDSDEDDDSDDSDDDSDEDEDSDSDEDEEPVREVYEPPVTAPRARVRRRAAARPAGPPSHD

SEQ ID NO: 90311 - protein, 320 aa, Brassica napus
MGGHQGSSTGRFSSATWFSQLCASARRFKSLAPPSLETAVRSTSGDSLFRRLGLFDPILLGIGPSIGAGVFVVTGTVARDAGPGVTISFLLAGASCVLNALCYAELASRFPAVVGGAYMYSYSAFNEITAFLVFVQLMLDYHIGAASISRSLASYAVALLELFPAFKGCIPLWIGSGQELFGGFLSFNILAPILLALLTLVLCQGVRESSAVNSVMTATKVVIVLVVICAGAFDIDVANWSPFAPNGFKAVLTGATVVFFSYVGFDAVANSAEESNNPQRDLPIGIMGSLLVCISLYIGVCLVLTGMVPFSLLSEDAPLA

SEQ ID NO: 90312 - protein, 377 aa, Oryza sativa
MPTLDARLRLPLAGLSPATTSFPGSTPKPGSLSFALRPPSASLSSSASAPAAAAPPIVVVGSANADIYVEVDRLPLVGETVAARAGRSLAGGKGANQAACGGRLAAGPTYLVARVGDDANGRLLEGALADAGGVRLDRVARAPGAPSGHAVVMLMPGGQNSIIIVGGANMEGWASGVGSDDLDLIRRAGVLLLQREIPDWVNVQVAQAAKGAGVPVILDAGGMDAPVPGELLSLVDIFSPNETELARLTGMPTETFEQISRAAGACHKMDNCNMRNCIKGVKEVLVKLGSQGSALFIEGGEPIRQPIIPATEVVDTTGAGDTFTSAFAVALVEGKPKEECMRFAAAAASLCVQVKGAIPSMPDRKSVMDLLESVQVE

SEQ ID NO: 90313 - protein, 300 aa, Physcomitrella patens subsp. patens
MFKLNTGGSIPAIGLGTWQSEPGLVGQAVKEAIKVGYRHIDCAKAYNNEKEEGILKREDLFITSKLWCSDHNPTDVIKALDRSIERLQCDYIDLYLIHWLVAFKKDALGFAPENFAPLDIKATWAAMEQCYESGKARAIGISNFSVEKTKDLLSHCKVRPAVNQVECHPHWQQKKLVPYLTSEDIHFSAYSPIGSSNSSFAKINVLQLPIITTLAEKYQKTPSRIALRWNVQQGHSVLPKSTHADRLATNIELFDFEISKEDLHEFDNIEQHRLLSGEGTFVNDTTSPHKTVEQLWDGDL

SEQ ID NO: 90314 - protein, 999 aa, Malus x domestica
MLLFLPLLLLLLLPPLPTTLSLNQEGLYLRHFKLSLDDPDSALSSWNYADSTPCNWLGVTCDDASSSSPVVRSLDLPSANLAGPFPTVLCRLPNLTHLSLYNNSINSTLPPSLSTCQTLEDLDLAQNLLTGALPATLPDLPNLKYLDLSGNNFSGAIPDSFGRFQKLEVLSLVYNLIENTIPPFLGNISTLKMLNLSYNPFHPGRIPAELGNLTNLEVLWLTECNLVGEIPDSLGRLKNLKDLDLAINGLTGRIPPSLSELTSVVQIELYNNSLTGELPPGMSKLTRLRLLDASMNQLSGQIPDELCRLPLESLNLYENNLEGSVPASIANSPNLYEVRLFRNKLSGELPQNLGKNSPLKWFDVSSNQFTGTIPASLCEKGQMEQILMLHNEFSGEIPARLGECQSLARVRLGHNRLSGEVPVGFWGLPRVYLMELAENELSGPIAKSIARATNLSLLILAKNKFSGPIPEEIGWVENLMEFSGGDNKFSGPLPESIVRLGQLGTLDLHSNEVSGELPVGIQSWTKLNELNLASNQLSGKIPDGIGNLSVLNYLDLSGNRFSGKIPFGLQNMKLNVFNLSYNQLSGELPPLFAKEIYRNSFLGNPGLCGDLDGLCDSRAEVKSQGYIWLLRCMFILSGLVFVVGVVWFYLKYKNFKKVNRTIDKSKWTLMSFHKLGFSEYEILDCLDEDNVIGSGASGKVYKVVLNSGEVVAVKKLWRRKVKECEVEDVEKGWVQDDGFEAEVDTLGKIRHKNIVKLWCCCTARDCKLLVYEYMQNGSLGDLLHSSKGGLLDWPTRFKIALDAAEGLSYLHHDCVPAIVHRDVKSNNILLDGDFGARVADFGVAKEVDATGKGLKSMSIIAGSCGYIAPEYAYTLRVNEKSDIYSFGVVILELVTGRLPVDPEFGEKDLVKWVCTTLDQKGVDNVVDPKLESCYKEEVCKVLNIGLLCTSPLPINRPSMRRVVKLLQEVGTEKHPQAAKKEGKLTPYYYEDTSDHGSVA

SEQ ID NO: 90315 - protein, 998 aa, Malus x domestica
MLLFLLPLLLLLPPLPTTLSLNQEGLYLQHFKLSLDDPDSALDSWNDADSTPCNWLGVKCDDASSSSPVVRSLDLPSANLAGPFPTVLCRLPNLTHLSLYNNSINSTLPPSLSTCQNLEHLDLSQNLLTGALPATLPDLPNLKYLDLTGNNFSGPIPDSFGRFQKLEVLSLVYNLIEGTIPPFLGNISTLKMLNLSYNPFLPGRIPAELGNLTNLEVLWLTECNIVGEIPDSLGRLKNLKDLDLAINGLTGRIPPSLSELTSVVQIELYNNSLTGKLPPGMSKLTRLRLLDASMNQLSGPIPDELCRLPLESLNLYENNFEGSVPASIANSPNLYELRLFRNKLSGELPQNLGKNSPLKWLDVSSNQFTGTIPASLCEKRQMEELLMIHNEFSGGIPARLGECQSLTRVRLGHNRLSGEVPAGFWGLPRVYLMELVENELSGAISKTIAGATNLSLLIVAKNKFSGQIPEEIGWVENLMEFSGGENKFNGPLPESIVRLGQLGTLDLHSNEISGELPIGIQSWTKLNELNLASNQLSGKIPDGIGNLSVLNYLDLSGNRFSGKIPFGLQNMKLNVFNLSNNRLSGELPPLFAKEIYRSSFLGNPGLCGDLDGLCDGKAEVKSQGYLWLLRCIFILSGLVFGCGGVWFYLKYKNFKKANRTIDKSKWTLMSFHKLGFSEYEILDCLDEDNVIGSGASGKVYKVILSSGEVVAVKKLWGGKVQECEAGDVEKGWVQDDGFEAEVETLGRIRHKNIVKLWCCCTTRDCKLLVYEYMQNGSLGDMLHSIKGGLLDWPTRFKIALDAAEGLSYLHHDCVPAIVHRDVKSNNILLDGDFGARVADFGVAKVVDVTGKGPQSMSGITGSCGYIAPEYAYTLRVNEKSDIYSFGVVILELVTGRLPVDPEFGEKDLVKWVCTALDQKGVDSVVDPKLESCYKEEVCKVLNIGLLCTSPLPINRPSMRRVVKLLQEVGTEKHPQAAKKEGKLSPYYYEDASDHGSVA

SEQ ID NO: 90316 - protein, 333 aa, Idiomarina baltica OS145
MKQAEVAILGAGSYGTALAICFARKGVKTLLWGRDEVQVAAMREHRENAHYLPGCKFPESLTVTADIKAAVDGVKNVVVVVPSHAFADILNTINPLLATHARVAWATKGLEPESGRLLYEVAEDVLGNTHALAVLSGPTFAIEMAKGLPTAISMSSTDQDFVDELSEMLHCERSFRVYTNDDFIGVQLGGAVKNVIAIGAGMADGIGFGANARTALITRGLAELTRLGLKLGAKSETFTGMAGLGDLILTCTDNQSRNRRFGLALGQGKSVDDALESIGQAVEGYRNTREVVSLAHREDCEMPICEQIYKVLYEGKAPEEAAIALLSRAKKNE

SEQ ID NO: 90317 - protein, 523 aa, Noctiluca scintillans
MEDNLRNSEALNTSNPVDDAGVPLSTPTRPRTLTPALILLVIVASLGGFLFGYDTGVVSGALIEMKIDGSGIKDGGLTTSEQEVVVSSTVAAAAVGAAVSGWAQRHPMFGRKTVIQISTVAFIVGALIMAVAPSLWLLLVGRIVVGVAVGIASQAVPVYVAEVSPPSLRGTLGVVNSAMIVFGQVVASAVCCGYAHLDLSRDVATSWRWMLGWGALPAALRLLGLSFLPESPRWLMQVRNDEAAARKAIWWMRPVSHDSEGELQEIIQGMEQEREAQRTLGGTTLMQRLCSKGVSRALRLGCVLQFLQQFMGINTIMYYSATIMQMATGKGVSCDSGGSDPQSTSLSPSDVNNICLSVPIASSQLAGNFIGLALADRVGRKPLTLTSLLLAVTWLIALGFSFFPENDVGWLALLGMCAYLLSFGAGMSVMPWVVNAEIYPLDVRSLANSISTAVNWISNYVVAATFLDLAKALSTDRACRQGHPEGAFWLYGGVALAGFLWLLRVMPETKGRTLKEIESLFSS

SEQ ID NO: 90318 - protein, 1001 aa, Malus x domestica
MLLFLLPLLLLLPPLPTTLSLNQEGLYLQHFKLSLDDPDSALDSWNDADSTPCNWLGVKCDDASSSSPVVRSLDLPSANLAGPFPTVLCRLPNLTHLSLYNNSINSTLPPSLSTCQNLEHLDLSQNLLTGALPATLPDLPNLKYLDLTGNNFSGPIPDSFGRFQKLEVLSLVYNLIEGTIPPFLGNISTLKMLNLSYNPFLPGRIPAELGNLTNLEVLWLTECNIVGEIPDSLGRLKNLKDLDLAINGLTGRIPPSLSELTSVVQIELYNNSLTGKLPPGMSKLTRLRLLDASMNQLSGQIPDELCRLPLESLNLYENNFEGSVPASIANSPNLYEVRLFRNKLSGELPQNLGKNSPLKWFDVSSNQFTGTIPASLCEKGQMEEILMLHNEFSGADVRQGWASARSLARVRLGHNRLSGEVPVGFWGLPRVYLMELAENELSGPIAKSIARATNLSLLILAKNKFSGPIPEEIGWVENLMEFSGGDNKFSGPLPESIVSLGQLGTLDLPALLSPGELPVGFQSCTKLNELNLASRPTFREKSQMELGTCPSLISTLIFPGIDFPGKSHLGCRICKLNVFNLSYNQLSGELPPLFAKEIYRNSFLGNPGLCGDLDGLCDSRAEVKSQGYIWLLRCMFILSGLVFVVGVVWFYLKYKNFKKVNRTIDKSKWTLMSFHKLGFSEYEILDCLDEDNVIGSGASGKVYKVVLNSGEVVAVKKLWRRKVKECEVEDVEKGWVQDDGFEAEVDTLGKIRHKNIVKLWCCCTARDCKLLVYEYMQNGSLGDLLHSSKGGLLDWPTRFKIALDAAEGLSYLHHDCVPAIVHRDVKSNNILLDGDFGARAANSPLAKVVDVTGKGPQSMSGITGSCGYIAPEYAYTLRVNEKSDIYSFGVVILELVTGRLPVDPEFGEKDLVKWVCTALDQKGVDSVVDPKLESCYKEEVGKVLNIGLLCTSPLPINRPSMRRVVKLLQEVGTEKHPQAAKKEGKLSPYYYEDASDHGSVA

SEQ ID NO: 90319 - protein, 510 aa, Idiomarina baltica OS145
MAHDKKPLVLMILDGWGYRDSAPDNAITAANTPVMDRLWNEYPHCLVDGSGGAVGLPDGQMGNSEVGHVNLGAGRVVYQDFTRISQSIKTGEFFDNPVLTENVEQAVAKNGAVHIMGLLSAGGVHSHEEHLMAMVELAHKKGAQRIYVHGFLDGRDTPPKSAGPSIEKFEALFERLGVGRFASLSGRFYAMDRDNRWERIEGAFNAVYHGRAEHRANNAHNALADAYERGESDEFVSPVVIGEPAAIEDGDAVFFMNFRADRAREMTRAFIDNELDTFERGIRKQLSGFVMLTQYADEFDTPCAFPPVRLDNVLGEWLAKHDKTQLRISETEKYAHVTFFFSGGREQAFDGEQRKLIPSPKVKTYDLQPEMSSKQLTDAIVEAVDNQEYDVIICNYPNGDMVGHTGNFDAAVKACEAVDHSVGRVVEALQKVGGECLITADHGNAEQMSDPSTGQAHTAHTSELVPFIYVGRHATPRNGILSDVAPTMLHLMGLEQPNEMTGKTLMQLDG

SEQ ID NO: 90320 - protein, 493 aa, Bacillus licheniformis ATCC 14580
MGKATGFMEFKREKPAERDPLTRINDWNEYSSPFSEEASKRQGARCMDCGTPFCQIGMDIGGYTSGCPIHNLIPEWNDLVYKGRWKEALDRLLKTNNFPEFTGRVCPAPCEGSCTVAISDPAVSIKGIERTIIDKGFENGWIQPRIPKKRSGKKIAIVGSGPAGLASADQLNQAGHSVTVYERSDRPGGLLMYGIPSMKLEKSVVERRIKLLTQEGVDFVTNTEIGKDITADELKEQYDAIILCTGAQKQRDLLIEGREAKGVHFAMDYLTGTIKSMLDSNFKDKQFINTKNKDVIVIGGGDTGADCVATALRQKARSVVQFGKHPKLPDTRTAENMWPEQPHVHTLDYAYEEAQAVFGNDPRQYSIQTKKLVADKNGHLKELHTIQMKKVKNDQGKFEFHEIPGTEKVWPAQYVFIAIGFEGTEQPLLEQFGVNTVRNKVDAAYGEFKTNVDGVFAAGDARRGQSLIVWAIHEGREVAREVDKYLMGSSVLP

SEQ ID NO: 90321 - protein, 412 aa, Arabidopsis thaliana
MEGQTHDAQNNVPEHDNPLMNVKNPSSNLFSKKDAQCLSVLCNGKWLQIVRSSPKVSCEASTCPSHILTKVGENYVAESEKMHKKVISFSSKTFSQGTLQFTMRANGTPHFVFKLENQKDVYVASLSSNVQDQNSYMIHLQRGESSASSSHLVGRINVSTLFSEKVLEREFVLFSSNGENLKIPRTRKNRGLSKKVVHAVKNERRTARLSRTSFIPDLGSWDEQFQAQNYDCLLKNKLPTNLETLAVVVKQETIEDEIGGWGLKFLKRSPMFQRSNDASETETSTSSISMNVVIPSGIHGGPEDGPSSLIERWKSQGNCDCGGWDLCCSLTLLKGQPRKDQYFELFIEGSKHETTGLKIVNVSGGLYLVQFEAKLTSLQSFAIALAFIHSEKLRPLHLYKLEKCQILERRSF

SEQ ID NO: 90322 - protein, 998 aa, Malus x domestica
  misc_feature (703)..(703): Xaa can be any naturally occurring amino acid
MLLFLLPLLLLLPPLPTTLSLNQEGLYLQHFKLSLDDPDSALDSWNDADSTPCNWLGVKCDDASSSSPVVRSLDLPSANLAGPFPTVLCRLPNLTHLSLYNNSINSTLPPSLSTCQNLEHLDLSQNLLTGALPATLPDLPNLKYLDLTGNNFSGPIPDSFGRFQKLEVLSLVYNLIEGTIPPFLGNISTLKMLNLSYNPFLPGRIPAELGNLTNLEVLWLTECNIVGEIPDSLGRLKNLKDLDLAINGLTGRIPPSLSELTSVVQIELYNNSLTGKLPPGMSKLTRLRLLDASMNQLSGPIPDELCRLPLESLNLYENNFEGSVPASIANSPNLYELRLFRNKLSGELPQNLGKNSPLKWLDVSSNQFTGTIPASLCEKRQMEELLMIHNEFSGGIPVRLGECQSLTRVRLGHNRLSGEVPAGFWGLPRVYLMELVENELSGAISKTIAGATNLSLLIVAKNKFSGQIPEEIGWVENLMEFSGGENKFNGPLPESIVRLGQLGTLDLHSNEISGELPIGIQSWTKLNELNLASNQLSGKIPDGIGNLSVLNYLDLSGNRFSGKIPFGLQNMKLNVFNLSNNRLSGELPPLFAKEIYRSSFLGNPGLCGDLDGLCDGKAEVKSQGYLWLLRCIFILSGLVFVVGVVWFYLKYKNFKKANRTIDKSKWTLMSFHKLGFSEYEILDCLDEDNVIGSGASGKVYKVXLSSGEVVAVKKLWGGKVQECEAGDVEKGWVQDDGFEAEVETLGRIRHKNIVKLWCCCTTRDCKLLVYEYMQNGSLGDMLHSIKGGLLDWPTRFKIALDAAEGLSYLHHDCVPAIVHRDVKSNNILLDGDFGARVADFGVAKVVDVTGKGPQSMSGITGSCGYIAPEYAYTLRVNEKSDIYSFGVVILELVTGRLPVDPEFGEKDLVKWVCTALDQKGVDSVVDPKLESCYKEEVGKVLNIGLLCTSPLPINRPSMRRVVKLLQEVGTEKHPQAAKKEGKLSPYYYEDASDHGSVA

SEQ ID NO: 90323 - protein, 317 aa, Kluyveromyces lactis NRRL Y-1140
MNTGIRKDHLRKGETVSWYNSVIAGSVSGVFARMATAPMDTVKIRYQLQPVQEDKYKGIASTVRTIMKEEGLRALWKGNIPATAMYVVYGAVQFGSYSWFNNVWSAKFPRFSQQGQTLTVGALAGMTSSVVSYPLDLLRTRLIANRTSHRTSVAEECRQMWLNEGVRGFFTGISTAMTTVTLSTAIMFLTYETVNIVCENHEKEFWSRPVSASSGIIAGFVSKTMVFPIDTLRRRMQVMNSKRTVHFTKFPAVYHEYRYKSSTAIIYKILRQEGVSALYRGLTMGLCKSVPTTAISLFVYERTMDLFDHGQRWGRSP

SEQ ID NO: 90324 - protein, 159 aa, Staphylococcus hominis
MKITILAVGKLKEKYWKQAIAEYEKRLGAYSKIEMIEVPDEKAPETMSDKEIEKVKEKEGQRLLAQIKPQATVITLEIQGKMLSSEGLAKELQQRMTQGQSDFVFVIGGSNGLHQDVLNRSNYALSFSKMTFPHQMMRVVLIEQVYRAFKIMRGEAYHK

SEQ ID NO: 90325 - protein, 648 aa, Xanthomonas campestris pv. vesicatoria str. 85-10
MLLCACRLRAAPPELPMTQESSAPLLFADLGLSDAVMKAVANVGYESPSPIQAATIPALLAGRDVLGQAQTGTGKTAAFALPVLSNADLHQVKPQALVLAPTRELAIQVAEAFQKYAEAIPGFRVLPVYGGQPYAQQLSALKRGVHVVVGTPGRVIDHLDRGTLDLSQLKTLVLDEADEMLRMGFIDDVEAVLKKLPAQRQVALFSATMPPAIRRIAQTYLKDPAEVTIAAKTTTSANIRQRYWWVSGLHKLDALTRILEVEPFDGMIIFARTKAATEELAQKLQARGMAAAAINGDMQQAAREKTIAQLKDGKLDILVATDVAARGLDVERISHVLNYDIPYDTESYVHRIGRTGRAGRNGDAILFVTPREKGMLRSIERATRQPIEEMQLPSVDAVNDTRVARFMSRITETLAGGQIDMYRDLLQRYEAENNVPAIDIAAALAKLLQGDAPFLLTPPVRGAREDTAPRERHERADRGDRPRFEPKFERGPRADGERAARPPRGDDAGERPRREPAPRGEPEFGMESYRIEVGHSHGVKPANIVGAIANEAGLESRYIGRIDIQDDYSILDLPADMPRELLQHLKKVWVSGQQLNMRKLEDGEAAAAASKPRFPRGGKPSGRPNGPGRPMDRAGAPHRKGPPKPRGE

SEQ ID NO: 90326 - protein, 372 aa, Desulfococcus oleovorans Hxd3
MNRSASTDVVSMPSGLDDLRREITRTDRELLALLNHRARLCRQVGRVKSAADQAVFKPFREKEVLEGLVAENPGDLPDDHLRTIYREILSSSRRLQQPQKAVYLGPEGTFSYFAGRELLGSSTDFEPCPSLETVFAAVAGKKADLGIVPLENSLSGSAGQNLDLFLRYGVHIQAEIYLRISYHLVGAGTGLAGIQTVYSHPRAIDQCAAWLSSHLPEAHVVFVGSTAAAAREAAGRPDCVAVGHRQLAAMFSLNLLAGPVEDAPDNWTRFIVIGHQAPAGGSRDKTSILFTLPDKSGALVSVLSVLARGGINMKKLESRPMRSEKWQYLFFADLECDLSDDEYADLQAELVENCQTLRVLGSYPAGLHLNDC

SEQ ID NO: 90327 - protein, 586 aa, Lactobacillus plantarum WCFS1
MKKTKIVSTLGPASTDTDTIVKLIEAGANIFRFNFSHGDHEEHLDRLNKVHEAEKITGKTVGIMLDTKGAEIRTTVQANGKSEYKIGDKVRITMDDSLDTTHDKIAVTYKNLYDDVHVGGHVLFDDGLLDMKIDEKDEANRELVTTVQNAGVLGSRKGVNAPGVSINLPGITEKDSSDIRFGLDHEINYIAASFVRKPQDVLDIRELLEEKHMEHVQIFPKIESQEGIDNADEILKVCDGLMVARGDMGVEIPAENVPLVQKSLIKKCNALGMPVITATQMLDSMQENPRPTRAEASDVANAVFDGTDATMLSGESANGLYPVESVAMMAKIDEKAENTLAENGTLQLNRFDKTSVTETIGIAIARAAKNLNIKTIVAATESGYTAKMISKYRPNADILAITFDERTQRGLMVNWGVQPIVAEKPETTDDMFDLAASKAVELGFAKEGDLILITAGVPVGERGTTNIMKIQLIGSKLADGQGVGDETVIGKAVIATSAQEAIDKAVEGGVLVTKTTDKDYLPAIEKSSALVVENGGLTSHAAVVGISMGIPVIVGVKDATSVIADGQLITVDSRRGLVYRGASNAL

SEQ ID NO: 90328 - protein, 506 aa, Pseudomonas putida KT2440
MIYAQPGTPGAVVSFKPRYGNFIGGEFVQPLAGQYFINSSPVNGQPIAEFPRSTAQDVERALDAAHAAAEAWGKTSVQDRARVLLKIADRIEQNLEVLAVTESWDNGKAIRETLNADVPLAADHFRYFAGCIRAQEGGVGEINEGTVAYHIHEPLGVVGQIIPWNFPLLMAAWKLAPALAAGNCVVLKPAEQTPLSITVFAELIADLLPAGVLNIVQGFGREAGEALATSKRIAKIAFTGSTPVGSHIMKCAAENIIPSTVELGGKSPNIFFEDIMQAEPAFIEKAAEGLVLAFFNQGEVCTCPSRALIQESIYEPFMAEVMKKIAKITRGNPLDTETMVGAQASEQQYDKILSYLEIAREEGAQLLTGGGAERLQGDLASGYYIQPTLLKGNNKMRVFQEEIFGPVVGVTTFKDEAEALAIANDSEFGLGAGLWTRDINRAYRMGRGIKAGRVWTNCYHLYPAHAAFGGYKKSGVGRETHKMMLDHYQQTKNLLVSYDINPLGFF

SEQ ID NO: 90329 - protein, 286 aa, Arabidopsis thaliana
MLLRLCRHRLPLPLTLSSSVFFSKSSPVSSAFMDASNPNSSRKSNVSSFAQSSRRGGGYERDNDRRRPQGRGDGGGGKDRIDALGRLLTRILRHMATELRLNMRGDGFVKVEDLLNLNLKTSANIQLKSHTIDEIREAVRRDNKQRFSLIDENGELLIRANQGHSITTVESEKLLKPILSPEEAPVCVHGTYRKNLESILASGLKRMNRMHVHFSCGLPTDGEVISGMRRNVNVIIFLDIKKALEDGIAFYISDNKVILTEGIDGVLPVDYFQKIESWPDRQSIPF

SEQ ID NO: 90330 - protein, 326 aa, Bacillus subtilis
MKAVTYQGIKNVVVKDVPDPKIEKSDDMIIKVTSTAICGSDLHLIHGFIPNMQEDYVTGHEPMGIVEEVGSGVTKLKKGDRVIIPFNIACGECFFCKNQLESQCDQSNDNGEMGAYFGYSGQTGGYPGGQAEYLRVPFANFTHFKIPESCEEPDEKLSVIADAMTTGFWSVDNAGVKKGDTVIVLGCGPVGLFAQKFCWLKGAKRVIAVDYVNYRLQHAKRTNKVEIVNFEDHENTGNYLKEITKGGADVVIDAVGMDGKMSDLEFLASGLKLHGGTMSALVIASQAVRKGGTIQITGVYGGRYNGFPLGDIMQRNVNIRSGQAPV

SEQ ID NO: 90331 - protein, 355 aa, Burkholderia sp. 383
MKIAVLPGDGIGPEIVNEAVKVLNALDEKFELEQAPVGGAGYEASGHPLPDATLKLAKEADAILFGAVGDWKYDSLERALRPEQAILGLRKHLELFANFRPAICYPQLVDASPLKPELVAGLDILIVRELNGDIYFGQPRGVRTAPDGLFAGEREGFDTMRYSEPEVRRIAHVAFQAARKRAKKLLSVDKANVLETSQFWRDIMIDVSKEYADVELSHMYVDNAAMQLAKAPKQFDVIVTGNMFGDILSDEASMLTGSIGMLPSASLDKNNKGLYEPSHGSAPDIAGKGIANPLATILSAAMMLRYSLNRAEQADRIERAVKTVLEQGYRTGDIATPGGQQVGTTAMGDAVVAAL

SEQ ID NO: 90332 - protein, 122 aa, Helicobacter hepaticus ATCC 51449
MKMPPLNEQERAVLLHKATEAPFSGAYTDCFENGIYLCRQCGTPLYESNAKFPSHCGWASFDDEIQGAIKRIPDSDGVRTEIICAHCGGHLGHIFENEGFTPKNIRHCVNSLSLSFRKNNAQ

SEQ ID NO: 90333 - protein, 382 aa, Zea mays
RERERGGRVAASRGVEEMSVAKEAGPSSRAVLVTGGAGYIGSHAVLQLLTAGFRVVVVDSLANSSELVIRRLRSLAVEHAKNLAFHKVDIRDKDGLEKVFASTRFDAVIHFAGLKAVGESVQKPLLYYDHNVVGTINLLEVMAAHGCKKLVFSSSAAVYGSPKNSPCTEDFPLTPHNPYGRTKLMAEEICRDIYHSDPEWNIILLRYFNPVGAHPSGYLGEDPCGTPNNLMPFVQQIAVGRRPSLTIFGNNYATKDGTGVRDYIHVVDLAEGHLFALKKLFESSSNIGCEAYNLGTGKGTSVLEIVNAFEKASGKKIPLIMGQRRPGDAEILFSSPAKAERELHWKAKYGITEMCGDLWNWASKSPYGYAASESPKLNGSSR

SEQ ID NO: 90334 - protein, 671 aa, Yersinia pseudotuberculosis IP 32953
MNPFIVADAESCIGCRSCEVACVVAHHEGQFPDKPEYFTPRVKVFKGDQCATAVFCHHCEDAPCASTCPNGAIVELNNSIQVIQEKCIGCKTCMIACPFGMMTVVTETVQPASHRLADVYRRTEAQKCDLCLDQPDGPACIKTCPTQALTLVDQQYLLHQQQQKRQHMALNEHNGRLFSRAVVQAASASSNKSIRDATPVNLLQRPRAPRLEPKKIPLAERKTGFAEIYLPFTESQIHEQAERCLECGDKTICQWTCPLHNAIPKWISLAHQGRIHEAAELSHQTSSLPEVCGRVCPQDRLCEQSCTLNDHDGAVTIGQIERHITETALATGWRPDLSQVKPSGKRVAIIGAGPAGLGCADILVRNGITPVVFDRYPEIGGLLTFGIPAFKLEKSVMTRRREIFTEMGVEFCLNTEIGRDITMENLLHDFDALFLGVGTYRSMRSGLENEDAQGVYDALPFLIGNTQHLMGYTANGAHPYVSMQDQRVVVLGGGDTAMDCVRTSLRQGASRVVCAYRRDEKNMPGSKREVKNAREEGAEFMFNLQPMSIVVDESGQVTGIKMVRTEMGQADAQGRRQALPIAGSEHLIPADAVIMAFGFSPHRMSWLAEHNVVLDKQGRVVAPTISGYPYQTSNPKIFAGGDIVRGADLIVTAIAEGRKAAESIAYYLNVL

SEQ ID NO: 90335 - protein, 326 aa, Azoarcus sp. BH72
MTHWYEDNARSIGHTPLVRLNRVTDGAPATILAKIEGRNPGYSVKCRLGAALIWDAEKRGLLGPGKELVEPTSGNTGIALAFVAAARGIPITLTMPETMSIERRKLLLAYGAKLVLTEGPKGMSGAVAKAEEIAASDPSRYVLLQQFKNPANPAIHEETTGPEIWNDTEGAVDIFVSGVGTGGTITGVSRYLKKTRGKDVLSVAVEPAASPILTQKRSGQELKPAPHKIQGIGAGFVPEVLDLSLVDQVETVGNEEAVDYARRLAREEGILSGISSGAAVAAAVRLARDPQHAGKTIVVVLPDSGERYLSSVLFEGVFDATGLPTA

SEQ ID NO: 90336 - protein, 636 aa, Streptococcus agalactiae 2603V/R
MIILQGNKIERSFSGDVLFDNINIQVDQRDRIALVGRNGAGKSTLLKILVGEEAPTKGEINKKRDLSLSYLAQDSRFQSENTIFQEMLQVFDSLREVEKRLRELELQMGQVSGSDLEQLMKTYDILSEEFREKGGFTYESDIKAILNGFKFNSDMWEMPISELSGGQNTRLALAKMLLEKPELLVLDEPTNHLDIDTIAWLENYLVNYQGALIIVSHDRYFLDKVATVTYDLTTHSLDRYVGNYSKFMDLKAEKIATEEKNFEKQQKEIAKLEDFVQRNIVRASTTKRAQARRKQLEKMERLDKPNVEQKSANMTFHAGKVSGNVVLTLENAAIGYEGVSLSEPIDLDVKKFDAIAIVGPNGIGKSTLIKSLVGQIPFIKGEAKLGANVETGYYDQSQSNLTKTNTVLDELWDAFSTTPEVEIRNRLGAFLFSGDDVKKSVSMLSGGERARLLLAKLSMENNNFLILDEPTNHLDIDSKEVLENALIEFDGTLLFVSHDRYFINRVATKVLEISDKGSTLYLGDYDYYLTKKAELEELARLNEEEVSASKTEIDVTSDYETQKANQKEFRKITRRVVEIEARLEVLENDENNINGLMLETNDIGKLSDLQKELESIQEEQLLLMEEWENLNMRLDL

SEQ ID NO: 90337 - protein, 462 aa, Streptococcus agalactiae 2603V/R
MAVEIIMPKLGVDMQEGEILEWKKQVGDVVNEGDVLLEIMSDKTNMEIEAEDSGVLLKITHGNGDVVPVTETIGYIGAEGEEVTEASSSENTSVEENATQVTSEPEKVEETSEPSVPAATSGEKVRATPAARKLAREMSIDLALVSGTGANGRVHREDVENFKGAQPRITPLARRIAEDQGVDIAEITGSGIRGKIVKNDVLAAMSPQAAEAPVETKATPTTEEKQLPEGVEVIKMSAMRKAISKGMTNSYLTAPSFTLNYDIDMTEMMALRKKLIDPIMAKTGLKVSFTDLIGMAVVKTLMKPEHRYLNASLINDAQEIELHNFVNIGIAVGLDDGLIVPVVHNADQMSLSDFVIASKDVIKKTQEGKLKSAEMSGSTFSITNLGMFGTKTFNPIINQPNSAILGVGATIPTPTVVDGEIVARPIMAMCLTIDHRIVDGMNGAKFMVDLKNLMENPFGLLI

SEQ ID NO: 90338 - protein, 152 aa, Streptomyces coelicolor A3(2)
MAIQVGDKAPDFELKDNHGATVRLSEFRGRKNVVLLFYPFAFTGVCTGELCEVRDNLPQFSDRDTEVLAVSNDSIHTLRVFAEQEGLEYPLLSDFWPHGNVSRAYGVFDEDKGCAVRGTFVIDQEGVVRWTVVNALPDARDLAEYVKALDAL

SEQ ID NO: 90339 - protein, 585 aa, Streptococcus agalactiae 2603V/R
MAFDVIMPKLGVDMQEGEILEWKKNEGDTVNEGDVLLEIMSDKTNMEIEAEDTGVLLKIVHQAGDVVPVTEVIAYIGEEGEEVGTSSPSADATITAEDGQSVSGPAAPSQETVAAATPKEELAADEYDIVVVGGGPAGYYAAIRGAQLGGKIAIVEKTEFGGTCLNVGCIPTKTYLKNAEILDGLKVAAGRGINLASTNYAIDMDKTVAFKNSVVKTLTGGVRGLLKANKVEIFNGLGQVNPDKSVVIGDKVIKGRNVVLATGSKVSRINIPGIESPLVLTSDDILDLREIPKSLAVMGGGVVGIELGLVWASYGVDVTVIEMADRIIPAMDKEVSLELQKILAKKGMKIKTSVGVSEIVEANNQLTLKLNNGEEVVADKALLSIGRVPQMNGLENLEPELEMERGRIKVNAYQETSIPGIYAPGDVNGTRMLAHAAYRMGEVAAENALGGNKRKAHLDFTPAAVYTHPEVAMVGMTEEQAREQYGDILVGKNSFTGNGRAIASNEAHGFVKVIAEPKYKEILGVHIIGPAAAELINEASTIMENELTVYDVAQSIHGHPTFSEVMYEAFLDVLGEAIHNPPKRK

SEQ ID NO: 90340 - protein, 352 aa, Pisum sativum
AGDSQTIVIGLAADSGCGKSTFMRRLTSVFGGAAEPPKGGNPDSNTLISDTTTVICLDDYHSLDRTGRKEKGVTALDPKANDFDLMYEQVKAIKDGKSVQKPIYNHVTGLLDAPELIKPPKILVIEGLHPMYDSRVRELLDFSIYLDISNEVKFAWKIQRDMAERGHSLESIKASIEARKPDFEAYIDPQKQYADAVIEVLPTQLIPDDNEGKILRVRLIQKAGVKYFSPVYLFDEGSTISWIPCGRKLTCSYPGIKFFYGPETYKGNEVSVVEMDGQFDRLDELIYVESHLSNLSSKFYGEVTQQMLKHADFPGSNNGTGLFQTIVGLKIRDLFEQIVASRAETPVGAAKA

SEQ ID NO: 90341 - protein, 315 aa, Idiomarina baltica OS145
MPKISLPRYDDIVLAANRLEGFIKHTPVLTCSEIDEALGCEVFFKCENLQKSGAFKYRGASNALLSLSEQQRQTGVFTVSSGNHGAALGYAGARLGISVTVAVPYNAPAIKRNNIEASGASIVTIEPGMEARERFAAERAQTGETFIPPYDHPDIIAGQGTATLELLKQVEDLDTVVAPLGGGGLLAGACLAAQGLEVYGAEPMLANDGFESLRTGVRQPAKPPRSICDGLLTQLGEYNFEILKRHVSAVLVVEDKDTKAAMELIWQRLKIIIEPSSAITLAALKQERSRFAGKRVGIVLSGGNIAAEPSQPLKV

SEQ ID NO: 90342 - protein, 148 aa, Polytomella parva
TFHILKDGDLQTITSDDIFAKKKVVIFGLPGAFTPTCSKSHVPGFVERAAEFKAKGVDTIACISVNDAFVMKAWGDSLGVGENVLMLADGLATFTKAAGLDQYLEPNGLGLRSKRYAAVVEDGVVTRINIEEGRAFVCSRADVMVDLL

SEQ ID NO: 90343 - protein, 539 aa, Brassica napus
MAARSRVSSLLSRSFSASSPFLSRSQGKNLNNGSRIVRRFGTSSAAEEVISPSVQVSYTKLLIDGNFVDAASGKTFPTLDPRTGEVIAHVAEGDAEDINRAVKAARKAFDEGPWPKMTAYERSRVMLRFADLVEKHSEELAALESWDNGKTYEQALTAEIPMVARLFRYYAGWADKIHGLTVPADGNYHVQTLHEPIGVAGQIIPWNFPLLMFAWKVGPALACGNTIVLKTAEQTPLTAFYVGKLFLEAGLPPGVLNIVSGFGATAGASLASHMDVDKLAFTGSTDTGKVILGLAANSNLKPVTLELGGKSPFIVFEDADIDKAVELAHFALFFNQGQCCCAGSRTYVHEKVYDEFVEKAKARALKRVVGDPFKKGIEQGPQIDSKQFEKVMKYIRSGVESNATLECGGGQVGDKGYFIQPTVFSNVKDDMLIAQDEIFGPVQSILKFSDVDEVIKRANDTRYGLAAGVFTKSLDTANRVSRALKAGTVWVNCFDVFDAAIPFGGYKMSGNGREKGIYSLNNYLQVKAVVTPLNNPAWI

SEQ ID NO: 90344 - protein, 201 aa, Polytomella parva
MLSSIKSSLKLSSLILKVNHNGRYLLFLVIVSKALFPSTADMHVTLCLQCPCEFIYVILCPYSILHFFNNILLLNLFLFMNVGKYVVLFFYPLDFTFVCPTEITAFSDRYSEFKKLNTEVIGVSVDSKFTHLAWIQTDRKEGGLGNLTYPLMSDLKRDISESFGVLTPDGIALRGLFIIDPQGFVQHATINNLGFGRSVDE

SEQ ID NO: 90345 - protein, 160 aa, Sinorhizobium meliloti
MRIGLFAVGRLKAGPEKDLAGRYLDRFAKAGPAVGLELARVVETAESRAANAETRKREEAGQLEKALADGSLLVLLDERGKALDSEAFARLLGTLRDSGKRDLMIAIGGADGLDPALHARADAVLNLGKMTWPHQLVRILIAEQLYRAVTILSGHPYHRA

SEQ ID NO: 90346 - protein, 510 aa, Burkholderia sp. 383
MDALQAAAETAAPSGTALKRRLQGRHIAMIAIGGSIGTGLFVASGASVAQAGPGGAIAAYIAIGLMVYFVVTGLGEMAALMPVSGSFAIYGEKYVDEGFGVALGWTYWYSWAVTIAIELVAAQIVMRYWFPTIPGIWWGAGFLVLIFLLNTLSVRGFGESEYWFSLIKVVTVVAFIAAGLLIAAGLIGNGHPVGMRNFTTGDAPFVGGVHAMMSVALIAGFSFLGTELVGITAGESENPRKTIPRAVKQIFWRIMLFYVFAIFVIGLLVPYTDPNLLKSDVTDIGVSPFTLVFSHAGFRLAAGAMNLVILTAVLSAGNSGTYAATRMLYNLAAEGRAPAMFATLSPGGVPRNALYATMAVGGLCFLTSLTNNQSIYLWLLNTVGITGFIAWLGIAVCHYRFRKGFLKQGYRLDQLPYRAKWFPFGPLFAIAICIVISLGQDYQAFFAARIDWMEVLSIYVWIPLFVAIWWAYRRARKSRLVRYEEMDIGPWLTRSVEAVDATVTQHGQPH

SEQ ID NO: 90347 - protein, 200 aa, Physcomitrella patens subsp. patens
MAEAVLEGSQPVDLAKHPSGIIPTLQNIVSTVNMDCRLDLKKIALQARNAEYNPKRFAAVIMRIREPKTTALIFASGKMVCTGAKSEQQSKLAARKYARIIQKLGFQAHFKDFKIQNIVGSCDVKFPIRLEGLAYAHGHFSSYEPELFPGLIYRMKQPKIVLLIFVSGKIVLTGAKVRDEIYEAFENIYPVLTEFRKIQQ

SEQ ID NO: 90348 - protein, 448 aa, Escherichia coli
EIVVSKFGGTSVADFDAMNRSADIVLSDANVRLVVLSASAGITNLLVALAEGLEPGERFEKLDAIRNIQFAILERLRYPNVIREEIERLLENITVLAEAAALATSPALTDELVSHGELMSTLLFVEILRERDVQAQWFDVRKVMRTNDRFGRAEPDIAALAELAALQLLPRLNEGLVITQGFIGSENKGRTTTLGRGGSDYTAALLAEALHASRVDIWTDVPGIYTTDPRVVSAAKRIDEIAFAEAAEMATFGAKVLHPATLLPAVRSDIPVFVGSSKDPRAGGTLVCNKTENPPLFRALALRRNQTLLTLHSLNMLHSRGFLAEVFGILARHNISVDLITTSEVSVALTLDTTGSTSTGDTLLTQSLLMELSALCRVEVEEGLALVALIGNDLSKACGVGKEVFGVLEPFNIRMICYGASSHNLCFLVPGEDAEQVVQKLHSNLFED

SEQ ID NO: 90349 - protein, 294 aa, Bdellovibrio bacteriovorus HD100
MPRVKKAIIPAAGLGTRFLPATKTVPKEMLTIVDAPIILYVVEEAVKAGIEDIILIAGRGKHAIEDFFDTSYELEDKLAKDGKEKLLERVTRIRDSANIISIRQKQAMGLGHAVLCGLPIVGKEPFAVLLGDEITMGFHGEPNVTSQLVSSFEETGTSTISVMKVEDKDVSKYGIAEIEEKSTGFFKVTSLVEKPKASETNSRWALPGRYVFDNAIMDILQNAKPTLNGEIQLTDSMKVLCAQHGLNAMTFTAQRFDAGDKLGYLQANIELALQSPELNQELKSYILSLAEKLK

SEQ ID NO: 90350 - protein, 169 aa, Paracoccidioides brasiliensis
MSAPENSKITLIPSDEPEDGRGIEVERVIIERSILIKNMLEDLGDSGEPIPIPNVNKAVLEKVIEWCEHHRNDPPTTNDEDYDSRRKTTDIDEWDQKFMLVDQEMLFEIILAANYLDIKALLDVGCKTVANLIKGKSPDDIRKTFNIQNDFSEQEEAQIRAENEWAEDR

SEQ ID NO: 90351 - protein, 457 aa, Mesorhizobium loti MAFF303099
MLANSLIELDRAHLIHPVSSYRGHEALGVRVLKSAKGATVTEASGRQLVDGFAGLWCVNAGYGHDSIVEAAARQMRELPYATAYFDLGAEPAIRLASELAERAPGDLNHVFFTLGGSDAVDSTVRFVRYYWNARGAPKRDQFISIEQGYHGSSVVGAGLTALPAFHAGFGIPFEWQHKIPSPYPYRNPVGEDANAIIAASLAALKAKIEELGPERVAAFYAEPIQGSGGVIVPPKGWIKAMRELCREYGILFIADEVITGFGRTGPLFACTDEEIVPDFMTTAKGLTSGYVPMGAVFMADHVYDVIADGAGASSVGHGYTYSAHPVSAAVALEVLKLYEDGLLENGIKAGARLMAGLSGLSDHPLVGDVRGRGMLAAIELVVDKEKKTPLPASAMPARRIFDRAWDNGLIIRAFANGVLGYAPPLCCTDADIDAIIERTRRTLDQTLADPDVRQALA

SEQ ID NO: 90352 - protein, 321 aa, Idiomarina baltica OS145
MKVYDNVLEMIGNTPLVKVNNIDTGPCDLYLKLELQNPGGSIKDRIAVEMINAAERDGKLKPGDTIIEATAGNTGLGLALVAASKGYPLMIVMPDKMSQEKVNNLRAMGATVKQTRSDVQKGHPEYYQDMAARLAEENGWFYVNQFENPANVEAHYKTTGPEIWQQTDGDIDAFVCGVGSGGTLTGIGRYLREQKSDVDLVLADPAGSILEPLVNRGEHVEAGSWLAEGIGEDFVPKICEIELANKAYAISDKEGMQMARQVLEKEGVMVGSSSGTLIAAAVRYCQDQTERKQVVTLACDTGNRYLSKLFNDEWMRENNLL

SEQ ID NO: 90353 - protein, 485 aa, Mesorhizobium loti MAFF303099
MKTLKDKNLFREAGLIGGEWVAAGSGKTVDVIDPATQAAIGTVPDMAGSDTRAAIDAAASAYGDWKKKTNAERADLLEAWHGLMLAHLDDLALILTTEQGKPLDEAKGEIRYGASFVKWFAEEARRINGHTIPSPTQDRRIIVLKEPVGVCGIITPWNFPNAMITRKVAPALAAGCTVVIKPSEFTPYSALALGVLAERAGIPAGVINIVTGMPAEIGNEIMANETVRKISFTGSTRVGSLLMRGAADSVKRLSLELGGNAPFIVFDDADLDLAVEGALVSKFRNGGQTCVCANRILVQAGVYEAFAAKLSARVNAMTVGPGTQPGVAIGPMINMAAVEKINRHVEDALAKGAAIITEKPALPEGPQYVAPLVLSGATKDMQLAGEETFGPVAPLFRFETEEEAIALANGTPYGLASYFYTENLKRAWRVGEALEFGMVGLNTGSVSMEVAPFGGIKQSGLGREGAQAGIEEYLEMKSFHIGGLG

SEQ ID NO: 90354 - protein, 526 aa, Arabidopsis thaliana
MAAMITVDFQNSFIFILFCLFSLICYSLFFRKPKDSRAGRDLPPSPPSFPVGSPQSNNLHLLLSALVHKSFQKISYKYGPLLHLRVFHVPIVLASSASVAYEIFKAQDVNVSSRGHAPAGESLLFGSSSFFFAPYGDYFKFMRKLIATKLLGPQALERSRKIRADELDRFYRNLLDKAMKKESVDIVEEAAKLNNNIICKMIMGRSCSEDNGEAERVRGLVIESTALTKQIFLGMIFDKPLKKLGISLFQKDIKSVSRFDELLEKILVEHEERMGKHYKANDMMDLLLEAYGDENAEYKITRNHIKSLFVDLVIAGTDTSAQTIEWTMAELINNPNILERLREEIESVVGNTRLVQETDLPNLPYLQAVVKEGLRLHPPGAVFLRTFQERCELKGFYIPEKTLLVVNVYAIMRDPKLWEDPEEFKPERFIASSRSGQEDEIREEVLKYMPFSTGRRGCPGSNLAYVSVGTAIGVMAQCFDWRIKGEKVNMNEAAGTLVLTMAQPLMCTPGPRTLNPLPSSLHVPIS

SEQ ID NO: 90355 - protein, 347 aa, Mesorhizobium loti MAFF303099
MKSYSIAMIPGDGIGRDVTAAAWTVLEAAAKHAGFALTGTEFPWSCKFYKDTGRMMPEDGIETLRGFDAILLGAVGWPAEVPDSVSLHGLLLPIRKAFVQYANIRPHRLLPGVTGPLRAEGFDILCIRENTEGEYSGAGGRVHQGTLDEVAVETSIFTRAGVERILRFGFEQARTRNGKLASVTKSNAQKYSMVFWDEITRKLAAEYSDVAVTSYHVDALAARMIMAPESLDVVVASNLFGDILTDIGAAIQGGLGYAASANINPDHSAPSMFEPVHGSAPDIAHLGIANPIATIWSGAMMLDHLGEKPAADRVMKAVEVATARGIGTIPAKDRTEAITAAVVAALT

SEQ ID NO: 90356 - protein, 399 aa, Oryza sativa
  misc_feature (227)..(227): Xaa can be any naturally occurring amino acid
MAAATTSLLLEATPRLLSLPPRRPVQPRGGIFLLKPPPPPPFPSRRGVAVAVAPPLRASHPDTARRVSVSPAAVEPPPKPRALLDAIKRSLLDSLAALKKPALALLLAGALLAAAGPHHGAALAASGGRVGGSAFSSRSSSPPSSYGYTAPAPRGGYSAAPFYSPSPFVSVGPAVGIGFGGSSFFFVLMGFAAFLYLAGFLSDSSRRGVLTETDKTTVLKLQVGLLXGMARSFQKELDQIAEKADTSTPAGLSYVLTETTLALLRHPDCCISAYSSVDVKRSIDDGEKRFNQLSIEERGKFDEETLVNVNSIKRQKAGSQRSSGFSNEYIVITILVAAEGVHKLPSINGSGDLKTALQKLGAIPSRKILAVEVLWTPQNENDTLSERELLEDYPLLRPL

SEQ ID NO: 90357 - protein, 798 aa, Lactobacillus plantarum WCFS1
MSSRDTANVLWFDELHREDVNLVGGKSSSLGEMTSSMDVPVPYGFATTARAYQYFMTQTGLNDKVNDLLASIQDYENSDELHTACEQIRNLIVNATMPADLAADIEQAYADLAKKMGQTDPFVAIRSSATAEDLPNASFAGQQESYLNIKGAADVVNRVQQCYSSLFTDRATYYRHKQHFPHEKVALSAAIQMMVFSKASGIMFSVNVADGDASKIVIDAIYGLGEYIVLGKVTPDHFVIDKQSMKIVEKNIIKQPVQLMRLPGGGTKEESVPDELQGQPVLTDAQVIELAGYAKEIERHYGCYMDMEYALDTNTNRLWIVQARPETVWSQRNKHKDAADDEDVVDEADAKVIVRGLPASPGLASGVVHVIDNPKDIDQFKQGEVLVTLMTSPDWVPAMKKAAAIVTNNGGMTCHAAIVSREMQIPCIVGTKSKEVAATDVLKTGDVVTVDAKNGVVYQGKVASMLKPKSGATAVAGQVVAAESFAPTATGVMMNLGDPDLADKYSSLPADGIGLMREEFLWTTFIHEHPLYLIEQGHPEKVVNMLADGIAKVVRAMAPRPVVLRFSDFKSSEYRNLKGGDKYEPHEPADLLGWRGASRYYDSKYIEAFKLELAAVKKVRNEFGLKNLNVMIPFVRTVDEAQKVTTIMRDEGLARSADFKVYMMAEIPTNIILADQFNQFVDGYSIGSNDLAMLILGCDRNNDTVAHLFDERNLAVKRAIRHLIKTAHKDGKTVSICGQAPSEYPEFTNFLIQSGIDYVSVNPDMVKETKRNVAHFEQRIMLDKATGRGLQDPIDYKW

SEQ ID NO: 90358 - protein, 337 aa, Brassica napus
RPTRPRDLRWRTGVNLVPVTCHSSNGFKITAEALDAAYENARVSNIPVKGLLITNPSNPLGTTLDRDCLKSLVKFTNDKGIHLIADEIYAATTFGESEFISVAEVIDEIPDCNTDLIHIVYSLSKDMGLPGLRVGIVYSYNDRVVQIARKMSSFGLVSSQTQHLIAKMLSDEDFVDEFIRKSKLRLAERHAELTTGLDGLGIGWLKAGAGLFIWMDLRNLLKTATFDSEMELWRVIVHKVKLNVSPGGSCHCHEPGWFRVCFANMDYQTMETALERIRVFTCQIEEESLILTKPMAKKKKCWQSSLRLSFKDTRRFEEGFFSPHSPVPPSPLVRAQI

SEQ ID NO: 90359 - protein, 429 aa, Lactobacillus plantarum WCFS1 [sequence omitted]

SEQ ID NO: 90360 - protein, 528 aa, Magnaporthe grisea 70-15
MSKVEHNACLIVIDGWGVASEESPKNGDAIAAAETPVMDEFARSKTGYVELEASSLAVGLPEGLMGNSEVGHLNIGAGRVVWQDVVRIDQSIKTGEFSKNEVITQVIEAAKSGNGRLHLCGLVSHGGVAAKEAQVPKVFIHFFGDGRDTDPKSGVGYMEELLEKTKEIGIGQIATVVGRYYAMDRDKRWERVELAMKGLVLGEGEASEDPVKTVKERYEKGENDEFLKPIVVGGDEGRIKDGDNVFFFNYRSDRVRQITQLLGDVDRSPRPDFPYPKIKLATMTRYKLDYPFDVAFEPQKMGNVLAEWLGKQNVPQVHVAETEKYAHVTFFFNGGVEKAFALEERDESQDLVPSNKSVATYDKAPEMSADGVADQVAKRLGEQKFPFVMNNFAPPDMVGHTGVYEAAIVGCAATDKAIGKIYEACKAHNYVLFITADHGNAEEMKFPDGKPKTSHTTNKVPFIMANAPEGWSLKPVGGVLGDVAPTVLACMGLPQPEEMTALVASARVAPAPDACAPAAWFFADVERD

SEQ ID NO: 90361 - protein, 186 aa, Brassica napus
MAFSFSFTALALLISSLAAAFLLLFRRTRYRRMGLPPGSVGFPLIGETLQLIKAYKTEDPEPFIDERVARYGSVFTTHLFGEPTVFSADAETNRFVLQNEGKLFECSYPDSISNLMGKHSLIRMEGSLHKRMHSFTMSFANASAMKDHLMVDIDRLVRFNLGSWSSRVLLMEESKKMTFDVAVKQL

SEQ ID NO: 90362 - protein, 496 aa, Glycine max
MPPILPDFSNSVKLKYVKLGYQYLVNHILTLTLIPMMIAIFMEILRLGPEEILNLWHSLHLDLVQILCSAFLIIFIATVYFMSKPRTIYLVDYACFKPPVTCRVPFATFMEHSRLILKDNPKSVEFQMRILERSGLGEETCLPPAIHYIPPKPTMEAARGEAELVIFSAMDSLFNKTGLKPKDIDILIVNCSLFSPTPSLSAMVINKYKLRSNIKSFNLSGMGCSAGLISVDLARDLLQVHPNSNAVVVSTEIITPNYYQGKERAMLLPNCLFRMGGAAILLSNRTSERRRAKYRLVHVVRTHKGADDKAYRCVFEEEDREGKVGISLQKDLMAIAGEALKSNITTMGPLVLPASEQLLFLLTLIGRKIFNPKWKPYIPDFKQAFEHFCIHAGGRAVIDELQKNLQLSTEHVEASRMTLHRFGNTSSSSLWYELNYIESKGRMKKGDRVWQIAFGSGFKCNSAVWKCNRSIKTPVDGPWADCIDRYPVDIPEIVKL

SEQ ID NO: 90363 - protein, 255 aa, Oryza sativa Japonica Group
MHSDQKTRFSLRGKPVYHYCAVSSFSEYTVVHSGCAVKVGPTVPMDRICLLSCGVSAGLGAAWKVADISKGSSVVIFGLGTVGLSVAQGAKLRGASIIIGVDTNPEKQEKGKAFGVTDFINPEELNEPVQQVVKRLTNGGADYSFECVGDTGVVSTALQSCSDGWGLTVTLGVPKAKPEVSAHYALLLSGRTLKGSLFGGWRPKSDLPLLVDKYANKEIQVDDLVTHDLSFDYINKALELMLENKCLRCVIHMPQ

SEQ ID NO: 90364 - protein, 195 aa, Polytomella parva
TAVETENKVLLTLSDGPSVREELQVPRHKKHAPAGEKTQVRLNQIWIDQADAKELKDGEEVTLMDWGNAIVEKITRSEDGQTVTALSGKLNLAGDVKKTKWKLTWLADVQELVNLTLIDFDYIISKRKIEVDDDFKEFVNDQSRTVKVAVGDINTAKLAKGEIIQLERKGYYIVDEPYVSSDKPVVLFAIPDGRQ

SEQ ID NO: 90365 - protein, 449 aa, Escherichia coli
EIVVSKFGGTSVADFDAMNRSADIVLSDANVRLVVLSASAGITNLLVALAEGLEPGERFEKLDAIRNIQFAILERLRYPNVIREEIERLLENITVLAEAAALATSPALTDELVSHGELMSTLLFVEILRERDVQAQWFDVRKVMRTNDRFGRAEPDIAALAELAALQLLPRLNEGLVITQGFIGSENKGRTTTLGRGGSDYTAALLAEALHASRVDIWTDVPGIYTTDPRVVSAAKRIDEIAFAEAAEMATFGAKVLHPATLLPAVRSDIPVFVGSSKDPRAGGTLVCNKTENPPLFRALALRRNQTLLTLHSLNMLHSRGFLAEVFGILARHNISVDLITTSEVSVALTLDTTGSTSTGDTLLTQSLLMELSALCRVEVEEGLALVALIGNDLSKACGVGKEVFGVLEPFNIRMICYGASSHNLCFLVPGEDAEQVVQKLHSNLFEDK

SEQ ID NO: 90366 - protein, 350 aa, Triticum aestivum
YRRFTYSELEAITNGFERVIGKGGFGKVYDGFLEDGTQVAVKLRSESSDQGEQEFLAEAQTLAKIHHKNLVSLFGYCKERECMALVYEYMSEGALDKHLRGRDNNTRTLTWKQRLLIAMESAQGLEYLHKGCNPPFIHRDVKTSNILLNAKLEAKIGDFGLLKAFNNDCDTHVSTARVIGTPGYLDPEYNATFQLTNKSDVFSFGVVLLEIVTGKPPLLNDPEPMSIIQWTRQRLARGNIEGVVDTRMHGDHDVNGVWRVADTALKCTAQAAEQRPSMTEVVALLHECLELEAARNHMNAGFYTAGSGGNVDGYGGYATGMLTNVSQSSSAFEMEHLGRVPTMSTGPAVR

SEQ ID NO: 90367 - protein, 446 aa, Escherichia coli
SEIVVSKFGGTSVADFDAMNRSADIVLSDANVRLVVLSASAGITNLLVALAEGLEPGERFEKLDAIRNIQFAILERLRYPNVIREEIERLLENITVLAEAAALATSPALTDELVSHGELMSTLLFVEILRERDVQAQWFDVRKVMRTNDRFGRAEPDIAALAELAALQLLPRLNEGLVITQGFIGSENKGRTTTLGRGGSDYTAALLAEALHASRVDIWTDVPGIYTTDPRVVSAAKRIDEIAFAEAAEMATFGAKVLHPATLLPAVRSDIPVFVGSSKDPRAGGTLVCNKTENPPLFRALALRRNQTLLTLHSLNMLHSRGFLAEVFGILARHNISVDLITTSEVSVALTLDTTGSTDTLLTQSLLMELSALCRVEVEEGLALVALIGNDLSKACGVGKEVFGVLEPFNIRMICYGASSHNLCFLVPGEDAEQVVQKLHSNLFEK

SEQ ID NO: 90368 - protein, 509 aa, Populus trichocarpa
MELSTFAALLLATVAVITLFRHLTRPKLNLPPGPKPWPIIGNLNLLTGPLPHRNMHALVQKYGPIMQLKFGSFPVVVGSSVEMAEAVLKTNDVKLADRPKIAAGKYTTYNYSNITWSQYGPYWRQARKICLMEIFSPKRLDQFETVRVQELHALLRKLFVSAGKPINARDEFSDLSLSVISRLVLGKNYTVKTGNQKQYMSPKEFKEMIDELFLLNGVLDIGDSIPWLAFLDLQGYIKRMKAVGQLFDGFLEYTLNEHQQRRKGVKDYVPQDMMDILLQLSDDPNLEVQLDRTAVKAFTMDLIAGGTESSAVTTEWAMAELLKKPEYFKRANEELDRVIGRDRWIEEKDIVNLPFINAICKETMRLHPVSPFLVPRLAREDIQLGGYDIPKGTRVMVNVWTIGRDASIWEKPHEFCPERFIGKSIDVKGHNFELLPFGAGRRMCVGYSLGLKVIQASVANLLHGFKWKLPGDMKTEELNMQEIFGLSTPKQIALVAELEPRLPAHMYSM

SEQ ID NO: 90369 - protein, 201 aa, Heliobacillus mobilis
MNHPPKIIAVMSGKGGVGTSTITALLGAGLTKAGLQTGVLDADAVGPVIPMMFGMTQVMERRGRKLHPSVSRDGLQIVSAGLLPEKPVDLSADAPDKVIQAVIPHVQWAPLNVLLIDMPAGFNDVHRFLFDELPVAGVVVVTSQRELDRLAVRNVMSILARRAVPILGVVENGGETECPSCSSPIALVIKRNIAEDSEVCS

SEQ ID NO: 90370 - protein, 388 aa, Vibrio vulnificus
MKIAVAGTGYVGLSNAMLLAQNHQVVAVDIIKDKVDLLNRKQSPIVDTEIEYFLSHKSLNFTATLDKEAAYQDAEFVIIATPTDYDPQTNYFNTSSVEAVIRDVMTINPDAVMVIKSTVPVGYTARIKKELGCENVIFSPEFLREGKALYDNLHPSRIIVGERSERAEVFANLLVEGAVKKDIQVLFTDSTEAEAVKLFSNTYLAMRVAYFNELDSYAEAHGLDARQIIEGVGLDPRIGNHYNNPSFGYGGYCLPKDTKQLLANYQEVPNNIIGAIVDANRTRKDFIADSIIKRQPKVVGIYRLIMKAGSDNFRASSIQGIMKRIKAKGIEVVVYEPVLQDAEFFHSRVVKDLNEFKKCSDVIVSNRMVEELADVAEKVYTRDLFGSD

SEQ ID NO: 90371 - protein, 346 aa, Vibrio vulnificus
MTGFCFFRNRLIMKYLVTGAAGFIGSATAEKLNAAGHEVVGIDNLNDYYDVNLKHARLARIENPLFKFASVDIADRGAMEQLFATEKFDRVIHLAAQAGVRYSLENPHAYADSNLVGHLNILEGCRQNKVNHLVYASSSSVYGLNAKVPFATSDSVDHPVSLYAATKKSNELMAHSYSHLYDIPTTGLRFFTVYGSWGRPDMAPFIFTKKILDGDTIDINNNGDMWRDFTHVDDIVEGVVRIADVLPTRNESWTVESGTPASSSAPYSVYNIGHGSPINLMDFVKAIEDELGIEAKKNFREMQPGDVYQTYADTEDLFTATGYKPRVTVKEGVAEFVSWYKEFYNK

SEQ ID NO: 90372 - protein, 208 aa, Candida albicans SC5314
MYFMKKLLSNQDGSRDLITVVAIAHVHANKTLVLNVLKNIMDKYIEYKREFDSNKSVSGQSSKAKLGEFKLYMNQIIKYEEMNYDSNQHIYNYGSTNENNEDGHPADQINPNQLLLANEEVDEVRQLMLENINKLLSRGDKINSLVDQTDRLNTSSSVFQKRAQQIKRKMWFMKTKFLLSITGGVLLILYLFIGSECGFPAFSHCIRN

SEQ ID NO: 90373 - protein, 356 aa, Noctiluca scintillans
MADRGRGRGRLYGSVAETVGNTPCVKISDAMCPPGRTIYAKCEFFNPCSSVKDRLALAIIEDAEQKGLLKPGDTLIEATSGNTGIAVAMMAAQRGYGCVIVMAEPFSVERRKLMRFLGAKVIITPKAGKGLGMVKKAKELADEHGWFLCHQFETEANARFHELTTGPEILADFSGQRLDYYVLGYGTGGTYAGAGKAIKAARPDVKICLAEPEAAALVQSGVASERNPDGSATGSHPAFAAHPIQGWTPDFIPKVLEVGLAATPYDEYISIPGTAALETSRKLAKTQGILTGISGGGSMWAAIEMAKKAPEGSVLVCMLPDTGERYLSTALFESIQADMNEEEIAVSKSTPSYTFE

SEQ ID NO: 90374 - protein, 807 aa, Glycine max
MSQQGESSDPKSGKKDFSTAILERKKSPNRLVVDEAVNDDNSVVTMHPQTMEKLQLFRGDTILIKGKKRKDTICIALADENCEEPKIRMNKVVRSNLRVRLGDVVSVHQCPDVKYGKRVHILPIDDTIEGVTGNLFDAFLKPYFLEAYRPVRKGDLFLVRGGMRSVEFKVVETDPGEYCVVAPDTEIFCEGEPLKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLSDDVDLERIAKDTHGYVGADLAALCTEAALQCIREKMDVIDLEDETIDAEVLNSMAVTNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPIAKNVDLRALARHTQGFSGADITEICQRACKYAIRENIEKDIERERKSRENPEAMDEDTVDDEVAEIKAAHFEESMKFARRSVSDADIRKYQAFAQTLQQSRGFGSEFRFPESGDRTTTGSDPFAASAGGADEDDLYS

SEQ ID NO: 90375 - protein, 1124 aa, Physcomitrella patens subsp. patens
MVRMAQHEWQQQGVSNARRRSLETVMKEQQARTKVSVRHLPPSLAWAVFQDQIAVKYAGTYTWWSYHPGKSSHKRQVYSRAYINFKKPEDVIDFYEDFNGHVFVNERGAQYKALVEYAPYQRVPKPRSKKDVREGTISTDPEYLAFVEQLAKPAEYLPSAEVQLERKEAEKASNLASGTSKDAVVVTPLMEYVRSRRAAKSTPQRGMSSSAKLAARSGGVPVSAFKLATQKRGSEKGRSGSSSYTGDSASTTKESANHNSASRDELQRKEREHLIERKRKETGEGKEKKSVREAVAAAVRANSSSQRGEFSKEKTILLTKDMSEAPSEGRALQNISAGGESGSRTSVAGKVSAVNGSGEGLTAGDVREPHKREYKRKQMLVAKDKDKELAVDPEQAVSVANSVGVGTTNNQRHRSSGPAKVAAGGVQQMQSAVAHRATSLGDSISSGKQIHRQEYGGRTSLRGTPAQGSSAPGLGSDSHAQPQASGTQVEKVGKRPPRPQAIRLAGKDQAISLVSSVEAEGQAGNGEERSVKQVANDGAASSPSLLDKQDARRLRNKDRPDRPVWTPRRREGVTGKADGTAFANSPASAAGTASTEGTSSTASSGTDVGSKNDRAERSSGRHNGRSGSEVRSSEPPQTSGGGGNGTFSKLRYVETGGRIPRGGRTVAAVGSQAAHDGSRTDAKSVGASDDVTSQYGKQGRDNGEPFVQSQEGQQSLVTEDRRRQGGSFWSESGTVSPCTQFLKGNLEAGLVDGHRCDDWVCVVWAGVCGAPGGSHRQGGRRERTGQQGAKEGDGGVVGTEAASKLVKRGRGSPASGSNEVFGGVSIMMGSLWCGTRHMTFRWWLHSFLSWKRCGGMIELWLKGREVKELIAGILQVKDLGFVEYVIVEWLSGWLCCLDTEASMGCRSKDSFGMIVLCLYLVSIATASSGFPCPSNSVYSGDALEATLRRTCTSHRYSSATMDCRGLCHVGSWMRSRVEITNGTVLLIPKGIPLAWCEKTVIQKTSDPACCRSGRDFNTRQSRYGGFLDTEVFTRQFVATCLTESFDHPVCEHFSNSLSFAFRFRFLRNQALSFPVLGTSQMSSSSGPRFELVTVLRAVGMNQATYLVFANVVYANGVFESCPGM

SEQ ID NO: 90376 - protein, 266 aa, Helicobacter hepaticus ATCC 51449
MVLKYYGLEEFALKSDSSPLTKADLESNTFITQELQENSPYKVCSEEAVLEYEERKDLEYYWLIDPLDGTKDFLAKNGGFTINIALIHKNRPILGVVYAPAFYQLYFALKGFGSFTYTPQTLKDALDSKTLNPAWLEQNKQRLSGERIAKEEQIIACDSLFHSTKETQDFIAKYHLKVQKYGSSLKVCALAEGKADIYPRLNGTSEWDSAASDIVLEEAGGVILDCESKKPLQYNKPSVRNPYFLAFAKSQVGGAIYKDILASPYA

SEQ ID NO: 90377 - protein, 546 aa, Lophopyrum elongatum
MGLDLGAIALKYTGLAVSDHGSIVAINIFIALLCGCIVFGHLLEGNRWVNESTTALVLGLITGGVILICSKGVNSRILIFSEDIFFIYLLPPIIFNAGFQVKKKQFFRNFATIILFGAAGTLISFVIITFGAMGLFSKLGVGPLELGDYLAIGAIFSATDSVCTLRVLNQDEAPLLYSLVFGEGVVNDATSVVLFNAIQNIDINHFDVFVLLQFIGKFLYLFFTSTVLGVAAGLLSAYIIKKLCSARHSTDREVAIMILMAYLSYMLSMLLDLSGILTVFFCGIVMSHYTWHNVTESSRVTTKHTFATLSLIAEIFLFLYVGMDALDIDKWKLASSSPKKPIALSAVILGLVMVGRAAFVFPLSFLSNLSKKESHPKISFNQQVIIWWAGLMRGAVSIALAYNKFTTSGHTAVRVNAVMITSTIIVVLFSTMVFGLLTKPLINLLIPPRPGTAADISSQSFLDPLTASLLGSDFDVGQLTPQTNLQYLLTMPTRSVHRVWRKFDDKFMRPMFGGRGFVPFVPGSPIERSVHGPGLLGTVTEAEDRS

SEQ ID NO: 90378 - protein, 834 aa, Oryza sativa Japonica Group
MSSMFLIILSCMLLLSNSGRTTTGAELGDTLGKGRNITDGERLVSAGGSFTLGFFSPASSSSSSTSRRYLGIWFSVSDDVVCWVANRDRPLTDTSGVLVITDAGSLLLLDGSGHVVWSSNTTTGGGASMAAQLLESGNLVVSDRGNGGAGAVVVWQSFDHPCDTLLPGMKIGKNLWTGAEWYLSSWRSSGDPSPGNYRYRTDTKGVPENVLWDGDGEVYRTGPWNGLWFSGIPEMGTYSDMFSYQLTVSPGEITFGYSANAGAPFSRLVVTGVGEVQRLVWEPSSRAWKNFFQGPRDLCDDYGKCGAFGLCDAGAASTSFCSCVEGFTPASPSPWKKMRDTSAGCRRDAALGCATDGFLTVRGVKLPDAHNATVDKRVTVEECWARCLANCSCVAYAPADIGGGGGCGAGSGCIIWADDLVDLRYVDGGQDLYVRLAKSELGKDGIRQRRPPAAVVIGASIASVVGVLLIILLVLLYVIRRRQRPRVSDDDAGVPAATAAVHARPNPALAAPSINLSSVKEATGNFSESNIIGRGGFGIVYQGKLPSGRKVAVKRLTQSLVTDKRKEDFIREVEMMSNTRHAYLVELLCYCQEGGEMILVYEYMENMSLDLYIFGEDRRLRASLNWVQRLDIIRGIAIGVEYLHNVKVIHRDLKPSNILLDDNRRPKVADFGTAKLFINDQTDPTLVLSAGYIAPEYAAQGNLTLKCDVYSFGVVLLEIISGKRNRTLPTFLRETWESWKQHEIEDILDLGLIKPEPDLLLGLDRCIQIGLLCVQQSPDDRPTMNQVVSMLTKYSSQIAMPKNPMINSRCEPSVSQVVSDTEPASHDRPGPSLN

SEQ ID NO: 90379 - protein, 823 aa, Oryza sativa Japonica Group
MAKATTGICLVDVILFSFFLVAPRAFAAAAAVTDTLRGGRNITDGETLVSADGTFTLGFFSPGVSAKRYLGIWFTVSPDAVCWVANRDSPLNVTSGVLAISDAGILVLLDGSGGGHVAWSSNSPYAASVEARLSNSGNLVVRDASGSTTTLWQSFDHPSNTLLPGMKMGKNLWTGAEWDLTSWRSPDDPSPGAYRRVLDTSGIPDVVLWQDGVERYRSGPWNGRWFSGNPEAATYTTNLITFQVTVSPGEISYGYVSKPGAPLTRSVVLDTGVVKRLVWEATSRTWQTYFQGPRDVCDAYAKCGAFGLCDANAPSTSFCGCLRGFSPTSPAAWAMKDASGGCRRNVPLRCGNTTTTDGFALVQGVKLPDTHNASVDTGITVEECRARCVANCSCLAYAAADIRGGGGGSGCVIWTGGIVDLRYVDQGQGLFLRLAESELDEGRSRKFMLWKTVIAAPISATIIMLVLLLAIWCRRKHKISEGIPHNPATTVPSVDLQKVKAATGNFSQSHVIGQGGFGIVYKGQLPDGRMIAVKRLHQSTLTKKGKKDFTREVEVMARLRHGNLLRLLAYCSEGSERVLIYDYMSNRSLDLYIFGDSGLRLMLNWRKRLGIIHGIANGIAYLHEGSGECVIHRDLKPPNVLLDDSFRPKIADFGTAKLFTADQPEPSNLTVVVSPGYASPEYAWRGEMTLKCDVYSFGVVLLETLSGQRNGPMYSLLPHAWELWEQGRVMSLLDAMIGLPLSVSGPDHTEMEDELARCVQIGLLCVQDAPEERPAMSAVVAMLTSKSSRVDRPKRPGVHGGRSRPPLRESELLGATDIDDDLT

SEQ ID NO: 90380 - protein, 229 aa, Noctiluca scintillans
MVESAKIAVIAVARIADQAVLATCFDTGASSTEKQSFEGAISSLLARSSNAYPRWKDRCECDGCDGTVFVLADAQATCITAVGIRDPKFPERVALQLLRECAEKTYNLQGSDLTDATPNSLNTALRKPLRHLMKTYNDASVDKMTKTQEQVDALKGVMQDNVKKILETHVTLDQLQNNTQSMSSQANQFLRQSVDLRRQVQLRNLKLKLIVVVCVLAVVLYFAMPFLDF

SEQ ID NO: 90381 - protein, 325 aa, Oryza sativa Japonica Group
MTPAADGDDDETTCIRALELIFTFVVPMTLKATIKLGLLDALTGGGHALTADELAAAAQLPAEAASSVDRMLRLLASLDVVKCAPTDTGGEAAVRRYTPAPLPAAVAGGDGQVAFEKARGMPMFEYMGTNRRLNTLFNQAMVQQSTVVIGKLLERFQGFDGVSVLVDVGGGTGATLEMITSRYKNITGVNFDLPHVIAQAPSLPGVKHIAGNMFESVPNGDAIFLKSMLHLHNDEDCIKILKKCHQALTHNGKVIAVEILLPAIPEPVPTAQNPFRMDMIMLNNHWGGKERTEPEFAKLAVECGYTGVFQATYIFANYWALEFSK

SEQ ID NO: 90382 - protein, 502 aa, Zea mays
MATTRIEAEKKPKTKIVCTLGPASRSVPMIEKLLRAGMNVARFNFSHGSHEYHQETLDNLRAAMENTGILCAVMLDTKGPEIRTGFLKDGKPIQLIQGNEITISTDYDLKGDEKTICMSYKKLPEDVKPGMVILCADGTISFTVLSCDKQAGLVQCRCENSATLGERKNVNLPGVIVDLPTLTDKDKEDILAWGIPNKIDMIALSFVRKGSDLVEVRKVLGKHAKNIMLMSKVENQEGVANFDEILANSDAFMVARGDLGMEIPIEKIFLAQKVMIYKCNIQGKPVVTATQMLESMIKSPRPTRAEATDVANAVLDGTDCVMLSGETAAGAYPDLAVQTMAKICIEAESTLDYGDVFKRIMEHSPVPMSPLESLASSAVRTANSARAALILVLTRGGSTAKLVAKYRPGMPILSVVVPELKTDSFDWACSDEAPARHSLIFRGLVPVLSAASARASHAETTEEAIEFAMQHAKSKGLCHNGDSVVALHRVGTASIIKILTVK

SEQ ID NO: 90383 - protein, 242 aa, Bordetella parapertussis 12822
MLQNREGQRVPSVTFPVRENNAWKQVTTDDVFKNKTVVVFSLPGAFTPTCSSTHLPRYNELAPAFFAAGVDSIVCVSVNDTFVMNEWAKDQESANVTLLPDGNGEFTDGMGMLVDKKDLGFGKRSWRYAMLVKDGVVEKMFIEPEKEGDPFEVSDADTMLAYVAPQARKPDRVVVFSKPGCPFCVDAKALLKGKGFDPIEIPLDNKVRGRVIGAVSGGDTAPQVFINGKLIGGFDALKAYLA

SEQ ID NO: 90384 - protein, 248 aa, Mesorhizobium loti MAFF303099
MSTPVVLITGALTGIGRETAIAFAKEGSRLVIAGRHEEAGRKLATELQSFGAEVEFIRADVRHDDEVRDLIDRAVARFGRLDVAVNNAGTEGKPGPVTEQTAETYAATFDTNVLGTLLSLKHELRIMLTQGGGSIVNISSTYGHEGAKGASIYAASKHAVEGLTKSAALEAAASGVRVNAVAPGPTNTGMLDRFTGTSEVKASLALTVPMGRVGQPSELARAIVFLASKEASFITGHVLTVDGGKTAG

SEQ ID NO: 90385 - protein, 400 aa, Vitis vinifera
MAEDRNGDLSEASDYTSEDEGTEDYRRGGYHAVRIGDTFKNGRYVVQAKLGWGHFSTVWLAWDTQKSKYVALKVQKSAKHYTEAAMDEITILKQIAEGDPDDKRCVVKLLDHFKHSGPNGQHVCMVFEYLGDNLLTLIKYADYRGTPLHMVKEICFHILVGLDYLHHQLSIIHTDLKPENVLLLSMIDPSKDPRKSGASLILPTSRDKIVSEPAASKDTKNMNGDLTKNQKKKIRRKAKRAAQGCMGKEASDDPELDAKAPDSEDSNNDANSNGDSVEEQQNSSVIKSSSVNTDDVKDVRRENQGRRRGSRSTRQKLLAEVDLKCKLVDFGNACWTYKQFTNDIQTRQYRCPEVILGSKYSTSADLWSFACICFELVTGDVLFDPHSGDNYDRDEVCRDP

SEQ ID NO: 90386 - protein, 223 aa, Synechococcus sp. CC9311
MSRQSLVVSPSILSADFSRLGEDVKAVDEAGADWIHVDVMDGRFVPNITIGPLIVEALRPVTKKPLDVHLMIVQPENYVEDFAKAGADIISVQVEACPHLHRNLAQIKDLGKMAGAVLNPSTPLDTLEYCLELCDLVLIMSVNPGFGGQSFIDNQVQKIRDLRRMCDEKGLDPWIEVDGGVKAANAWKVIEAGANAIVSGSGVFNQPDYAAAIQGIRNSKRPS

SEQ ID NO: 90387 - protein, 169 aa, Thermoplasma volcanium GSS1
MKNKQTEDFPESFYVMIEIPMGSNCKYEYKEELDNIVLDRVLFTAMTYPANYGFALDTRGKDGDPLDVLVFSSVSINPGIIVRCRAIGVAEMNDEEGEDNKILAVPVDKVDPASSIVRNESDIPEYQKDKLKHFFEHYKELEKGKFMKFHGFKGRDEAVKQLAEARLKQ

SEQ ID NO: 90388 - protein, 317 aa, Bacillus anthracis str. A2012
MEITMMKKVYFNHDGGVDDLVSLFLLLQMDNVELTGVSVIPADCYLEPAMSASRKIIDRFGKNTIEVAASNSRGKNPFPKDWRMHAFYVDALPILNESGKVVTHVAAKPAHHHLIETLLQTEEKTTLLFTGPLTDLARALYEAPIIENKIKRLVWMGGTFRTAGNVHEPEHDGTAEWNSFWDPEAVARVWEANIEIDLITLESTNQVPLTIDIREQWAKERKYIGIDFLGQCYAIVPPLVHFAKNSTYYLWDVLTAAFVGKADLAKVQTINSIVHTYGPSQGRTVETDDGRPVHVVYDVNHDRFFDYITRLAKKVST

SEQ ID NO: 90389 - protein, 138 aa, Streptococcus agalactiae 2603V/R
MEQTFFMIKPDGVKRGFIGEVISRIERRGFSIDRLEVRYADADILKRHYAELTDRPFFPTLVDYMTSGPVIIGVISGEEVISTWRTMMGSTNPKDALPGTIRGDFAQAPSPNQATCNIVHGSDSPESATREIAIWFNN

SEQ ID NO: 90390 - protein, 691 aa, Halobacterium sp. NRC-1
MTRVRVTLRDAADRTADAPAVGPGQLSFTAETRQQIGVAEGDAVTVTGSEDTVATVGPDTTAIAASSGLAGADVLRNVGPTDTVTVAPADPSPAAELTVAPATSSTLEGDADALARALAGRHLVADDRIAVPLFSGTVVVTLDVEDTTPGGPVTVTADTAITLTGHAADSGHADAEHATPADTRVGGLDDERGALRRLVVAPLVADSYAAIGVRPPAGVLVHGPAGTGKTTLVRAVAAAADLAVESVAPEDAGDRDALAAVLDAARDAEPGCVVFVESLAAAAPDPTADGASGRGSPSALGWLLDRVRGHDTVVVVGETTDPDAVDPALRRGGRFDAEVRVGVPDPAARRAILDVHTDGVRLADAVSLDAVADRTHGYTGADLTAVLVDAATRAAGSAAGPPVIRQRDLEAALDAVGPSTLRDASVQTPTTTYQDIGGLDRAKREVVRTVEWPQRYPALFERLDAAAPTGVLLHGPPGTGKTMLAKAVAASTDANFLSVDGPELMNRYVGESERGVRDLFERARRLAPAVVFLDEVDSLAPARHDTDTGASERVVSQLLTELDGLSPRGSVAVLAATNRRESVDPALLRPGRIETQVAVPIPDQDARAAIFEVQLDGVATGRIDTTALAAATTGYTGSDIAGVVREGALLAMEDHLRETEFDATDASGLVVTQRHLRRAIETTAPSVDGAG

SEQ ID NO: 90391 - protein, 476 aa, Erythrobacter sp. SD-21
MADNRKLEMEDVLRKQRAVHTQMRPEPLSARKDRIKRAMKLLKDHGDDLCKVMSADFGNRSPMQSMITDIAGTVNFGKYCLKHVDKWSRSEKRSVQFPLGLLGAKAELRYEPKGIVGILSPWNFPVNLTFGPLMQVFAAGNRAMIKPSEFTAKTSLMMKELVEEYFTPDECAVFTGGPEVAAAFSELPFDHLVFTGSTATGRKVMEAASKNLVPVTLELGGKSPVFLGESADFAKAGERIAMGKMMNAGQICLAPDYMYVPESKQDEAIHGVWQGTADMYPTMLENEDYASLVSDRHFDRLQDMVADARDKGAEVIEVNPGNEDFGSSNARKMPLTILKGVTDDMKAMQEEIFGPVLPVKTYTQIDDAIDYVNENDRPLGLYYFGEDSSEREKVLTKTISGGVTVNDVIFHVSMEDLPFGGVGPSGMGSYHGVEGFREFSHARSVYTQPKIDVAKLGGFKPPYGSATEKAVKGMMK

SEQ ID NO: 90392 - protein, 357 aa, Moorella thermoacetica ATCC 39073
MPLTCGIIGLPLVGKTTLFNLLTQAEAETSAFAGRTKTNIRTAPIPDARLDFLAALYHPRKVTPATLEIIDVPGLTRGAGAAFLAAVREVDALIHVVRAFRNDSIIHVEGNLNPVRDLETINAELLLADLQLVETRLERIAASKKIKPEMQAEREALEHCRQALEAEKPLLEAGLTEEEWQTLRHMGFLTTKPMIIVVNIDEDQLRSGHYAGEEEVKAYAQPKGLPILTLCAELEAEIARLEPGDREDFLREMGITEPGIDRLARAIYHRLGLISFLTAGEDEVRAWTIQAGTNARAAAGKIHSDIERGFIRAEVVNFADLERCGNMNKVKEQGLARLEGKDYIVQDGDIINFRFNV

SEQ ID NO: 90393 - protein, 147 aa, Glycine max
MSAYKDQDTRLHGIKTKIRVVPNFPKSGIEARGFIFGPPIALAIGAKFVPLRKPKKLPGKVISQEYILEYGRDCLEMHVGAVEPGERALVVDDLIATGGTLCAAMDLLECSGPEIFFCCSYVHKSSSCQRLVSLRSTPIYDGMKGKT

SEQ ID NO: 90394 - protein, 250 aa, Corynebacterium efficiens YS-314
MVMTNGKLILLRHGQSAWNASNQFTGWVDVDLTTIGEAEAKRGGELLVENNVLPDVVYTSLLRRAIRTANLALDAADRHWIPVVRDWRLNERHYGALQGLNKAETKDKYGDEQYMAWRRSYGTPPPELADDAEYSQAGDVRYKDLESVPRTECLKDVVERFIPYFEEEILPRVKKGENVLIAAHGNSLRALVKHLDNISDDDIAELNIPTGIPLVYEITPEGTVVNPGGTYLDPEAAAAGAAAVANQGGK

SEQ ID NO: 90395 - protein, 324 aa, Heliobacillus mobilis
MTSVGIGKRRIYAMSWRHKDLLGLRGLEKKDIELILDTAAPMKDIIGRDIKKVPTMRGKSVVCLFYEASTRTRTSFELAGKYMSADTVNIAASSSSVVKGESLIDTGKTIDAMGTDIIIIRHGASGAPHLLAKHVKARIVNAGDGAHEHPTQALLDMFTIRERKGTLQGLTVTILGDIFHSRVARSNIWGLRTMGADVRVCGPSTLLPPDIAELGVKAYTRIDEALEGADVVNVLRLQLERQQKGLFPTIREYARTFGLNQERLKRCKPDVLVLHPGPMNRGVEIADDVADADFAAIEEQVTNGVAVRMAILYLMGGTSSGIAH

SEQ ID NO: 90396 - protein, 170 aa, Zea mays; identical to SEQ ID NO: 1591

SEQ ID NO: 90397 - protein, 1375 aa, Helicobacter hepaticus ATCC 51449
MQENNVQILVLDFGSQYTQLIARRLREYGVYTEIVPYFEKLDSIKSKNPKGIILSGGPASVYEKDAYKPDSAIFTLGIPILGICYGMQLIAQHFGGRVIKADAQEFGKAVLEIMESSQDSKDSSCFAFQGASQGIQAPMTLSFDIFSHHKFPQMLTALLDLWEDSVQASHIFLTKQHIAEIRLEVKAALQSSQNIITATDKKDFLGFIGVEKNKIEMLFVASSVFRKGIGKALLKEALERYLKDYPYILVDCNEQNTQGLAFYKSLGFEKVGMSEKDSAGRDFPIVHLKVSKAILKKALERGTSDSVANAFVCESERVFLRPYTQADFAALHKIVSDKETMYAWGQGFSKKQSQEWLDKQLAHYQQYGFGIWAIIEKQSGAIIGNAGLNHTEISLKGKTQKIVEIGYLLHRDFWGKGYGSEVARMCVKYGFETLGLEEVYCLIKEDNTASIKVAKRLEMQKVGEYPKPYKGKKISHLVFRLEKKVWQESKNNATQGFKSCSLFKGIKQDSIVWMSHADKVESIPQGFRELAKSGNTHYCAIADSKRKIYALQFHPEVVHSECGGQMLQNFAVGICGANTCWNMRHFAQNEIEKLRRIVYGGKAHCENPMSFMQIQEAFKHIGKAQTIQRLVEIWEEGARATHKDLSENEIAGMREEIREAILKSKNLLIAQKNEEWLGFIEIEKNEIAMLFVVPKAFRKGVGKALLKEAFMRYLGAFEVIKVNSLEWALGFYQALGFAKTGKKPIPAGSAGAFSPELIPLSIARESLQKSLGLEAQDSNEGVREKVRCAWATDKDEAARKLYEDYHDTEWGEPLHEDKKLFEHLVLEGFQAGLSWITILKKREAFRVAFDDFDPHIVANYDEDKIKELMRNEGIIRNRAKIEAAIINAKAFMAVQREFGSFDKYIWGFVGGKPIINAFESIADLPASTPLSDKIAKDLKKRGFKFVGTTTMYAMMQSIGMVNDHLTSCFKCNSSLGMQCDKILDFSQGTNTKSANLTKNPKNLHSHTANTRIVDSQHTESSDIKGQSHLESSADSGSAVSLRDFKSCEGATRGSYLEGNDRSGVANSLKITKETTSKVLCAVSGGVDSSVVAALLYRAIGENLIPVFVDTGLLRKGEREAVEKIFKENLKVPLITADASELFLSRLKGVLDPEIKRKIIGETFIEVFEKEAKKHNTKGEIKFLAQGTLYPDVIESVSVKGPSKTIKSHHNVGGLPEWMKFELIEPLRELFKDEVRALGRELGMPESMLMRHPFPGPGLAIRIMGEVNKADLDLLREADSIFIDELHKQSYYDKVWQAFCVLLNVRSVGVMGDNRTYDNTICVRAVEAIDGMTATFAHLPHDFLEGVSNRIINEVEGINRVVYDITSKPPGTIEWE

SEQ ID NO: 90398 - protein, 456 aa, Triticum aestivum
  misc_feature (40)..(40): Xaa can be any naturally occurring amino acid
RWRPARPRGRSPGGFPRGTAATRTATAASPGTAHGMSSSXSLRKKSDATLVRKVPVASLRPVLANLQEVLLGTKLAVLFIAVPLAVAAQCFRFGQVWVFALSPRGRIPLAERVSFLTEQIALYTGPTIGGLLNATCGNATELIIAVFALVQGKIEVVKCSLLGSVLSNLLLVLGTSLFCGGIKNLGADQPYDRKQADVSTGLLTLGVLCQSLPLLLRYAVSSGEHAVATDTTVLELSRACSFIMLLAYVAYLFFQLKTHRQLFEPQEIEGGDDDEEEAVLGFGSALFWLILMTIIIAVLSEYVVGTIEPTSQSWGLSVSFISIILLPIVGNAAEHAGAVIFALKNKLDITLGVALGSATQISMFVVPLSVLVAWIMGIQMDLDFKLLETGSLFISVLVTAFTLQDGTSHYLKGVLLLLCYIVIGACFFVTRQPAPHANGNGTLLDVPTGPMIVQVA

SEQ ID NO: 90399 - protein, 383 aa, Xenorhabdus nematophila
IPAIMGADIQPELLHNRMLILDGYRGEIFIEPEPLIMQEYRQIIEEEQVLSKLAEGEQQQQAQLRSGEHVFVQLNAGLSLKYEQQIGDSVDGVGLYRTELPFMLHCGFPSEDEQKHRYQEILALFPDKPVVLRTLDIGADKQLSYMPINEDNPCLGWRGIRITLDQPEIFLIQLRAMLKANVSTGNLKILLPMVTSIEEIDETRKLLARAKSEVEQTLGRTIAMPQIGVMLEVPSTIFLLPQLMKRIDFVSVGTNDLTQYLLAVDRNNTHVASLYDNLHPAVIRALKLAFDECQRLGLPISICGEMAGLPIGALVLLGLGYRSLSMSGRSVPRIKYLLRHLEVSELECLIDAILKAETSQQVKVLAAEFMEAHSLGGLIRGGI

SEQ ID NO: 90400 - protein, 120 aa, Populus trichocarpa
MDMHIHMSYCTPHGFRVLASNYLGVNGYHRLFGEIEDLIENTEVTPAQVAEELMTSEDSDTALEGLVKLLKRKKLEGDELFDEGLHKGEIQKAKKQKVENKRRGSVRIKSRRKIIKRRSY

SEQ ID NO: 90401 - protein, 348 aa, Bdellovibrio bacteriovorus HD100
MSHIYDSILETIGNTPIVRLKNVTKGSKHQFFAKIEYFNPGGSIKDRVAVAMIEEAEKRGDLKAGGTIVEATSGNTGVGLALAAAVKGYKCIFVMPEKMSEEKRAILRAYGAKVVITPMVDPEHPLSHYSVSQKIAKETPGAFLTNQYHNPDNPQRHYQTTGPEIWKQMDGKVDVVVGGAGTGGTLSGVAKYLKEMNPNIKAICADPIGSILYDLYYHKKIVDPPGSYKVEGVGEDMLPDNVHLNIYDGFERVSDPEAFTMTRRLVAEEGLLVGPSSALALVGAMKAAEKIEKPSNIVVVFPDSGRAYLSKAFNDTWMIENALLKPEEAKNVFNRVVNAADFLAELNK

SEQ ID NO: 90402 - protein, 182 aa, Zea mays
EGADAIMLSGETAHGKYPLKAVKVMHTVALRTESSIYNPTTSPSVIASAQGLQNEEFSPSQLSKMFGSHATMMANTLRTPIIVFTQTGSMAVLLSHYRPSSTLFAFTNEERVKQRLALYQGVIPIHMQFSDDAEETFSRAISSLLKAQYVKKGDYVTLVQSGVTSIWREESTHHIQVRRAQV

SEQ ID NO: 90403 - protein, 144 aa, Streptococcus agalactiae 2603V/R
MKETQEELRQRIGHTAYQVTQNSATEHAFTGKYDDFFEEGIYVDIVSGEVLFSSLDKFQSGCGWPAFSKPIENRMVTNHQDHSHGMHRIEVRSRQADSHLGHVFNDGPVDAGGLRYCINSAALDFIPYDQMAKRGYGDYLSLFD

SEQ ID NO: 90404 - protein, 503 aa, Oryza sativa Indica Group
MARAPPPPSSLPPPRRPTVVLLLGLALAFCLAVLSIQSSFFTAPRLASRLDLDADEVRALSGFQSRVQQCVARRGLGLTADIIDHCKLVLKFPKGTNSTWYNTQFKYFEPLEYNYDVCETILLWEQYRNMTTVLTREYLDVRPDGWLDYAAKRIAQLGADKCYNRTLCEELLSVLLPAKPPFHPRQFATCAVVGNSGDLLKTEFGQEIDAHDAVFRDNEAPVNKKYAKYVGLKRDFRLVVRGAARNMAPILKGSCNAVILKAHGNVLHFWFSQLGRRLADEVLIIKSLTHKEINAVIKELPNPVYLFQGIVLRRGAKGTGMKSIELALSMCDIIDMYGFTVDPNYTEWTRYFSPPRKGHNPLQGRAYYQLLECLGVIRIHSPMRAKRVEDWSDIPSREEIRTAHAAAFRLKRHETGQSDQMGPFSNCKVWGTVDPDYGPVSGTPDMSETRKNSNYKKWEVLPFDSLRMEAQEHHVQMGGVSLYKMDGNKLDDLVCVRHERSSS

SEQ ID NO: 90405 - protein, 370 aa, Oryza sativa Indica Group
MEGLTSAAAFVEGGIQDACDDACSICLEAFCESDPSTLTGCKHEFHLQCILECQELLEAVERERNVRTNQTRNTTIFHHPALGDFEVQHQDELLQLPVVGNDAELEERILQHLAAAAAMGRSHHLGRREGHRGRSGSHGRPQFLVFSSHPNMPSAGSVSSSSVQGEVDNESSPVHTAGELSLHASTHEEAGNQSPGMLTYDADQDAVVSSGNSTPVSSPRFFNRRHSTGQSTPVNNDRAGPSDLQSFSDSLKSRLNAVSMKYKESITKSTRGWKERLFSRNSSVADLGSEVRREVNAGIASVSRMMERLETRGSNNGRTSDGPATSTSEVIPSTESSNERVTENNPTTAATSTSNTSTSSAPCVTTTGSN

SEQ ID NO: 90406 - protein, 514 aa, Candida albicans SC5314
MVSPSSPQSNDDDDLTNADSAITPATSTITTETPTKSSFDDYQLLSSIRIPITRRITPSLSPQYEESNISTTTSATTTTTQQQHQQQQQQQQQQQLRQMSSLSASKIEQAKTDVLNNKKISFIHRFITNWLIMDPNLISHYNNTNTRRFKNYQIENQGQSNFIYFLGGRLHTIKTKYPINLITLSLIIIPGILYIIFELSWQWRNFSPIIVIIFLYIWIISIFHFFKLSTGDAGKLPKNIHLPKKLITITTTTTTTNDNEIDHRNNYKVRGSPPDEYFNTVTLPYWKTNNDNNDNTKISKLANAYHSHGVQVKYCGTCHIWRPSRTSHCNTCQQCILNHDHHCIFLNNCIGQRNYKFFLWFLLYIVIACLYLLIISILQLCHYKFASHKESEIITTFNQSIKTHPISLLLLIYSCLAICYPGLLLAFHIFLTSQNITTREYLNFVYKKPSKSTDGGDGTRGFVNVYNTHSIWENLYINWLGKSNGVSLTFPRDYYHQGDIRFANIEPLGTFTNK

SEQ ID NO: 90407 - protein, 759 aa, Halobacterium sp. NRC-1
MKLTVKPLKQKDAGRGLAAVDRDSMDELALENGDYVVIDGQGDHGRAVARVWPGYPEDDGDGVVRIDGRLRKEADVGIDDQVTVEPADIKPAGGVTVALPQNLRVRGNIAPMVRDRLNGRPVTAGQTIPISFGFGGMSTISGQQIPVKIAETEPSGTVVVSNDTEIQLSERPAEEIAPGAGEAAETGDPTPNVTYEDIGGLDGELEQVREMIELPMRHPELFQQLGIDPPKGVLLHGPPGTGKTLIAKAVANEIDAHFETISGPEIMSKYYGESEEKLREVFDEAEENAPAIVFVDELDSIAPKRGETQGDVERRVVAQLLSLMDGLEDRGDVTVIAATNRVDAIDPALRRGGRFDREIEIGVPDQDGRKEILQVHTRGMPLVEDIDLDDYAESTHGFVGADIESLAKEAAMNALRRVRPDIDLESDEIDAELLESISITEADFKRALNGIEPSALREVFVEVPDTTWADVGGLTDTKERLRETIQWPLDYPDVFSEMDLQSAKGVLLYGPPGTGKTLLAKAVANEANSNFISVKGPELLNKYVGESEKGVREVFEKARSNAPTVVFFDEIDAIAGQRGRATSDSGVGERVVSQLLTELDGIEALEDVVVVATSNRPDLIDDALLRPGRLDRHIHVPVPDADARRAILDVHTRDKPLADDVDLDVVAQRMDGFVGADVEALVREATMNATREFINSVDPADASDSVGNVRVTMAHFEAALGEVTASVDADVKENYEEIEQRFNTADTPTDDEPASGAFR

SEQ ID NO: 90408 - protein, 382 aa, Triticum aestivum
MGGEKENLDLSDLNSSLPAAAAALSAEDRVGLVNALKDKLQSLAGQHADVLESLSPNVRTRVEFLRGIQSQHDEIEAKFFEERAALEAKYQNLYEPLYAKRYDIVNGVVEVDGAAKEPTSENAAEGGDSDAKGIPDFWLTALKTNDVLTEEIQERDEPVLKYLKDIKWSRIDDPKGFKLEFFIDTNPFFKNSVLTKSYHMVDEDDPILEKAIGTEIEWYPGKNVTQKILKKKPKKGSKNTKPITKTEECESFFNFFSPPQVPDDDEDIDEEAADELQGQMEHDYDIGSTIRDKIIPHAVSWFTGEAVQAEDFDDMEDGDEDDDDDDDDDEEDDEDDEDEDEDDDEDEEELSKPTKKVAGKPKGPAKGGAQGNAEQPTECKQQ

SEQ ID NO: 90409 - protein, 273 aa, Oryza sativa Japonica Group
MEKYEKLEKVGEGTYGKVYKAQDRATGQLVALKKTRLEMDEEGIPPTALREISILRLLSQSLYVVRLLSVEQATKNGKPVLYLVFEFLDTDLKKFVDAYRKGPNPRPLPTNVIKSFLYQLCKGVAHCHGHGVLHRDLKPQNLLVDKEKGILKIADLGLGRAFTVPMKSYTHEIVTLWYRAPEVLLGSTHYSTGVDIWLLGTPTEEQWPGVTDLRDWHEFPQWKPQILERQVPSLEPEGVDLLSKMLQYNPANRISAKAAMEHPYFDSLDKSQF

SEQ ID NO: 90410 - protein, 273 aa, Corynebacterium efficiens YS-314
MEGMTIIAVIGGGQIGEALVSGLVAADVNPQNIRVTNRREERGAELEERYGVVTMTDNAQAVDGADVVFLCVKPKMILDVLAEIATTVDNNSVSTVVVSMAAGINLASMEEKVSAGMPIVRVMPNTPMLVRKGMCTVTGGRFVDAEQLELVQELLTSVGDVMVVEESDLDAVTALSGSSPAYLFLVTEALIDAGVSLGLTRAAAKQLAVSAFDGAGTMLKETGREPSDLRAGVSSPAGTTVAALRELEESGIRGAFFRAAQACADRSAEMGRN

SEQ ID NO: 90411 - protein, 104 aa, Oryza sativa
RLYRRDSLETVPTIKMLRSYADRIRASDLEWCLQKIGEDSLTQEVVEDSIEELSTGIVNKLLHGPLQHLRCVGSGIRTLDETLEYMHALNRMFSLDTEKAIIEQ

SEQ ID NO: 90412 - protein, 428 aa, Coxiella burnetii RSA 493
MTATITDINAHEILDSRANPTLEVRVTLSSQAYGCAAVPSGASTGEREAVELRDNDLERYGGKGVLQAVENVNGPIRDALLGQDPRSQEEIDRIMIELDGTENKANLGANAILGVSLAVAYAAANNADLPLYRYLGGDGGPFSMPVPMMNIINGGAHATNNLDFQEFMIVPVGAPTFAEALRYGAEVFHALKKRLVSRGLMSAVGDEGGFAPDLPNNEAAFELILEAIEDANYVPGKDIYLALDAASSELYQNGRYDFENNQLTSEEMIDRLTEWTKKYPVISIEDGLSENDWAGWKLLTERLENKVQLVGDDIFVTNPDILEKGIKKNIANAILVKLNQIGTLTETLATVGLAKSNKYGVIISHRSGETEDTTIADLAVATDARQIKTGSLCRSDRVAKYNRLLQIERELNDQAPYAGKEAFLFNRK

SEQ ID NO: 90413 - protein, 644 aa, Bacillus cereus ATCC 14579
MKTLILLQVNALSKLYGAETILANIKLEVQTKDRIALVGRNGAGKSTLLKIIAGELSHDGGEIIKPKDVSIGYLAQNTGLETSLTIWDEMLTVFTHLQQMETKLRRLEQEMGKEKNFSNEATYERLLADYDQLQLNYKDQGGYQYEADIRSILSGLGFPVETHQTTISTLSGGQKTRLALGKLLLTKPDLLILDEPTNHLDIETLTWLEQYLQGYPGAILIVSHDRYFLDKLVTQVYEISNKESRRFVGNYSKYLDLKSALYEQEMKRYEKQQDEIAKLEDFVQKNIARASTTKRAQSRRKQLDRMELLTRPLGDSKSASFHFDIEKQSGNDVLQVNDATIGYDGNPIIEHVTMRLTRGDSVALVGPNGIGKSTLLKSIVNKLPLLNGDVSFGSNVSVGYYDQEQANLTSSKRVLNELWDEYPLQPEKEIRTILGNFLFTGDDVLKPVSSLSGGQKARLALAKLMMQKSNLLILDEPTNHLDLNSKEILENALIDYPGTLLFVSHDRYFINRVTTTVVELSTEGAQEYLGDYDYYVEKKNEMIERAELEQQESDVPVQKVVAQEKLNYLEEKERKKLERQRTRKIEELEQSIVELEEEIATLEDQLCLPEIYADYEKASEITTKKQTLQEQLETCMAEWEELHV

SEQ ID NO: 90414 - protein, 475 aa, Alteromonadales bacterium TW-7
MSNELKTQVVVLGGGPGGYSAAFRAADLGLEVTLVESRETLGGVCLNVGCIPSKALLHVAKVIDDAAEMSSHGVTFGAPQIDLDKIRSWKESVVGQLTGGLDGMAKMRKVKVVPGYGKFTGSNTLAVEGADGTTTITFDNAIIAAGSKPVNLPFIPEDDRVIDSTGALELKDIPEKLLVLGGGIIGLEMGTVYRALGSAIDVVEFADQLVPAADKDIIKIYQKYVSDKFNVMLSTKVVAVEAKDDGLYVTFEGKNAPAEPVRYDKVLVAVGRTPNGNLLDAEKAGVNVDERGFINVDKQLRTNVSNIFAIGDLVGQPMLAHKAVHEGHVAAEVISGQKHFFDPKCIPSIAYTDPEIAWVGVTEKEAKEQGLSIETAVFPWAASGRAIASSRTEGSTKLIFDKESGRIIGGAMIGINAGEMLGEIGLGIEMGADGEDLALTIHAHPTLNESIGLAAEIFEGSITDLPNKKAVKKKK

SEQ ID NO: 90415 - protein, 634 aa, Alteromonadales bacterium TW-7
MSIEINVPDIGGDDVEVTEILVSVGDKVDVDQSLLTVEGDKASMEVPAAQAGTVKEIKVNVGDTVTTGSLVFIFEGESADADSAPEASAESAAPAHASGSSTKEVTVPDIGDDEVEVTEIMVAVGDTVEEEQSILNVEGDKAAMEVPAPFAGTVKEIKVATGDTVKTGSLVFVFEVAGSSASASDAPKQESAPAEPAQSAEPSIKEVNVPDIGDDEVEVTEIMVAVGDTVEEEQSILNVEGDKAAMEVPAPFAGTVKEIKVAAGDKVKTGSLIFVFEVAGSATAKASAPAEQKPAAALAKTESAPAQAAPAAKVSNESFENNSAYAHASPVVRRLAREFGINLANVKGTGRKNRVVKEDVQNYVKSLVKQVESGQVSASAGNTGGSELGLIPWPKVDFAKFGEIEEKKLSRIQKLSGKNLHRNWVQIPHVTQFDEADITSLEVFRKEQNVLSEKKKLGVKITPLVFVMKAAAKVLAEFPTFNSSLSEDGESLILKKYINIGVAVDTPNGLVVPVFKDVDKKGIIELSRELMEVSKKAREGKLTASDMQGGCFTISSLGGIGGTAFTPIVNAPEVAILGVSKSEMKPKWNGKDFEPKLMVPLSMSYDHRVIDGALAARFTATLASYMSDIRQLVM

SEQ ID NO: 90416 - protein, 487 aa, Rhizobium leguminosarum bv. viciae 3841
MRRFQHYIDGEFSDGEASYASIDPASGAVWAEMPEAREGDVGRAVDAADRALYDGAWPKMTATQRGKLLCKLADLVAANAQVLAELETRDTGKIIRETSAQIAYVAEYYRYYAGIADKIEGAYLPIDKPDMDVWLRREPIGVVAMVVPWNSQLFLSAVKIGPALAAGCTMVVKASEDGPAPLLEFARLVHEAGFPAGVVNIITGFGASCGAALGRHPKVAHVAFTGGPETARHVVRNSAENLASTSLELGGKSPFIVFADADLESAANAQVAGIFAATGQSCVAGSRLIVERSIKDKFVALLREKAEAIRIGAPLDMATEVGPLATKRQQDNIGALVAKSIESGARLVTGGRKIDGEGYYFPPTILDCDDVASPSLTEEFFGPVLSVVSFETEAEALRLANDTRYGLASGVFTQNLTRAHRLMKGLRAGIVWVNTYRAVSPIAPFGGFGLSGHGREGGMAAALDYTRTKTIWLRTSDDPIPDPFVMR

SEQ ID NO: 90417 - protein, 713 aa, Arabidopsis thaliana
MNEEEAPSEQKKTLSLVPSPTTNLFLPDDILLSSLSRISRLYYPTFSLVSKSFRSLIASPELYQTRSILGRTESCLYVSLRLLNDSNLRWYTLCRVPDRKLTNFSGGHLLVPILSRYAPPAHWSSVVAVDYNIYAIGGPINDAPSSSVSVLDCQCEKWREAPSMRVARNYPTATVLDGKIYVAGGCEDCTSLDCIEVFDPKTQTWDSVASPGTERCERLVYKSVGIEGKYHLFGGAGHVAYDPKEGRWDSVGMDMEMGRTWVSYCVINNILFYYNDREFKWYDYKGRFWRKLMGLERLIKFLCYSRVNLAAYGEKMAVLWDTFVPSSSKNKMIWCAEITIERHDIYEICGKTEWFDVVLRVPKSYELPMSSPERKRKRVTSTKNPSVKKKKKISPVPTPIPSLPDDLLEGNPDPNPLWFTLCMKPDRTLKNGKKKKKKKMSSGNLLIPIPVPNPPLEHWSGHASVGSDIYFFGGYMEENVRSSRVVILDCRSHTLREAPSLQMERSDPAASVIDGKIYVAGGVDGDDADSLYPIEVFDIKTQIWDHRPIPYWEKDWGALSRSAYVDGKFYLTIGMKVMAYDLEESRWDFAGYQMGQSWFWSCNCVIENVLYCYGDAFRWFDTKLRLWKVMKVKGLPKLSRNVDVKIADYGGKMAIFWDNPSPSASDTNKIIRCAVIALERPNSEEIWGTVEWHEAVLTVPVSYEFEHALAVTV

SEQ ID NO: 90418 - protein, 493 aa, Burkholderia xenovorans LB400
MKNLADSFSAPSVPTPAGQTGSAVAKPLRLGLLTALVIGSMIGSGVFSLPQNMASGAGAAAVLIGWLITGVGMLMLAFVYQTLTTRKPELDNGIYAYARASAGEFVGFNSAWGYWVSAWIGNVGYLVIVFGTLGYFFPIFGDGNTPAAVLGASIALWIMHAVILRGVRSAAVLNAITTVAKVIPLLLFIVLAAIAFRSHVIAQDFWGNAKLGSVFTQVKSTMLITVWVFIGIEGASVFSARAQRREDIGRATLLGFVVVLLLLMAVSLLSLGIVPQGELAAMKNPSMAGVLDKAVGAWGAVLISIGLLVSVGGALLAWTLLAAETLFTPANGGVMPKFLARENSHGVPANALWVTNGLVQLFLIITLVSNATYQALISLATSMILIPYLFSAVYATGIAMRGEGYAPAEGARTRDMLIGAAATVYCCWLLYAAGPKYLLLSALLYAPGVLLYGWAKRERGARLFKPFEAVILAALLILAAVAAWLLSTGALGL

SEQ ID NO: 90419 - protein, 386 aa, Rhodococcus sp. RHA1
MSGYDTDSAVLVLEDGRAFRGTTFGAVGQTLGEAVFSTGMTGYQETLTDPSYHRQIVVATAPQIGNTGWNDEDDESVGPTGSSAEAKIWVAGYVVRDPARRTSSWRATGSLQDELVKQGVVGIAGIDTRALVRHLRTRGSMRAGVFSGDALADTDVLLDRVKSQPSMLGADLAGEVSTTSGYVVEPTGGDARFTVAAIDLGIKTNTPRMFAERGIRVHVLPSNATLEQILDLKADGVFLSNGPGDPATADGAVHLTKEVIGQGLPLFGICFGNQILGRALGLGTYKMKFGHRGINIPVVEHETGRIAITAQNHGFALEGEAGQEFDTPFGKAVISHTCANDGAVEGVRLLDGSAFSVQYHPEAAAGPHDAAYLFDRFTSLLEGVKN

SEQ ID NO: 90420 - protein, 515 aa, Bacillus cereus ATCC 14579
MIILKKQHDTIIVLDFGSQYNQLIARRIREFGVYSELHPHTITAEEIKAMNPKGIIFSGGPNSVYGEGALHCDEKIFELGLPIFGICYGMQLMTQQFGGKVERANHREYGKAVLKVENESKLYANLPEEQVVWMSHGDLVTGLPEGFVVDATSESCPIAGMSNEAKNLYGVQFHPEVRHSEHGNDLIKNFVFGVCGCSEGWNMENFIEVELEKIRETVGDKKVLCALSGGVDSSVVAVLIHKAIGDQLTCIFVDHGLLRKGEAEGVMKTFSEGFHMNVIKVDARDRFMDKLKGVEDPEQKRKIIGNEFIYVFDDEASKLQGMDFLAQGTLYTDIVESGTATAQTIKSHHNVGGLPEDMQFKLIEPLNTLFKDEVRVLGSELGIPDEIVWRQPFPGPGLGIRVLGEITEEKLEIVRESDAILREEIIKAGLDREIWQYFTALPGMRSVGVMGDERTYDYTVGIRAVTSIDGMTADWARIPWDVLEKISVRIVNEVKHVNRIVYDVTSKPPATIEWE

SEQ ID NO: 90421 - protein, 332 aa, Burkholderia xenovorans LB400
MAFNLRNRSLLNMQDFAPRDIRFLLDLASELKRAKYAGNEVPRLNGKNVALIFEKTSTRTRCAFEVAVHDQGGHVTYIDSASSQLGRKESLKDTARVLGRLYDGIEYRGFHQSVVEDLATYSHVPVWNGLTDEFHPTQVLADLLTMQEFGEKPLHELSFCYLGDARFNMGNSLLIGGVQMGMDVRIAAPRELWPHDELVAQMRLLAERTGASVTIVEDPHEAVSGVDFVYTDVWVSMGEPVEAWGPRIDLLRPYQVNAALMKATGNPRTRFMHCLPAYHNLDTDTGRMVHEHFGMSELEVSDEVFESDASIVFSQAENRMHTIKAVLVATLA

SEQ ID NO: 90422 - protein, 327 aa, Mycobacterium avium subsp. paratuberculosis K-10
MTSPPLDPDAAARIASFGETAPMRQRGLPAVRAGLESAPRPATMPEMASVTEALVPSAAGGIPVRIYRPTTDSGVAVLVYLHGGGLVMGSNRSFEPLARELASASAATVVAVDYRLAPESPPPAQFDDAYAATEWVSRKAGELGVDADRLAVIGDSAGGSLAAAVALAARDRRGPPICAQVLLYPGLDRDMSVASIAAMPDAPLLIRDDIDYMHALVDGDAGPPTDPYLVPAYAADLSGLPPAIVVTAGCDPIRDWGERYADRLRDAGVQTTVTRYPGMYHGFLMRSDATARGRLAIAEIGGLLRAKFSHPLRFDVPITGRHSTATR

SEQ ID NO: 90423 - protein, 389 aa, Physcomitrella patens subsp. patens
MERKWRIPLFASIFISFVLLLVAGTKDSLVGQSVVTLPAPPRLAYLISGNKGDGMRIRRTLQALYHPRNYYVLHLDLEAPPKERVELARYVRSDPVFQQTKNVIMIVKANLVTYRGPTMVSTTLHGAAILLKNFQDWDWFINLSASDYPLATQDDILHVFSFLPRDLNFIEHTSNIGWKEFQRAKPIIIDPGLHMNRKSDIFWATQRRALPTAYRLFTGSAWAVLSRSFMEFTIMGWDNLPRILLMYYTNFVSSPEGYFHTVICNSQEFRNTTVNHDLHYIAWDNPPKQHPLALSMRDFQNMTSSGAPFARKFNREDPVLTFIDKQLLGRSPGKFTPGGWCIGGVGDDPCTMIGDTSVLRPGPGARRLQGLIERLLAKPRFRSEQCILT

SEQ ID NO: 90424 - protein, 387 aa, Bdellovibrio bacteriovorus HD100
MNIHEYQAKEVLRKFGVATLKGKLAHSPEEAVAAAKEIGGSVWVVKAQIHAGGRGKGGGVKVAKSLDEVSEFTKKMIGMTLVTHQTGPEGKVVQKVFIEQGCNIAKEYYVACLIDRATGRAAMMASSEGGMDIEEVAEHNPDAIKKVDIDPTVGLMPFQARELAFQIGMEPAIVNKAVKFFAGLYNAFVATDCSIAEINPLVVTKEGDVLCLDAKMNFDSNSLFRHPDIVEMRDLNEEEPSEIEASKFDLAFIKLDGNIGCLVNGAGLAMATLDIIKLHGAEPANFLDVGGGANKEKVTEAFKIILKDKNVKGILVNIFGGIMKCDIIAEGVIAASKELGLKVPLVVRLEGTNVELGKKMLKESGLNITPADNLTDAAKKIVAAIKG

SEQ ID NO: 90425 - protein, 241 aa, Noctiluca scintillans
MSANGSGEDPTASHPNDFYELLEIQRDAGEIDIKKGYRQQALKWHPDKQDVNNRAYAEERFKLVSEAYQVLSDPQKRAAYDRYGKDGGPSAGMPSSPFGQGGFSGFSGFGGPGVRVVIRTGPNGTTFTQSSTTSSGHGFGGGFPDSFPHRAQDPMDLFREFFSVRDPFGGNGPFGFMRGRFPDDEVQRAVEASLIEEEQAQHRRNQEELQPPMSEEEALEMALRLSMEEQQRAHPRHGRVQ

SEQ ID NO: 90426 - protein, 476 aa, Physcomitrella patens subsp. patens
MSKGGSLKKEAWEVLRKSIMYHHGMPIGTIAATTIDPLEDMVNYNQVFMRDFFSSGIAFLIAGEPEIVKNFLLMAVQLQGDEKQVDCFTLGEGVMPASFKVTVDQNSNQESVEADFGDAAIARVAPVDSGFWWIVLLRAYTHSTGDHSVANSPQCQLGIIRCLNLCLHDGFDTFPTLLCADGCSMIDRRMGIYGYPLDIQSLFYMALRCGKELLRQDRDMGAFVERIDKRLHALTFHMRQYFWLDHNQLNNIYRYKTEEYSYTAVNKFNIMPDSLPNWVFEFMPNKGGYMVGNVSPAFMDFRWFTIGNFLAITSSLATNQQANAIMDLVEERWDELIGEMPMKCMYPALEGEEWRIVTGCDPKNTRWSYHNSGSWPVFLWFLTAAAIKVGRPNIAHRALEIAEKRLLKDEWPEYYDGKLGRTIGKQARKLQTWTISGYLVAKLLLEDPSQAEMLFMDEDMRCRINPLARSSSSEGG

SEQ ID NO: 90427 - protein, 358 aa, Cordyceps bassiana
MAEFVRAQIFGTTFEITSRYSDLQPVGMGAFGLVCSARDQLTNQNVAVKKIMKPFSTPVLAKRTYRELKLLKHLRHENVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLDGKPLFPGKDHVNQFSIITELLGTPPDDVINTIASENTLRFVKSLPKRERQPLRNKFRNADDSAIDLMERMLVFDPKKRITAAEALSHDYLAPYHDPTDEPVAEEKFDWSFNDADLPVDTWKIMMYSEILDYHNVEAGASGLEDGSVPAQ

SEQ ID NO: 90428 - protein, 484 aa, Rhizobium leguminosarum bv. viciae 3841
MKLNDPSLFRQACPIADRWIEAEGRKAATVRNPATGEPLGVVPDLGAAETEDAIRAAVIAQKLWAKKTAGERAAVLKKWHRLMIENRDDLAMILTLEQGKPLAEAKGEITYGASFIEWFAEEARRINGEVVPGHQPDKRILVLRQPAGVVAAITPWNFPNAMITRKIGPALAAGCAVVLKPALQTPFSAIAIAVLGERAGLPPGLLNIVTGDAAAIGGVLTASRDVRVLTFTGSTRTGELLYRQCAPTIKKLGLELGGNAPFIVFDDADLDAAVEGALIAKFRNNGQTCVCANRLYVQDGVYEAFAAKLAAAVSGLKVGNGLDRDVVLGPLIDDNAVAKVESHIRDAVSKGAGIVSGGKRHALGGHFFEPTILRDVAAGMQVAREETFGPLAPLFRFRDEEDVIEQANDTEFGLASYFYARDLSRVFRVAEALEYGMVGVNTGLVSTAEAPFGGVKMSGLGREGSRHGLDEYTELKYVCLGGIA

SEQ ID NO: 90429 - protein, 646 aa, Mycobacterium avium subsp. paratuberculosis K-10
MSTGMAVTTESAGAAGPDPYDVGELRANLRQADPGVLVAVLAQLTGDPAVVDRFAPKITHVPDPPEQAGVTDPETAAQLVDEIVTALRTPRRADAVPADDLDLFARVAPVALGGEVGPEYLGLLVEQGGFQPSQPVLPRTAKLPAGFRVVIIGAGIAGITAALACADAGIEYQIIERNDEVGGTWYTTRYPGIGVDTPSAYYSLSRDINGDWSSYYPQGAEYQAYLVSVADKNDLRKHTRFGTEVEALWWQERRRQWQIHSVGPDGTRDVSYANVVIPAAGYLNRPRWPELAGRETFSGISIHSAHWDPELDLTGKRVAIIGAGCTAVQIVDACVDQVAHLTVFQRQPHWVAPRRRASDDVSTYQRWLGTRLPYYANWIRIKSYWGTADNNYPVILHDPQWAAEHLSVSPANDVLLRMCLDYIDRVFGAGSELARKVTPDFAPYGKRIIRDPGGYYAALAREHVDVEASEPARVNQAGIVTADGRQIDLDVIIYATGYYLDFLSTVDIRGRDGKKLTDEWGDAPRAYRGGMVPGFPNMFISSAPNYSPGHGAGHNFGVEVMVHYVMECLQLMALRRATTVEVTQRAYEEYVADIDALMAGTVWCHTPSAHTYYRSGGGRIVTAFPYRLVDFWRDHRAPSEEDLELR

SEQ ID NO: 90430 - protein, 461 aa, Physcomitrella patens subsp. patens
MEDAKASSSRGVRRQVLALSAGASHSVALLSGDLVCSWGRGEDGQLGHGDAEERHFPTIVSALDDCEISSVTCGADHTTALSNSTKTVYSWGWGDFGRLGHGNSSDLFIPQPIKALKGLEVKQIACGDSHCLAITTDGEVLGWGRNQNGQLGLGHTEDVLTPHKLTAFEGVAVKMLAAGAEHTTAVTENGKLYGWGWGRYGNLGLGDREDRLVPDQVAAVAGELMKMVACGWRHTICVAESGNMYTFGWSKYGQLGHGDFADHLIPHQVQALKSKKIQAITGGWRHTFALDSDGRLYGWGWNKFGQVGCGNTEDQSSPQLVKGLQDQVVTVVQCGWRHTLAMTDRGNVYSWGRGTSGQLGHGDTVDRSTPKRIEILSSDGFACEQIESSGSSNCTSKTSNWISPAERYAVVPDETLGPLARRLHQTTNFEGEELEVPTASDDSSGDANVPDTDTKRMRTTL

SEQ ID NO: 90431 - protein, 250 aa, Bdellovibrio bacteriovorus HD100
MKTGAAFITGAGSGIGRATAMAYAQAGIPVAVVDFSEQGANETIALIRKNSDVPADAYVCDVSIDGDVSRTFFAAVERFGHIRYAFNNAGVEGDSSLLQDVTDENWDGVLNVNLRGVWLCMKYQLYHMAKAGGGSIVNCSSIAGLVGFENLAPYVASKHGVIGLTKAAALEYAKKNIRVNAVCPGVIKTPMLDRAMKHLHQDPEQFAKAAPIGRMGTPQEIAETVLWLNSDKASFVTGHSLIADGGWTAQ

SEQ ID NO: 90432 - protein, 248 aa, Oryza sativa Indica Group
MGGWIMQPKGLHSWDLLKTEFGQEIDAHDAVFRDNEAPVNKKYAKYVGLKRDFRLVVRGAARNMAPILKGSSDEVLIIKSLTHKEINAVIKELPNPVYLFQGIVLRRGAKGTGSKITTFRNVSAGQIWQGLSRKDYEKKKELVATEIIKRLEKKLFPGLQDSIVLKEGSCVLIELQLILKNTFSHMSWSLHICFGEPYMDQAAVFASWDLASAWYIQEVGFSAAVIPEKLKLPGIIVQISVVIWEQKA

SEQ ID NO: 90433 - protein, 424 aa, Synechococcus sp. CC9311
MPQNHHPHLWPPFTQVSTTPPLERVLRGDGALLYRDEGPPLIDAISSWWVTLHGHSHPHIAKAIAHQAETLEQVIFAEFTHPQAERLANRLATKTGLERVFFSDNGSTAVEVALKIAIQWWHNKGEPRQQIIAFDGAYHGDTFGAMAVGARSLFSEPFDPLLFPVARIPWPATWWDDDQVEQHEQTALNQLEEALKTPTAAVILEPLVQGAGGMSMVRPTFLQEVEKRVRNAETLLIADEVLTGFGRCGDFLATQRAGVQPDLVALSKGLTAGFLPMGITMASGAVFGAFVGQDPSLTLWHGHSFTANPLGCAAANASLDLLEAEPDKYLGFEARHRSRLEHLARHPGIRHVRVTGTIAAFDLVVTDQEGYLNPAGKVLRKLARERGVLLRPLGQVVYLLPPLCISDEQLDHCYSVIQEAINLL

SEQ ID NO: 90434 - protein, 171 aa, Halobacterium sp. NRC-1
MYARIREDVRAMRRRDPAAGSRLDVALTYPGLHAVWAHVFLAGPLYDRWPTAGRLVAYWVRLLTGIEIHPDADIGRRVTIDHGHGVVIGETAVVGDDVHMYHGVTLGGNDSRPVDRHPTVRAGVTLGANATLLGDIEIGANASVGAASVVTDDVAAGATVTGVPAQRVDDA

SEQ ID NO: 90435 - protein, 266 aa, Brassica napus
  misc_feature (220)..(220): Xaa can be any naturally occurring amino acid
  misc_feature (240)..(240): Xaa can be any naturally occurring amino acid
  misc_feature (259)..(259): Xaa can be any naturally occurring amino acid
RPTRPGPATSKKIFVGGLASSVTEAEFKMYFAQFGTITDVVVMYDHRTQRPRGFGFISFESEEAVDRVLQRTFHELNGKMVEVKLAVPKEMALNPIRNQMNVNSFGSSRISALLMNEYTQGFSQSPISGYGVQPEVRYSPGVGGNRGGFSPFGHGFGIELNFEPGHYGSGSSAGFGRPFSPGYAASQGRYGSQIESGARNNLWGNGGGLGGYMSNSPISXSSFNGNSGMSSLGSIGDNWXGAARARSGYRSEGGGLGLXAMKGVHV

SEQ ID NO: 90436 - protein, 132 aa, Zea mays
LISLAFTQLILLASPLPSDLLPPSSAPAKMSTVTRAYLDQRLAAAKRCSKEAAMAGAKAAAVATVAAAVPTLASVRMLPWAKAHLNPTGQALIISTVAGMAYFIVADKTILSMARKHSYETAPEHLKNTSFN

SEQ ID NO: 90437 - protein, 466 aa, Corynebacterium efficiens YS-314
MLVVGMSHRSAPVALLERLSMDDSVRGQTTSALVERPSLSEALIVSTCNRLEVYTVTSSFHTGVNDVVEVLHEISGVDIETLRGYLYVRYADAAAEHMLVVASGLDSMVVGEQQIIGQVRTAYQQATEAGTVGPALHALAQTALHTGKRVHTETDIDEAGASMVSFAIDRALTQMGIDPASDKPLAGKTALVLGAGAMSSLAATHLGREGVDKLIMANRTRERAERLASHSLEAGVPAEVVDFADRASVLDRVDMVVSATGADDFTVKPADIPAGVQLMLVDLSMPRDIDDACAEVPGVDLVNIERLHRAKREDPTGAAAEGADALAIVREELEAFTSEQRIRDVVPAVSALRKRANELLLDELDRLQARTPDISQEDWKEVTRTVRRVMDKFLHEPTVRVKKLAARSGSVSYESALQELFGLEAVQTTAPPAITSVNASDLPDAGIVAIVNSPSTTGQSVSVDGS

SEQ ID NO: 90438 - protein, 377 aa, Shewanella sp. MR-4
MSKRDYYEVLGVGRDASEREIKKAYKRLAMKFHPDRNPGDKAAEASFKEVKEAYEILTDANKKAAYDQFGHAGVDPNRGGGGGYGGAGDFGDIFGDVFGDIFGGGRRGGQRQAARGSDLRYNLELSLEEAVKGLTKELRIPTLASCDVCDGSGAKKGTSATTCGTCHGQGQVQMRQGFFTVQQACPTCHGRGKIIKDPCTKCHGDGRVEKTKTLSVKIPAGVDTGDRIRLAGEGEAGEFGAPPGDLYVQVTVREHAIFVRDGNNLYCEVPISFSKAALGGEIEVPTLDGKVSLKIPAETQTGRMFRLRGKGVKSVRSHAVGDLLCKVVMETPVNLNERQKELLREFEATLTGESKKHSPKAEGFFDGVKKFFQDLNS

SEQ ID NO: 90439 - protein, 249 aa, Xanthomonas campestris pv. vesicatoria str. 85-10
MTRKLVLLRHGQSQWNLDNRFTGWVDVELTDQGRQEAVAAGKLMKDEGLQFDVAHTSVLKRAIHTLQGALKELDQDWLPVSKSWRLNERHYGGLQGLDKAETAAKHGEEQVKIWRRSYDIPPPAMDVNDPGHPCHDRRYATLDRNALPGTESLATTLVRVLPYWHDAIAPQLKAGQTVLVTAHGNSLRALYKYLNDVSNEQILELNIPTGIPLLFELDDNLQVRSFRYLGDPEAAKRAAEAVANQGKAK

SEQ ID NO: 90440 - protein, 220 aa, Geobacillus kaustophilus HTA426
MNMIRIAPSILSADFARLAEEIRSVEEGGADWIHVDIMDGHFVPNLTFGPPVVAAIRPVTKLPLDVHLMIADPDRYIPAFAKAGADVISVHVEACVHLHRTIHFIKEQGVKAGVVLNPHTPVEMIRHVIGDVDLVLLMTVNPGFGGQAFIPAVVPKIREVARMASEQNKEVDIEVDGGINAETAPLCVEAGANVLVAGSAIYNERDRAAAIRTLREVCAN

SEQ ID NO: 90441 - protein, 306 aa, Coxiella burnetii RSA 493
MTPFNETHFIIMLYQTIRDQLKKRAIAARAVQAGQKGMPAIKNIIAVASGKGGVGKSTTAVNLALALAEAGAEVGLLDADIHGPNQPLMLGVQKKPEMQAKKFVPIRKYGIQSISVGYLIDPKTPVIWRGPMVSQALQQLLYDTLWEDLDFLILDLPPGTGDIPLTLAKKAPIAGAVIVTTPQDVSLLDAGKALTMFKKLGITVLGIVENMALYTCPQCGHTEAIFGSGGGESMAAADNVPLLGRLPLHIAIRKNADAGTPLVMAEPESALASHYRTIAFALVEQLTLQPINYAVKFPTIVVEGGK

SEQ ID NO: 90442 - protein, 386 aa, Shewanella sp. MR-4
MEVALTKSALLVLEDGTVFTGTAIGADGLSVGEVVFNTSMTGYQEILTDPSYSRQIVTLTYPHIGNTGTNNEDVESNGVHACGLIIRDLPLIASSFRNQQTLSDYLKANNVVGIADIDTRKLTRILREKGAQAGCIMAGADLDEAKALAAAKAFPGLKGMDLAKEVTTETAYQWRKGSWRLVGGLPEDTPAEALKYKVVAYDYGVKQNILRMLVDRGCDVTVVPAKTSAAEVLAMNPDGVFLSNGPGDPEPCDYAIEAIQQILKTDTPIFGICLGHQLLALASGAKTLKMKFGHHGANHPVSNIEKGNVMITSQNHGFAADEATLPANIKVTHKSLFDGSLQGIHLTDKPAFSFQGHPEASPGPNDAAPLFDHFIELIEQYRQNAK

SEQ ID NO: 90443 - protein, 629 aa, Sinorhizobium meliloti 1021
MIQISGLSARIAGRLLIDNASVTLPAGTKAGLVGRNGAGKSTLFRVITGELAAEAGSVSLPKNARIGQVAQEAPGTEEPLIEIVLKADRERTALIAESETAVDPHRIAEIQTRLADIGAHSAEARAASILAGLGFDHEAQKRPASSFSGGWRMRVALAAVLFSEPDLLLLDEPTNYLDLEGTLWLEDYIRRYPHTVIIISHDRDLLNTAVNAIVHLDQKKLTFYRGSYDQFERQKAEADELQMKAKAKNEAARKHLQSFIDRFKAKASKARQAQSRIKALERMGTVAAVIEDHVQGFTFPDPEKQVASPIVAIQGGAVGYEPGKPILKRLNLRIDADDRIALLGSNGNGKSTFAKFIAGRLRAESGEVRIAPGLKVGFFAQHQLDDLVPTQSAVEHVRRRMPEAPEAKVRSRVAQMGLATEKMDTAAKDLSGGEKARLLMGLAAFEAPSLLILDEPTNHLDIDSRNALIAALNDFSGAVILISHDRHLIEATADRLWLVRDGTVANYDGDLEDYRGLIVGGPKPKDDKPRVNGSDEALSKADQRKANADRRASLAPLRKKINEIESLTGKLEKVIQALDAELADPALYEKAPAKAAQRAKERADAVEKLAAAEEQWLELSAEYEEAMAG

SEQ ID NO: 90444 - protein, 331 aa, Mycoplasma mycoides subsp. mycoides LC
MALNLKGKSFLKLLDFCPREIRYLLDLSRDLKRAKYTGNEIQTMQGKNVVLLFQKDSTRTRCAFEVAALDQGAHVTYLGPSGSQFGKKESVADTARVLGRMYDAIEFRGYDQAVVEELAKYSGVPVYNGLTNEFHPTQILADFLTVEEYKGNLKGLKFVFVGDTRNNVATSLMIGCAKMGMHFVGAAPKQLWPSQDLINQSKEIAKETNAIISFTEDMKQACSDADVIYTDVWVSMGEPAEVWESRINLLKPYQVNMDAIKIAKPDVIFMHCLPSFHDLNTEIGRQIYEKFNIPEMEVTNEVFESKHSVVFEQAENRLHTIKAVMVATIGK

SEQ ID NO: 90445 - protein, 341 aa, Burkholderia xenovorans LB400
MAQLMKAAVVHEFGAPLRIEEVPVPQVGRGQILVNIKASGVCHTDLHAADGDWPVKPTLPFIPGHEGVGYVAAVGEGVKHVKEGDRVGVPWLYTACGHCEHCLGGWETLCQEQQNTGYSVNGAYAEYVVADPNFVGHLPAAVSFEDIAPILCAGVTVYKGIRMTDARPGQWITISGIGGLGHVAVQYAIAMGLRVVAVDISEDKLALARELGATLAFNASECDPAAAIQKEIGGTHGVLVTAVSRSAFAQALGMVRRGGTVALNGLPPGDFPLPIFSTVLNGITVRGSIVGTRQDLQESLEFAAQGRVRARIHLDRLDNINHVLAELKSGKVDGRIVLNLD

SEQ ID NO: 90446 - protein, 253 aa, Pseudomonas fluorescens PfO-1
MSMTFSGQVAVVTGAANGIGRATAQAFAAEGLKVVVADLDAAGGEGTVALIRTAGGEATFVRCNVTVESEVKNLMDEVINTYGRLDYAFNNAGIEIEKGKLAEGSMDEFDAIMGVNVKGVWLCMKYQLPLLLAQGGGAIVNTASVAGLGAAPKMSIYAASKHAVIGLTKSAAIEYAKKKIRVNAVCPAVIDTDMFRRAYEADPKKGEFANAMHPVGRIGKVEEIASAVLYLCSDGAAFTTGHSLAVDGGVTAF

SEQ ID NO: 90447 - protein, 140 aa, Sinorhizobium meliloti 1021
MAIERTFSMIKPDATKRNLTGAITKMLEDAGLRVVASKRVWMSRREAEGFYAVHKERPFFGELVEFMSSGPTVVQVLEGENAIAKNREVMGATNPANAAEGTIRKVHALSIGENSVHGSDAPETAAEEIAYWFSGTEIVG

SEQ ID NO: 90448 - protein, 337 aa, Salmonella typhimurium
MRVLVTGGSGYIGSHTCVQLLQNGHDVVILDNLCNSKRSVLPVIERLGGKHPTFVEGDIRNEALITEILHDHAIDTVIHFAGLKAVGNSVARPLEYYDNNVNGTLRLVSAMRAANVKNLIFSSSATVYGDQPKIPYVESFPTGAPQSPTGKSKLMVEQILTDLQKAQPEWSIALLRYFNPVGAHPSGDMGEDPQGIPNNLMPYIAQVAVGRRESLAVFGNDYPTEDGTGVRDYIHVMDLADGHVVAMEKLADKSGVHIYNLGAGVGSSVLDVVNAFSKACGKPINYHFAPRDGDLPAYWADASKADRELNWRVTRTLDEMAQDTWHWQSRHPQAYPD

SEQ ID NO: 90449 - protein, 307 aa, Mycobacterium avium subsp. paratuberculosis K-10
MSLEPQIAAIIEQLDSGFPPVQQMSGAEARALIRSRLVPPAQPEPVAEVADRLVEGPGGPLRIRVYRPEAAAPLPVVVYAHGGGFVFCDLDSHDGLCRNLANLVPAVVVSVDYRLAPENAWPAAAEDVYAVTCWARDHADALGADPARLVVGGDSAGGNLAAVTTVMCRDRGGPAPAAQLLIYPVIAADFDTESYRLFGQGYYNPAPALRWYWDCYVPSTRDRAHPYATPLNADLRGLPPAVVVVAGHDPLRDEGLAFGAALEAAGVPTVQLRYEGGIHGFMTMPMLDIAHRARNEAAAALADLLQW

SEQ ID NO: 90450 - protein, 380 aa, Salmonella typhimurium
MNLKENASRLFAEIFGYPATHTIQAPGRVNLIGEHTDYNDGFVLPCAIDYQTVISCAPRDDRTVRVIAADYDNQVDEFSLDAPIVTHDSQQWSNYVRGVVKHLQLRNNAFGGVDMVISNVPQGAGLSSSASLEVAVGTVFQQLYHLPLDAQIALNGQEAENQFVGCNCGIMDQLISALGKKDHALLIDCRTLGAKAVSMPKGVAVVIINSNFKRTLVGSEYNTRREQCETGARFFQQPALRDVSLEAFNAVASELDPVVAKRVRHVLSENARTVEAASALEKGDLQRMGQLMAESHASMRDDFEITVPQIDTLVDIVKATIGDRGGVRMTGGGFGGCVVALIPEDLVPAVRQAVAQQYEAKTGIKETFYVCKPSQGAGQC

SEQ ID NO: 90451 - protein, 493 aa, Aspergillus oryzae
MLSPIHLLSRRTCLRSIATAIDQPRFPVFLQQQSLSTPFSSSLVYSKALKFPRPTSTRLISCSFSRLYTTSVNDLAKMSSLTPYQRKHKVTVIGSGNWGTAIAKIVAENTASNPAIFEKDVQMWVFEENVEVPKTSPHYNPSSPLCQGPQKLTEIINKTHENVKYLPGINLPTNLHANPSLEDSVKDSTILVFNLPHQFIIKTCEQIKGKILPYARGISCIKGVDVREDGISLFSETIGKILGIYCGALSGANIASEVAQEKWSESSIAYDPPHLDSKAPSPNRSPSSSTVDVVHFTHKDVSGQLSRVKLQALPSEYPPIDHAVLKTLFHRPYFHISVVSDVAGVSLGGALKNVVAIAAGWVEGMGWGDNAKAAVMRVGLLEMVKFGEMFFGATINTRTFTEESAGVADLITSCSGGRNFRCAKLSIERKQPIGKVEETELNGQKLQGTLTAIEVNKFLKNQGVEEEYPLLTAVYKILEGTMSVEDIPSYIER

SEQ ID NO: 90452 - protein, 561 aa, Cryptococcus neoformans var. neoformans JEC21
MPIRSPTSLSLKRSSHFTTATRRLHTSTPTLIAAASLSKKLQRFSPQLTPRLLAPNGSRTMSNWPKVTSENPLGLDDPSLFIQKGFINGQYVGTQSGKTFEVNDPASGKTIGTCPEMTVEDTRHAIEVAEKAFATFRNTSPVQRSNWLSELYRLYQASIKDIARLIVWENGKSWNDAMAEATYAGTFFSWFAGEALRTYGDVIPCSVPGTRNFSIKQPIGVVALLCPWNFPAAMIARKMGPALAVGCTSVIKTPSETPFTTLAIIELARRAGIPDGVINVITTDANLQDVGKELCTNPAVHKVSFTGSTRVGKILASQCSSTLKKMSLELGGNAPLIVFEDADIPTAVAGTIASKFRGSGQTCVCANRIYVHEAIYDEFAKKLAEKVAEFKVGPGFGEGVTHGPLIHSRQADKVEEHVQDAIKKGAKVLVGGKRGNGTEYIPTVLTNVSDECLIATEETFGPVAALFRFSSEEEVVARANRAEVGLAGYFFSRDSDRIWRVAEALETGMVGANTGMISQAVIPFGGIKESGYGKEGGRQGTEEYTITKLVAVGTSLHNMPK

SEQ ID NO: 90453 - protein, 754 aa, Cryptococcus neoformans var. neoformans JEC21
MISERRWPISHRRVPTRHVLSSHLPSAVHNVSISRFPPPSALAMPPIAASPPNHDENAPLLASPSLEAGTTGPPTPSPPWQFWNRPPFRRVHFADHDQFVSPASAHSESELSADGNGGYGTNPKYPRQPLQQEEKMGQWMMYCLLVLVGMVFGALFSRNWSIKGDAGDMPMVPPVWTLPPPTGLPRNDAYLINATTAAVASEDVTCSNLGLSIMQDKNGSAVDAAITTTLCIGLLNAFSSGIGGGGFMVVRVPETHEVKDQALRDIGYDGELEESRVVALDFRETCPSNCEKDTYGTHKAGRMAAQVGGLAIGVPGELRGLEAAHKLYGTLPWKDVVMPVAELAKGWRVSRELARRLRLFGDFMLSSPTWSAVYAPRGPLLVEGDFIQRLNYGKTLKKIAEEGASAFYQGEIAESSVKTIAKAGGVMTLDDLQSFKALSYPAIHSTFMSKEIYTTSAPSSGGIMLGLLNILEPLNITSNNGLKNPLNLHRFIEALKFAFGARSWVTDPAFAEDRKRLEEVYTKEWANEIREKITDNETHSADYYGLQYDTPIDHGTTHLSVVDKWGGAASVTSTINLIWGSHVMDPKTGIIFNDEQDDFAVPGAPDAFGLWPSPWNYPAPGKKPLSSTSASIILNPATGSSPSPSLYAVVGGSGGSRIFPSVAQVLLNLFSGLGISQSIEAYRVHNQIVPDLTTMEVGPEGVDEEVVKGLKERGHKIGEFDVNIGISEVQAIVLEDGHIFASSDSRKNGIAAGY

SEQ ID NO: 90454 - protein, 350 aa, Triticum aestivum
  misc_feature (301)..(301): Xaa can be any naturally occurring amino acid
  misc_feature (313)..(313): Xaa can be any naturally occurring amino acid
  misc_feature (327)..(327): Xaa can be any naturally occurring amino acid
NKFVQKSRLVPVRNSRDIVDPRVRQHQDTASVGFSSATGILFARHFVVGWSFALDGPAPTLNISSLPALPPTGPKPRSRVLEIVLPIASATVVLAVGIAAYILVRRRLRYAEVREDWEVAFGPQPFSYKDLYQATKGFSETNLLGAGGFGSVYKGVLRKPDMDTEVAVKRVSHQSRQGMKEFVAEVASMRRLHHRNLVQLLGYCRRKGELLLVYDHMPNGSLDKYLHDPSPGKPTLEWPQRLHLIRGVAPGLSYLHEGWGPLVIHRDVNASNVLLDGEMNGRLGDFGLARLYDHGSDARTXHVVGTMGYLAPXLGHTGKAPRLTDVXAFGAFLLEVTCGRRPIEENEENN

SEQ ID NO: 90455 - protein, 268 aa, Mycobacterium avium subsp. paratuberculosis K-10
MSGLSGRVVLVTGAGRGIGRSHCQRFAEEGADVIAVDVPAAAPDLAQTAAAVQQRGVRAATALADVSDFAALAAAVDEAVGRLGRLDVLVGNAGIHPAAAPAWEITPQNWQQTLDVNLTGVWHTVKAGVPHMSRTARGGSIVIISSTSGIRGTPGAAPYSASKHAVVGLARTLANELGPQGIRVNTVHPGAVATAMVLNEATFRRLRPDLDNATADDAAEALSARHLLPVPWVEPVDVSNAVVFLASDQARYITGTQIVVDAGLLARA

SEQ ID NO: 90456 - protein, 247 aa, Yersinia pseudotuberculosis IP 32953
MMLEQIGQLAREAGVAIMAVYQGDKPLDIAHKKDDSPVTAADLAAHQIIKAGLARLTPDIPLLSEEDPPAWDVRQHWQRYWLVDPLDGTKEFLNRNGEFTVNIALIDQGEPVLGVVYVPVTEVMYSAANGQAWKEECGRRMQIQVRDALPPLVVVSRSHSDAELEDYLSQLGEHQTISVGSSLKFCLVAEGKAQLYPRFGPTNVWDTAAGHAVAIAAGAQVHDWQGKTLSYTPRESFLNPGFRVSLF

SEQ ID NO: 90457 - protein, 227 aa, Rhodococcus sp. RHA1
MATPMIAPSILSADFARLAEEADAVAGADWLHVDVMDAHFVPNLTLGLPVVQSLLAATDIPLDCHLMIDDPGRWAPPYAEAGAHNVTFHAEATDDPRSVARDIRAAGAKAGLSVKPGTPIEPYLEILKDFDTLLVMSVEPGFGGQSFIPEVLSKAKAVRRLVDSGELRLVVEIDGGINADTVEAAAEAGVDCFVAGSAVYGTSDPAEAVRALRASAAKASPHLSLSR

SEQ ID NO: 90458 - protein, 370 aa, Kluyveromyces lactis
MTGISQALALNDSGVNGFDTDLAKRNGTVNASGGQSPGGSETVNALKVLLLGSGESGKSTVLQQLKILHQNGFSREELLEYKPFIFDNIIETGKDLAKARRTFNVQLEEDAEISESDLDELLSQQYQPTKLPCLPADLAKTLKILWNLQSTQDLLVSEHRSSFYLMDSASYFYENLDRISEPKYIPTITDVIRTRKKTSGIFDTMIDLDKNLKLHFFDVGGQRSERKKWIHCFDNVTLIIFCVSLSEYDQTLLEDNSQNRLEESLILFDSVVNSRWFARSSVVLFLNKIDIFAEKLRHVPLEKYFPDYTGGKDINKAAKYILWRFVQLNRANLNIYPHVTQATDTSNIKLVFAAIKETILENSLKDSGVL

SEQ ID NO: 90459 - protein, 76 aa, Glycine max
FTAVLKFAAEEFKVPPQTSAIITNDKRLWTFKYSHLQKLSLNVVGINPQQSAGNIFLKHGSELRLIPRDRVGAAGV

SEQ ID NO: 90460 - protein, 202 aa, Yarrowia lipolytica CLIB122
MSQQQHLEEEEEEEFVDTYVPGEKKSVAEYVNLDAEDESLRKWKEALGITSNVAGQTVGDPNDKRRVVIMENRTYLGDDEPIVKNLEDPKTIEDLKTGTIKIKEKIKYYSEIKFRVQHEIVTGLVYQQTISRMGVPIETRKQVMGSYPPNTPENPFYVKKFELQEAPSGFLVRGKYLGQSKYIDDDGVVHAEYPFNFEITKK

SEQ ID NO: 90461 - protein, 276 aa, Oryza sativa Japonica Group
MSTSARRLLLLAGAAAAIALLLSATAPVAGAEDDGYSYIPGSPRGPQNWGSLKPEWATCSSGKMQSPINLGLLDLTLAPGLGNLNYTYQNANASVVNRGHDIMVRFDGDAGSLKINGTAYQLRQMHWHTPSEHTIDGRRYDMELHMVHLNAQNQAAVIGILYTIGTRDEFLQKLEPYIIEISKQEGKERVIIGGADPNVAKGQDTVYYRYMGSFTTPPCTEGVIWTVVRKVRTVSLSQITLLKAAVLTGNENNARPLQGVNNREIDLFLPLPLINN

SEQ ID NO: 90462 - protein, 485 aa, Zea mays
MAARKKKPLLIACQATSARITRSQAAANSTRSGLAPSVPVPLKTEHNHAAKKKMKREASDENASADAGASAPLPKRRTVLKNVTNISCAKISKRCTAVTGLKLGPSQKAGQSINKQCTNKISMLLPLAVGGSSLVDDSNNAEETQMVDLLAQKEKQIVLLKEAQPLQNTEQNKGGACDEASVEERNAMNVHETAALKAGVSNGLNIVDIDKNNGDPQMCVTYVAEIYRNLMASELIRRPRSNYMETLQQDITASMRGVLIDWLVEVSDEYKLVADTLYLTVYLIDQFLSQNCIQTHKLQLLGITSMLIASKYEEYSAPSAEEFCNITAGTYAKAEVLEMEQQVLNDLGFHLSVPTTNTFLRRFLRAAQASRTAHLTTLNYLASYLAELTLISYDFMKFLPSEVAASSIFLAKWTLDQSDHPWNPTLEHYTSYKSFDIRTCVRALQELQHNTSNCPLNAIREKYGQQKFECVANLRSPELLRSLFS

SEQ ID NO: 90463 - protein, 310 aa, Oryza sativa Japonica Group
AEDLGGASVHCKISGVSDHFAQDELHGLTLGRNIVKNLHLAAKVPNVQNSACDYQEPLYDVQELRSIAPADMKQSFDIRQVIARIVDGSEFDEFKKLYGTTLVTGFARICGQPVGIIGNNGILFTESALKGSHFIELCAQRNIPLIFLQNITGFMVGSKSEASGIAKAGAKMVMAVSCSKVPKITIIVGGSFGAGNYGMCGRAYSPNFLFMWPTARISVMGGIQAAGVLAQIEKNNRKRQGVEWTKDEEEAFKAKVVEAYDKEGSPYYSTARLWDDGIIDPADTRRVLSLCLSAAAKPVPEDTKYGVFRM

SEQ ID NO: 90464 - protein, 503 aa, Oryza sativa Japonica Group
MATAIPQRQLFVAGEWRAPALGRRLPVVNPATESPIGEIPAGTAEDVDAAVAAAREALKRNRGRDWARAPGAVRAKYLRAIAAKIIERKSELARLETLDCGKPLDEAAWDMDDVAGCFEYFADLAESLDKRQNAPVSLPMENFKCYLRKEPIGVVGLITPWNYPLLMATWKVAPALAAGCTAVLKPSELASVTCLELADVCKEVGLPSGVLNIVTGLGSEAGAPLSSHPGVDKVAFTGSYETGKKIMASAAPMVKPVSLELGGKSPIVVFDDVDVEKAVEWTLFGCFWTNGQICSATSRLILHKKIAKEFQERMVAWAKNIKVSDPLEEGCRLGPVVSEGQYEKIKQFVSTAKSQGATILTGGVRPKHLEKGFYIEPTIITDVDTSMQIWREEVFGPVLCVKEFSTEEEAIELANDTHYGLAGAVLSGDRERCQRLTEEIDAGIIWVNCSQPCFCQAPWGGNKRSGFGRELGEGGIDNYLSVKQVTEYASDEPWGWYKSPSKL

SEQ ID NO: 90465 - protein, 672 aa, Geobacter metallireducens GS-15
MAQVVFSSWGGTVVDNRAGSEAKDASFRLPTTLDGDRALAAFMGWDGIIVFDKGVDVPAMAAEYMKRVQTLYCCGKCTPGKKGTRVLMDALAAIVEGRGTEAQLDTIADLGDLLANCKCTLCQSSTVPVIDAVKHFRDDFLAYVNGAKKPTASHRYIEKYTAPCMDRCPAHIDIPAYIEAIKEYRFDESLHVIRDNMPLPSVCGRVCPHPCETHCRRKNVDDSINIMVLKRSASDYEWMHNVAPPMKPKPRKNKTVAIVGAGPAGLACAYYLALEGYPCTIYEALPEGYGGGMIAVGIPPYRQPRHLLQRDIDIIASMGVEIIYNTRIGVDISLEELKSKYNAVFLAPGAHRSKPMGVEGEDKGYKGFLRGGIDFLREAYMGRPTGMGKKVVVVGGGNTAIDCVRVALREGAEESILLYRRSRKEMPADVWEVDGADEEGVRFEFQVLPTKIIVDQNEQVTGVECVRMALGEPDASGRRRPEPVPGSEFVVECDTVIPAIGQDPDLSFIPENMGIDITKWNTVVTKYIPLKDAAGKDLKDGMGNPLVRTLITDLDGVFAGGDAEIGPLTVVACIGNAHRAARVIQRWLEEGKVYLTDDEFMEDILTNLPVYDKGEAVPWLDSVERAHQAEVHGRERASKGNYQEVELGFADSQAIREAERCLRCYRVAMAAV

SEQ ID NO: 90466 - protein, 338 aa, Avibacterium paragallinarum
MAILSTGGAGYIGSHTVVELVNAGFNVVVLDNLSNSSPKSLQRVEQITGKAVKFYQGDVLDRAMLQQIFAENAINSVIHFAGLKAVGESVQKPMAYYQNNVVGSLVLVEEMKKAGVWNLVFSSSATVYGDPEIVPITEQCKVGGTTNPYGTSKLMVEQILTDVAKAEPQFSSTILRYFNPVGAHHSGLIGEDPTGIPNNLLPYISQVAIGKLPQLFVFGSDYDTHDGTGVRDYIHVVDLAIGHLKALERHQNDVGLHIYNLGTGVGYSVLDMVSAFEKTNGIQIPYKLGDRRPGDIATCYSDPSLAAEGLGWKAERGLEQMMQDTWNWQKNNPKGYRD

SEQ ID NO: 90467 - protein, 558 aa, Synechococcus sp. CC9311
MLLNYISTRNIRGDAFGGLTAAVVALPMALAFGVASGAGAAAGLWGAVIIGLVAALFGGTSTLISEPTGPMTVVFTAVILNFTSQIPDRGTALALAFMVVMLAGLFQILFGLCRLGRYITMMPYTVISGFMSGIGVILVILQLAPFLGQTSPTGGVIGTLSSLPQLISGAQPLEFLLALITLLILWFTPESWKRFCPPQLLALIVGTVLSLTVFADVGLSRIPEFSAEFPSFQPPTFSGVTPDLLRLMVVNGAVLGMLGCIDALLTSVVADSLTRTEHNSNKELIGQGLGNLVSGLFGGLPGAGATMGTVVNIQAGGRSALSGIVRALILMLVILLAAPLASLIPLAVLAGIALKVGFDIIDWSFLMRAHHLSMKAACITYGVIGLTVLVDLIWAVFIGVFVANVLTIERMTALQSKGVKTISTTDDDVTLPLEEQSLLDQASGRLLLFQLTGPMIFGVAKTINREHNAIEDCEAVLFDLSEVSHLGVTASLALENAIKEAIEVGRSVYLVVLPGATRRRLEKLKLLDLLPENHVSANRHEVLLNAVNQLPTLQKLSS

SEQ ID NO: 90468 - protein, 336 aa, Saccharophagus degradans 2-40
MPMTTYRPAKTSLANLPTALQPLDRVSQILGGPRIWLKRDDLTGSTLSGNKVRKLEYVVAEALSNGADTLITCGGLQSNHCRATALVAAQLGLKAHLILRGQQKGSAADGNLLLDDLAGAQISQYSVADYSKNLTSLFSHWQNHYAQQGRKAWCIPTGASDEIGIWGYIDAFAELEAQLAERDINPDLVVCATGSGGTQAGLSLGAHILGSKAKVVGMAVCDSEAYFERKAKQDITLWQQKYGQAAGISAQQATQVQINTIDKYIGPGYAKAYPELLERIRWLAATEGVVLDPVYTGKAFYGLVQEIKSGRWANMKDIVFVHTGGIFGLFPYRDEF

SEQ ID NO: 90469 - protein, 258 aa, Xylella fastidiosa Temecula1
MAVNLKTKEEIEQMRIAGRLAATVLDVVAPYVKPGVTTAELDQICHNYIVTVQGAIPANLGYRGFPKTICTSVNNVICHGIPSDAKVLKDGDIINIDVTVIKDGWHGDTSRMYYVGNPSVMARRLVETTYEAMWRGIRAVKPGATLGDIGHAIQTYAENERFSVVREYCGHGIGKVYHDNPQVLHYGRPGEGLVLESGMTFTIEPMINEGTRHHKVLPDGWTVVTKDRKLSAQWEHMIAVTEDGVDVLTLSPNDIGST

SEQ ID NO: 90470 - protein, 120 aa, Oryza sativa
  misc_feature (30)..(30): Xaa can be any naturally occurring amino acid
MFAIGLWQTPFGQECAPDFYAPFGISGVPXANSLLKIASPIEYNWVPLWEEDFTFKLTVPEIALLRLEVHEYDMSEKDDFGGQTVLPVSELIPGIRAVALHDRKGIKLNNVKLLMRFEFE

SEQ ID NO: 90471 - protein, 331 aa, Mycoplasma mycoides
MALNLKGKSFLKLLDFSPREIRYLLDLSRDLKRAKYTGNEIQTMQGKNVVLLFQKDSTRTRCAFEVAALDQGAHVTYLGPSGSQFGKKESVADTARVLGRMYDAIEFRGYEQAVVEELAKYSGVPVYNGLTNEFHPTQILADFLTVEEYKGNLKGLKFVFAGDTRNNVATSLMIGCAKMGMHFVGAAPKQLWPSQDLISQAKEIAKETNAIISFTEDMKQACSDADVIYTDVWVSMGEPAEVWESRINLLKPYQVNMDAIKTAKPDAIFMHCLPSFHDLNTEIGRQIYEKFNIPEMEVTNEVFESKHSVVFEQAENRLHTIKAVMVATIGK

SEQ ID NO: 90472 - protein, 473 aa, Buchnera aphidicola
MLKQQVGVIGMAVMGRNLALNIESKKYTVSIFNRTQSVTEEVINNNKEKKIFPYFSIKDFVNSLRKPRCILLMVKSGQPTDETIQFILPYLNKGDILIDGGNTFYKDSIRRSNDLMKCGINFIGMGVSGGELGALNGPSIMPGGSREAYDLVSSMLKNISAKFKNEPCVSYIGPNGAGHYVKMIHNGIEYGDMQLISESYFILKNVLNMKNEELSNTFSQWNKGELNSYLIEITKNIFLKKEKDGIHYLIDSILDHAEDKGTGKWISQDALELHEPLSLITESVFARYLSSLKDQRLIASKILKGPILKCISSQNKELFVEEVTKSLYLGKIISYAQGFSQLKKASEIYSWNLQYGKIAKIFRAGCIIRADFLERITDAFKSNNVTNLLLTPYFSEISNKYEKSLRYITSYAIKYGIPVPTFASAISYYDNYRTMSSSANLIQAQRDYFGAHTYRRTDKKGYFHTNWLTKKEL

SEQ ID NO: 90473 - protein, 369 aa, Helicobacter pylori J99
MELSYYEILEVEKHSNQETIKKSYRKLALKYHPDRNAGDKEAEEKFKLINEAYGVLGDEKKRALYDRYGKKGLNQAGTSQSDFSDFFEDLGSFFEDAFGFGARGSKRQKSSIAPDYLQMIELSFKEAVFGCKKTIKAQYQSVCESCDGTGAKDKALENCKQCNGQGQVFMRQGFMSFAQTCGACQGKGKIIKTPCQACKGKTYILKDEEIDAIIPEGIDDQNRMVLKNKGNEYEKGKRGDLYLEARVKEDEHFKREGCDLFIKAPVFFTTIALGHTIKVPSLRGDELELKIPRNAKDRQAFAFRNEGVKHPESSYRGSLIVELQVIYPKSLNKEQQGLLEKLHASFGYEGEPHKSVLETCVSKIKDWFK

SEQ ID NO: 90474 - protein, 294 aa, Salmonella typhimurium
IVFRAAQKRSDIEIVAINDLLDAEYMAYMLKYDSTHGRFDGTVEVKDGHLIVNGKKIRVTAERDPANLKWDEVGVDVVADATVIFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLV

SEQ ID NO: 90475 - protein, 219 aa, Shewanella sp. MR-4
MTQDEMKKAAGWAALKYVEKDSIVGVGTGSTVNHFIDALATMKADIEGAVSSSEASTQKMKALGIPVYDLNSVDKLSVYVDGADEINGHMDMIKGGGAALTREKIVAAVAEKFVCIVDNTKQVDILGEFPLPVEVIPMARSYVARELVKLGGDPVYREGVVTDNGNVILDVYNLKIINPKELEEKINAIVGVVTNGLFAKRGADVLLVGTPEGVKTFTA

SEQ ID NO: 90476 - protein, 308 aa, Salmonella sp.
INGFGRIGRIVFRAAQKRSDIEIVAINDLLDAEYMAYMLKYDSTHGRFDGTVEVKDGHLIVNGKKIRVTAERDPANLKWNEVGVDVVAEATGIFLTDETARKHITAGAKKVVLTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDN

SEQ ID NO: 90477 - protein, 292 aa, Helicobacter hepaticus ATCC 51449
MAKNNKTQVILNEFFTLNNGNKIPKLGLGTWRIDDNVVEAAVREAFKVGYRHIDTAQAYGNERGVGEAVRKSKIKREELFITSKIRAEYKDYKSASASIDTSLKTMKLDFIDLMLIHSPQPWNSFRKGDYFKENVEVYNALEDAQKAGKVRSIGVSNFLQKDLENILKNCKTKPAANQILCHIGNTPFTLLDYCKKQNILAEAYSPIAHGELLKDPRVIELAKKYNVSPAQICIRYTLELGLVSLPKSKTPKYIAENAQVDFTFSKADLQTLKKLTFKDYGEHSYFPVFGGK

SEQ ID NO: 90478 - protein, 195 aa, Sinorhizobium meliloti 1021
MPTPIAYSIPNLLTYFRILIVPLIVFCFFIEGRLHSSDFARWTALILFVAASITDFFDGYLARIWKQTSNIGRMLDPIADKLLVASILLLVAADGTIAGWSIWAAIIILCREILVSGLREYLAALKVSVPVTRVAKWKTTIQMVAIAFLLAGPAGDKIVPYVTEAGILLLWIAAAITLYTGYDYFRAGLKHVVNE

SEQ ID NO: 90479 - protein, 120 aa, Brassica napus
ETHFSLLQRTRLIGENSSEGPSGRVGGRVGEQARENHVKKKVEEALRSKMKAKALNECDQYVSKYAECATGRTFSVVWTCRKQAKELNTCLHQFTNDKVLEEMKREYMIQEEGKISASTA

SEQ ID NO: 90480 - protein, 406 aa, Chlamydophila abortus S26/3
MVCRIKEDFPIFSNKKLQGESYIYLDSAATTHKPKKVIDAITDFYSSSYATVNRNVYTSSQVTTANYNAVRGKVRAWIQAAYDEEIVFTRGTTAALNLLAISANDAFIPEGGVVLVSEVEHHANVLSWELACRRRGSCVKKIAVDHLGYIDLEHLEVLLKAGAVFVSIAHVSNVTGCIQPLKEIASLAHQYGAYVAVDGAQGVAHTSVDVVDWDVDFYAFSGHKMYAPTGLGVLYGKKALLEKLPPVEGGGDMVSIYDSEHPEYLPAPLKFEAGTPPIASILGLGAAIDYLQSLPDSVYQEEEELTQYLYNELLTIPGMQILGPEVGHPRGALISFKVEGAHPFDIGCLLDLQGIAVRTGHQCAQPAMTRWDLGHVLRVSLGLYNDKEDVDAFLSALRVILNKVRV

SEQ ID NO: 90481 - protein, 77 aa, Geobacillus kaustophilus HTA426
MADVLERVTKIIVDRLGVDESQVTLEASFKDDLGADSLDIVELVMELEDEFNMEISDEEAEKIVTVGDAVNYIKSRL

SEQ ID NO: 90482 - protein, 331 aa, Mycoplasma mycoides subsp. capri
MALNLKGRSFLKLLDFCPREIRYLLDLSRDLKRAKYTGNEIQTMQGKNVVLLFQKDSTRTRCAFEVAALDQGAHVTYLGPSGSQFGKKESVADTARVLGRMYDAIEFRGYDQAVVEELAKYSGVPVYNGLTNEFHPTQILADFLTVEEYKGNLKGLKFVFAGDTRNNVATSLMIGCAKMGMHFVGAAPKQLWPSQDLIDQSKEIAKETNAIISFTEDMKQACSDADVIYTDVWVSMGEPAEVWESRINLLKPYQVNMDAIKVAKPDVIFMHCLPSFHDLNTEIGRQIYEKFNIPEMEVTNEVFESKHSVVFEQAENRLHTIKAVMVATIGK

SEQ ID NO: 90483 - protein, 308 aa, Salmonella bongori
INGFGRIGRIVFRAAQKRSDIEIVAINDLLDAEYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDTYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAMKAASEGAMKGVLGYTEDDVVSTDFNGEVCTSVFDAKAGIALNDNFVKLVSWYDN

SEQ ID NO: 90484 - protein, 417 aa, Rhodococcus sp. RHA1
MTRFDSIERAVADIAAGKAVVVVDDEDRENEGDLIFAAEKATPELVAFMVRYTSGYLCVPLDGADCDRLGLPPMYATNQDKHGTAYTVTVDAREGIGTGISASDRAATMRLLADPSSGAQDFTRPGHVVPLRAKEGGVLRRPGHTEAAVDLARMADLRPAGVICEIVSQKDEGHMAQTDELRVFADDHNLALISIADLIAWRRKHEKHVERVASARIPTRHGEFTAVGYRSIYDDVEHVALVRGDLPGPDGDGSDVLVRVHSECLTGDVFGSLRCDCGPQLDAALDMVAQEGRGVVLYMRGHEGRGIGLMHKLQAYQLQDAGSDTVDANLELGLPADARDYGIGAQILVDLGISSMRLLTNNPAKRVGLDGYGLQITERVSMPLRANAENLTYLRTKRDRMGHDLIGLDDFEAGEML

SEQ ID NO: 90485 - protein, 270 aa, Aspergillus oryzae
MFPEARDQYVPIIDSILAKSDLNTISEKRIRKGLQEEVGYDLTPQKLIMERFDIFAENGGIEASPEAAVATAPATNGHSSATPVEASSPAQSSKSQKRQADSVERESDKTPPMKRKKPDHDVDADALFAAKLQAEENMRARPTRGASARKVQPAKKKTTKAKTSKKVKAEDDSDVDSSSDSKKVNRSGGFHKPLTLSPALSALLGGEESLSRPQTVKKVWAYIREHELQDPTDRRQIRCDEPMRAVFKQDRIHMFTMTKILSQNLYSPDE

SEQ ID NO: 90486 - protein, 163 aa, Rhodococcus sp. RHA1
MSGEGLPELQLGEAGDLRLAIVAGSWHAEISEALIAGAQRVAAEANVKNVTLVRVAGAIELPVVAQALARTHDAVVALGVVIRGGTPHFEYVCDAVTAGLTRVSLDESTPVGNGVLTTDTEQQAVDRSGLPGSVEDKGGQACAAALDTAVTLARLRRAEESFV

SEQ ID NO: 90487 - protein, 141 aa, Bdellovibrio bacteriovorus HD100
MSIEQTFSIIKPNAMKKNAIGDIVSMFEANGLKIAAAKITVLTTAKAEEFYAEHKARPFFGELVSFMTSGPVMLMCLQGEGAVLKNREIMGATDPKKANPGTVRAKFGDNVGENAVHGSDSPESAARELALFFEKHEICNV

SEQ ID NO: 90488 - protein, 354 aa, Pseudomonas fluorescens PfO-1
MPASPLVWINGLHMTEQRPIAVLGGGSFGTAVANLLAENGHQVRQWMRDPEQAEAIRVNRENPRYLKGIKILPGVTAVTDLQETLDACELCFVALPSSALRTVLAAHAERLSGKMLVSLTKGIEAQTFKLMSQILEEIAPQARIGVLSGPNLAREIAEHALTATVVASEDEELCKAVQAALHGRTFRVYASADRFGVELGGALKNVYAIIAGMAVALEMGENTKSMLITRALAEMTRFAVNQGANPMTFLGLAGVGDLIVTCSSPKSRNYQVGFALGQGLSLDEAVSRLGEVAEGVNTLKVLKAKAQEVGVYMPLVAGLHAILFEGRTLEQVIGLLMRAEPKTDVDFISTSGFN

SEQ ID NO: 90489 - protein, 403 aa, Chlamydophila abortus S26/3
MDRLTVRELSPEEKKVLVRVDFNVPIKDGKILDDIRIRSAMPTIHYLLQKRAAVILMSHLGRPQGKGFEEKYSLQPVVEVLEGYLGHHVPLAPDCVGEVARQAVAQISPGRVLLLENLRFHPGEEHPEEHPAFAAELSSYGDFYVNDAFGTSHRKHASVYTVPQAFPGRSAAGLLMEKELEFLGQHLLISPKRPFTAILGGSKVSSKIGVIEALLSQVDNLLLAGGMGFTFLKALGKSVGNSLVEESGIELARRVLHIAQQRNVRIVLPIDVKVAKACTPAVSWTEVSIDQGIPQDLEGLDIGTKTVQEFCKIIDASSTIFWNGPVGVYEVPPFDQGSMAIANCLARHPSAITVVGGGDAAAVVALAGCTAQVSHVSTGGGASLEFLEKGFLPGTEVLSPSQE

SEQ ID NO: 90490 - protein, 339 aa, Rhodococcus sp. RHA1
MTVRVGVNGFGRIGRNFFRAVDAQKALGTTDIEIVAVNDLTDNATLAHLLKYDSILGRLPHDVSLEGEDTIVVGNQKIKALAIKEGPAALPWGDLGVDVVVESTGIFTDAAKAKGHLEAGAKKVIISAPAKGEDITIVMGVNDDKYDGSQNIISNASCTTNCLGPIAKVLDDEFGIVKGLMTTVHAYTQDQNLQDGPHSDLRRARAAALNVVPTGTGAAKAIGLVLPQLLGKLDGYALRVPIPTGSVTDLTANLKKSASVEDINAAMKAAAEGPLKGILKYTDAPIVSSDIVTDPHSSIFDSGLTKVIDDQAKIVSWYDNEWGYSNRLADLIGLVAKSL

SEQ ID NO: 90491 - protein, 403 aa, Rhodococcus sp. RHA1
MAVQTLDDLLNAGVEGRAVLVRSDLNVPLDGDRITDPGRIIASAPTLKALAEAGAKVIVTAHLGRPKGEPDPQYSLAPVAVKLAEVLGRNVQLAGDVVGQDALARAEGLTDGDVLLLENIRFDPRETSKDEAERTKLAKALVELVGDDGAFVSDGFGVVHRAQASVYEVAKLLPHYAGKLVEAEIKVLGKLTEEPERPYAVVLGGSKVSDKLAVIEALAPKVDTLVIGGGMYYTFLAAQGVSVGNSLCEESMIDTCKALLEQYADVIHIPQDVVIADSFSADAESKIVSVLEIPDGWMGLDIGPQSVRRFAAILTSAKTVFWNGPMGVFEFEKFAAGTKGVAEAIIEATGKGAYSVVGGGDSAAAVRQLGLPEDGFSHISTGGGASLEYLEGKELPGIAVLEG

SEQ ID NO: 90492 - protein, 265 aa, Bacteroides thetaiotaomicron VPI-5482
MIFLKTEDEIELLRQSNLLVGRTLAEVAKVVKPGVTTRELDKVAEEFIRDNGATPTFKGFPNQYGDPFPASICTSVNEQVVHGIPGDIVLKDGDIVSVDCGTYMNGFCGDSAYTFCVGEVDEEIRTLLKVTKEALYIGIQNAVHGKRIGDIGYAIQQYCESHSYGVVREFVGHGIGKEMHEDPQVPNYGKRGYGPLMKRGLCIAIEPMITLGDRQVIMEGDGWTVRTRDRKCAAHFEHTVAVGAGEADILSSFKFIEEVLGDKAI

SEQ ID NO: 90493 - protein, 261 aa, Rhodococcus sp. RHA1
MARKPLIAGNWKMNLNHLEAIALVQKIAFSLPAKYFDKVDVTVIPPFTDIRSVQTLVEGDKLLLTYGAQDVSAHDSGAYTGEISGSMLAKLGCTFVVVGHSERRTLHCEDNDTVLAKTKAALKNGITPIVCIGEGLDVREAGEHVSYNVEQLRGSLAGLSGEDIAKVVIAYEPVWAIGTGRVASAANAQEVCAAIRATLGELASQDVASGVRVLYGGSVNAKNVGEIVGQTDVDGALVGGASLKADEFATLSAIAAGGPLP

SEQ ID NO: 90494 - protein, 475 aa, Vibrio cholerae O1 biovar eltor str. N16961
MSKEIKAQVVVLGAGPAGYSAAFRCADLGLDTVIIERYNTLGGVCLNVGCIPSKALLHVAKVIEEAKALTEHGIVFGEPKTDIDKVRLWKEKVINQLTGGLAGMAKMRKVNVVNGYGKFTGPNTIEVDGEEGKTVVTFDNAIVAAGSRPIKLPFIPHEDPRIWDSTDALELKEVPGKLLIMGGGIIGLEMATVYHSLGSKIDVVEMFDQLIPAADKDMVKVYTKRIKDKFNLMLETKVTAVEAKEDGIYVSMEGKSAPAQAERYDAVLVAIGRVPNGKLLDAEKAGLEVDERGFIRVDKQMRTNVPHIFAIGDIVGQPMLAHKGVHEGHVAAEVISGKKHYFDPKVIPSIAYTEPEVAWVGKTEKEAKAEGINYEVATFPWAASGRAIASDCADGMTKLIFDKETHRVIGGAIVGTNGGELLGEIGLAIEMGCDAEDIALTIHAHPTLHESVGLAAEVFEGTITDLPNAKAKKKK

SEQ ID NO: 90495 - protein, 473 aa, Triticum aestivum
MDVPLASKTFPSPSPSKREQCNIDGHKSSSKHADLNPHVDDSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPDWFQGTADAVRQYLWLFEEHNVMEYLILAGDHLYRMDYEKFIQAHRETDADITVAALPMDEERATAFGLMKIDEEGRIIEFAEKPKGEQLKAMMVDTTILGLDDARAKEMPYIASMGIYVISKHVMLQLLREQFPGANDFGSEVIPGATSTGMRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAEKGGIPIGIGKNSHIKRAIIDKNARIGDNVMIINVDNVQEAARETDGYFIKSGIVTVIKDALLPSGTVI

SEQ ID NO: 90496 - protein, 387 aa, Photorhabdus luminescens
MSVIKMTDLDLAGKRVLIRADLNVPVKDGKVTSDARIRASLPTIEAALKQGAKVMITSHLGRPIEGEYNEEFSLKPVVDYLKEKLSSSVRLEKEYLEGVEVSEGELVVLENVRFNKGEKKDDESLAKKYASLCDIYVMDAFGTAHRAQASTHGVAKFAPVACAGPLLFGELEALGKALDNPARPMVAIVGGSKVSTKLTVLDTLSKIADQLIVGGGIANTFVAAEGHNVGRSLYEDDLIPEAKKLLISCDIPVPTDVRVATEFSETAEATLKSSSDIKDDEQILDLGDESAQRLADILKNAKTILWNGPVGVFEFPNFRQGTEIVARAIADSDAFSIAGGGDTLAAIDLFGIADKISYISTGGGAFLEFVEGKKLPAVVMLEERAKQ

SEQ ID NO: 90497 - protein, 319 aa, Staphylococcus aureus subsp. aureus MRSA252
MRRLFSIGEALIDFIPNITNANLKDVQTFTKQIGGAPCNVACTVQKLGQQAHMITQLGNDAFGDSIIETISSIGVDVSKVYRTNEANTALAFVSLTEAGERDFSFYRKPSADMLFEPSFVNDIDVNENDVVHFCSVDLVDSPMRDAHYQLITKTLNANGTVVFDPNVRLPLWDNAEDLRQTIHTFLPLAHIVKVSDEELEFITGIHDENEAIQSLFTGNVTVVIYTKGADGAAVYLKNGINHYHSGYKVKSVDTTGAGDAFIGAVISRILATDVLNLTQLFENEGEEILAFSNRVAAIVTTKYGAINSLPTLQEVEQAF

SEQ ID NO: 90498 - protein, 438 aa, Geobacter metallireducens GS-15
MKFTDLNLPELVQRGIADTGFTDCTPIQEKTLPLALSGKDVAGQAQTGTGKTAAFLISLFTRLLKNPTEGETRNPRALILAPTRELVVQIEKDAQALGAHCGFVIQAIYGGVDYMKQRSALKEGADVVVGTPGRLIDYLKQKVYSLKEIEVLVIDEADRMFDMGFIADLRFILRRLPPFDKRQNLMFSATLNQRVMELAYEFMNVPEKVAVTPEQMTAERVEQVLYHVGRKEKFPLLLGLLRKKGMERTMIFVNTKREAEFLDERLNANDFPCRVISGDVEQRKRMRILEDFKNGKLPIMIATDVASRGLHIDGVSHVINYDLPQDAEDYVHRIGRTARAGAEGKAISMADEDGAFHLEAIHEYIKDKIPVEWAEDDLFVHDFKRVKPKPKGHETRAKGPTRHGRKHPEGEKKEGEGEAKKRRRGPRKKPAGEKPKPE

SEQ ID NO: 90499 - protein, 513 aa, Bacillus subtilis subsp. subtilis str. 168
MTKLVNEMILVLDFGSQYNQLITRRIREFGVYSELHPHTLTAEEIKKMNPKGIILSGGPNSVYDENSFRCDEKIFELDIPVLGICYGMQLMTHYLGGKVEAASQREYGKANIRIEGTPDLFRDLPNEQVVWMSHGDLVVEVPEGFTVDAATSHHCPNSAMSKADKKWYGVQFHPEVRHSEYGNDLLKNFVFGVCECEGEWSMENFIEIEMQKIRETVGDKQVLCALSGGVDSSVVAVLIHKAIGDQLTCIFVDHGLLRKGEAEGVMKTFSEGFNMNVIKVDAKDRFLNKLKGVSDPEQKRKIIGNEFIYVFDDEADKLKGIDYLAQGTLYTDIIESGTATAQTIKSHHNVGGLPEDMQFELIEPLNTLFKDEVRALGTELGIPDEIVWRQPFPGPGLGIRVLGEVTEEKLEIVRESDAILREEIANHGLERDIWQYFTVLPDIRSVGVMGDARTYDYTIESRRTSIDGMTSDWARIPWDVLEVISTRIVNEVKHINRVVYDITSKPPATIEWE

SEQ ID NO: 90500 - protein, 246 aa, Oryza sativa Japonica Group
MDSEHWISSLAAAKRFYAAQLGHVDDMAGIGMEEVEMEMEDDGEGMELELEMQLEEATWPDVACPYCYEDHDIASLCAHLEEDHPYEPHTSPCPICFEKITRDMLNHITMQHGYLFKSGRRMRRFDIPESQALSLLSRDLRDAQLQALLGGGHRQRRSNTTATNISADPLLSSFGLGFSTLDSEERSKAPVPIPDDTSIHKDTPAQPWESRIDSSLTSEEREQKRKQATDRATFVQGLVLSTLFED

SEQ ID NO: 90501 - protein, 566 aa, Thermoplasma volcanium GSS1
MRSCFMDSRVSDRKLRRELTTWDLLMLSLGGIIGSGWLFAAFGAATTAGPGSIFAWIIGGVIIIFIALVYAELGAMIPRSGAIVRYGHLSHGSFAGFVLGWAYFLSAVSVPAIEAEGVITYAASYSSKYGIVLLTNTGVMSVLGTFLAMLLMLGFFFLNYAGIKIMGKTNTGLTWWKFVIPTLTVILLLVVSFRPSNIIVGGIVPYGWAPVFSAVATSGIVFSYLGFRQGIDYGGEAKTPQRSIPLATVFSVLIGILLYTALQIVFIGGIDWGKLGLVPGSWAQIYSLATSNSNPEAVALYDAPFAHIAQAAGLVFLTYILFADAYISPSGTLNVYLGTSTRTLYGMAANGHMPKKLLEIMDKNRIPFIPLLATLLIGYIFFLPFPSWYKMVGFITSATAFTYIVGGAALMSLRRTAPELKRPFKLPYARVLSPIAFIGAGEVVYWSGWPLVLYLAIAIFLGFAVYFVLLLLGAIENSFTKENIKAGLWVPIFIIVLTVLSYIGDTSLGGIGVIKFPFDLVTVAVISFIFYMWSVRSGIRTEDITEMIESGSQYVFEESAREAVGK

SEQ ID NO: 90502 - protein, 407 aa, Triticum aestivum
  misc_feature (255)..(255): Xaa can be any naturally occurring amino acid
  misc_feature (270)..(270): Xaa can be any naturally occurring amino acid
MASSTQGQVITCKAAVAYEANKPLVVEDVQVAPPQAGEVRIKILSTALCHTDYYTWSGKDPEGLFPCILGHEAAGIVESVGEGVTDVQPGDHVIPCYQAECKDCKMCNSGKTNLCGKVRGATGVGVMMSDRKSRFSVNGKPIYHFMGTSTFSQYTVVHDVSVAKINPQAPLDKVCLLGCGVSTGLGAVWNTAKVEAGSIVAVFGLGTVGLAVAEGAKSAGASRIIGIDIDAKKFDVAKNFGVTEFVNPKDHGQPXISRVLVDLTDGGVDXSFECIGNVSIMRAALECCHKGWGTSVVVGVAASGQEIATRPFQLVTGRVWKGTAFGGSKSRSQVPWLVEKSMTGDLKVDEYITHNMNLTDINKAFDLLHEGGCLRCVLAMEQFVSCEVVMQIYPPPWDYRTRWPRNS

SEQ ID NO: 90503 - protein, 200 aa, Coxiella burnetii RSA 493
MAVLVGREAPDFTVPAVLANGDIVENFNLAEAIQNKYGLVFFYPLDFTFVCPSELIALDKAIADFQKRRVEVIGVSIDSQFTHNAWRNTPVEKGGIGPVRYPLASDVTHSICRSYGVEHVAGVALRGAFLIDKQGIVRSQIVNDLPLGRSIPELLRLVDALQFTEEHGEVCPANWKKGDPAMQASPDGVAKYLAENADNL

SEQ ID NO: 90504 - protein, 470 aa, Pseudomonas putida GB-1
MDATSTTTTAKSGHESKLSASLKSRHLTMMSIAGVIGGALFVGSGSVIHSAGPAAVLAYLAGGILVVLIMRMLGEMATSSPDTGSFSTYADRAIGRWAGFTIGWLYWWYWVILMAWEAYVAGKILHGFFPDVSVNVFVLATTLLLITVNFFNVKHYGEFEFWFALIKVIAIVCFLIVCTAAVMNVWQFGEVRGISHLTAEGFMPNGITTVIGALLGVMFAFLGAEIVTIAASEAKDPAAQIVKATNSVVWRVCLFYVGSIFLIVCLVPWNDPHLGVSGYGAYRRTLELLGVPYAELLMNFVVLTSVSSCLISGHYTASRMLFSLAQRGDAPSFFKITRAGTGVPVYAIMGSCAVAVVCALINFSETLRPKDVLDTLMNTTGMIALLVYLVIAFSQLRMRRKLIAEGKEVRLKMWLFPWLTYLVIAFIVAALVTMAFMPDYQILVISTGIAAAIVVAMGVVHQIRSGSKQH

SEQ ID NO: 90505 - protein, 308 aa, Salmonella sp.
INGFGRIGRIVFRAAQKRSDIEIVAINDLLDAEYMAYMLKYDSTHGRFDGTVEVKDGHLIVNGKKIRVTAERDPANLKWNEVGVDVVAEATGIFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDN

SEQ ID NO: 90506 - protein, 379 aa, Cercospora zeae-maydis
MATEQIPDKGLAGVCVNEGPDFKVEVQEVDIPEPSKQNCWTISVNSSLTERWPESGELLIRLNCTGLCMSDIHFMVNDWAVPPMSQFGTKCAGHEGAGVVVKLGPNVSGWEVGDRAGIKPLWDVCHNCEHCWNGRENYCQHGVYTGLVAEGTYRQYLTSPAIYTSRIPEGVPDEVAGPIMCSASTMHRALVDSGLKAGDFVVFPGGGGGVGIQGVQLAKAMGMRPIVIDSGEAKSKLSKELGAEEFIDFKEHEDVAARVKEVAGGIGAHGVLVTAYQAYKDSFSYLGNRIGGRIMCIALPPAGTVNMGTDPNFIVFKNVRVIGTLVGTMQDTAAALEYARRGLLKGIAKVQGVSRFDKSVQALQRGKVAGRIVIDFNKK

SEQ ID NO: 90507 - protein, 402 aa, Helicobacter pylori J99
MLAKMSFMQNVKNIQEVDVNHKRVLIRVDFNVPLDENLNITDDTRIRESLPTIQFCIDNKAKDIILVSHLGRPKGVEEKLSLKPFLKRLERLLNHEVVFSQNIAQLKQALNENAPTRIFLLENIRFLKGEEENDENLAKDLASLCDVFVNDAFGTSHRKHASTYGTAKFAPIKVSGFLLKKEIDSFYQAFNHPLRPLLLIVGGAKVSSKLTLLKNILDLIDKLIIAGAMSNTFLKALGYDVQDSSVEDALINDALELLQSAKEKKVKVYLPIDAVTTDDILNPKHIKISPVQDIEPKHKIADIGPASLKLFSEVIESAPTILWNGPLGVHEKQEFARGTTFLAHKIANTYAFSLIGGGDTIDAINRAGEKDNMSFISTGGGASLELLEGKILPCFEVLDKRH

SEQ ID NO: 90508 - protein, 308 aa, Salmonella typhimurium
INGFGRIGRIVFRAAQKRSDIEIVAINDLLDAEYMAYMLKYDSTHGRFDGTVEVKDGHLIVNGKKIRVTAERDPANLKWDEVGVDVVAEATGIFLTDETARKHITTGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDN

SEQ ID NO: 90509 - protein, 308 aa, Salmonella typhimurium
INGFGRIGRIVFRAAQKRSDIEIVAINDLLDAEYMAYMLKYDSTHGRFDGTVEVKDGHLIVNGKKIRVTAERDPANLKWDEVGVDVVAEATGIFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDN

SEQ ID NO: 90510 - protein, 635 aa, Vibrio cholerae O1 biovar eltor str. N16961
MKVGKVMAIEIYVPDIGADEVEVTEILVKVGDKVAEEQSLITVEGDKASMEVPASQAGIVKEIKVVAGDKVSTGSLIMVFEAEGAAAAAPAPAPQAAAPVAAAPAAAALKEVQVPDIGGDEVEVTEIMVKVGDVVAEEQSLITVEGDKASMEVPAPFAGTVKEIKIAAGDKVSTGSLIMVFEVAGAAPLAAPVQAAAPAAAAAPAVAALKEVQVPDIGGDEVTVTEIMVNVGDSISEEQSLITVEGDKASMEVPAPFAGTLKEIKVATGDKVKTGSLIMVFEVAGAAPVAAPVQAAAAPAAAPAQAATPAAAAPATSGEFQENHEYSHASPVVRRLAREFGVNLAKVKGSGRKNRILKEDVQNYVKEALKRLESGAQAAASGKGDGAALGLLPWPKVDFSKFGDTEVQPLSRIKKISGANLHRNWVMIPHVTQWDNADITELEKFRQEQNAMEAKRDTGMKITPLVFIMKAAAKALEAFPAFNSSLSDDGESLILKKYVNIGIAVDTPNGLVVPVFKDVNKKGIYELSKELAEVSKKARGGKLTAADMQGGCFTISSLGGIGGTAFTPIVNAPEVAILGVSKSEMKPVWNGKEFAPRLQLPLSLSYDHRVIDGAEGARFITYLNECLSDIRRLVL

SEQ ID NO: 90511 - protein, 514 aa, Rhodococcus sp. RHA1
MSEPAASDDWVNPLRDGRDKRLPRIAGPCALVIFGVTGDLARRKLMPAIYDLANRGLLPPGFALVGFARRDWSDEDFGKIVHDAVRDHSRTPFREDVWERLSEGLRFVKGSFDDPAAFQELAHTLGTLERERGTGGNHGFYLAIPPDAFPVVLKQLSEAGLAQSNDDQWRRVVIEKPFGHDLASARELNAVVNEVFPEDTVFRIDHYLGKETVQNILALRFANQLFDPIWNAHYVDHVQITMAEDIGLGGRAGYYDGIGAARDVIQNHLLQLLAFTAMEEPISFEPSELQAEKIKVLSATRLAQPLDETTARGQYAGGWQGGTRVVGLLEEEGFSKDSTTETFAAITLEVDTRRWAGVPFYLRTGKRLGRRVTEIAVIFKRAPHLPFDQTMTEELGQNALVIRVQPDEGVTMRFGSKVPGSSMEVRDVNMDFSYGQAFTESSPEAYERLILDVLLGEPSLFPVNAEVELSWEILDPVLEHWAADGRPEPYEAGTWGPPSADEMMHRTGREWRRP

SEQ ID NO: 90512 - protein, 459 aa, Rickettsia sibirica 246
MQEFDLVVIGSGPAGYTGSIRAAQLGMKVACIEKSDTLGGTCLNIGCIPSKVLLNSSEKYEAALKHFENIGIIADVKLDLQKMLANKDKVVLDLTQGIESLFAKNKVTRIKGEAKISSSNIVEVNKEQIKAKNILITTGSSVIEIPNIKIDEEFIVSSTGALKLSKVPENLIVVGGGYIGLELGSVWRRLGAKVTVIEYAPSIVPMLDKEIATQFMKLQQKQGIEFKLNTKVLSAEVKSGKVNLTIEEDGKSSVVTSNVVLMAVGRKAYTQNLGLESVGIITDKQGSIEINDRFQTAISNIYAVGDVVKGAMLAHKAEEEAVAAVEIMAGQAGHVNYNLIPSVIYTYPEVASVGETEEQLKEKGINYKVGKFPFLANSRARAIGSTEGMVKILADSKTDRVLGAHIIGADAGTLIAALTAYMEFGAASEDIARTCHAHPTLSEAIKEAALSVDKRTINM

SEQ ID NO: 90513 - protein, 245 aa, Triticum aestivum
AYLGDTPEQVCTKKQAGTGPEFPGYRRPTRPGGQPFHRAHGMTAYEYNSTDPRANCLFNEAMLNHSTIITKKLLEFYRGFDNVETLVDVAGGVGATAHAITSKYPHIKGVNFDLPHVISEAPPYPGVQHIAGDMFKKVPSGDAILLKWILHNWTDDYCMTLLRNCYDALPMNGKVVIVEGILPVKPDAMPSTQTMFQVDMMMLLHTAGGKERELSEFEELAKGAGFSTVKTSYIYSTAWVIEFVK

SEQ ID NO: 90514 - protein, 321 aa, Rhodococcus sp. RHA1
MRAIQVSRLGGPDVLEPAEVPEPRIGATDLLVRTDAIGINFIDTYFRTGLYPRPLPYVPGDEGSGVVEAVGGDVTGIAPGDRVAWCSGPGSYAEKVVVPAAVAIAVPDSVPAPQAASALLQGMTAHYLAHSTYPIRSGDTVLVHAGAGGVGLLLTQMATTLGARVITTVSSDAKEQLSRDAGAYEVLRYDDDIAARVRELTDGDGVAAAYDGVGASTFEASLASVRIRGTVALFGAASGPVPPFDPQRLNPAGSLFLTRPTLAHYIRNREELTWRAGDVFSALADGSLTVRVGAEYPLARAEEAHRDLEARATTGSIVLVP

SEQ ID NO: 90515 - protein, 156 aa, Bdellovibrio bacteriovorus HD100
MKFILYNLATAKEPWADEVSELYKKKISFFIPFDIQSLKAKKSAREDADFKRNEESELILKNINSDDYVVLFDERGSVLDSIQFSKKVENILGSSKKRAIFIIGGAFGVNEEVRKRADLKVALSPMVMNHLMAQAMSLEQIYRAFTIIKKIPYHNI

SEQ ID NO: 90516 - protein, 159 aa, Buchnera aphidicola str. Bp (Baizongia pistaciae)
MKHRILSILLENESGALSRVVGLFSQRGYNIESITVAPTEDLSISKITIQTFGDKKVIEQIGKQLHKLIDVLKVTEIEDEEHFKREIMLIKINNTYDQYRKVQDITNAFRGYIISATSNISIIQLSGTNKNLDTYIEIMKKLTNIIEISRSGIISIYKN

SEQ ID NO: 90517 - protein, 347 aa, Thermoanaerobacter tengcongensis
MDGLMTAVVKQYHKEGADIVKKEIPKIGPDEVLIKVKATSICGTDVHIYVWNEWAKSRIKPPKTMGHEFVGEVVEIGENVTSVKVGDLVSAETHIVCGKCRACRTGNAHICENTLILGVDTDGAFAEYIKVPESNVWINDKNIPLEILSIQEPLGNAVHTVFSGDVVGKSVAVIGCGPIGMMAIPLLKRTGAAAIFAIEPADYRRELAHKLGATRVINPLREDVVSIIKSETEGYGADVVLDFSGNPTAIRQGLEYIAKGGRMSILGLPDNEVPIDITNNVVFKGITIQGITGRRMYDTWYTVKGLLKSGLAEDLKPIITHTFPLTEYQKGMELMIKGQCGKVVLYP

SEQ ID NO: 90518 - protein, 642 aa, Staphylococcus aureus subsp. aureus MRSA252
MILLQLNHISKSFDGEDIFNDVDFEVKTGERIGIVGRNGAGKSTLMKIIAGVENYDSGNLSKIKNLKLGYLTQQMTLNSNATVFEEMSKPFEHIKRMESLIKEETDWLSKHANDYDSDTYKTHMSRYESLSNQFEQLEGYQYESKIKTVLHGLNFSEEDFNKPINDFSGGQKTRLSLAQMLLNEPDLLLLDEPTNHLDLETTKWLEDYLRYFKGAIVIISHDRYFLDKIVTQIYDVALGDVKRYVGNYEEFIQQRDLYYQKRMQEYESQQAEIKRLETFVEKNITRASTSGMAKSRRKILEKMERIDKPMLDAKSANIQFGFDRNTGNDVMHVKNLEIGYQTAITKPISIEVSKGDHIAIIGPNGIGKSTLIKTIANQQKALNGDITFGANLQIGYYDQKQAEFKSSKTILDYVWDQYPLMNEKDIRAVLGRFLFVQDDVKKIINDLSGGEKARLQLALLMLQRDNVLILDEPTNHLDIDSKEMLEHALQHFEGTILFVSHDRYFINQLANKVFDLTIDGGKMYLGDYQYYIEKVEEAEALKAHQEEQSVNVQAHEKSMEQSSYHNQKEQRREQRKLERQISECENEIETLETTILQIDEQLTQPEVYNNPQKANELAIQKQDSEQKLEHAMSKWEELQQKL

SEQ ID NO: 90519 - protein, 452 aa, Geobacter metallireducens GS-15
MTFAELNLLPPILKAVAACGYTDPTPIQAQAIPRALEGRDLLATAQTGTGKTAAFVLPALQRLARPAQKPGRGPRVLVLTPTRELAQQVTDAVRSYGKFLRIRSGAILGGMPYREQLRLLSAPVDLIVATPGRLVDLLDRRSLDLSRLELLILDEADRMLDMGFSDDVDRVAAASPSDRQTLLFTATMDATMARLAGRLLNEPERIEVAGTKTTHEHIEQRLHVADDLSHKNRLLQHLITDGDVRKAIIFSATKRDAENMAIELRSQGHSAAALHGDMPQSARNRTIAAMKQGRIRLLVATDVAARGLDVSGISHVINFDLPKFAEDYVHRIGRTGRAGASGIAISFASLNEVSYLARIERYIGQTLPEHQIPGLEPRRPLHRVSTGRGSRPGNSTGGPRKSYGNRDAAKTGGRPGNAKRSPWGKHTTSNGPVVEYRSSKGREGSGQPRRQS

SEQ ID NO: 90520 - protein, 190 aa, Triticum aestivum
MAPTVMASSATSVAPFQGLKSTAGLPVSRRSSSAGLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEEVWQGLNYELKQWPMYEGLL

SEQ ID NO: 90521 - protein, 375 aa, Desulfovibrio vulgaris subsp. vulgaris str. Hildenborough
MRALLALEDGFVLEGRSFTGPGETGGEAIFNTGMTGYQEVLTDPSYAGQMVCMTYPLVGNYGVTREDMESGKVHVEAFIVKECCKVPSNWRSEISLPDYLKRHGVMGIEGIDTRALTRHLRIHGAMRGVISTQETDPARLVERARALPSMEGQNLVTRVAPAAPYRWDGERPQAVTLEPGGCAWVGKGPRLVVYDFGIKWNILRLLAQQGFDMLVVPPSFKAADVAAVGAQAVFLSNGPGDPATLKDEIAEIAKLAQTYPTAGICLGHQLLGHALGGRTMKLKFGHHGCNHPVKDLTTGRIEISSQNHGFCVDIDSLTDVEITHVNLNDGTLEGFAHKTKPVIAVQHHPEASPGPNDSRYFFARFRNMVREAAGC

SEQ ID NO: 90522 - protein, 330 aa, Helicobacter pylori J99
MPIKIAINGTGRIGLCAIRVASQRKDVEIVAINSTAELETLLHLIRHDSVHGHFEAKLNANRTLNIGHSKNILVLSERDINKLDFSVANAEIIIECTGKFNSLEASSAHLKNSVKKVIISAPAQNAPTFVYGVNHTNYHNESVISNASCTTNATAPLLKILDEAFKVENALLTTIHSYTNDQNLLDTKHKDIRRARAASLNLIPTSTGVSKAISLVLPHLGPKITGLAIRVPTPNVSLVDLSLNFKKVVSKASVQHALKDASKHAFKGIVSVDEERLVSSDFISSPFSAIVIDDQIMTIGEKNAKVLAWYDNEMGYSERLIDMAQYIAQN

SEQ ID NO: 90523 - protein, 441 aa, Burkholderia pseudomallei
MGLNDSLLDMQLLTIGINHHTAPVALRERVAFPLEQIKPALSTFKSVFLGHPAPNAPEAAILSTCNRTELYCATNDRAARDAAIRWMSDYHRIPADELAPHVYALPQSEAVRHAFRVASGLDSMVLGETQILGQMKNAVRTASEAGSLGTYLNQLFQRTFAVAKEVRGTTEIGAQSVSMAAAAVRLAQRIFEQVAQQRVLFIGAGEMIELCATHFAAQGPRELVVANRTAERGAKLAERFGGRAMPLADLPARMHEFDIIVSCTASTLPIIGLGAVERAVKARRHRPIFMVDLAVPRDIEPEVGKLKDVFLYTVDDLGAIVREGNASRQAAVAQAEAIIETRVQNFMQWLDARSIVPVIRHMHTQADALRRAEVERARKMLARGDDPDAVLDALSQALTNKLIHGPTSALNRANGADRDSLIDLMRGFYQHAPRSSDTSDR

SEQ ID NO: 90524 - protein, 790 aa, Marinobacter sp. ELB17
MHDYIIWFEHLGMSDVDRVGGKNASLGEMISNLANAGVTVPGGFATTSHAYREFLATNGLKDKIDETLDALDVNDVNELARVGAKIRQWVIDTPFPAVLDNALAEAYAQLQNGNPKMAVAVRSSATAEDLPDASFAGQQETFLNVVGLDKIRTSVKEVFASLFNDRAISYRVHHGFDHKLVALSAGIQKMVRSETASSGVMFTLDTESGFRGVVFITGSYGLGETVVQGAVNPDEFYVHKSTLTAGRPAVLRRNLGSKAIKMIYHTNPTEGEFVETVKVDAAERGRFCITDAEVEELAKQAMIIENHYQRPMDIEWAKDGDDGRIYIVQARPETVKSRASANVMERYLLKETGKVLVEGRSIGHKIGAGPVKIITSINEMDKVQDGDVLVTDMTDPDWEPVMKRASAIVTDRGGRTCHAAIIARELGIPAVVGCGDATDLLSNGQKVTVSCAEGDTGFIYEGALDFELRENTIESMPNIPFKIMMNVGNPDRAFDFQALPNEGVGLARLEFIINRMIGVHPKALLNYDTLPRDIQLTVDKRISGYASPVDFYVDKLVEGISTLAGAFAPKKVIVRMSDFKSNEYANLIGGALYEPDEENPMLGFRGASRYISETFRDCFELECRAMKRVRNEMGFTNVEVMIPFVRTVGEAAQVMDLLAENGLKRGENGLRVIMMCELPSNALLADQFLEHFDGFSIGSNDLTQLTLGLDRDSGIIAHLFDERNDAVKVLLSSAIQACRKAGKYIGICGQGPSDHPDLAKWLMEQGIDSVSLNPDSVLDTWFFLADQKPD

SEQ ID NO: 90525 - protein, 432 aa, Streptococcus pyogenes M49 591
VRDVLRTAFDELFKTENRINEIYASMADDKADIAVLMEEVGELQDRLESRDFYTLDAKIDEVARALGVMDFGMESDVTSLSGGQRTKVLLAKLLLEKPDILLLDEPTNHLDAEHIEWLKRYLQHYENAFVLISHDISFLNDVINIVYHVENQSLVRYTGDYYQFQAVYEMKQSQLEAAYERQQKEIANLQDFVNRNKARVATRNMAMSRQKKLDKMDIIELQAEKPKPNFEFKQARTPSRFIFQTKNLVIGYDYPLTKEPLNITFERNQKIAIVGANGIGKSTLLKSLLGVIEPLEGHIVTGDFLEVGYFEQEVTGVNRQTPLEVVWDAFPALNQAEVRAALARCGLTSKHIESQIQVLSGGEQAKVRFCLLMNRENNVLILDEPTNHLDIDAKNELKRALKAYKGSILMVCHEPDFYNGWVTDTWDFSKLT

SEQ ID NO: 90526 - protein, 386 aa, Geobacillus kaustophilus HTA426
MNIHEYQAKEILRSYGVSVPNGRVAFTVDEAVEAAKELGAPVCVVKAQIHAGGRGKAGGVKVAKSLEEVRTYASELLGKVLVTHQTGPEGKEVKRLLIEEGCDIQKEYYIGLVVDRATSRVVLMGSEEGGTEIEEVAAKTPEKIFKEYIDPAVGLQAFQARRLAFNINIPKHLVNQAVKFMMGLYQVFVDKDCSIAEINPLVVTGDGKVMALDAKLNFDSNALYRHPDILEYRDLDEEDPKEVEASKYDLNYIALDGNIGCMVNGAGLAMATMDIIKYYGGEPANFLDVGGGASEEKVREAFKIILSDPNVKGIFVNIFGGIMKCDVIASGIVAATKQVGLTLPLVVRLEGTNVELGKKILQESGLNIIAAESMADGAQKIVELVR

SEQ ID NO: 90527 - protein, 313 aa, Pseudomonas fluorescens PfO-1
MIGAPAVRIAKNAMTLQYPTIADCVGNTPLVRLQRLPGVTSNTLLLKLEGNNPAGSVKDRPALSMITRAELRGQIHEGDTLIEATSGNTGIALAMAAAIKGYKMILIMPDNSSAERKAAMTAYGAELILVSQEEGMEGARDLAQRMEAEGRGKVLDQFANGDNPEAHYTTTGPEIWRQTQGSITHFVSSMGTTGTIMGVSRYLKEQNDNVQIVGLQPMEGSAIPGIRRWPQEYLPKIYQADRVDRIVDMAQSEAENVTRRLAREEGIFCGVSSGGAVAAMLRLSKEVENAVIVAIICDRGDRYLSTGIFDAPN

SEQ ID NO: 90528 - protein, 142 aa, Brassica napus
  misc_feature (80)..(80): Xaa can be any naturally occurring amino acid
  misc_feature (96)..(96): Xaa can be any naturally occurring amino acid
MAYSMLSSAAVVTSPAQATMVAPFTGLKSSSAFPVTRKANNDITSIVSNGGRVNCMQVWPPIGKKKFETLSYLPDPYRKXMGVREVDYLLRNKWIXLCVEIRVGATGFCVPWSMEAHLDTTMAVIGQCGSFLCSDALTLLKC

SEQ ID NO: 90529 - protein, 102 aa, Chlamydophila abortus S26/3
MVKVVSAENFNSFIASGLVLIDFFAEWCGPCKMLAPVLESLATEVPSVLIGKVNIDDSPAPAEQYGVSSIPTLILFKDGKEVDRTVGLKDKDALIKLINQHA

SEQ ID NO: 90530 - protein, 327 aa, Cryptococcus neoformans var. neoformans JEC21
MADDPSGWSLTESDPQVFTQLLKDLGVNGLQVDDLYSLDAETLATLKPIHALIFLFKYVAPDAESAQESAGVEVDPLDNGVWFANQVINNSCGTLAALNAVMNIKPQQSVHERESIKLGSELENLREFGAGMQSLDLGHVLSSSDHIREVHNSFSKSSPFAMDPSAFPEREKEDAYHFVAYLPINDILYELDGLRRFPIMHAPVDGDWLDTARETIEQRIATYPPGSLMFNLLCVRSDAIPRLERLLNDPSTPAEQKFVIQDQLEHERNKSQKGAMENSLRRHNLLPVVFQLFKSLGESGMAAKAVEDARTKGKERRERMQAKGEAE

SEQ ID NO: 90531 - protein, 386 aa, Zea mays
MSDTAGKTITCKAAVAWEAGKDLVVEDIEVLPPRAHEVRIQVYYTGVCHTDAYMLSGKDPEGAFPVIAGHEGAGIVESVGEGVTNVKVGDTVVALYTPECKECKFCKSGKTNLCGKIRATQGKGVMPDGTSRFKCKGKDLLHFMGCSTFSQYTVLADISVVAVTPDAPMDRTCLLGCGITTGYGAAVITAGRGGVEKGSNVAIFGAGCVGLSVIQGAVKQGASKIIVVDVNDAKKEWAKKFGATDFVNPAKDLKEGENIQSRLIDMTDGGCDYTFDCTGNVHVMRSALEACHKGWGESIIIGVAAAGQEISTRPFQLVTGRVWKGCAFGGVKGRSQMGQLVQDYMDNKLKVDEFITHRQPLGGINEAFHDMHAGDCIRCVVDMRKV

SEQ ID NO: 90532 - protein, 809 aa, Arabidopsis thaliana
MGSTPTDLPGEDVADNRSGVGGGISDVYGEDSATLDQLVTPWVTSVASGYTLMRDPRYNKGLAFTDKERDAHYLTGLLPPVILSQDVQERKVMHNLRQYTVPLQRYMALMDLQERNERLFYKLLIDNVEELLPVVYTPTVGEACQKYGSIFRKPQGLYISLNEKGKILEVLKNWPQRGIQVIVVTDGERILGLGDLGCQGMGIPVGKLSLYTALGGIRPSACLPITIDVGTNNEKLLNDEFYIGLKQRRATGQEYAEFLHEFMCAVKQNYGEKVLVQFEDFANHNAFDLLSKYSDSHLVFNDDIQGTASVVLAGLIAAQKVLGKKLADHTFLFLGAGEAGTGIAELIALKISKETGAPITETRKKIWLVDSKGLIVSSRKESLQHFKQPWAHEHKPVKDLIGAVNAIKPTVLIGTSGVGQTFTKEVVEAMATNNEKPLILALSNPTSQAECTAEQAYTWTKGRAIFGSGSPFDPVVYDGKTYLPGQANNCYIFPGLGLGLIMSGAIRVRDDMLLAASEALAAQVTEEHYANGLIYPPFSNIREISANIAACVAAKTYDLGLASNLPRAKDLVKFAESSMLRREEEQNKELYNHWLDQSELQFMALNPQLLPNGMPVPFVNEMFVLVRDGVEFEVDKIPGGHGGHVKAKGVIYLSNIRMVFVSSKPVDNFVAFDMPLLYIHAEKFNQPIFHCNNIAGQVEPVVPENEHRALYSTHSFKILFKEGGCGTFVPLFLNLISSVRQYNRQMQQAAEAAAAAPHVDPLQAAQTPVDEMMRHAYVDPNDPTRIYLQQPSGESQLRRRAYHSGAAEH

SEQ ID NO: 90533 - protein, 224 aa, Pseudomonas putida GB-1
MQPYAIAPSILSADFARLGEDVDKVLAAGADIVHFDVMDNHYVPNLTIGPMVCTALRKYGVTAPIDVHLMVSPVDRIIGDFIEAGATYITFHPEATQHIDRSLQLIKDGGCKAGLVFNPATSLDALKYVMDKIDMVLLMSVNPGFGGQKFIPGTLDKLREARALIDASGRDIRLEIDGGVNVNNIREIAAAGADTFVAGSAIFNAPDYQEVIAKMRAELALARP

SEQ ID NO: 90534 - protein, 266 aa, Buchnera aphidicola str. Bp (Baizongia pistaciae)
MTCIFIKNINEINKMRLVGKLVADVLDMIKEYIVPGITTEELNNICHNYITYKQHAKPACLGYQGFPKSICTSINDIVCHGIPNKNSILKNGDIINIDVAILKDKYYSDASKMFFVGKPTELGKKLCYVAKKSLYLALYTIRPGINLQKLGKVIQNYVKKQNFSIVKEYCGHGIGRSFHEPPQILHHNYYKSNTTILQSGMTFTVEPMINSGSCEVQCTNDGWTVKTKDKSLSAQYEHTILVNEEGCEILTLQKGEQISRILKNLT

SEQ ID NO: 90535 - protein, 207 aa, Picea sitchensis
MAAAYSPLPTSSAPATVPATTTTPTPTAAGAFFSRLLEGTNNALSQRRPWPELVDRNSLAKPSSTAEAVARIRKNWAYFRVNYLLLLSGVLAFSLLSNPLSFFLLVGLLGGWIFLYLLRREPLVLLSRTYSDREVLGILTVLTIVIVFMTSVGSVLISALMIGLAMVCAHGAFRVPEDLFLDEEEPAPGFLSFLGSPALQIPVVANV

SEQ ID NO: 90536 - protein, 419 aa, Rhodococcus sp. RHA1
MTTSVRVFDVTRIREDFPILARTVRDGKPLVYLDSGATSQRPNQVLDAEREFLTTCNAAVHRGAHQLAEEATDAYENARAAIAAFVGADSDELVFTKNATESLNLVTHVLGDDRFERHLGPGDEIVITELEHHANLVPWQELARSTGATLRWYGVTDDGRIDLDSLELTDAVKVVAFTHQSNVTGAVAPVEELVRRARAVGALVVLDACQSVPHMAVDFHALGVDYAAFSGHKMLGPSGVGVLYGRRELLNAMPPFITGGSMIETVTMERTTYAPPPQRFEAGVPMTSQVVGLGAAVRYLEEIGMDAVAAHEHTLVEAALAALGAIDGVHIIGPTTAEDRGGAVSFVVDGIHAHDLGQILDDEGVAIRVGHHCAWPLHRRFGVAATARASFALYNTVDEIDALAAAVRRAQEFFGEVPA

SEQ ID NO: 90537 - protein, 190 aa, Synechococcus sp. CC9311
MNGRVWSAFDASVMRNQTLRSLFAIALLAVMTVLPFPVIALDTSTGVGLQDRALFQERVDYTLTNQSGGDFHGQNLVNTSFAGATGRGADFSDANLQGTIFTQAEFPEANFHGANLSDALMDRADFSKTDLRDALLVGVIAAGSSFAGADIEGADFTDALLDREDQRRLCQDADGVNSSSGVSTRDSLDC

SEQ ID NO: 90538 - protein, 384 aa, Candida albicans SC5314
MDPNLISHYNNTNTRRFKNYQIENQGQSNFIYFLGGRLHTIKTKYPINLITLSLIIIPGILYIIFELSWQWRNFSPIIVIIFLYIWIISIFHFFKLSTCDAGKLPKNIHLPKKLITITTTTTTTTTNDNEIDHRNNYKVMGSPPDEYFNTVTLPYWKTNNDNNDNTKISKLANAYHSHGVQVKYCGTCHIWRPSRTSHCNTCQQCILNHDHHCIFLNNCIGQRNYKFFLWFLLYIVIACLYLLIISILQLCHYKFASHKESEIITTFNQSIKTHPISLLLLIYSCLAICYPGLLLAFHIFLTSQNITTREYLNFVYKKPSKSTDGGDGTRGFVNVYNTHSIWENLYINWLGKSNGVSLTFPRDYYHQGDIRFANIEPLGTFTNK

SEQ ID NO: 90539 - protein, 348 aa, Staphylococcus aureus subsp. aureus MRSA252
MTYNIVALPGDGIGPEILNGSLSLLEIISNKYNFNYQIEHHEFGGASIDTFGEPLTEKTLNACKRADAILLGAIGGPKWTDPNNRPEQGLLKLRKSLNLFANIRPTTVVKGASSLSPLKAERVEGTDLVIVRELTSGIYFGEPRYFNNHEALDSLTYTREEIERIVHVAFKLAASRRGKLTSVDKENVLASSKLWRKVVNEVSQLYPEVTVNHLLVDACSMHLITNPKQFDVIVYENLFGDILSDEASVIPGSLGLSPSASFSNDGPRLYEPIHGSAPDIAGKNVANPFGMILSLAMCLRESLNQPDAADELEQHIYNMIEHGQTTADLGGKLNTTDIFEILSQKLNH

SEQ ID NO: 90540 - protein, 376 aa, Desulfovibrio vulgaris subsp. vulgaris str. Hildenborough
MRTQEGPLGHPLRNIKALLLMGDGPSGVPDSVYSALALPTVGPLDPGFDEILDRLQGQLRNIFNVSDGVCAVLDGPAAVGMETCLVNLLEPGERLLVLDNGMGGERLRETAQRLGLAVDVLTVPWGDPVLSEQVAQRLARSDYHAVVMVHAESSTGVRSPVGAVGDLVSMHGALFIVDCETSLGGMDVDMARWRADALFASSHKCLSCPPGLAPVAFSMRALDRVGRRRTPIPGRYFDIALHLDYWQGAPRVCHLMPSVNLLYALHMALEGVLNEGLPNVFARHRAAHEQLVTGLAALGLRPLADVPWRLPMLHVVPAPEGVDAEDVRGRLRAEHGIEIGGGVGRLAGRVWRIGLMGHSARTTNVVALLEALGRLL

SEQ ID NO: 90541 - protein, 422 aa, Staphylococcus aureus subsp. aureus MRSA252
MTVKTTVSTKDIDEAFLRLKDIVKETPLQLDHYLSQKYDCKVYLKREDLQWVRSFKLRGAYNAISVLSDEAKSKGITCASAGNHAQGVAYTAKKLNLNAVIFMPVTTPLQKVNQVKFFGNSNVEVVLTGDTFDHCLAEALTYTSEHQMNFIDPFNNVHTISGQGTLAKEMLEQAKSDNVNFDYLFAAIGGGGLISGISTYFKSYSPNTKIIGVEPSGASSMYESVVVNNQVITLPNIDKFVDGASVARVGDITFEIAKKNVDNYVQVDEGAVCSTILDMYSKQAIVAEPAGALSVSALENYKDHIKGKTVVCVISGGNNDINRMKEIEERSLLYEEMKHYFILNFPQRPGALREFVNDVLGPQDDITKFEYLKKSSQNTGTVIIGIQLKDHDDLIQLKQRVNHFDPSNIYINENKMLYSLLI

SEQ ID NO: 90542 - protein, 326 aa, Aspergillus nidulans FGSC A4
MASSSTSANMVKRTILSNRLAAQILNFAEASPRTIRPFAFGSIRSIHNSARLPTITASETRHRPTLRPHQLSAAHGRVNGQPPTGKRTIFIQTESTPNPDALKFIPNHRVLPEDFPTSFLEYLSPRSTLAPPHPSTLAANLFNVEGVQSVFFGTDFITVTKASDTNWAHIKPEVFSLITQAVTSGEPIVNTVEKSGASGQKGGEEDSLSYNEEDDEVVSMIKELLETRIRPAIQEDGGDIEFRGFENGIVMLKLRGACRTCDSSTVTLRNGIESMLMHYIEEVQGVEQVLDEEEEISMLEFAKFEEKLRQQKGAQATAPSSLDSAP

SEQ ID NO: 90543 - protein, 422 aa, Geobacillus kaustophilus HTA426
MYKRFGKVSRVIGLMMESKGPKSSIGDLCYIHEQSGCRKIPAEVVGFHEQHVLLMPFSAMSHIAPGCLVEATGRPLEVHVGDALIGMVLDPLGQPLDGSPLPPGLKPVSVERDPPNPLVRPPIVEPLEVGIRVIDSLLAVGKGQRVGIFAGSGVGKSTLMGMIARHTSADVNVIALIGERGREVREFLERDLGPDGLARSVVVVATSDQPALMRVKGAYTATAIAEYFRDQGADVMLMMDSVTRVAMAQREIGLAVGEPPTTKGYTPSVFALLPKLLERAGTNASGTITAFYTVLVDGDDMNEPIADAVRGILDGHFVLERQLANKGHYPAINVLKSVSRVMPHMISAEHREAANRFRRLLSTYIDSEDLIQIGAYKRGSSQEIDEAIEFYPQMMAFCRQNIDEKTTRAESIDALLRLLSVR

SEQ ID NO: 90544 - protein, 447 aa, Salmonella typhimurium
MDQTCSLESFLNHVQKRDPHQTEFAQAVREVMTTLWPFLEQNPRYRHMSLLERLVEPERVIQFRVVWLDDKNQVQVNRAWRVQFNSAIGPYKGGMRFHPSVNLSILKFLGFEQTFKNALTTLPMGGGKGGSDFDPKGKSEGEVMRFCQALMTELYRHLGPDTDVPAGDIGVGGREVGFMAGMMRKLSNNSSCVFTGKGLSFGGSLIRPEATGYGLVYFTEAMLKRHGLGFEGMRVAVSGSGNVAQYAIEKAMAFGARVVTASDSSGTVVDESGFTPEKLARLCEIKASRDGRVADYARDFGLTYLEGQQPWSVPVDIALPCATQNELDVDAARVLIANGVKAVAEGANMPTTIEATDLFLEAGVLFAPGKAANAGGVATSGLEMAQNAARLSWKAEKVDARLHHIMLDIHHACVEYGGDNKHTNYVQGANIAGFVKVADAMLAQGVI

SEQ ID NO: 90545 - protein, 485 aa, Burkholderia xenovorans LB400
MSESATVFKNLIAGEWTESVSGKTFANINPADTRDVVGQFQASVVADAQAAIQAASSAFAQWRRTPVTARARIVNKAADWLESHADTFAQELTREEGKPLAQSRDEILRSAQVLRFYAVEAQSFTGETFPSDDPEQHVYTQREPLGVVTVITPWNFPISIPARKIAPALMAGNTVIFKPSSDAPLIGYRLAEAFAQAGIPAGVLNFITGRASDIGAAITESPVVRAISFTGSTAAGEHIHRSVPITTRTQMELGGKNPLIVMDDADLDRAVDLAVKGGLSLSGQACTGTSRILVMESVRETFTAKLVERVKSLKIGSGVTPGMDLGPLANRKQLESVLGYVASGKEQSTHLIGGEQLTGEGFEHGYYVTPAVFSDVPESARIYREEIFGPVLAITSVTGYDDAIAKANDTEYGLSAAIATSNPRYMHRFADEIEAGTVKINRTTTGNVINAPFGGLKRSSTSTFRESGRAGLEFYTQIKTVYRGL

SEQ ID NO: 90546 - protein, 479 aa, Bacillus cereus ATCC 14579
MLEKKVGIYFAIKRENNVKKRMGYAMNTKKFAKVNEQIPGPKAASLLERRQNIVPKGVSNGIPTFVRSANGALVTDVDGNQYIDFAGAIGTINVGHCHPTVKEALHKQVDQYIHTGFNVMMYEPYIELAEKLAALAPGSFDKQVLFLNSGAEAVENAVKIARKYTKRPGIIAFSKGFHGRTLMTMTMTSKVKPYKFGFGPFAPEVYKAPFPYEYRRPEGLTEEQYDDFIIEEFKNFFISEVAPETIAAVVMEPVQGEGGFIVPSKKFVQEVRRICSENGILFVADEIQTGFSRTGKYFAIDHYDVVPDLITVSKSLGAGVPISGVIGRKEIMNESAPGELGGTYAGSPLGCAAALAVLDVIENEKLNDRAIELGKVVMNRFEEMKNKYHCIGDVRGLGAMCAFEVVQDRKTKAPDKTLTANLCAEANKRGLLLLSAGTYGNVIRVLMPLVITDEQLEEGLTIIEESLQACYEQTNIARV

SEQ ID NO: 90547 - protein, 334 aa, Alteromonadales bacterium TW-7
MINVAINGYGRIGRNVLRALYESAQNSEIKIVAINDLAPANVNAHLTQFDSVHGQFSKKVTLADNTMLIGDDVITLTQERDPANLPWKELNVDIVLECTGFFTKREDAAKHITAGAKKVIVSAPGKDLDATVVHGVNSDVINADSNIISNASCTTNCLAPIAKAINDTVGIEQGSMTTIHAYTNDQNLSDVYHPDLYRARSATQSMIPTKTGAAAAVGLVLPELAGKLDGMSVRVPTINVSLVDFTFITKRETTAEEINEVMKAAATGSMKEILEYNELPLVSIDFNHNPASSIFDATQTKAEGKLVKVMAWYDNEWGFSNRMLDQVKALGQYL

SEQ ID NO: 90548 - protein, 431 aa, Salmonella typhimurium
MVSLEKNDRVMLARQLPLKSVALILAGGRGTRLKDLANKRAKPAVHFGGKFRVIDFALSNCLNSGIRRIGVITQYQSHTLVQHIQRGWSLFSEEMNEFVDLLPAQQRMKGENWYRGTADAVTQNLDIIRRYKAEYVVILAGDHIYKQDYSRMLIDHVEKGARCTVACMPVPIKEATAFGVMAVDESDKIIDFVEKPANPAMLGDASKSLASMGIYVFDADYLYELLAADDKDDASSHDFGKDIIPKITREGMAYAHPFPLSCVQSDPQAEPYWRDVGTLEAYWKANRDLASVTPQLDMYDQNWPIRTHMESLPRAKFVQERSGSHGMTLKSLVFGGCIISGSVVVQSVLFPRVRINSFCNIDSAVLLPEVWDGRSCRLRCCVIDRACIIPEGMVIGENAEEDARRFYRSEEGIVLVTREMLRKLQGHKQER

SEQ ID NO: 90549 - protein, 483 aa, Bacillus cereus ATCC 14579
MDKKATFVSIDKKAMYINGEWITLQEQIEVNNPATKEIFATVPKGGVTEAKQAVDAAHEAFKTWSKLTAADRATKLKKWFTLIDENKEEIAAIMTKEQGKPFAEALGEVNYANSFVEWYAEEGKRVYGEMIPAAHPNKRILVMKQPVGVMAAITPWNFPAAMITRKVAPALAAGCTAVVKPASQTPLTALKLAELAHEADIPKGVINIITGSAKAIADTWMEDGRVRKVSFTGSTEIGKELMASAAQTMKKVSLELGGHAPFIVMNDADLDKAVEAVIGSKFRNAGQTCICTNRVFVQEEVYEVFVEKFQKAVGQLKVGDGFGDGTTVGPLIDENAVSKVQEHIEDAIQKGGTVLYGGQKVAELEGHFIQPTVIGLANDTMLCMNEETFGPVAPVAKFKTVDEVIERANNTPYGLAAYIFTKDISQAFQISEALEYGIIGLNDGLPSVAQAPFGGFKESGIGREGGHFGIEEYLEIKYISLGL

SEQ ID NO: 90550 - protein, 522 aa, Bdellovibrio bacteriovorus HD100
MSTEVSSGIQARLADLEKRNEAAMAGGGAARLAKHKQGGRLTARERVDVLLDPGSFVEMDRFVSHRCTNFGMDKNVVPGDGVITGYGRINGKLVYLSSQDFTVIGGSMSRTQANKICKVMDLAMKNGAPFISINDSGGARIQEGIESLGGYADIFTRNTMASGLIPQITAIMGPCAGGAVYSPSITDFVFMVKNTSYMFVTGPDVIKTVTHEDVTKEELGGATTHSAKSGVAHFAAEDDKHCLLLIREMMNFLPSNNLDDAPVLPTNDRPDRLTEALNNLIPENPKKPYDMISVITECVDEGYFLEVHKHFAQNLIVGFARFNGRPVGIVANQPNILAGCLNIEASRKGARFIRFCDAFNIPVVSFVDVPGFLPGKDQEWNGIITHGAKLLYAYAEATVPKITVITRKAYGGAYIVMGSKLLRSDVNLAYPSAEIAVMGADGAVSIIFREEINKAKDPVAERARLTAEYEAKFSNPYVSAELGYTDEVIEPAMTRKRIIDSLEMLKHKRDITPAKKHGNIPL

SEQ ID NO: 90551 - protein, 667 aa, Zea mays
MKRSSGRKDSNFIEQLILYVASAALSSLVLYVGLRQLDPNRDAAKKSLEHKREIAKRLGRPLIQTNQYEDVIACDVINPLHIDVEFGSIGGLESIKQALYELVILPLKRPELFAYGKLLGPQKGVLLYGPPGTGKTMLAKAIARESEAVFINVKVSNLMSKWFGDAQKLVSAVFSLAYKLQPAIIFIDEVDSFLGQRRSTDNEAMSNMKTEFMALWDGFTTDQNARVMVLAATNRPSELDEAILRRFPQSFEIGMPDCQERAQILKVVLKGESVESDINYDRIARLCEDYTGSDIFELCKKAAYFPIREILEAEKEGKRVSVPRPLTQLDLEKVLATSKKTQVAASEYTGLSSQSSVWGSPSNADENYLLGAFKPACNISITFTDGKNRKQVPTKKDNGQIVMNPLFQSQETIAGKINIEPYQGKKVEHNGVKVELLGQIEMYFDRGNFYDFTSLVREIDVPGEIYERKTYPFEFSSVEMPYETYNGVNVRLRYVLKVTVTRGYAGSIVEYQDFVVRNYVPLPPINNSIKMEVGIEDCLHIEFEYNKSKYHLKDVILGKIYFLLVRIKIKNMDLEIRRRESTGAGANTHVETETLAKFELMDGAPVRGESIPVRVFLTPYDLTPTHKNINNKFSVKYYLNLVLVDEEDRRYFKQQEITLYRLKEETS

SEQ ID NO: 90552 - protein, 121 aa, Populus trichocarpa
MLPRQTSKNVKLGTLDVPAGTHFYLALPSVHHDPDIWGKDANEFNPLRFNEPRNHLASFFPFGIGPRMCVGKNLAVMEVKIVLAMIIRSYSFVVSPTYVHAPSLLLSTQPQFGAQILFRRI

SEQ ID NO: 90553 - protein, 576 aa, Rhodococcus sp. RHA1
MFRVAGGRVKLLVRVFFAQFFSFNASVIFLGVLLITATDLEVRAGVRTLLSAPGPALRVQPGDRIGLVGRNGAGKTTTLRILAGEGEPYAGAVVRTGDLGYLPQDPKEGDLDVLAKDRVLSARGLDALLRDMEKQQILMSEVVDDAERDKAVRKYGNLEDRFSALGGYEAESEAARICNSLGLADRILGQQLHTLSGGQRRRVELARILFAASDGSGGRSDTTLLLDEPTNHLDADSITWLRGFLQNHEGGLIVISHDVDLLNDVVNRVWFLDAVRGEADVYNMSWKKYLDARATDEQRRRRERANAEKKAGALRAQAAKLGAKATKAVAAQNMAKRADKLMSDLDAERVSDKVARIRFPEPAACGKTPLMAENLTKVYGSLEIFTGVDLAIDRGSRVVVLGLNGAGKTTLLRILGGVETPDAGGLVPGHGLKIGYFAQEHDTLDDNASVWENIRHAAPDTGEQELRSLLGAFMFTGPQLEQPAGTLSGGEKTRLALAGLVSSAANVLLLDEPTNNLDPVSREQVLDALRSYTGAVVLVTHDPGAAEALDPERVILLPDGTEDHWSQDYLELIQLA

SEQ ID NO: 90554 - protein, 440 aa, Parvularcula bermudensis HTCC2503
MAKDQSYEQGSLSLWGTIAMGTGVMIGAGIFALTGQVAELSGDLFPLAFLFAAAISGFSAYSYIKVASAYPSAGGIAMILKKAYGQTTVTGAAALLMAFSMIINESLVARTFGSYALRPFGVADDSVLIPVLAVGLVVFAFVVNVANNKWIGGISQIAAILKIGGILVFGIVAMAAAGFSFEPYENGLANDTGAFGFLAGTALAILAFKGFTTITNSGDEVKNPEKNVGRAIIISLAICAIVYLVVAFGVASTLSVKEIVAAKDYALAEAARPAVGSLGVGFTVAVALIATASGILASVFAVSRMLTMLTEMKLIPHRHFGMSGPIHRHLLVYTVVLAGTLAAFFDLTRIAALGAIFYLVMDIIIHWGLLRHLREDVGAKGWVVITAITLDTVALLAFVVMKAQQDRLVVAIALVGIALTFVGERIFLQQSQGDEAGAAR

SEQ ID NO: 90555 - protein, 580 aa, Ostreococcus tauri
MLALVASATTVASMGADQSRASPVRSSTRAADRAPPTNAVRRAACGPGYASLRDASAYRGLATNDRRGKGVDGLIPAGEVGEEVEIARANAALAQCETPFEKYKQLVALQMTDESTFYRMLRSQTETLLPILYTPTVGEACVKFGTLVQRPMGLWVSSNDAGNVKQLIRNWPATDVKIAVITDGERILGLGDQGANGMGISAGKSMVYAACGVPPSALLPIQVDTGTNNQTLLDDPLYIGLKQKRDRTKAYDALLDEIVVAVRSRYGQKTIIHWEDFAPKNAFRVLRRFQQAPEVVTYNDDIQGTAAVTVSGLLASVRSLGGDVTQQRVLFFGAGQANIGAAELFVSALVQRGVSEEEAKKRVWLFDSKGLVVRSRASQLSEDKLAYAQDAPEESDLERVIELIKPTALVGAAAVPGKFNERVVKKMSKINDRPIIFALSNPTSQAECSAEQAYAWSDGRAIFASGTRFPPVTYRSRKFEPGFANNAFIFPPIALATIVTGTINVTPEMFLTAAEALAESVDDELFSVGAVYPPVDRIASSARVVAARVAHAVDPSISLEEWTDRVDQYVRKNDLFSSVS

SEQ ID NO: 90556 - protein, 530 aa, Rhodopirellula baltica SH 1
MQRQRSLTKLKERSEPWDIVIIGGGATGVGIAMDAASRGLDCLLLEQADFGKGTSSRSTKLVHGGVRYLQQGNITLVRDALKERTLLRNNAPQLVHDMPFLIPCQSRWERMYYAIGLKVYDFLATGNRFGRSHAINQKESLERVPTIKTEKANGGVIYHDGQFDDTRLLISMARTADEQGACLLNYFAVTDLSKDARGDIDGVVAEDRETGETHSIMARRVINAAGPFCDAVRMMDEPAAEKMLAASQGVHIVLPRRFFPGDIAMIVPKTSDGRVLFIIPWHNHAVVGTTDTAIENVSLEPKPQAGEIEFLLETAKEYLVEAPTRSDVLSVFTGIRPLVKGDKSSRTASLSRDHTIRLSDSGLITITGGKWTTVRKMAEDCVDRALASTKNSANPLKANACRTETLHLHGYDPNSGSTNTVAGSGRGHYGSDLSEIESLEREHVEWASPLHHELSITGAEVIWATRYEMARTVEDVLARRTRCLFLNSAAAIAISETVARLMASESDRDEAWISAQVASFAKLSEAYRIG

SEQ ID NO: 90557 - protein, 214 aa, Listeria monocytogenes str. 4b F2365
MTFVAPSLLAADYMNMANSIKEAEHAGADYLHIDVMDGHFVPNLTFGIDMVEQIKKTATIPLDVHLMLSNPENYIEKFAAAGAHIISVHIEAAPHIHRVIQQIKAAGCKAGVVLNPGTPASVLDAVLADVDLVLQMTVNPGFGGQAFIDSTIKNMRYLDHWRRENNGSYVIEVDGGVNAETAEKCKQAGVDVLVAGSYFFRADDKIACIKELKA

SEQ ID NO: 90558 - protein, 364 aa, Rhodopirellula baltica SH 1
MPQSFHLVILGGDGIGPEVCDQSVRLLEIMQPHLDGVEFQLDRHSVGVGEYQRSGEALPQSAYDACLASDAVLLGAMGLPNVRYPNGKEIAPQLDLRERLQLYGGVRPIRLYHEADTPLKGHGPGEIDFVLVRESTEGLFYGRDAIADLEADEATNLLRITRSASERVCRLAFETARRRDGKKTVTLIDKANVLSSMVYFRHVFDEVAKEFLDIKAEHVYVDAAALFLVRRPQDFDVMVTENMFGDILSDLAAGLVGGMGMAPSGDIGDDAAVFQPSHGSAPDIAGQSIANPIAMHLSTAMMLEWLDHPETRRAADALNAAIADVLSDPTQRTADMGGNLSTVEITDKIAERLSKRLQGETTAV

SEQ ID NO: 90559 - protein, 501 aa, Rickettsia sibirica 246
MLPPKIFFEKVKEIMWPIERKELKLFIPMALMMLCILFNFGALRSIKDSLVVPSMGAEIISFLKLWLVLPSCVIFTVLYVKLSNNLNFEYIFYIIVGSFLLFFLLFAYIIYPNQDIYHPNDEMINKLIASYPNFKWFIKIGSQWSYALMYIFAELWSAVVINLMFWQFANHIFDTSKAKRFYPVLGMVGNIGLIIAGSVLVFCSSGQDVIDSELLPDSFNSSAGNAIMLQPIMSIIVTAGIIAMLLFRIINRFILTDSINVLDAKKVTAKMKTKLSVIESIKLVIHSKYIGRIALLIICYGLLINIVEGPWKAKIKELHPNTIDYVNFMGRFNIWMGISCVTFMIIGSNILRRLGWLISALLTPIMLSITGLMFFIFIIFIEEIGECFGDFNLLYAAIIVGAIQNILSKSSKYSLFDSTKEMAYIPLSLELRTKGKAAVEVIGTKFGKSLGAFIQSLIFIIIPTATFDSIIIYLLVTFIVMMSLWIWNVIKLNKEYVELCK

SEQ ID NO: 90560 - protein, 510 aa, Thermoplasma volcanium GSS1
MLKRELGIIDLTMSSVTGMIGSGWLFSALYASSIAGPYSIISWIVGSLIVAVLALIYADLSGRMPTAGAAAAYPFLTNGDAAGSINAWSLFLGYASTPPLEVIASITYMNFVMPGLINSSGMLTLRGMLIAISLLFVFFIINAMGIRHTSKVNNYISYLKIGIPIITSFFFISTMFSISNFSYVSSVHPEGIFTAIPDAGIAFSFLGFRQAVELSGEAKNPQRTVPIAIMLSVAIASGIYLLVQVAFIGSLKWFSLTPGDWSGLYNSAYSSGPMLVLASALGLGALASVLLFDGVVSPLGTSNVYQTSTSRVVYRISRMGFLTKKIGTLNSNSVPFYALLLDFFVMSLFILPFPSWYDLVSVNSDLTIIAYMTGPISLVIMNQLGIAPKGFKLPLAKILAPLGFVFSILIIYWSGYPTTLYMSIIALAGLVLFIFARRSPLKSLVGASYMIFILIFVPVASFLGSYGIGLFPFPYDIAIVAVASLGAFAIGTRLYVPSADMSDRIKETVN

SEQ ID NO: 90561 - protein, 546 aa, Desulfovibrio vulgaris subsp. vulgaris str. Hildenborough
MSRRQILERLQADKTFDLLIVGGGATGCGVALDAATRGLDVALVERDDFAQGTSSKSTKLVHGGVRYLEKAILKADKEQFALVHEGLRERGYLLRNAPHLAHPVQLMTPVDSWKDAGYLFAGLTMYDLLAGRLGLGHSRFVTRSKAQRLFPTLRLGKAKGAVLYYDGQFNDARMAVTLARTAALHGATCANHVEVIDLVRENGRLCGAVLRDVNSGETWQVRARGIINATGPFSDGLRRMDDQNACDILKVSSGIHLVIDPGHTPPHLGLMVPRTDDGRVLFMIPWQGHVVFGTTDEPVDISRDPVPTQEDIDYLLNYAGRYLSRPLSRDDVRAAWCGLRPLVFEADKSCTQELARTHVIEVSPGGLLTITGGKWTSYRRMAEDTIDRADAAFELGLQRPCVTRDLRVIGSRGFVRGAHAEMARDFGVDPALARGLFELHGDETPLILTLAREEGLMDRLHPAHNYIGAQVAFAVRHEMAVHLTDVMVRRLPLGLVDVQHTLEASAPAADIMAQELGWDAATRQREMEALAAYLAAWRPAPDAATT

SEQ ID NO: 90562 - protein, 293 aa, Xylella fastidiosa Dixon
MIASFSSIAMPHVTLLPSPSPIAFIGGGNMARSLIAGMIRQGAPSTSICVIEPIAALRDALMADFNIKAVTTATEAATDTSTWVLAVKPQVMPDVCATLPLPVQPNTPLVISIAAGITTCKLKHWLGDTCAIVRAMPNTPALLGAGVTGLFATSQTTGTQRTLAEELFNSVGKTLWITEEALMDAVTAVSGSGPAYAFLLAEAMETAAIMQGLSTANARTLVQQTLLGAARMMTESGETPAALRHRVTSPHGTTEAAITTFQENDFQALVAKAIDAATLRARALGKINDTDPT

SEQ ID NO: 90563 - protein, 310 aa, Lactococcus lactis subsp. lactis Il1403
MTKIYDNITELIGQTPIVKLQHVPAESADVYVKLEAFNPGGSVKDRIALAMIRAAEADGHLKPGGTIVEPTSGNTGIGLAFVGSALGYKVVIVMPESFSLERRKLIQAYGAQLVLTPASGGMKAAIAKAKELSETEGYFLAMQFENPANPEIHEKTTGAEIIDAFGPTGLDAFVAGAGTGGTITGVSHALKKANPTIKTYVVEADESAILSGEAAGPHKIQGISAGFIPGNLDTKSYDEIIRVKGDDAILTARHLGGKEGFLVGISSGAAIYAALEVAKKLGKGKKVLAIAPDNGERYLSTALYDFESEK

SEQ ID NO: 90564 - protein, 513 aa, Xylella fastidiosa Dixon
MCSRWMVSAWNEEVTESLFMSRKHAFQFLDLPRQMPQRIPVELRTSGDWRELYGKFDKGEAQYQAGRCLDCGNPYCSWKCPVHNAIPQWLQLVQENRIDEAAALCHATNPLPEVCGRVCPQDRLCEGSCTLEEFGAVTIGAVEKYIVDTALQQGWRPDLSHVQPTGWRVAVVGAGPAGLACADRLARAGVQAVVYDRYEQIGGLLQFGIPSFKLDKAVMSTRRQVLEGMGVEFRLGVEIGKDLGIEALLEDYDAVFLGVGAYRYTDGGLPGQDLKNVLPALPFLVQNGRIVSGNDPYGRPIAGWEDQVQLPDVTGKSVVVLGGGDTGMDCVRSAIRLGATKVTCIYRRDEANMPGSAREVANAREEGVRFLFNRQPLSIQSGTDKQAIGVTVVETKLAEPDANGRRNAVPIQGTEAVLEADVVIIAFGFSPMLLEWLTAQGVQASSNGRIVVALSDTGDRLTYQTTHPKLFAGGDCVRGADLVVTAVAEGRDAAESIVRWLRATAQVMDVAVI

SEQ ID NO: 90565 - protein, 363 aa, Shewanella sp. MR-4
MGFKCGIVGLPNVGKSTLFNALTKAGIEAANFPFCTIEPNTGVVPVPDPRLDALAAIVNPQRVLPTTMEFVDIAGLVAGASKGEGLGNKFLANIRETDAIGHVVRCFEDDNIVHVANRVDPARDIEVINTELALADLDSLERAVIRQQKRAKGGDKDAKFEVDVLEKMRPILDEGHMLRSMELSKEELEAVAYLNFLTLKPTMYIANVAEDGFENNPHLDAVRAIAEKENAIVVSVCAAIESELAEMEAEERDEFMADLGLEEPGLDRVIRAGYQLLSLQTYFTAGVKEVRAWTVSVGATAPQAAGVIHTDFERGFIRAQVMAFDDFITYKGEAGAKEAGKLRVEGKTYIVQDGDVMHFLFNV

SEQ ID NO: 90566 - protein, 86 aa, Marinobacter sp. ELB17
MVDTQSEDIMSTVEERVKKIVCEQLGVKESEVQNSSSFVEDLGADSLDTVELVMALEEEFETEIPDEEAEKLASVQNAIDYIVSHT

SEQ ID NO: 90567 - protein, 504 aa, Magnaporthe grisea 70-15
MADPTSQIPPDANHDKTKQASTTEQPDIETATTEKTYFSKLSVWLMILFSGLAIGSDGYNAAVIGNVNLILAILYPSALGPEIRQRLSNAFLIGMIIGMLVFGVVADQLGRKTGAVATTILLVVGIAMSAGASGTSDTGMFWMLIVARGVAGVGAGGEYPVAGAGAAEATDESAAHRRHRGFMFAMLADLSASLGYVWAGLVPLLLLLIVGEQTVDGYVVVWRVAFALGALPPLLIFWFRLRMAVSTAYRRSAMRKQRTPYLLALKRYWRPLLGCSGTWFLYNWISIPFGIFSSTIISRVNAGESLVKTLGWGVVINCFYIPGPFLGGYLSDKIGRRRTMALGFTLQAVLGFVLGGAIGPIQDIFPLFVVMYGVFLTLGEVGPGSTVVIASTECFPTSIRGQMMGMVAAWSKVGAALGTQVFTAILNAYVDDPAKGNQAAFLIGSGFAVVGAAVALFVIPEASRNLDDDDRDWKKYLNDNGWEATWGDATTQDPAGVVLGTARS

SEQ ID NO: 90568 - protein, 469 aa, Salmonella typhimurium
MSAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRATGIADTVLFGPEPEFFLFDDIRFGASISGSHVAIDDIEGAWNSSTKYEGGNKGHRPGVKGGYFPVPPVDSAQDIRSEMCLVMEQMGLVVEAHHHEVATAGQNEVATRFNTMTKKADEIQIYKYVVHNVAHRFGKTATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEPMDKNLYDLPPEEAKEIPQVAGSLEEALNALDLDREFLKAGGVFTDEAIDAYIALRPEEDDRVRMTPHPVEFELYYSV

SEQ ID NO: 90569 - protein, 655 aa, Arabidopsis thaliana
MSYSFIWMLFVIHISCVLSADGNHILCSPSFTCGNQRGLLYPFWIAGRKECGHPDFELDCNAGVPELSISSVKFRILGADYDSGIITLARSDNIDDPCLPNSFTTSFNETVLPLASTTDLLTIYYDCNRNVSSFVSTFVKELDCPDDGTDDRRNYYLTRNLTFLPPSLKLEGNSFLLNDFGGSCSRNVSNPASRTALNTLESTPSTDNLKIALEDGFALEVNSDCRTCIDSKGACGFSQTSSRFVCYYRQEPQNPTRNKVILKLFFIVIYVLGIGAASFAMMGVILVVTCLNCLIRRQRKTLNDPRMRTSDDSRQQNLKALIPLKHYSYAQVTSITKSFAEVIGKGGFGTVYRGTLYDGRSVAVKVLKESQGNGEDFINEVASMSQTSHVNIVTLLGFCSEGYKRAIIYEFMENGSLDKFISSKKSSTMDWRELYGIALGVARGLEYLHHGCRTRIVHFDIKPQNVLLDDNLSPKVSDFGLAKLCERKESILSLMDTRGTIGYIAPEVFSRVYGRVSHKSDVYSYGMLVLDIIGARNKTSTEDTTSSTSSMYFPEWIYRDLEKAHNGKSIETAISNEEDEIAKKMTLVGLWCIQPWPLDRPAMNRVVEMMEGNLDALEVPPRPVLQQIPTATLQESSTFSEDISAYTEICSINVA

SEQ ID NO: 90570 - protein, 876 aa, Arabidopsis thaliana
MSYMPTSCLVLFFLLFLFHPLPWALSKEDLGWCEALFQCGNNTAGFPFWGGNRAKPCGHPLLELRCLNNITSLNISNHEYNVFHIDQTSNTLRLARTDLLGSFCSAEFNTPTFPREIFKLFPTYKSLTVLYNCDPKLSYRSSYTCPDLGLFSMSQSLDYQNSCQDSFKVNVPTSFVPEEKEMNLTHLESALRKGFEVKLVIDEIPCQECSSSRGICGFNSTTQICCNVTSLSGGVTCVPQHQPSADELRRRCSERFSCGNQRNLYYPFWIPGREYCGHPDFKLDCSGGFAELNIASVNFRILNMSYDSSNKRLARSDYLNDLCPPNPLNDEPLIETVLQFSADTELLTLYYDCQLNSSATSPFPSSYFGELGCDEGRSYYVTRNLSSPLLDRFRGVLNNLREMCKRKVSVPASGPALNTLQTNPNSNNLKMALEHGFELQDNSNCSMCVLSGGSCGYNQNSSLFVCYCKDGPQDNQCDINLDVAIIIGIFVALCTIGGFIAFLVLLCPCCKVRIFRNRKTSDDRRQEKLKALIPLKHYTYAQVKRMTKSFAEVVGRGGFGIVYRGTLCDGRMVAVKVLKESKGNNSEDFINEVSSMSQTSHVNIVSLLGFCSEGSRRAIIYEFLENGSLDKFISEKTSVILDLTALYGIALGVARGLEYLHYGCKTRIVHFDIKPQNVLLDDNLSPKVSDFGLAKLCEKKESVMSLMDTRGTIGYIAPEMISRVYGSVSHKSDVYSYGMLVFEMIGARKKERFGQNSANGSSMYFPEWIYKDLEKADNGDLEHIEIGISSEEEEIAKKMTLVGLWCIQSSPSDRPPMNKVVEMMEGSLDALEVPPRPVLQQIHVGPLLESSWITEESSSISEIENRNLQVCEKILS

SEQ ID NO: 90571 - protein, 241 aa, Prochlorococcus marinus str. MIT 9215
MRKSVIAGNWKMHMTCAEAKSYLEEFIPLIKNIKDDRKVVIAPPFTAISTFSNHSDFDYLDISSQNIHWEDQGAFTAEISPKMLLEHGVSYAIVGHSEPRKYFSESDEQINKRAVFAQSSGLTPIVCVGETLEQRERGEADRIITRQVEQGLENTDPSNLIVAYEPIWAIGTGKTCEAEDANKICSLIRKLIGFDDVIIQYGGSVKPNNIDEIMSMSDIDGVLVGGASLDPNSFARIANYK

SEQ ID NO: 90572 - protein, 329 aa, Bacillus cereus ATCC 14579
MIDNFWRELPRPFFVLAPMEDVTDVVFRHVVSEAGRPDVFFTEFTNSDSYCHPEGMKSVRGRLIFTEDEQPMVAHIWGDNPEYFRQMSIGMAELGFKGIDINMGCPVPNVASRGKGSGLILRPDVAAELIQAAKAGGLPVSVKTRLGFKELSEWEDWLTHIFKQDIANLSIHLRTREEMSQVDAHWELIPEIKKLRDRIAPNTLITINGDILDRKMGLELAEKYGIDGVMIGRGIFKNPFAFEKEPREHSSKEHLDLLRLQLDLQDQYAEVLPRSITGLHRFFKIYVKGFPGAAELRNQLMSTKSTDEVRALLDKFEASVDEAQDSETV

SEQ ID NO: 90573 - protein, 153 aa, Sinorhizobium meliloti 1021
MAKIKPVHILIVEARFYDDMADAMLDGAKHALDAAGATYDIVTVPGALEIPAAIAMALDGADEGGAEYDGFVALGMVIRGETYHFDIVANESARALMDLAVSESLALGNGILTVENDEQAWARARRTEGDKGGFAARAALTMIELKQRLGAEK

SEQ ID NO: 90574 - protein, 289 aa, Streptococcus thermophilus
MKGIILAGGSGTRLYPLTRAASKQLMPIYDKPMIYYPLSTLMLAGIKEILIISTPQDLPRFKDMLGDGCEFGISLSYAEQPSPDGLAQAFIIGEDFIGDDNVALILGDNIYHGNGLTKMLQLAASKEKGATVFGYQVKDPERFGVVEFDADMNAISIEEKPEEPKSNFAVTGLYFYDNDVVEIAKNIKPSPRGELEITDVNKAYLDRGDLSVELMGRGFAWLDTGTHESLLEAAQYIETVQRLQNVQVANLEEIAYRMGYITKEQVYELAQPLKKNEYGQYLLRLIGEA

SEQ ID NO: 90575 - protein, 125 aa, Salmonella typhimurium
MSKQQIGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGT

SEQ ID NO: 90576 - protein, 868 aa, Bdellovibrio bacteriovorus HD100
MSKKFQLKNGLKVLLLESHKSPVVSVQMWVKTGSADEKKTEEGISHFIEHLVFKGTRKYKVGEIAATVEGSGGELNAYTSFDQTVFYVTISKQFSDVALDVISEMMGYPTFDPQEIDNEREVVLEEIKRGQDSPGRRASQLLFTNVFQKSPYGIPVIGYDKVVKKVSAKKIREFYQSRYVPSNMFLVVSGDFDSKEMKNRVQQMFGGFAPYKLRKVARKKEPAQKTIRIKVEQAKFEQTTAYLTWRIPSVKHKDIAALEVMSAILGQGDSCRLMQTLRIKEPLTNSVGSFAYSMQDDGLFAVSLGLEKENLTKALSALIPELVRIVTEPPTVAEMQKAITNFASHEVYSMETVDNIARKAGSNEFYYGDHDYYKKYMKQVYALKPEDIQKIAKKYLKADSFGLSMMTNMDKKNADRILKAFAKDLRKALREAKAVKQKAPRFAAKKFNINAGAAKGVPTTERIVLDSGATLLIREQSDTPYVAMKAAFLGGARVEPEGQNGLTELFARNWMSGSKNFTEDDINLRVDELAAGIGAFGGRNSAGLSMDYLSPFEDKMLEIYADSLLEPQFPEIILEREKVVLKNQIKARNDNPAQLCILAFMQEIFKGHPYARDLVGSETTVNAITSADLLGYYKKIAMAKNVTFSVVGDVDTKKWVKTLNEITKELPKGERVKNHFAAPKITESKHLFRELKKEQSHIIVGYQGLTLSSPERYTMEIIQSILSGQGGRLFIELRDKNSLAYSVSPMHMEGIERGYFGGYIGCSPEKSEKAIQMLKAEFNKLASTKISPEELVRAQRYLIGRHDIELQRKSTIGNAILFDDIYGLDYRESLDVADKYFAVSPEDVQKLAQKIFAQPAIVSLVGPTDVKS

SEQ ID NO: 90577 - protein, 224 aa, Listeria monocytogenes str. 4b F2365
MRKIAASIMCADQLHLGEELRRLESAGVELLHCDVMDGVYVNNLALGPEYLEIVRNNTEIPLDIHLATITPLKYIDMFGPVKPEYISFHVEVAEDVSEVIRKIRSYNVKPSIAINPETPIEAIYPYLDDVEMVLMMTVNPGFAGQKFQTDVLQKLHDLKAKLAGKVHAPLIEVDGNINKETVGLMRDCLPDIYVLGTSALFHDRDKTSYAERLVHIWSDVEKHV

SEQ ID NO: 90578 - protein, 525 aa, Triticum aestivum
RLVGCCNELNAAYAADGYARARDGGVGACAVTFTVGGLSAINAVAGAFSENLPVICIVGGPNSNDYGSNRILHHTIGIPDFTQELRCFQNVTCYQAVVNNLEDAHEQIDTAISTALKESKPVYISISCNLPSIPHPTFSRHPVPFFLSPKLSNQMTLEAAVETAAAFLNKSVKPVLVGGPKMRVAKACEAFVELADACGYPVAAMPSAKGLVPEHHSRFIGTYWGAVSSPFCAEIVESADAYLFAGPIFNDYSSVGYSLLLKKEKAIIVQPDRVVIGNGPAFGCVLMKDFLHALGTRLKKNTAAYDNYSRIFVPQGEPLSSAPGEPLRVNVLFKHIQKMLSGDSAVIAETGDSWFNCQKLKLPEGCGYEFQMQYGSIGWAVGATLGYAQAAKGKRVISFIGDGSFQVTAQEVSTMLRWEQNNIIFLINNGGYTIEVEIHDGPYNVIKNWNYTGVVEAFHNGEGKCYTAKVRTEEELKKAIEASLGPNKDSLCFIEVIVHKDDTSKELLEWGSRVSAANSRPPNPQ

SEQ ID NO: 90579 - protein, 495 aa, Aspergillus oryzae
MVNMLRGLFVASLAASVVHAQSYSGCHTHGSVEYCYGTDGEETPITTHAQATATSVSATTTSSAQSSAVTGCHNHGDDVYCINGEGNEVQVSLTATPTGELPAQYTGCHSHGGSQYCMDADGNDVQILKEGESGDESDSTSESSSSSSGEQNCHFHAGVEHCVGAGESEGSSEQSCGVQSRDYDMPLRIGTLFVILVTSALGVFLPMLLVKLPFPTINTMASTVIKQFGTGVILSTAFVHLYTHANLMFTNECLGELDYEATTSAVVMAGIFLSFLTEYIGHRFVAARASKSTPECCEDSPSNNVSATPKENTAQRTMQLAQLSHSHGTDGTSPNTKLSVLVMEAGVIFHSILIGLTLVVAGDSFYKTLLVVIVFHQFFEGLALGARIAMLPGRIFPSKAVMAGTFALITPIGMAIGMGVLHSFNGNERSTLIALGTLDALSAGILVWVGVVDMWARDWVMEGGELLDAPLVRVLVGGVSLIAGMVLMGVLGKWA

SEQ ID NO: 90580 - protein, 343 aa, Listeria monocytogenes str. 4b F2365
MKAVVKTNPGYDQMELRDVEEPQVYGDKVKIKVAFTGICGSDIHTFKGEYKNPTTPVTLGHEFSGVVVEVGPDVTSIKVGDRVTSETTFETCGECIYCKERDYNLCSNRRGIGTQANGSFAEFVLSREESCHVLDERISLEAAALTEPLACCVHSALEKTTIRPDDTVLVFGPGPIGLLLAQVVKAQGATVIMAGITKDSDRLRLAKELGMDRIVDTLKEDLAEVVLGMTDGYGAERVFDCSGAVPAVNQGLPLTKKKGDFVQVGLFAEKKNAIDEESIIQREIAYIGSRSQKPSSWILALDLLANGKINTDKMITKVYGLDDWREAFEAVMAGNEIKVLVKS

SEQ ID NO: 90581 - protein, 461 aa, Triticum aestivum
MATTASPSTTTTPRSFLSSPSSSLRASKSNHLRTTRRLPVNVRCASSSPAADTSYTTKVSRNANIAKLQAGYLFPEIARRRAAHLLKHPDAKIISLGIGDTTEPIPEVITNAMAERAHALSTVDGYSGYGAEQGEKKLRAAIAATYYADLGIDETDIFVSDGAKCDISRLQVLFGSKVKIAVQDPSYPAYVDSSVIMGQTDLYQQDVQKYGNIEYMRCSPENGFFPDLSKVPRTDIIFFCSPNNPTGAAASRDQLTQLVKFAKDNGSIIVYDSAYAMYISDDSPKSIFEIPGAKEVALETASFSKYAGFTGVRLGWTVGPKELLFSDGHPGAKDFNRLVASSFGGASTISQAGGLGCLSPEGLKAMQDVVGFYKENTKIIVDTFESLGFNVYGAKNAPYVWVHFPGRNSWDVFAEILEKANVVTTPGSGFGPGGEGFVRVSAFGHRENIIEAARRLKQLYK

SEQ ID NO: 90582 - protein, 433 aa, Vibrio cholerae O1 biovar eltor str. N16961
MSKIVKVLGREIIDSRGNPTVEAEVHLEGGFVGMAAAPSGASTGSREALELRDGDKSRFLGKGVLKALAAVNGPIADALVGKDAKDQATIDQIMIDLDGTENKSNFGANAILAVSLANAKAAAAAKGMPLYEHIAELNGTPGVFSMPLPMMNIINGGEHADNNVDIQEFMIQPVGAKTLKEAVRMGAEVFHNLAKVLKSKGYNTAVGDEGGFAPNLKSNAEALEVIAEAVAAAGYKLGTDITLAMDCAASEFYDAEKKEYNLKGEGRIFTSNGFSDFLEELTEKFPIVSIEDGLDESDWEGFAYQTEKLGKKIQIVGDDLFVTNTKILKRGIDNGIANSILIKFNQIGSLTETLAAIKMAKDAGYTAVISHRSGETEDATIADLAVGTAAGQIKTGSMSRSDRVAKYNQLIRIEEALGSRAPFNGLKEVKGQA

SEQ ID NO: 90583 - protein, 442 aa, Solanum tuberosum
QTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPHWFQGTADAVRQYLWLFEEHTVLEYLILAGDHLYRMDYEKFIQAHRETDADITVAALPMDEKRATAFGLMKIDEEGRIIEFAEKPQGEQLQAMKVDTTILGLDDKRAKEMPFIASMGIYVISKDVMLNLLRDKFPGANDFGSEVIPGATSLGMRVQAYLYDGYWEDIGTIEAFYNANLGITKKPVPDFSFYDRSAPIYTQPRYLPSSKMLDADVTDSVIGEGCVIKNCKIHHSVVGLRSCISEGAIIEDSLLMGADYYETDADRKLLAAKGSVPIGIGKNCHIKRAIIDKNARIGDNVKIINKDNVQEAARETDGYFIKSGIVTVIKDALIPSGIVI

SEQ ID NO: 90584 - protein, 350 aa, Listeria monocytogenes str. 4b F2365
MRAAVLYENNVIKAEQIDEATCGKDQVRVEVKAVGICGSDIHKMQTRWKYPLPAVMGHEFAGVVTEIGSEVTNVAIGDRVAGIPLEPCMECNYCKAGDFALCDNYRMVGSHFHGGFAENVVMKADNVISIGDLDFEEGAMIEPLAVSMHGVLGIQPRLGDTVIVFGIGTIGILVVQCLLLAGVKDIIAVDISDKKLADAREFGCKYTINPKNEDLKERVFAYTNGLGADIALECAGSKITQEQCLLVTKKKGKVGYLGIAYADVLLHEEAFENIFRRELTLKGFWNSYSAPFPGEEWRTSIEFVKQGRIKLKPLISHRYKLEETKEAFDMILSREHDYNKVMILPQKGDD

SEQ ID NO: 90585 - protein, 334 aa, Parvularcula bermudensis HTCC2503
MKTVVITGASGGVGRALARAYADRECRIGLIARGRKRLEETAREVRERGGEALVLPLDVADAEAVAKAASTCEAELGPIDLWINGAMVTVFSPIERLKPEEIHRVTAVTYLGAVHGTMTALNHMRPRGRGTIVQIASAIGYRAIPLQSAYCAAKAAMIAFSDSLRTELRHDGVGIDVTMMQLPAVNTPQFEWARNKMPKRPRPVPPIYRAEAVAEAIAAKAESGEREIWIGRPAMKAILAQKLAPNLAERMLADSAWSGQMTDEPAEAGRPDNLFEPVETVPSEAEGRFLDRAKAARPMTLGTTARNRLLAGGGAAAVGTAALLLRRILRGHGH

SEQ ID NO: 90586 - protein, 442 aa, Solanum tuberosum
QTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPDWFQGTADAVRQYLWLFEEHTVLEYLILAGDHLYRMDYEKFIQAHRETDADITVAALPMDEKRATAFGLMKIDEEGRIIEFAEKPQGEQLQAMKVDTTILGLDDKRAKEMPFIASMGIYVISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDADRKLLAAKGSVPIGIGKNCHIKRAIIDKNARIGDNVKIINKDNVQEAARETDGYFIKSGIVTVIKDALIPSGIVI

SEQ ID NO: 90587 - protein, 170 aa, Bacteroides thetaiotaomicron VPI-5482
MALIKSVRGFTPEIGENCFLADNATIIGDVKIGNDCSIWFCTVLRGDVNSIRIGNGVNIQDGSVLHTLYEKSTIEIGDHVSVGHNVTIHGATVKDYALIGMGSTILDHAVVGEGSIVAAGSLVLSNTVIEPGSIWGGVPAKFIKKVDPEQAKELNQKIAHNYLMYSQWYK

SEQ ID NO: 90588 - protein, 183 aa, Oryza sativa Japonica Group
MQNPGGHHASPASAAKSKSSTAAAASASGQGSSHHHHHHHSGGGGGGGGGADASATTLKRKRGVFQKDLQHMMYGFGDDPNARNCLGIGCNLCTLCCGTLEPLPETVALVEDIVVEYVTDLVHKAQNVASKRGKLLTEDFLYLIRKDVRKLHRATELLSMNEELKQARKAFDVNEETLATNNE

SEQ ID NO: 90589 - protein, 401 aa, Cucumis melo
MDYVYAPGKNHLFVPGPVNIPEPVLRAMNRNNEDYRSPAVPALTKTLLEDVKKIFKSTTGTTFLIPTTGTGAWESALTNTLSPGDRIVSFLIGQFSLLWIDQQQRLNFNVDVIESDWGQGANLDVLESKLATDGGHTIKAICIVHNETATGVTNDLSKVRFLLDKYKHPALLLVDGVSSICALDFRMDEWGVDVALTGSQKALSLPTGLGIICASPKALEASKTSKSVKVFFDWKDYLKFYNLGTYWPYTPSIQLLYGLRAALDLLFEEGLDNVIARHSRLGKATRLAVEAWGLKNCTQKEEWFSDTVTAVLVPSYIDSAEIVRRAWKRYNLSLGLGLNKVAGKVFSIGHLGNLNELQLLGCLAGVEMILKDVGYPVKLGSGVAAASAYLQNNIPLIPSRI

SEQ ID NO: 90590 - protein, 336 aa, Silicibacter sp. TM1040
MSTGTLSKADLWRAARLSVAPMMDWTTRECRYLHRLLSRETLLYTEMVTAPALVRGGALHLLDHDPSEHPVALQLGGSDPKELAEAARLGAEAGYDEINLNCGCPSDRVQSGAFGAVLMQTPELVADCVAAMAEAVSVEVTVKCRIGVDDQTPDEILPDFLDKIRAAGVKRVTIHARKAWLQGLSPKENRDIPPLDYELVHAMKSAFADMHISLNGGITSLDEAQAQLARGLDGVMVGRAAYHQPADVLCAADPRIYGTGTASDPLEVVRQMLPYIEQQMQSGSRLHQITRHMLGLFAGRPGARQWRRHLSEGAHRTGAGPELVEEALSLVLARAA

SEQ ID NO: 90591 - protein, 401 aa, Cucumis melo
MDYVYGPGRNHLFVPGPVNIPEQVLRAMNRNNEDYRSPAVPALTKTLLEDVKKIFKTTSGTLFLFPTTGTGAWESALTNTLSPGDRIVSFLIGQFSLLWIDRQQRLNFKVDVIESEWGEGAKLDVLAAKLAADTDHTIKAVCIVHNETATGVTNDLSLVRRILDEYRHPALFLVDGVSSICALDFRMDDWGVGVALTGSQKALSLPTGVGIVCASPRALEASKTAKSLRVFFDWKDYLKFYNLGTYWPYTPSIQLLYGLRAALDLVFEEGLENVIARHKRLGQATRLAVEAWGLKNCTQKEEWHSDTVTAVVVPPYIDSAEIVRRAWKRYNLSLGLGLNKVAGKVFRIGHLGNLNELQLLGCLAGVEMILKDVGYPVKLGSGVAAASSYLQNNIPLIPSRI

SEQ ID NO: 90592 - protein, 403 aa, Triticum aestivum
MLSARRQISKIELLGLIFSALLILCPWLEIVRTEKTSPQAILDLITGGKIIRKVPVVVGNCTGFAVNRTFCPYTRGAQLLVGVTDIQLKPRNIRKVAVIGGGLMGSGIATALLVGNISVVLKEVNPQFLQRGQKTIAGNLEGLVKRGSLTKDKMSKAISLLKGALDYSDFKDVDMVIEAVIEKVPLKQSIFADIEKICPPHCILATNTSTIDLNIVGEKTNSQDRIIGAHFFSPAHIMPLLEIVRTEKTSPQAILDLITVGKIIKKVPVVVGNCTGFAVNRTFFPYTQGAQLLVSLGIDLFRIDRIISNFGMPMGPFQLQDLAGYGVALAVKDIYAAAFGTRNFNSVLVDLMAETGRQGKSNGKGYYLYEKGAKPKPDPNVQHVIDEYRRQAKKTMPGGKPVT

SEQ ID NO: 90593 - protein, 375 aa, Oryza sativa Japonica Group
MVPKRHGPGLQDLGFLPLAPIPLPPESCPQYPDTDENIDDWRDIAMPKDHTKPPRVRTLGVNTTLSGFGHENVEKVYSDTTTPSDDQTKTADSTVTKKRSAGFLFDEEGLFNVDDEGRTEKQQCAVAASNIIRNFSFMPENETVMVQHRHCLETVFQCLEDQNTEDDELITNMLETLVNLAPVLDLRIFSSSKPSFIKITEKRAVQAIMGMLASSIRVWHCAAAELIGRLIINPDNEPFLLPAIPQIYKRLVDLLSVPAVDAQAAAISALYNVAEVNMDFRLKLASERWAVDRLLKVVKTPHPVPEVCRKASMIVESLVSEPQNRMHLLVHENTFAEILTSEGKYSDTFARILYELTARPSNKVTAGQAIWGNIN

SEQ ID NO: 90594 - protein, 401 aa, Cucumis melo
MDYVYAPGKNHLFVPGPVNIPEPVLRAMNRNNEDYRSPAVPALAKTLLEDVKKIFKSTTGTTFLIPTTGTGAWESALTNTLSPGDRIVSFLIGQFSLLWIDQQQRLNFNVDVVESDWGQGANLDVLESKLATDGGHTIKAICIVHNETATGVTNDLSKVRFLLDKYKHPALLLVDGVSSICALDFRMDEWGVDVALTGSQKALSLPTGLGIICASPKALVASKTSKSVKVFFDWKDYLKFYNLGTYWPYTPSIQLLYGLRAALDLLFEEGLDNVIARHSRLGKATRLAVEAWGLKNCTQKEEWFSDTVTAVLVPSYIDSAEIVRRAWKRYNLSLGLGLNKVAGKVFRIGHLGNLNELQLLGCLAGVEMILKDVGYPVKLGSGVAAASAYLQNNIPLIPSRI

SEQ ID NO: 90595 - protein, 199 aa, Glycine max
MGKSKSKGAKFAAVKKIISKKTIQKYKEDVLDPRKKDTEKEKLGRNVPQVSSALFFSYNMALGPPYRVIVDTNFINFSIQNKLDLEKGMMDCLYAKCTPCITDCVMAELEKLGQKYRVALRIAKDPRFQRLACTHKGTYADDCIVERITQHKCYIVATCDRDLKRRIRKVPGVPIMYITQHRYSIERLPEATIGGAPRI

SEQ ID NO: 90596 - protein, 196 aa, Oryza sativa
MSQTQIGRPAPDFKGVAVVDGAFKEISLSDYKGKYLVIFFYPLDFTFVCPTEIIAFSDRVEEFRSIGCEVVTASTDSEFSHLAWVNTPRKQGGLGKMNIPILADKTHDISRRYGVLKEDEGIAFRGLFIIDDKGNLRQITINDLPVGRSVDETLRLVQAFQFTDKHGEVCPANWKPGKKTMKADPSESKEYFDSVN

SEQ ID NO: 90597 - protein, 401 aa, Cucumis melo
MDYVYGPGRNHLFVPGPVNIPEQVLRAMNRNNEDYRSPAVPALTKTLLEDVKKIFKTTSGTPFLFPTTGTGAWESALTNTLSPGDRIVSFLIGQFSLLWIDQQQRLNFKVDVIESEWGEGAKLDVLAAKLAADTDHTIKAVCIVHNETATGVTNDLSLVRRILDEYRHPALFLVDGVSSICALDFRMDDWGVDVALTGSQKALSLPTGIGIVCASPRALEASKTAKSLRVFFDWKDYLKFYNLGTYWPYTPSIQLLYGLRAALDLVFEEGLENVIARHKRLGQATRLAVEAWGLKNCTQKEEWHSDTVTAVVVPPYIDSAEIVRRAWKRYNLSLGLGLNKVAGKVFRIGHLGNLNELQLLGCLAGVEMILKDVGYPVKLGSGVAAASSYLQNNIPLIPSRI

SEQ ID NO: 90598 - protein, 466 aa, Xylella fastidiosa Dixon
MNQGKIVQIIGAIVDVEFPRNNVPKVYNALKIDGTAIILEVQQQLGDGIVRTIALGSTDGLKRNLIATDTGHAITVPVGTGTLGRIMDVLGNPIDEAGPITYTDQWEIHRNAPSYEDQASTTELLETGIKVIDLMCPFAKGGKVGLFGGAGVGKTVNMMELINNIAKAHSGLSVFAGVGERTREGNDFYHEMKDSNVLDKVAMVYGQMNEPPGNRLRVALTGLTIAEYFRDEKDSSGKGKDVLLFIDNIYRYTLAGTEVSALLGRMPSAVGYQPTLAEEMGVLQERITSTANGSITSIQAVYVPADDLTDPSPATTFGHLDSTVTLSRSIAALGIYPAVDPLDSSSRQMDPLIIGEEHYNTTQRVQQTLQKYKDLKDIIAILGMDELSEDDKLAVSRARKIERFFSQPFHVAEVFTGAPGKYVPLKETIRGFKAIVDGEYDHLPEQAFYMVGNIEEVIEKANKMTA

SEQ ID NO: 90599 - protein, 363 aa, Triticum aestivum
  misc_feature (104)..(104): Xaa can be any naturally occurring amino acid
  misc_feature (171)..(171): Xaa can be any naturally occurring amino acid
  misc_feature (301)..(301): Xaa can be any naturally occurring amino acid
  misc_feature (314)..(314): Xaa can be any naturally occurring amino acid
MGSTAADMAASADEEACMYALQLVSSSILPMTLKNAIELGLLETLVAAGGKLLTPAEVAAKLPSTANPAAADMVDRMLRLLASYNVVSCTMEEGKDGRLSRRYXRAAPVCKFLTPNEDGVSMAALALMNQDKVLMESWYYLKDAVLDGGIPFNKAYGMSAFEYHGTDPRFXRVFNEGMKNHSIIITKKLLEVYKGFEGLGTIVDVGGGVGATVGAIVAAYPAIKGINFDLPHVISEAPPFPGVTHVGGDMFQKVPSGDAILMKWILHDWSDEHCATLLKNCYDALPAHGKVVLVECILPVXNPEATPKAQGVFXHVDMIMLAHNPGGRERYEREFEALAKGAGFKAIKTTYIYANAFAIEFTK

SEQ ID NO: 90600 - protein, 357 aa, Mycosphaerella graminicola
MAEFVRAQIFGTTFEITSRYTDLQPVGMGAFGLVCSAKDQLTGQAVAVKKIMKPFSTPVLSKRTYRELKLLKHLKHENVISLSDIFISPLEDIYFVTELLGTDLHRLLTSRPLEKQFIQYFLYQILRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITDLLGTPPDDVISTICSENTLRFVQSLPKRERQPLKNKFKNADPQAIELLERMLVFDPRKRVKAGEALADPYLSPYHDPTDEPEAEEKFDWSFNDADLPVDTWKIMMYSEILDYHNVDSANNGEGQENGGA

SEQ ID NO: 90601 - protein, 221 aa, Sulfitobacter sp. EE-36
MKWNIPNILTLLRLVAAPGVAVMFLYFTRPYADALAMFLFIAAAVTDWFDGYLARAWGQETKLGTMLDPIADKAMVVIALMVIVAFSSWSPWLVLPATVILFREVFVSGLREFLGDVSGTLKVTALAKWKTTAQMVAIAVLFGQGLFEHYFGMSIFGMDNALVGAILSGEEEDVLGLTWKFHGMIWAGRIGLVLLWIAAALTAITGYDYLRKSMPHLVEPR

SEQ ID NO: 90602 - protein, 260 aa, Shewanella sp. MR-4
MALRRPMVAGNWKMNGSAALAQELFKKFASKLQNDSAEVVLCPPSIYLESVRQLLEANKEALDGSLVRMGAQNLSQHDFGAYTGEVSGQMLKDCGCRYVIIGHSERRRMYGETSNIVAEKFAAAQKHGLTPILCVGESGPAREARRTFEVIAEELDIVIQKNGTMAFDNAIIAYEPLWAVGTGKSATPEQAQEVHAFIRKRLSEVSPFIGENIRILYGGSVTPSNAADLFAQPDVDGGLIGGASLNSSEFLSLCTIAMSA

SEQ ID NO: 90603 - protein, 435 aa, Aspergillus nidulans FGSC A4
MAAHSKKSSVKGEKKAKATKDTILPANLISAISAFLSEHGFSSTSAAFTKELAKKSISASKKSDVPSLLEIFQSWESQLNRKNVPSSSSSASSDSDADSSSDSDSSDSDVEMSEAPKVQRRRSSSTSSSSSSSSASSSSSSSSSSSSSSDSDADDEDEDEAALAPGPAAKGVKRKAESSASSSGSDSEETPKAKKTKLTSKAEESSSSSSESSSDSSSDSDSDSDSSSSSESESESESDASHSSSSSSSSDSSDSSSDSSSDSSSDSSSDSSSESESDAAKKADKKALKAATETPLPPSDSSSSGSSDSSSSSGEESSSTSRTLQNSEAEATQKPAATSEASVSSSASPAPRNGNGNGKKNHTGTRPTPLAALSELPHNHPSNQYVPYAYAEKAYKDLSVTRGKGFTKEKNKKKRGSYRGGPIDISGGKSFKFED

SEQ ID NO: 90604 - protein, 711 aa, Sinorhizobium meliloti 1021
MTILLGVIACGLLSVVYAIWATKSVLAADQGNARMQEIAGFIREGAQAYLTRQYTTIAIVGVVVFIAAWLLLSGAAAIGFLIGAVLSGAAGFIGMHVSVRANVRTAQAASVSLASGLDIAFKSGAITGMLVAGLALLGVSVYYLILTAGLGHEPAAREVIDALVALGFGASLISIFARLGGGIFTKGADVGGDLVGKVEAGIPEDDPRNPATIADNVGDNVGDCAGMAADLFETYAVSVVATMVLASIFFAGAPVLATVMTYPLAICAACIITSIIGTFFVKLGANASIMGALYRGLIVTGALSILGLGAATSLTIGWGSIGTVAGMDITGWNLFLCGIIGLIVTALIVVITEYYTGTNKRPVNSIAQASVTGHGTNVIQGLAVSLESTALPAIVIVGGIIATYQFAGLFGTAIAVTAMLGLAGMIVALDAFGPVTDNAGGIAEMSHLPPEVRKSTDALDAVGNTTKAVTKGYAIGSAGLGALVLFAAYSNDLAYFAANGDKHPYFADVGTISFDLSNPYVVAGLIFGGLIPYLFGGIAMTAVGRAGSAVVEEVRRQFKEKPGIMEGKDRPDYGRAVDMLTKAAIREMIIPSLLPVLAPIVVYFGVLLISGSKASAFAALGASLLGVIVNGLFVAISMTSGGGAWDNAKKSFEDGFVDRNGTRHMKGSEAHKASVTGDTVGDPYKDTAGPAVNPAIKITNIVALLLLAVLA

SEQ ID NO: 90605 - protein, 480 aa, Oenococcus oeni PSU-1
MENKKTNISKTNYALNFIKTKSKAERHLKIIALCVTLGGLLFGVDTGVINGALPYMAKKQELNLNPATEGLVTSSITLGAAFGAIFAGRLADRYGRKRILFYLSIVFFFCTAICSLAPNAIIMMIFRFLLGLAVGSASVIVPTFLSEIATVKLRGPLVTQNEIMITGGQLLAFVVNAILGNIFVNVSNIWRYMIAFGMIPSALLFIGTLIVPESPRWLIMKGKTKTALKILKGIRSDKRQSQQEVTQIQATLKKEKEVSHISWYDLKKPWIKKLIILGSGLGIVQQIVGINIIMYYGTTVLIKAGFTHNIALITNIANGIVSVLATYTGMHLMNHINRRKMLLTGIAGTGGALALITLVSQILPHSKLLPVCVVFLTLIFLSFFQGCISPTIWLLMSEIFPQNLRGLGMGISTFFLWMANFLVGFLFPIFLNYFGFSITFGIFVLCNLISFIFVYKFAPETRNKSLERVQLELRTRIDKN

SEQ ID NO: 90606 - protein, 745 aa, Ralstonia eutropha JMP134
MAAAVAAPPFATIAGMSYQVLARKWRPRDFTTLVGQEHVVRALTHALEQQRLHHAYLFTGTRGVGKTTLSRILAKALNCTGADGNGGITAQPCGQCKACTEIDSGRFVDYIEMDAASNRGVDEMAQLLDKAVYAPTAGRFKVYMIDEVHMLTNHAFNAMLKTLEEPPGHVKFILATTDPQKIPVTVLSRCLQFNLKQMPPAQIVSHLDNILGQEGIGHDGNALRLLAQAAHGSMRDALSLTDQAIAYSAGEVSEEAVRGMLGAIDQGYLVQLLDALAAEDGAALIGIADAMADRSLSFAGALQDLGSLLHKIALAQAVPASVQDEWPEAGDVRRLAGVFDAQEVQLFYQIANLGRSELALAPDEYAGFTMTLLRMLAFRPSSTPEPLPASAPGQGGGATPRARTVAASAPVVAEPVARYAESAASPTPAPAPAPAAQAPAVAAPARQDAGGDAPMSPARAALAAARQASAARGGGSGSGRALAAAPMSTPAGGAARQPAQPLRAPAPAAAASRPAPAPTARPVPPAAAPAPARKPAPQAESAPPWEASGGSDIPPWEDLPPDLPVFGPYDNEPVSLPTKAAAPARASKPEAPAPEAPRPRPVAKAVPPRPPAAAEDGTPPVFTGEWPTLAANLPLKGLPQQLAYQSELTQVVGRTFNLRIPVAALGENGVAERLQQVLSDHFGVPVRVQCEIGAVSETAAAADAQARAERQREAEANIEADPFVQGLLRDFGGQIVPGSIQPRVA

SEQ ID NO: 90607 - protein, 187 aa, Bacillus cereus ATCC 14579
MLLIGTEVKPFKANAYHNGEFIQVTDESLKGKWSVVCFYPADFTFVCPTELEDLQNQYATLKDLGVEVYSVSTDTHFTHKAWHDSSETIGKIEYIMIGDPTRTITTNFNVLMEEEGLAARGTFIIDPDGVIQSMEINADGIGRDASILVNKIKAAQYVRNNPGEVCPAKWQEGSATLKPSLDLVGKI

SEQ ID NO: 90608 - protein, 397 aa, Clostridium difficile 630
MLTSLALIFLLGMASGGIFKRIKLPNLLGMLLTGIILGPYVLNLIDNSILDISSDLRKIALIIILTRAGLSLDINDLKKVGRPAVLMCFIPATFEIIGMIVLAPKLLGVSILEAAVMGAVVGAVSPAIIVPKMLKLMEEGYGTEKSIPQMLLAGTSIDDIFVIVMFTVFTGLAQGNSISAISFLQIPVSIILGVIVGAVIGICLAVFFKKVHMRDSAKGVLLLSISFLMISLETALEGIVPFSGLLAVMSIGIFLQIKYRVVARRLSIKYSKLWVGAEILLFVLVGATVDISYAFKAGIGAVILIFGVLLFRMVGVFFCLIKTNLTIKERLFCMIGYIPKATVQAVIGGVPLAMGMASGQLILTLAVLAILITAPLGAFGIDVTYKKLLTSVKGESK

SEQ ID NO: 90609 - protein, 162 aa, Glycine max
MFVLENGVKNKGEDPRLQAISQAIRVVPHFPKQGIMFQDITTLLLDHNAFKDAVDIFVDRYRDMDISVVAGVEARGFIFGSSIALGIGAKFAPLCKPGKLPGEVISEKYVLEYGTDCLEMHVGAVQQNERVIIIDDLVATGGTMSAAIRLLGDLHMQALLLR

SEQ ID NO: 90610 - protein, 391 aa, Oryza sativa
MQKTRRRRSMASKFVVGSSHGPQIRSPHSLDRAKMGGGSGVGDEEAEAEAAAAAEVTGRGGARGDVGGGGGGAGEAAAAVRTGGERRRRCGRVGGVEIPGGVGSQLAANSEVNDSVVPANSEVRLRFQVACLSGSVSTGMPALKGHSRGLLFSPQIPNLSSPKLSPTPMAGRYYTPQTHPPPPPENTLDVFMDGDTIPIHTTITSSHSLAAQFINEIARERPQGGLIVGIDTEWRTDHLPNGKTCYKVAVLQLCVGRRCLLFQIYQAGNMVPHELAEFLADPSVRFVGVAVNNDMQRLANDCNLRVACAVDLRYAAAAVLGQPELARAGLKRLALTVMGAHMEKEKNITKSRWGEPTLTWEQVNYACIDAYVSYEIGRRLLSGEPILAAPL

SEQ ID NO: 90611 - protein, 352 aa, Bacteroides thetaiotaomicron VPI-5482
MKQIKKLGLVVVTLLLSATMAFAAKPNIHILATGGTIAGTGSSATGTSYTAGQVAIGALLDAVPEIKDIANVTGEQIVRIGSQDMNDEVWLTLAKKINELLKRPDIDGIVITHGTDTMEETAYFLNLTVKSDKPVVLVGAMRPSTALSADGPLNLYNAVVTAAAKESKDKGVLVAMNGLILGAESVVKMNTVDVQTFQAPNSGALGYVLNGKVCYNQITLKKHTTQSVFDVTKLTSLPKVGIVYSYSNIEADMMTPLLNNGYKGIIHAGVGNGNIHKNIFPSLIDARRKGIVVVRSSRVPTGPTTLDAEVDDAKYQFVASQELNPQKSRVLLMLALTKTTDWKQIQEYFNEY

SEQ ID NO: 90612 - protein, 199 aa, Buchnera aphidicola str. Bp (Baizongia pistaciae)
MKLTKISEAKLPTSFGEFLMIVFEESKTDKNHIALVYGDIKDTNNSVLSRIHSECLTGDALFSIRCDCGFQLKSALMEIVKEGSGILIYHRQEGRNIGLSNKIRAYALQDIGLDTVEANHHLGFSADERDFSVCIDIFNTLNIKKIKLLTNNPSKVTVLNNAGIQITERISLIVGRNAKNSKYLNTKAHKMGHFLPIEY

SEQ ID NO: 90613 - protein, 557 aa, Arabidopsis thaliana
MATSSAWKLDDHPKLPKGKTIAVIVLDGWGESAPDQYNCIHNAPTPAMDSLKHGAPDTWTLIKAHGTAVGLPSEDDMGNSEVGHNALGAGRIFAQGAKLCDQALASGKIFEGEGFKYVSESFETNTLHLVGLLSDGGVHSRLDQLQLLIKGSAERGAKRIRVHILTDGRDVLDGSSVGFVETLEADLVALRENGVDAQIASGGGRMYVTLDRYENDWEVVKRGWDAQVLGEAPHKFKNAVEAVKTLRKEPGANDQYLPPFVIVDESGKAVGPIVDGDAVVTFNFRADRMVMHAKALEYEDFDKFDRVRYPKIRYAGMLQYDGELKLPSRYLVSPPEIDRTSGEYLTHNGVSTFACSETVKFGHVTFFWNGNRSGYFNEKLEEYVEIPSDSGISFNVQPKMKALEIGEKARDAILSGKFDQVRVNIPNGDMVGHTGDIEATVVACEAADLAVKMIFDAIEQVKGIYVVTADHGNAEDMVKRDKSGKPALDKEGKLQILTSHTLKPVPIAIGGPGLAQGVRFRKDLETPGLANVAAKVMNLHGFVAPSDYEPTLIEVVE

SEQ ID NO: 90614 - protein, 235 aa, Streptomyces avermitilis MA-4680
MRDLPSATVRTRVTVPLRFGDGYTVTGELVTFHGLADGQEHVAVVLGEPGPNPLVRLHSECLTGDVFGSARCDCGPQLREAVERIADRGGVLLYLRQEGRGIGLYNKLDAYALQDQGLDTYEANAALGLPEDGRDYTAAAQMLGALGIDALDLLSNNPDKAGQLRDLGLTVTDRVPTGVFTTAQNVRYLRAKVVHTQHTLPLTELTELTERAERAGLAKLTERTGLTEMTELTAG

SEQ ID NO: 90615 - protein, 309 aa, Oryza sativa
  misc_feature (218)..(218): Xaa can be any naturally occurring amino acid
  misc_feature (240)..(240): Xaa can be any naturally occurring amino acid
MGNSRRPAAAATAPSPSPPASDLEVGFAKLQGEDFEYYMQTYSIVLGRHSRRRNQPVGVGVGVGVGGGGGGGGDAAADDVDVDLGILGGGMNVSRRHARIFYDFPRRRFALEVLGKNGCLVEGVLHEPGGEPVKLDSQDLLQMGDAQFYFLLPTRSVFATDAARRASAAARRAVPPPPSSSSDGDDGEEEREAAVAKRPRNGDAGSLAGRKSEKGSKXYRQSDNLKFLQLEETDVISSTXMFEKYGDLWHHNRVRKYLTSEDWPKSETDGRPWHGLSLLLRKYPEHFVINIRMSGGRSIEFVSLVSLQP

SEQ ID NO: 90616 - protein, 233 aa, Bacillus subtilis
MQDSKEQRVHGVFEKIYKNYDQMNSVISFQQHKKWRDKTMRIMDVKEGAKALDVCCGTADWTIALAKAAGKSGEIKGLDFSENMLSVGQQKVKDGGFSQIELLHGNAMELPFDDDTFDYVTIGFGLRNVPDYLTVLKEMRRVVKPGGLVVCLETSQPEMFGFRQAYFMYFKYIMPFFGKMFAKSYKEYSWLQESAREFPGMKELAGLFEEAGLKNVKYHSFTGGVAATHIGWK

SEQ ID NO: 90617 - protein, 145 aa, Brassica napus
NYRLNMSDSEVRKLVAQKRWDELKNSDQLIRELRRGHVFDGWREGPIKFPPTYKYEFDSDRYAGENLKEGEKKRAPAWCDRILWLGKGIRQECYKRSEIRMSDHRPVTSIFNVGVEVFDQRKLQRALHVNNAAASAVHPEPAFSV

SEQ ID NO: 90618 - protein, 335 aa, Chlamydophila abortus S26/3
MKVVINGFGRIGRLVLRQFLKRNSSIEVVAVNDLVPGEALTYLFKYDSTHGRFPAEVSHENGCLVVDGRRIQLLAQSDVQKLPWKDLGVDIVIESTGLFTKKEDAEKHLASGAKRVLITAPAKGDVPTFVMGVNEHKFDPEKDLIISNASCTTNCLAPLAKVLLDSFGIEEGLMTTVHAATATQSVVDGPSKKDWRGGRGAFQNIIPASTGAAKAVALCLPELKNKLTGMAFRVPVADVSVVDLTVRLQKSTSYEEICKVVKEASEAHLSGILGYTDQEVVSSDFIGCEYSSIFDAGAGIALTDRFFKLVAWYDNEIGYATRIVDLLEYVAKNSK

SEQ ID NO: 90619 - protein, 130 aa, Triticum aestivum
MFARGIRAVSRRAAIAAPLARPTILPATRQIAPAVAVNSSRSYHEKVLDHYSRPRNVGSMNKKDADVGTGLVGAPACGDVMKLHCSMLAEDAIKSAISDYYTKNPNAKVSNLSGTGMKLPEADAPAAATA

SEQ ID NO: 90620 - protein, 141 aa, Chlamydophila abortus S26/3
MEQTLSIIKPDSVGKAHIGEIIAIFEKSGFRIAAMKMLHLSVKEAEGFYAVHKSRPFFQELVDFMISGPVVVMVLEGNNAVARNREIMGATNPQEAAPGTIRAQFGESIGINAVHGSDSLENAAIEINYFFSKVEIVNSAA

SEQ ID NO: 90621 - protein, 780 aa, Ostreococcus tauri
MDVEGGMLGGSRSDASSRAFTARPNSVTSRAHAFYARDPMRTKQILAVAAAVCFLLALRCSWTAAWVFVACAASLAFAAHLANWVMRLDEGSEDMRAVSDAIRDGADGFFTTQYGLISRLAVGVAGAIFFTYLFRATTREQQEAGVGAFSMALLTTVSFISGALCSGVSGYVGMWVSVRANVRVASSARHGAREALTVALRAGGFAALIVVGMTVMGVTVLFALYSFLFSVGSPGGMSVHEIPLMLVGYGFGASFVALFAQLGGGIYTKAADVGADLVGKVEQGIPEDDPRNPATIADLVGDNVGDCSARGADLFESIAAEVISAMILGATMSKSAGIDDATGFIMFPLRDVHSSRGSVQGAQGGYNVSISLAVVGFGLACRIMLASAKYPGAWFYFYLCGLIGIACAYAFVFIAQYYTDHQFPPVRVIAEASTTGHGTNIIAGVGVGMESTAAPVIVISIAIISAFWCGNSSGIVNAQGTPIGGLFGTAVATMGMLSTAAYVLTMDVFGPIADNAGGIVEMSEQPESVREICDELDAVGNTTKATTKGYAIGSAALASFLLFSAFMDEVSAFTGKPFDQVDIAIPEVFVAGLLGAALVYLFSAWSITAVGRSAQEVVREVRRQFSERPGIMTGEEKPDYARCVAIVAASALREMVRPGALAVLSPVAVGVIFKNLGVATGQELLGVKCVAAFLMFATVAGILMALFLNTAGGAWDNAKKYIETGAHGGKGSEAHKAAVSGDTVGDPFKDTAGPSIHVLIKMLATITLVMAPMFIDSTRA

SEQ ID NO: 90622 - protein, 345 aa, Rhodococcus sp. RHA1
MSAPAHRLIVDVDTGIDDSLALLYLLASPEAEIVGIASTAGNVPVEQVAANNLNWLALCGAPDIEVALGARVPLDCPLRTTEDTHGPQGIGYAVLPPSGRSLSERDATTLWVDLVRAHPGELTGLVTGPLTNLALAIREEPELPRLLRRLVVMGGAFNHPGNTTPTSEWNVSVDPEAAKEVFDAFSGLPAGRRPILCGLDVTETIEMTPDHVRRLAEAAGSTPAEIISPDDGPQVRSTASNPVIRHLSDAIRFYMDFHRTHDQGFLAHMHDPFAAAVALNPAITRTRPATVDVELHGRLTRGTTVADWVGHWNREPNVDIAVRTDPAAFFDDLVDRVGRFAKSVG

SEQ ID NO: 90623 - protein, 310 aa, Ostreococcus tauri
  misc_feature (1)..(1): Xaa can be any naturally occurring amino acid
XSECGERDGFILGAADLELVGVIGTGSGGVVRLATHKRTGEALAVKTIAISLARDENERKRIVTELRTLHKSECDYIVRSSGAYFDRGSVSLVMEYMDGGTMSDATKYLGKWVEQDLAAATSMLADGLHYLHTKLNVVHRDIKPCNVLLNLRGEAKLSDFGVSGHLTDASKCHSWVGTVTYMSPERIQGESYEYTADVWSFALTMVECALGRFPYNPPDVSRRLVFWDLLDIVVQDPVPNLRPELDVSDEFDNFVALGLNKDPTGRMLTKNMIAHPWIFGRDRASDKRRIAALAARHLDARSKARERGEK

SEQ ID NO: 90624 - protein, 1263 aa, Bacteroides thetaiotaomicron VPI-5482
MIGKEVLNYTIVSLIGKGGMGSVYLAEHKYIKQQKVAIKVINSDMVNDFTRQRLKEEAEHLASLNHQNIVRFHDYHIDELGSIYLIMEYADGISLDKYIQTVSGLIVEDKICPLFEPILDAVEYAHEHNIIHRDIKPANIIITKEGIPKILDFGIATIINRESVEKDDMVMGTPSYMSPEQVRGDHLDSRSDIYSLGVMLHQMLTGNAPYDTTTLTEYDINKKVVEEPLPRMRTYYKYVSDKVQKIVDKATAKEPGERYQTCDDFKKALHRVIYPPKIPKWVWTSVAAIVLLMIGGGVYFWDYNRTKVYYYKDYVEQWGVPQGIGELSSREMSHVNRLYRFEYKKHKLQRMSHVNSKENIIEDGESERNERPLDMLLYYTDKGNISRAKVLDRSGKVLYVKSYNDKLNTVIFQYDDEYGTEKTLGAQTIGYVRALEDNGVEKGKISRWLLEYDENGYVSTIRYAGFQNVLVGDAHNIYGRKYVRDEKGRVLSEHYLSFDGTPKATKWGLGMKKFYYDENDNWVKAEYLTVDGKPAYDDADGIGVYVMEYDKYGNVVYALHQDADGKLMLPKKNGVAGIKYIYDQHGFPIEASYLDIDRKACFIPNDGFSKVVRKFDDNGYIINQTFYDVDGNQCLSNDGNSSAKYINDNRGNVQEMWFYGLDGKLNEINEGYAGVKLNYDSIGNIIEYVTYGIDQKPCLKSDGTAGYKAEYNDMNLITKLVNIGVDLSPCKDNNGIVIAARDYDKRGNQIKVSFYDAGGKTLVLSNENIAGWNSVYDDNGNETERSFFDDKNNLTVCAGSCAKWISKFDEQGNETNLRYYNLSGKLMMVNGSAGANYKRDKRGNILEKIEIGTDEQLASGKLIARYKYDKFDNQIEFSVYDRNNKPALNSLDYHKYVCIYNSRNQRIEIEYYGKDGELTSYNNDKYAIQKDEYDERGYIVRTSYYGKDKQLVVSNEGWASSTREYDVLGNVLKQSFFGIDGKPTDPKVMVPEGLCRYDRWGNRIYLAAGDGKGHLIINPKTGWSIQKSEYNSRGKLLSEAYFDENEKPLISRMDGYHKAVISYTSSGNEKEKCYYDIMNKPMLCPDGYFKEVYEYNDNQQAISLSYLGVNGKSIDCKDGYSKIELTYNKDGEMESRKYTNASGRILLTQKWNGKEWVNSSPEPISRNWQQDVRKFNAELPIDFGENTKHLVASSFLVTGSNSCELSFKTPKSKYEMTEAEVNEYFASIKLVVTKIKSESLPSSVVITGILFDSKGRQLRSIRK

SEQ ID NO: 90625 - protein, 266 aa, Buchnera aphidicola str. Bp (Baizongia pistaciae)
MHPILNIAIRVARKCGNILIQYYDRNKTNNEKQILKKDFITKIIFVLEKTMIDMIHKSYPEHSIITYHKNNKIFKNTEIIWLINALDGIKNFENNLPHFCISIAIIVRKTTQISVIYDPIRNELFTSVKGQGSQLNGYRMRCKSTNTLKRSLVGLVYPCNNSKFQNYFFTIINLLFSHEVKLRCTGCISLDCAYVAMGRLDYLFNGNLIPLLFSSGSLQIKESGGLISDLNGGHDYVSSGIILIGNPKLMRVILVKIRELFQNNLK

SEQ ID NO: 90626 - protein, 314 aa, Haloarcula marismortui ATCC 43049
MSLVTFGETALRFSPPDVQRFETAREASIRVDGTASSVAATAGRLGADAQWLSKVPDTPLGRRVVAELHEFGLETEVVWADPDTGRQGLTFHEDADPPRAERLLQDRGDTAMATLTPGELPMGEIQNADVVFTSGATLSLSETAADTTGALLRAAAGMRAFDLGFHPGLWDAEDALDALADLLPAVDTLFAAEEQVSAVFDTTGSPREVVHTLATEYDLTRVILTRSEYGAVAYHDGVIHEQDAIETSAVDEAGQHEAFIGATLQQLAAGADTDEVLLHGVAAAALSRTLSGPLTPLEPSEVERLVDSQQSRRP

SEQ ID NO: 90627 - protein, 529 aa, Arabidopsis thaliana
MEAEKWNSDGGEYTSEDEGTEDYRRGGYHAVRIGDSFKTGRYVVQSKLGWGHFSTVCLSWDTQSSRYVALKVQKSAQHYTEAAMDEITILQQIAEGDTDDTKCVVKLLDHFKHSGPNGQHVCMVFEYLGDNLLTLIKYSDYRGLPIPMVKEICYHMLVGLDYLHKQLSIIHTDLKPENVLLPSTIDPSKDPRKSGAPLVLPTDKDNTVVDSNGDFVKNQKTGSHRKAKLSAQGHAENKGNTESDKVRGVGSPVNGKQCAAEKSVEEDCPSTSDAIELDGSEKGKQGGKKGSRSSRRHLVASADLKCKLVDFGNACWTYKQFTSDIQTRQYRCPEVILGSKYSTSADLWSFACICFELVTGDVLFDPHSGDNYDRDEDHLALMMELLGMMPRKIALGGRYSRDFFNRHGDLRHIRRLRFWPMNKVLTEKYEFSEQDANDLSDFLVSILDFVPEKRPTAAQCLLHPWINSGPRSIKPSLKDENSDKLDTEKNKRENEEQEAVEVKMGNVVISSLDSKPGMSQSSSTLKLAI

SEQ ID NO: 90628 - protein, 330 aa, Desulfovibrio vulgaris subsp. vulgaris str. Hildenborough
MKIAVLGGGSWGTALAHLLAGKGEDVRLWVRDPAVVEGVNRDHENPRYLKGLHLHEALRATCDAGEALEGADILLSVVPCQQTRTVLRSLRPRLKTGMVVVSASKGIETDGLRTVGEMVEDELAGLAPRYAVISGPSFAAEVVAGMPTAVVLGCADRDLGGTLREVFSTPTFRTYSCTDVRGVELGGAVKNVIAIAAGLSDGLGFGSNARAGLITRGLAEMGRLGVALGARGSTFMGLSGLGDLVLTCTGDLSRNRQVGLRLAEGQGLDAIVAGMGMVAEGVKTTEAVYELAQREGVDLPITQAMYAVLHDGRDPRDMVQELMTRELREE

SEQ ID NO: 90629 - protein, 325 aa, Saccharophagus degradans 2-40
MPNPSLLNLLTGDLPQLAATVQHQRLNWRVADEAGVAVYLRRDDAIHAKLSGNKLYKLHGHLQAYFESAHSKQPIASFGGAYSNHLYALAAAGQILGIPTIAVIRGERPKGAAPTLDDLEAMGMRLHFISRERYKLRNDQALLMALNLELGEPCFWVPEGGAGLLGNTGCQVLGASCSEFLQRVTPNESDAYVVMACGTGTTFSGVVNGVGPSVQVLGVPVLKVGGEYKAEIAAAIGANTRWKLLEDGHCGGYAKFPEYLLKFMVETELEVGVQLDPVYTAKMLYSLATAIKQGKFARGSHIVAIHSGGLQGRRSVEKQLMELYV

SEQ ID NO: 90630 - protein, 434 aa, Helicobacter pylori J99
MPLKSLKNRLNQHFELSPRYGSVKKIMPNIVYADGFNPSVGDVVKIEKSDGTECVGMVVVAEKEQFGFTPFNFIEGARAGDKVLFLKEGLNFPVGRNLLGRVLNPLGQVIDNKGVLDYERLAPVITTPIAPLKRGLIDEVFSVGVKSIDGLLTCGKGQKLGIFAGSGVGKSTLMGMITRGCLAPIKVIALIGERGREIPEFIEKNLKGDLSSCVLVVATSDDSPLMRKYGAFCAMSVAEYFKNQGLDVLFIMDSVTRFAMAQREIGLALGEPPTSKGYPPSALSLLPQLMERAGKEENKGSITAFFSVLVEGDDLSDPIADQARSILDGHIVLSRELTDYGIYPPINILNSASRVAKDIISESQNLCARKFRRLYALLKENEMLIRIGSYQMGNDKELDEAIKKKALMEQFLVQDENALQPFEQSFQQLEEILR

SEQ ID NO: 90631 - protein, 868 aa, Xylella fastidiosa Dixon
MSASPTVERWIVLKFGGTSVSRRHRWDTIAMVVRKRLEEHGTRVLIVVSALSGVTNELTAIAQGVVDSAQRVAALEQRHRDFLAELGLDAQAVLGTRFAMLSDLLQDARAVTRSLDWQAELLGQGELLSSTLGAAYLGASGVDIGWMDARDWLTALPPQPNQSEWSQRLSVSCQWKSDVEWRTRFDAQRAQVLITQGFISRHQDGGTAILGRGGSDTSAAYFGALLGAACVEIWTDVPGMFSANPKEVPDARLLTRLDYYEAQEIATTGAKVLHPRSIKPCRDTDVPMLILDTERPDVLGTRIDAEVEPVLGVKAISRRDGIVLVSMEGIGMWQQVGFLADVFTLFKKHGLSVDLIGSAETNVTVSLDPSENLVNTDVLTALSTDLSQICKVKIIVPCAAITLVGRGMRSLLHKLSEVWATFGKERVHMISQSSNDLNLTFVIDETDADGLLAVLHFKLIESGAMPVQDRAVFGSPWREIIGHVRTRVMPWWHSARMRLLAMRDEEGIGPCYVYHLPTVRERARQLNSVAAVDQRYYAIKANPHPAILRTLIEEGFGLECVSLGELRHVFAVVPHLVPSRVLFTPSFASRVEYEQAFLLGVNVTLDNVEALRLWPEVFRDRTLWLRIDLGYGDGHHEKVTTGGKTSKFGLSVKRIDEFIDVAKTLNITVTGLHAHLGSGVERGNHWSRMYDELAGFASRIGSVSTLDIGGGLPIPYRPDDEPFDVGAWGASLAEVKALHPKFQLVIEPGRFLVAEAGVLLTRVTQVIEKDDILRVGLEAGMHTLIRPALYDAWHGVENLSRLDETPHVLCDVVGPICESSDVFGRRRRLPAATASGDLMLIADAGAYGFSMASTYNLRGLPAEVVLDA

SEQ ID NO: 90632 - protein, 184 aa, Marinobacter sp. ELB17
MANVRSHKGSTPQFGERNWVDPSAVVIGDVTTGEDCSIWPMTVVRGDMHKIRIGARCSVQDGSVLHITHASDFNPGGWPLIIGDDVTIGHKALLHGCTVGNRVLVGMGCIIMDGAVVEDEVIIGAGCLVPSGKRLDSGYLYVGSPCKQARALTDKERGFFLYTASNYVKLKDEYLAEKANDYHY

SEQ ID NO: 90633 - protein, 267 aa, Pseudomonas putida GB-1
MSVPSFGLGTFRLTGQAVIDSVKSALALGYRVIDTAQIYKNEADVGQAIAESGVPRSELFITTKIWVDNYAADKLIPSLRESLEKLRTDYVDLLLIHWPAPGNGVELTEYMTALADAKKLGLTRQIGVSNFNIELTRQAIEVVGKGEIATNQIELSPYLQNSKLTAFLKEQGITVTSYMTLAYGKVLKDPALAEIAAKHKATVAQVALAWALQLGYAVIPSSTKRENLASNLLARDLKLDADDMARIATLERNGREVSPDGLAPIWD

SEQ ID NO: 90634 - protein, 434 aa, Aspergillus nidulans FGSC A4
MSNTTNSNGFRRESSEQDALLGDSRRNSAQHKREVHWTGWPAHVWHLTWATLSRDYVNVLLVFVPLGIIAGALKWDSTVIFTLNFLAIVPLASLLSFATEELAATLGQALGGLMNATFGNAVELIVSIIALKDKQIRVVQASMLGSILSNILLVLGCCFVVGGIKFPEQSFNTTVASTMSSLMTVSSASLIIPATLYASLSSAKDPSHKTENILFLSHWTAIILLVLYVIYLYFQLKSHAELFEEVNNQTTGDPEAAGEQVAEEEEEHLLNPWAASAALIVVTILVAICADYLVGSIDSIVEKTGMSRTFIGLVLIPIVGNAAEHVTAVVVAYKGKMDLAIGVAIGSSLQIALFVTPFLVILGWIMNVEMTLHFHIFETVAFFISGLVVTFLIQDGKSNYLEGCLCLGMYLILALAFYVYPDNVNEDALFHALK

SEQ ID NO: 90635 - protein, 510 aa, Arabidopsis thaliana
MTMISDLSKDLVEEILSKAPITSLGAVRSTHKQWNALSKGRLLYKAEAKDQFLGFMVMDHRFLSMIFHLNGILKGDGEGFDRPSIREVGDIVNQIDISKVFQCDGLVLCVPSDNSSVVVWNPYLGQTKWIEAREPHDESDMFALGYDKDKNHKILRLYDECYYYYEVYNFKTESWGEEDHLPGWDIDSYNRGVSLNGNTYFLTQEQRAKDKYRVFLLCFNFTTEKFENFIAMPFKYHRKYVGTLSCVGNEKLAALYQRWDTGEMAIWVTTKIESNEVLWSNLFKVDMKPLVRFGFQQCKDEAGSFFIDEEKKLAVVFNLDKKRGKRNNKTRCYHTAYIIGEKGYLKKEVLGEAVEVRKDVYRSALVCSSSYVPSLEKINQIEEEEEDKCKSIKMVDTKRQRKKRKRKSKSCFFIDEEKKLAVVFDLAESKRCKTANAYIIGDSYTELMVFSCYVPSLVQIDDPIARRDKRERNRKWMSKRKEKKRKGTNKQQGLTPMKKKQEVHLLLINR

SEQ ID NO: 90636 - protein, 549 aa, Chlamydophila abortus S26/3
MQSSEMKPFSRLRAYFCPIYRSEFPKFLPLFWLAFFVGFNYCLLKSMKDTLVVVGSDAGAEVIPFLKVWGIVPGAVIVTMIYGWLSNRCPRDTVFYSFIGTFLGFFFLFAVVIYPMGDAIHLHSVADKLQELLPQGLRGFIVMIRYWSYSLYYVMSELWSSVILSTLFWGLANEVTSIKEAGRFYALINTGLNLSSVLAGEISYWMGKHTFFVCPFVKDKWHEVMLNLTILIVLAGLSMIWLYRKVHLLTKHTYNFSAYSSSESITEGSSQVEESVASAKAKKKTKAKAKNLFLYLIRSRYLLGLAIIVLSYNLVIHLFEVVWKDQVSQIYSSHVEFNSYMSRITTLIGIVSVLAAIFLTGQSIRKWGWTVGALTTPIVMLVTGVLFFGAIFAVKKDVMIFGGLFNTAPLAIAAWIGGMQNVFSRAAKFTFFDQTKEMAFVPLPNDQKNLGKAAIDGVVSRIGKSGGSLIYQGLLIIFSSVAASLNVIAVVLLLIMIVWIAVVAFIGREYNIKEADAVAASSGADSMVSDMAISKTPGENSNQEEVAIL

SEQ ID NO: 90637 - protein, 472 aa, Sulfitobacter sp. EE-36
MNRIKTDLLIIGAGSGGLSVAAGASQMGADVVLLEGHKMGGDCLNFGCVPSKALIATGKAAYGQRHSADYGVSNAAGEVDYAAAKDHVADVIAQIAPVDSQERFEGFGVNVIREYGRFISEDEVQAGDTVIKARRIVIATGSSPLVPPITGLDKTPYETNETLFNLREKPEHLLIIGGGPIGMEMAQAHIRMGCKVTVIEGDKALSKDDPELAAIVLQTLKDEGIEIAEGAQAAEIRGDVGAIEVEAKDGRVFKGSHLLVAVGRKANTDRLDLEKAGIEPIKNGIKVDDSLRTTNRKVYAIGDVAGGMQFTHVAGYHGGVVIRSLMFALPAKAKTAHIPWATYTDPELSQVGLTEAQAKEKHGDKLEVVRFHYNHNDRAIAERKTKGLIKVMVVKGRPVGASIVGYQAGELINLWALALANNMKMSQIASMVAPYPTIGEINKRAAGAYFSPRLFESDLVKTVVRLVQRFIP

SEQ ID NO: 90638 - protein, 413 aa, Pseudomonas fluorescens PfO-1
MALIVQKFGGTSVGTVERIEQVADKVKKFRDAGDDLVVVLSAMSGETNRLIDLAKQISGEDQPVPRELDVIVSTGEQVTIALLAMALIKRGVPAVSYTGNQVRILTDSAHNKARILQIDDQKIRGDLKAGRVVVVAGFQGVDEHGNITTLGRGGSDTTGVALAAALKADECQIYTDVDGVYTTDPRVVSVAQRLDKITFEEMLEMASLGSKVLQIRAVEFAGKYNVPLRVLHSFKEGPGTLITIDEEETMEQPIISGIAFNRDEAKLTIRGVPDTPGVAFKILGPISAANIEVDMIVQNVAHDNTTDFTFTVHRNDYQSAQTVLENTAREIGAREVVGDTKIAKVSIVGVGMRSHAGVASRMFESLAKESINIQMISTSEIKVSVVIEEKYLELAVRALHTAFELDAPARQGE

SEQ ID NO: 90639 - protein, 322 aa, Physcomitrella patens subsp. patens
DLSRGFEAIPIPIVNHINSETLPSSFFYIDKSRPYEKAFVNLAISRIGDDDCCPNCHNDCLSAPYLCACARETGGEFAYTSDGCLHRRYIDQFLRIKKGLSAERKHYCESGFHCPHERHKNEENPTSCKGHPVRDFLKECSSKCGCSKQCGNRVVQRGISRKLEVYMTPEGKGWGIRTLEDLPAGAFVFEYVGEILTNTEMWERNNEIIRNGEGRHTYPVALDGDWGSEANLKDEEALCLDATYFGNVARFLNHRCLDANLMEMPVEIESPDRHYYHVAFFTNRHVKAKEELTWDYGIDFGDEEHPIPAFPCCCGSEYCRGK

SEQ ID NO: 90640 - protein, 450 aa, Chlamydophila abortus S26/3
MELQKAGQMIENDFQGYPSSYQVSHFYRDKVGVIVLCGGEGRRLSPLTCWRCKPTVSFGGRYKLIDVPISHAIASGFSKIFVIGQYLTYTLQQHLMKTYFYHGVLQDQIHLLAPEGRDGSQVWYQGTADAIRQNLLYLEDTEIEYFLVLSGDQLYNMDFRRIVDYALYAKSDMVIVAQPIQEKDASRMGVLQIDKDGNLLDFYEKPQEQEILNRFRLSPADCRRHKLDPQYGNFLGNMGIYLFRRESLFQLLLEEPGDDFGKHLIQAQIQRGTVKTFLYDGYWTDIGTIESYYEANIALTQRPRPHVRGLNCYDDRGMIYSKNHHLPGTIVSDSMISNSLLCEGAVIDSSKVSHSVVGIRGVIGKNSVIDHSVVMGNDRYGNTLQTPLGIGDNCEIYKTIIDENCRIGNGVKLTNIKGYKDYDSPDGKLVVRDGIIIIPRGTRIPNNYTF

SEQ ID NO: 90641 - protein, 358 aa, Triticum aestivum
MAVDLTPRQPAKAYGGEGGAYYEWSPAELPMLGVASIGAAKLSLAAGCMSLPSYSDSAKVAYVLQGKGTCGIVLPEATKEKVVAVKEGDALALPFGVVTWWHNTPGSATELVVLFLGDTSKGHRPGQFTNFQLTGASGIFTGFSTEFVGRAWDLKQDDAAKLVSSQPASGIVKLTAGQKLPVPVDADRKDMALNCLEAKLDVDIPNGGRVVVLNTANLPLVKEVGLGADLVRIDAHSMCSPGFSCDSAYQVTYIVRGSGSVQVVGPDGKRVLETHIEGGSLFIVPRFHVVSKIADASGMEWFSIITTPNPIFSHLAGKTSVWKAISPEVLEASFNTTPEMEKLFRSKRLDSEIFFAPN

SEQ ID NO: 90642 - protein, 413 aa, Ostreococcus tauri
MGRTRRDGAAATTVSATRRTRGEDGRGRRTRTHAGAYEAFKAGVSEEDRASIVGEWDKIMRWAAFVESAHARNDESVLKSAKKVAIMGGGSFGTAMATLLARNKGDLDVVILMRSDKDAASLNAEHRNLKYLPKYDLPVNIRATTDAREALSGSDFIIHAVPVQQSRAFLSGVKDFIDPKTPLLCLSKGLETGTCEMMSEIIPAGLGRDQPLAVLSGPTFAVELMQGLPTTIVAASEDEGLAIRVQQLFGSSCLRVNTSTDVTGVELSGAMKNVLAIAAGIVEGLELGNNAMASLVAQGVTEIRWLAGKLGARPETLAGVSGTGDIMLTCFVNLSRNRTVGVRLGSGESLEEILGSMSQVAEGVATAGAVVRLARRHRVNLPVLTAVACILDGDMDAKTAVDKIINLPQVPEV

SEQ ID NO: 90643 - protein, 483 aa, Rhodococcus sp. RHA1
MTIDNTEGARAQIGVTGLAVMGSNIARNFARHGHTVALHNRSIAKTDALIEEHGSEGDFVRTETIEEFVGALQKPRRVLIMVKAGDPTDAVIEELAAAMEPGDIIIDGGNALYTDTIRREASLRERGLHFVGAGISGGEEGALNGPSIMPGGPKESYAALGPLLESIAAQVDGTPCCTHIGPDGSGHFVKMVHNGIEYADMQLIGEAYNLLGSALGYDADKIADVFTEWNGGDLESYLVEITAEVLRQKDAKTGKPLVDVIVDAAEQKGTGRWTVKSALDLGVPVTGIAEAVFARALSGSREQRKAAVGLASGVLADKPTDAAQFTEDIRQALYASKVVAYAQGFDQIAAGSAEYDWDLHPADLATIWRGGCIIRARFLNRIKDAYDENPKLPSLILAPYFRDAIETAIDSWRRVVSTATLLGIPVPAFASSLSYYDALRAERLPAALTQGQRDFFGAHTYERVDAEGKFHTLWSGDRSEVQA

SEQ ID NO: 90644 - protein, 218 aa, Vibrio cholerae O1 biovar eltor str. N16961
MTQDEMKKAAGWAALKYVEKGSIVGVGTGSTVNHFIDALGTIKDEIKGAVSSSIASTAKLEALGIRVYDCNDVSELDIYVDGADEINPERDMIKGGGAALTREKIVAAIAKKFVCIVDGTKAVDVLGNFPLPVEVIPMARSYVARELVKLGGDPVYREGVITDNGNVILDVYNMKITHPKDLESKINGIAGVVTVGLFAHRGADVVITGTPQGAKIEE

SEQ ID NO: 90645 - protein, 632 aa, Rhodococcus sp. RHA1
MTNAVQTTSAPLEQTETETPDQNATVTFAEIGLPAPLVQALARNSITVPSPIQALAVPDALAGTNVLGRAQTGSGKTLAFGLPMLTRLSRHEDRPAPKRPRALVLVPTRELAFQVVDSLNSYAGAMGLTVRPAVGGTPFSKQVDQLRRGVDILVATPGRLNDHLRQGTCILDSIEITALDEADQMADMGFLPEVRAILGETRADGQRLLFSATLDREVQSLVRQFLPDHVQHSTEDGRASVDTMEHYVLLVDRGQKDNVLAEIGARDGRTIMFARTKLGCEGITDRLRAVGIAAEALHGGKAQNQRTRVLERFKNGRTPVLVATDVAARGIHVDGIDLVVHVDPPADHKDYLHRAGRTARAGEKGTVVAIVLPNQKRTFRRLTGMAGVDATAVPVTPGSEKLASITGAKAPSGEPVRDTYSRGERGGDRKFGDRGPRREGGYAGRDGGGYRGNRNDRGDRGERSFGDRPSGGRSFEGRGPRRDQTDNRSGGYRGDRPQRDGDNRGGGYRGDRDNRTFTDRAPRRDFGDSAPRREYGGGTTAPRRDFGDRGDSHRGTGERSFDRSAPRRDFGDNRGAAGGFRRDDRRDDRRDDRRPAATPERRPAATTGGGFRSRTERRSYDGFDGPRRERRS

SEQ ID NO: 90646 - protein, 125 aa, Brassica napus
  misc_feature (101)..(101): Xaa can be any naturally occurring amino acid
MAEVKDHLEIKFRLNDGSDIGPKSFPDATTVAALKETVVSQWPKEKENGPKTVKDVRLISAGRILENNKTVGDCRSPVSNLSDAVTTMHVLIQPQVTDKEXKTKKKPKGDLKQNNCVCLCFGRRL

SEQ ID NO: 90647 - protein, 480 aa, Haloarcula marismortui ATCC 43049
MQVVPVRDRVAAALETEGIINDVTAAILAVATFEFVIASQSSPVVVIEAFVARLAVGHVVGIAVGGGTALLLKRWHLSADNALQNARVVVLTAALLAYALGSMWLSEAGIAAAAIAGIVLGNAEIPHKEEVAGFKGGITLFVLSFVFIVLAAQLSLGDLRALGVGGLVVVIVVAALVRPLGVFLSTLGGRLTVRERMFVGGMGPRGIVPASVATLFAIELRPENPEAATVLVGTVFLVIFATVMFQGGLARHFAQALDILPMQTLIVGGGRVGRELAVRYESRGEEVVLIDSDEDTVERTRADGHRVVHGDATNATVLEEAGANRASVVVAATADDDVNLLVAQLATTRFDVDTVVARANQPDNVEAFEDLDVETISAGFAVADAIDDAVERPALAHWLSDSGRTGDVLEVELSNDSLVDRTIEETAEKLPNGYLVAMVSRNGTDRVPDSDFRLASGDHLTLVCETNEAMQDARRLCQGG

SEQ ID NO: 90648 - protein, 164 aa, Vibrio cholerae O1 biovar eltor str. N16961
MRHIISLLLENQPGALSRVVGLFSQRGYNIETLNVSPTDDETLSRLNITTKTDEMQLEQIQKQLHKLIDVLKVQEVTECEHIERELMLVKVKASGFARAEVKRTADIFRGQIVDVTASQYTVQLAGTSEKLDAFIEAIAEVTEVIEVARSGVVGIARGERALRA

SEQ ID NO: 90649 - protein, 280 aa, Listeria monocytogenes str. 4b F2365
MTLSFSDTYRLNNGIEMPRHGFGVYKLTDEARMRTALETAVDVGYRLFDTASFYHNEKELGDFFASSGLKRDEFFVTTKMWNTEQGYDETLRAFEKSQKKLQLDKIDLYLVHWPKQDTFFDTWRAVEKLYDEGLVRAIGVSNFEAHHLDRLRTSANVLPVVDQLETHPHFPNHLLHRYLEELHIVHQAWSPLGRGGVLQEQILIDLAEKYGKSPAQIVLRWHLQNNISIIPKSETPSRIRENAAIYDFELSEADMRQVERLNTGERVSHAPDVMYVRSEI

SEQ ID NO: 90650 - protein, 509 aa, Brassica rapa
MTSVNVKLLYHYVITNLFNLCFFPLTAIVAGKAYRFTIDDLHHLYYSYLQHNLITIASLFAFTVSGFGLYIARLPKPLYLVEYSCYLPPRHLKVSVSKIMDIFYQIKADTSSRNVACDDPSSLDFLRKIQERSGLGDETYSPEGLIHVPPRKSFAGSREETEKVIIGGIENLFENTKVKPKDIGILVVNSSKFNPTPSLSAMVVNTFKLRSNIKSFNLGGMGGSAGVIAIAIDLAKDLLHVHKNTYALVVSTEGITQGIYAEENRSMMFSNCLFRVGGAAILLSNKSGDRRRSKYELVHTVRTHTGADDKSFRCVQQGDDEDGKTGVCLSKDITNVAGTTLTKHIAICRPLILPLSEKFLFFATSVAMKLLKDKIKHYYVPDFKLAVDHFCIQPGGRAVIDELEKNLGLSPIDVEASRSTLHRFGNTSSSSIWYELAYIEPKERLKKGNKKGWQIALGLGFKGNSAVWVALNNVKASANSPWEHCIDRYPVKNDSDLSKSKHQVQNGRS

SEQ ID NO: 90651 - protein, 258 aa, Desulfovibrio vulgaris subsp. vulgaris str. Hildenborough
MSTSEDTLRTSPDTFDADSVTSKGAPQEHARQVSGMFGRIARWYDLLNHVLSGGLDLYWRYRLVRQVVPGPTGRVLDLAAGTLDVAREIHRQHPGMRVPALDFCEAMLRAGQPKLVDGVQDVIWPAVADGRRLPLADASVDCVTIAFGIRNIVPRREAFEEMLRVLVPGGRACILEFGTGKTPVWKGLYNFYLNTLLPLVGRCVSGDAGAYRYLADTIMSFPDADALAAEMHDAGFTRVYHLPLTSGIVRLHVGEKPL

SEQ ID NO: 90652 - protein, 272 aa, Arabidopsis thaliana
MAVPPLFFLLTLLSLPSLLISAGASNAYPSIPGTAPIDGGFTDELKPIRREVYGNGKIYDISHRYTPEMPSWDSSEGIGRFLWLAASMKNGSLANNSEMKIPTHTGTHVDSPGHVYDKYYDAGFDVDSLDLQVLNGLALLVDVPKDKNITAEVMKSLHIPKGVSRVLFRTLNTDRRLMFKKEFDTSYVGFMKDGAQWLVDNTDIKLVGIDYLSVAAYDDLIPSHLVFLKDRETILVEGLKLDGVKAGLYSVHCLPLRLVGAEGSPIRCILID

SEQ ID NO: 90653 - protein, 399 aa, Xylella fastidiosa Dixon
MFELSCNLISGGGIGVPGSQSETPPVTEPAILVLEDGTVFEGDAVGANGLSVGEVVFNTALTGYQEILTDPSYAYQLVTLTYPHIGNTGCTDQDDEANKVWAAGLIVRDVPRRPSNWRSQISLSDWLAARGVVAIAGIDTRKLTRILREKGAQHGALMAGEIDVGKAQDAARQFAGIKGMDLAKVVSTKQGYSWYEGQLDLDRNEFKRAAPQYEVVAYDYGVKLNILRMLAERGCDLTVVPAQTPADEVLALCPDGVFLSNGPGDPEPCDYAVAAIKTFIMRRVPIFGICLGHQLLAQAVGARVVKMSHGHHGANHPVQDLRSGRVMITSQNHGFAVDEATLPNNVRVTHRSLFDGTNQGIELLDVPAFSFQGHPEASPGPHDVDVLFDRFITMMAAQS

SEQ ID NO: 90654 - protein, 274 aa, Bradyrhizobium sp. BTAi1
MPTIIITGASDGIGAAAARQLKANGHNVVLVGRSKAKTEALARELNAPFHLADYTQLADVQRLAGELLDHGRIDVLANNAGGIMGQRALTSDGFEMTFQVNHLAPFLLTRLLLERLIASRAKVIQTASAAANIFGRNFDVDDLNNERGYTPQGAYGYGKLENILFTRELDRRHRADGIAAVSFHPGIVRSNFANDTTHLMRLFYHSPLKYLITISPERSAQRLTWLAESAPGTDWQLGECYSGRKPMPVAFKDDGTAARRLWEHSETFVKPWLG

SEQ ID NO: 90655 - protein, 447 aa, Oryza sativa Japonica Group
MLPQQQQQQKQQAAALMPPSMYAMPPPPPLHHHHHPLLAAAPPQQQGSAIWNSKTPFFFLLFGEYKSENLSDPNLCSVLILDQLILFEIGLQIEPILTGNLPPGFDTSTCRSVYVGNVHVQVTEALLREVFQSTGLVEGCKLIRKEKSSYGFVDYYDRRSAALSILTLNGKQIPEVTDSALFAFFSGYSSCSFIWILNCTTFWYLVMPELCGIKRLEDLEVMALFPSGINRYGQWLGSRQIRCNWATKGASNGEQQTSDSKNVADLTNNLTEDGKEKANEDAPENNPQYRTVYVGNLAHEVTQDVLHRLFHALGAGAIEEVRIQLGKGFGFVRYSNHAEAALAIQMGNGRILGGKPIKCSWGNKPTPPGTTSAPLPPPAAPSVTAADLLEYQRSLALSKMVSSQALMQAQAQQHLKQAMGMGAGVSQAMYDASFPNVGPSQQQLMYY

SEQ ID NO: 90656 - protein, 440 aa, Desulfovibrio vulgaris subsp. vulgaris str. Hildenborough
MNEQTSFDDIASGRTAVAVVGLGYVGLPLAVALARHFRVIGFDIQQNRVDELSSGHDRTGEVDDASLAATPALFTTDAARLGEAGVIIVAVPTPIDNHRNPDLGPVEKSSITVGRHMKAGCVVVYESTVYPGVTEEVCVPILERESGLVFGRDFTVGYSPERINPGDKVHTLETIMKIVSGSDAATADLLEKVYGSVVTAGIHKAASIKVAEAAKVIENTQRDLNIALMNELSIIFDRLGIDTLEVLEAAGTKWNFLPFRPGLVGGHCIGVDPYYLTFKAEELGYHPQVILAGRRINDGMGKHVAEMTVKRMIRSGCRVAGARVGVLGLTFKENVPDLRNTRVIDVVRELEEYGVTVLVHDPFADPAEAMHEYGLTLAHLKDFQQLDALVVTVPHDVYRAMDLVQVRRWCASSGTPPLLDVRGTFNPGTAREAGFDYWRL

SEQ ID NO: 90657 - protein, 263 aa, Aspergillus nidulans FGSC A4
MTLVKTPSNDQDYFERVTLLRQGNYLLSLMTVIRDELTTSNAFAAAFDRISDLLIAAGSVSKSRSYIRTYPTSTEITAQHSKFSKPADHLSIPIPALDLLPTERLTIRTPTGWTYEGRRQVKPVCGVSILRAGASFETALRRAYGENLSMGKLLIQRNEETSLPVHLYSKLPAGIAEQSVLILEPMLATGGSAIKAIDVLKEKGVCEEDIVFVNLVASKKGLETIMQRFPRLRLVTAAVDEALTVSNHIAPGLGDFGDRFYGT

SEQ ID NO: 90658 - protein, 385 aa, Mycobacterium avium 104
MKSRAAILHDVGGPWSVEEFELDPPRAGEVLVQMAAAGLCHSDDHILKGDMSAPNEVMRSLGLPTMFPTIGGHEGSGIVREVGEGVTDFAPGDHVVMSFVAVCGQCRWCASGMEYLCDVGIGTMIPGMPTDGTFRHHTAGGGNLGHIAKIGAFAEHTVVSTNSLVKIEQQLPLAPSALLSCAIPTGYGSAANRAGVCGGDAVVVIGAGGIGTGAIQGARISGAAQIVAVDPVEFKQKSALRFGATHSVATIAEALDLVRDLTYGVMADAVVVSPSLITADDVRDALKLTRKGGTCVLTGMTSQLTRSVNIELQDFILMNKTLAGTIFGSCNPRADIARLARLYQTGQLQLDEMITKRYRLDEVNDAYDDLLNGKIVRGIIDFGIA

SEQ ID NO: 90659 - protein, 292 aa, Zea mays
MEGKEEDVRLGANKFSERQPIGTAAQGAGAGDDDKDYKEPPPAPLFEPGELKSWSFYRAGIAEFVATFLFLYITVLTVMGVSKSTSKCATVGIQGIAWSFGGMIFALVYCTAGISGGHINPAVTFGLFLARKLSLTRAIFYIIMQCLGAICGAGVVKGFQQGLYMGNGGGANVVAPGYTKGDGLGAEIVGTFILVYTVFSATDAKRNARDSHVPILAPLPIGFAVFLVHLATIPITGTGINPARSLGAAIIYNRDHAWSDHWIFWVGPFIGAALAAIYHQVIIRAIPFKSRS

SEQ ID NO: 90660 - protein, 128 aa, Glycine max
  misc_feature (17)..(17): Xaa can be any naturally occurring amino acid
ASSMISSPPVTTINRAXAGMAATFTGLTSMAGSPTRNTNNDITYIASNSGRVHCMHVWPPDDKKNFETISYLPDLDDAQLAKEVKYLLRKGWIPCLEFELEHGFVFREHNKSPEYYDGHYCTMWKPPI

SEQ ID NO: 90661 - protein, 122 aa, Populus trichocarpa
MAAEDGQVIGCHTVEAWDEQLQRGNESKKLVVIDFAASWCGPCRVIAPFLAELARKLPDVIFLKVDVDELKTVAQDWAVEAMPTFMFLKEGKIVDKVVGARKDELQQAIAKHTAPAAATASA

SEQ ID NO: 90662 - protein, 348 aa, Streptococcus pyogenes M49 591
MLDAKDIKQDFQILNQQVNDEPLVYLDNAATTQKPALVLEALQSYYQEDNANVHRGVHTLAEHATHKYEASRQQVADFIHAKSSKEVLFTRGTTTSLNWVARFAEQVLTPEDEVLISIMEHHANIIPWQQACQKTGARLVYVYLKDGQLDMDDLANKLTTKTRFVSLVHVSNVLGCINPIKEIAKLAHAKGAYLVVDGAQSVPHLAIDVQDLDCDFFAFSAHKMLGPTGLGVLYGKEELLNQVEPLEFGGEMIDFVYEQEATWKELPWKFEAGTPHIAGAIGLSAAISYFQRLGMADIHAHEAELIAYVLPKLEAIEGLTIYGPSQPSARSGLISFNLDDLHPHDWQS

SEQ ID NO: 90663 - protein, 617 aa, Arabidopsis thaliana
MEFNCLPPTFITLRLMRRKLPFSMCCGYCLQASYSCLYFRKFLEVTPVLGYLAAGILIGPYGLSIIRNVHGTKAIAEFGVVFLLFNIGLELSVERLSSMKKYVFGLGSAQVLVTAAVIGLITHYVAGQAGPAAIVIGNGLALSSTAVVLQVLQERGESTSRHGRATFSVLLFQDLAVVVLLILIPLISPNSSKGGIGFQAIAEALGLAAIKAAVAITGIIAGGRLLLRPIYKQIAENRNAEIFSANTLLVILGTSLLTARAGLSMALGAFLAGLLLAETEFSLQVESDIAPYRGLLLGLFFMTVGMSIDPKLLLANFPLIMGTLGLLLVGKTILVVIIGKLFGISIISAVRVGLLLAPGGEFAFVAFGEAVNQVIIYMMISVFCFFTMGLVTAVFLGELDWYFFQGIMTPQLSSLLFLVVGISMALTPWLAAGGQLIASRFELQDVRSLLPVESETDDLQGHIIICGFGRIGQVLHKIGADRACAAAIALDTPGANYRCVWALSKYFPNVKTFVRAHDVDHGLNLEKAGATAVVPETLEPSLQLAAAVLAQAKLPTSEIATTINEFRSRHLSELAELCEASGSSLGYGFSRSTSKPKPPSPSETSDDNQIIEGTLAI

SEQ ID NO: 90664 - protein, 283 aa, Oenococcus oeni PSU-1
MSILDETFQLNNGNQIPKVAFGTWRLKDGDEAYQAVAAALKIGYRHIDTAFHYFNEPSVGQAIKDSGIKREDIFLTTKLPAEIKNHDDILKNFQESLDRLQTDYVDLYLIHAPWPWADINLDYRYDGANREAWQAMEEIYKSGRAKAIGVSNFDVHDLKNIQQIWSVKPAVNQIEFYVGWTQPKIAAYTKSLDIQLEAYSPLATGGLATQPDIQKIAEKYQVSVPRVALKYVLQKNVLPLPRATKAEHVKSNAELDFEISAADMEVLDKLPDTGQARHNVTMG

SEQ ID NO: 90665 - protein, 343 aa, Ostreococcus tauri
MSAAAQALQNLARAAVGLGVTATAVSQVIYDGACDGREGNDGREGSSRAAGTPRRRSSMRGNSTRATRVRANGAGREEWTARERDPRAMTRARGVRGGLTRRWRAVMFDRFRGVLPVVKGEGTHLMVPFIQNPTIYDVRTRAKSLTSVTGTKDLQQVNVTLRVLCRPDVDKLPKIHMELGQDYDDRVLPSIGNEVLKATVAQFNADQLLTQRQEVSNMVSQGLRKRAKDFGIILDDVALTHLSFSHEYTKAIEAKQVSQQEAERAVYVVKRSEQEREAAIIRAEGESESARLISLATKTAGPALVELRRIEASREIAQTLAKSRNVMYLPGSGANMLLGIGGQ

SEQ ID NO: 90666 - protein, 232 aa, Vitis vinifera
MPKRTTHTYSSEDAAPDGPESDLFVYYCKHCGSHVLITDTQLQKVPKRKTDRSYVLDKTKHLARLNINEAGKVLLKRGEGKLEKQFRMNCMGCGLFVCYRSEEDLESATFIYVVDGALSTVAAETNPQDAPVPPCISQLEGGLVQVAIEVEDRAQRSAITRVNADDVRVTVAAPAARGEANNELLEFMGKVLGLRLSQMTLQRGWNNKSKLLVVEDLSARQVYEKLLEAVQP

SEQ ID NO: 90667 - protein, 360 aa, Bacteroides thetaiotaomicron VPI-5482
MTNMDNYCVIMGGGIGSRFWPFSRKTLPKQFLDFFGTGRSLLQQTFDRFQKVIPTENILIVTNAMYADLVKEQLPELDEKQILLEPARRNTAPCIAWAAYHIRALNPNANIVVAPSDHLILKEEEFRAAIIKGLEFVSHSEKLLTLGIKPNRPETGYGYIQIDEPTGDGFYKVKTFTEKPELELAKVFVESGEFYWNSGLFMWNVNTIIKAAEILLPELVSKLAPGKNIYATDKEKAFIEENFPACPNVSIDFGIMEKADNVYVSLGDFGWSDLGTWGSLYDLSERDREGNVTLKSHSLIYNGKDNMIVLPKGKLAVIDGLEGYLIAESDNVLLICRKDEEHSIRKYVNDAQMQLGDDFI

SEQ ID NO: 90668 - protein, 333 aa, Buchnera aphidicola str. Bp (Baizongia pistaciae)
MTIKIGINGFGRIGRVLFRLAQLRSNIEILAINDLINVQYIAYMLKYDSIHGNFNGKIVIKNETLFVNGKKIRITNEKDPKNLMWGDLNIDVVIESTGIFLTTEDSYKHIQAGAKKVIITSPPKDNTPMFVRGVNFNEYVGQKIVSNASCTTNCLAPLAKVINDEFEIVEGLMTTVHATTATQKTVDGVSYKDWRGGRSALQNIIPSTTGAARAVGKVLPELNGKLTGIAFRIPTANVSVVDLTVRNKKIATYEDICQIIKYASNHDMKEVIGYTEDHVVSSDFNGNTLTSIFDAKAGLSLNNNFIKLVSWYDNECGYSSKVLDLSEFISTFS

SEQ ID NO: 90669 - protein, 363 aa, Vibrio cholerae O1 biovar eltor str. N16961
MTDRDYKIAVLPGDGIGPEVMAQAHKVLDAIEQKHGIRFSREEHDVGGIAIDNHGCPLPESTLRACEEADAVLFGSVGGPKWEHLPPNEQPERGALLPLRKHFQLFCNLRPAQIHQGLEAFSPLRADISARGFDIVVVRELTGGIYFGQPKGREGEGAHEKAFDTEVYHRFEIERIARIAFESARLRRKKVCSIDKANVLQSSILWREVVSEIAKEYPDVSLSHMYIDNATMQLIKDPAQFDVMLCSNIFGDILSDECAMITGSMGMLPSASMNESKFGLYEPAGGSAPDIAGKNIANPVAQILSAALMLRYSLGEEAAARDIENAVSQALAAGELTADLAGSKPALSTSAMGDKIASYILNS

SEQ ID NO: 90670 - protein, 410 aa, Buchnera aphidicola str. Bp (Baizongia pistaciae)
MNIINIFIPDLPESVTDATIIKWHKKKGDKVQEDTILVDIETDKVILEIPSPSDGILNSIIADKGKIVLPGQVIGTLLKIGIKNEEKIIKTTNNVVNTDNNQNINLKLLEKTYSPTVRRLISMHDLRDVDIIQGTGTKNRLTRKDILNYLKNIRSNTNKKINNYDLNAYNFNTTHKNHRSIKRVKMTRLRKKISERLLSTKNNTASLTTFNEVNMQSILNLRRKYGELFKQKHGIKLGLMSFYVKAVIEALKIFPEINASIDNDEIIYYNYFDISIAISTPRGLVTPVLKNADLMSMAEIEIKIKDFSEKGKNSKLTIDDLIGGNFTITNGGVFGSLFSTPLINPPQSAILGMHAIHKRPVIVDENIEVHPMMYLALSYDHRLIDGKESVGFLLKIKEFLEDFSRIVLNI

SEQ ID NO: 90671 - protein, 228 aa, Haloarcula marismortui ATCC 43049
MKQGGSDAAKQAAGESAAEAVEDATVVGLGTGSTAAYAIRAIGQAVDAGLDVVGVPTSFQSRQLARDCGIPLADLDDVSVDLAIDGADEVASGNLIKGGGAAHAREKIVDASADRFLVVADPTKEAAVLSYPVPVEVLPMARSTVVTAVEELGGDPTLRRAERKDGPVVTDNGNLVLDCDFNSIHDPAALASDLAALPGVVEHGLFVGMADEIHVGTADGVTVRTLSK

SEQ ID NO: 90672 - protein, 694 aa, Oryza sativa Japonica Group
MASSISSSSITYTLQTALVISSSLLVAADVGGGQSNNHYCPPSSCGDLHNISYPFRLQGDSRDCVAAPRPWYDLSCSNTGKATIQINTRTYYVSSINYTDLSFLVTDATMQDDDSSCPLPPSDHPPYSTDDLLDRTTTDSYGFLDLATSSDSAWACFVNCSRPIQDTTSPWYRPVSCLPTNNSFVYLNEFYGCTIGELQPSCRYLSMIPFDTQHISVSQLQNASYTDIIGFIGKGFRVRFPMDHSSLRPCLDGTKTYFNEHITGASIPNIARAIFWSELYFTRCRVAGHAYTTKFMTLMVIIVSAIVIIKFCKVLFRLMLAPLVVFIFLAHKYWKTRITIDAVEKFLQMQQMIGPMRYAYTDIIAITSHFRDKLGQGGYGSVYKGVLLPGNVHVAIKMLSGNSNCNGDEFISEVSTIGRIHHINVVRLVGFCSEEMRRALVYEYMPRGSLDKYIFSLEKCFSWDKLNEIALGIARGINYLHQGCEMQILHFDIKPHNILLDDNFVPKVADFGLAKLYPRDKSFVPVSAARGTVGYIAPEMISRSFGTISSKSDVYSFGMLLLEMAGGRRNADPNAANSSQAYYPSRVYKQLTRRETCEISDIVDMHELEKELCVVGLRCIQMRSSDRPTMSEVIEMLEGGSDDLQVPPKPFFCDDEQPLGVEPYHLSSDLTAISEAEEDDDDESISLFQSFSYQ

SEQ ID NO: 90673 - protein, 220 aa, Zea mays
MGQQSLIYAFVARGTVVLAEYTEFTGNFTTIASQCLMKLPASNNKFTYNCDGHTFNYLVEDGFTYCVVAVESVGQQIPIAFMDRVKEDFTKRYGGGKAATAAANSLNREFRLKLKEHMQYCVDHPEEVSKLAKVKAQVSEVKGVMMENIEKVLDRGEKIELLVDKTENLRSQAQDFRQQGTNVRRKMWLQNMKIKLIVLGIIIALILIIILSVCHGFKCH

SEQ ID NO: 90674 - protein, 232 aa, Buchnera aphidicola str. Bp (Baizongia pistaciae)
MKVYKLVLMRHGESIWNELNKFTGWHDVDLSNRGVQESLKAAKLLKKHGFYFDYAYSSVLKRSIHTLWNIIKFLDQSWIPVKKSWRLNERHYGALEGLNKDDVIQKYGNDKVQQWRRSFNIAPPKISYLEKKKLAHDSRYNNINFDILPYCESLKLTTQRVLPYWLNEIFPRFQKNTKIIIVAHGNSLRALIKYLNNINDIDILNLNIATGFPIIYEFNSEFKPIQYYYLKQ

SEQ ID NO: 90675 - protein, 285 aa, Oryza sativa
ASKPTFHIHAILLRLLLLLLLLGFIGPGNLAESIARGVAASGVLPATAIRTAPHRRPERAEAFSSIGAHILETNAQVVDDSDVIVISVKPQIVRQVLVELKPLLSEEKLLVSIAAGIKMEDLQGWSGHRRFIRVMPNTRSAVGQAASVMCLGEMATENDENRVRSLFSAIGKVWTAEEKYFDAVTGLSGSGPAYIFLAIEAMADGGVAAGLPRDLALGLASQTVLGAATMVNKTGKHPGQLKDMVTSPAGTTITGIQELEKGAFRGTLINAVVAATKRCRELSQS

SEQ ID NO: 90676 - protein, 252 aa, Buchnera aphidicola str. Bp (Baizongia pistaciae)
MKKKIIIANWKLNGNIQLLQTLLKPLVNFYIRHKNKSSIKLVIMPPYVYLYPMKSIISHSSILLGSQNVDINLIGAFTGEVSINMLKDVGVSYVLVGHSERRQYHRENDVIIAKKFKIVKDSHLIPVLCIGETEHEYLSCKTEKICKFQIDAIFDLLGPSGFNNSVIAYEPKWAIGTNTIPSINFIQKILMFIQNYIFNKQNSTIKLFSLQYGGSVNEHNIIELYDVKNIDGFLVGSASLSLDFFKKLLNNC

SEQ ID NO: 90677 - protein, 225 aa, Haloarcula marismortui ATCC 43049
MPIEQRGDASVVTHALARDELTRIRNVETEQVAFRKGLVRLGRICGYEIIDGRMETEYTEVQTPLTTTMGERVKGLEDVVIVNVLRAATPFVEGLLKAFPRARQGVISASRDEEAGMNDDGEFPISVEYVKLPEITEDDTVIIADPMLATGSTMATVLDYITSEKTEPENLLVLAAVSAPEGIVRVSEAQPDADIISVAIDDELDEDGFIVPGLGDAGDRAFRTT

SEQ ID NO: 90678 - protein, 335 aa, Arabidopsis thaliana
MMSIPMELMSIRNPNSTLLYRAHSRPPVKLCAPPRSLLPSRRHFSAPRAVVSYPGIRFGFTSPEVLLNRSVVAFAASHEDSGESGVEVGKEKSDIDVEDDTSKEAWKQTLESFKEQVSKMQSVSSEAYSVNSQKAMTVLKETSEQLRIQAEKAKEELGTKAKVVSEEGREYILKAAEESPSDVKEIVEAFASTEDLKNVSRANDFHVGIPYGLLLLVGGFINFMVSGSIPAIRFGVILGGALFALSLASLKSHRKGESSTKFLKGQMAIVAIIFLRELRLLLSQKSTFLGFFTTLTSGGVLGFYLYKMVVKREKGPTLEDGGEDESSDGFVRSEG

SEQ ID NO: 90679 - protein, 752 aa, Saccharophagus degradans 2-40
MPTETNQNTTQYDLFVSCSQGWEGLLQTELEQLAVGDVKPGHAGVYVSATLEQMYKICLWTRLATKVLLPLDSGPIETGDDVHTVASKVDWPSLMKPGASLKVDFIGTNDAVRNTQFGAQRVKDAVVDSIRHAGGERPNVEKMQPDVRIHARLHRDELHISIDLSGDSLHRRGYRQKQGGAPLKENLAAALLLRAGWPTIAEQGGALLDPMCGSGTLLIEGALIAYSIAPGLSRDKFGFECWTGHNADTWAQVVNDAKAIRDKNLQEKSFDIFGYDSDYYVTKAAEMNCEALGLQNVIHIANKPVEELKQPTHKVLVPGLVIVNPPYGERLGEVNELRTTYQILAHQVKQQFEGWTFAVFTSNPELAKETRLRANKKNKFKNGALPAELFVYSVLSADDAKLRKDKLTQAVQTDEDGQVENASGAWVRKNLCDKPLTEAATMVANRIKKNLKRLKKSVKQNDWHGYRVYDADMPEYSAAIDLYNDQVHIQEYAAPKTIDADKAEARFETLKHGAAVALQAPDNKLFVKTRKRNKGKAQYEKQTDTQGFDAERCIQVQEGNAKLWVNLQDYLDTGLFLDHRPLRMRIHKEATGKRFLNLFCYTATASVQAALGGATESVSVDMSNTYLEWADNNFRLNNVHLARHRLVRADCFDWLNKCREGFDLIMLDPPTFSNSKKMSDVLDIQKDQVRLISRCMDILNPGGTLYFSTNFRQFKLDEQISTRYVVENISAATIDEDFKGNPKIHYCWKIQH

SEQ ID NO: 90680 - protein, 121 aa, Physcomitrella patens subsp. patens
MAADHGNIHIVNNTVEWKTKLDEATSSGKIVVVDFTATWCGPCRMMAPIFADLSKKFEKLLFLKVDVDAVQEVTQEWEVRAMPTFLFIKDGKLLDKIVGANKDELEKKCNQYASQPVVATA

SEQ ID NO: 90681 - protein, 448 aa, Triticum aestivum
  misc_feature (415)..(415): Xaa can be any naturally occurring amino acid
SNLSARLPTQIAARNPAAQVSRRRLLQDSNLAAPPFANAPLPPSVPVPSTGSGSFSAFSPKAAPAVNPPVTPPKSPDTPSEAGSTRSMKWLYAILIPSIALLLIIIACMLLLCRNKSVATIGPWKTGLSGQLQKAFVTGVPKLQRSELEGACEDFSNIVASYPHYTVYKGTLSSGVEIAVVSTVLASSKDWSKHSEGRFRKKIDSLSRINHKNFINLLGYCEEEEPFMRMMVLEYAANGTLYEHLHVDGCARIDWNGRMRVIMGVAYCMQYMHELNPCITHPGLQSSAILLSEDGAAKIADMSVWQEVISKEKMPKNDDASEHHEPIRADPAGNVCSFGLLMLEIMSGKPPDSEHEGSLANLAMECIKDDRSISCLLDPTLTTHKENDLDIICELIEDCIQSDPKKRPSMREVTXTKWREVLAISPEAATPRLSPLWWAELEILSVES

SEQ ID NO: 90682 - protein, 210 aa, Triticum aestivum
  misc_feature (26)..(26): Xaa can be any naturally occurring amino acid
MVTDPGGVPAIRPRRSIRHTSAIRRXKITILGTRLDSLEGMLARLPPKSITDKELNKHRDTLSNLKSRAKQMAESFNMSTFANREDLLGQSKKAADDMNRVAGLDNQGIVGLQRQIMKEQDEGLEKLEQTVLSTKHIALAVNEELDLHARLIDDLDDHVDGTNSRLQRVQKRLAVLNKRAKGGCSCMSLLLSTVGIVMLVVIVWLLIKYL

SEQ ID NO: 90683 - protein, 380 aa, Oenococcus oeni PSU-1
MLNYRDLMVFLFATKEGIKIFKESRELKMKAAVVREKNDGFVDLIDDWKPRELGFGDALVDVEYCGLCHTDLHCASGDFGDPNTLGERNGDFRRVAGHEGVGIVSKLGEGADQYLKVGDRVSIAWFYDACGVCDYCVSGNETFCRKVRNSGYTVDGAMAQQVVVDAKYAVKVPEGLDPAQASSITCAGVTMYKSLKVGETKPGQWVSVHGAGGLGNLAVQYAHNVFGAHVVAIDGNPDKLEAAKEGGAEVLINRKQPGIDVAAEVQKDTGGVHNAQVTAVNDAAFKQAVDSLRPMGKLVAVALPQGDMELNIVKTVLDGIEVRGSLVGTRADLKEAFQFGAEGKVTPIVEKVDLNDINDVIEEMKEGTITGRKVFDFTHM

SEQ ID NO: 90684 - protein, 242 aa, Oryza sativa
  misc_feature (61)..(61): Xaa can be any naturally occurring amino acid
MSPSRSRSNSRSRSRSRSGSKSKSKSKSRSRSRSRSRSRSPRRERLRSERVSRRSRSRSRXRSPIRRREHRGHRHFAAECTSETVCWNCKQSGHIATECKNDALCHTCSKTGHLARDCPSSGSSKLCNKCFKPGHIAVDCTNERACNNCRQPGHIARECTNEPVCNLCNVSGHLARNCQKTTISSEIQGGPFRDITCRLCGKPGHISRNCMTTMICGTCGGRGHMSYECPSARMFDRGLRRF

SEQ ID NO: 90685 - protein, 474 aa, Shewanella oneidensis MR-1
MNMATDPTQISPLTELLQRQRASYLAAPNPDYAIRKERLTRLKTALLNYQQPLVEALSQDYGHRSTDDSLISDIMPVVNNINYSLKNLKKWLKPSRRHAGILLAPAQVKVHYQPLGVIGIIVPWNFPVMLSIGPLVTAIAAGNHAMLKLSEFTPATNKVIKQLLTEVFDESHVAIVEGEADVAAQFSALPFDHLLFTGSTTVGRHVMRAAANNLTPVTLELGGKSPVIIAPDMPLEIAVERMIYGKCLNAGQICVAPDYVLCPNAKVNDFIQAYQAKFLAMYGEVAKNKDYGSIINARQFDRLMAVLEDAKTKGAKIISASNEAIDSLNRKIPTQLITHTTEDMQLMQEEIFGPLLPIIGYDTLDEAIRYINLRARPLALYVMSFDEANQQKILQQTHSGGVCINETVFHVAADDAPFGGIGPSGMGHYHGKEGFLTFSHAKTVLSRGRFNTGKFVHPPYGTFIQRMLMKLFLR

SEQ ID NO: 90686 - protein, 271 aa, Triticum aestivum
MSDQTAAAAGAAGGDALFSRCLLALYVISPVTVFLLRFVSAPYGKLSRPGWGPAIPAALAWCAMESPTLWLPPLVSPLPLLLAAAASVSPLAALPPALYALHYFNRTVLHPLRILRLRRAAAPVPVLVAACAFGFNLLNAYVQARSWALHADRPASAFALPRCLAGLALFAWGMRVNVAADRELLRLKEAGGGYKIPRGGWFDAVTCPNYFGEIVEWLGYCLVAWSPAAWAFFLYTCANLMPRARDHRQWYLNKFGGEYPASRKAVIPCIY

SEQ ID NO: 90687 - protein, 460 aa, Bartonella henselae str. Houston-1
MNVNRENIFTKLGLSALLVKNLTIAGMSKPKPIQEQAIPMMLKGHDILGIAQTGSGKTLAFSLPILSQILALGDKRFPKTARALILAPTRELAVQIDETIRAVAKGTHLSTCLIFGGVSRLKQIKRMEAGVDILIATPGRLRDLIREKYVDLSQSRFLILDEADRMLDMGFIHDIRHIVKLLHQVRQTALFSATMPKEITTLAKCLLNDPVKIEVSPQGTTAAEIAQKLYCVPTCEKKNVLGKLLTNPDFVSVIVFTRTKYCADAVTRNLASRGYSVATIHGNKSQSARQSALKAFRERSVRILVATDIAARGIDIPGISHVINYDLPDEAESYVHRIGRTGRNGASGEALTLFDEGVEQMRLRAVERLICMRLVRETIPEQFAAFPEKPLVIEGIEKENIKGPHFRKSKRQKWFKSHKDNAAQSEGRKSSSQSERHRKAKAIAKRAKSFHSRKSVNKVA

SEQ ID NO: 90688 - protein, 421 aa, Bartonella henselae str. Houston-1
MSKFIQDVNKAMVALHNVFAETPLQRNDFLSQKYDAEIYLKREDLTPVRSYKIRGAFNFVSEMLSKISQNAAFVCASAGNHAQGVSFVCRYFKRKGVIFMPVTTPQQKIDKTRVFGKEFVDIRLIGETFDQCYAAAQSFATESGGVMAPPFDDTRIITGQATVLCEAVLQWKKLNGESEPDLILVPVGGGGLASGVSKFLHEYGWKTELRFVEPKRAASLFACLKSGKRVKLENIDTFVDGAAVAEIGALNYTMLKNFSPDSVITVPENRVCSTMVEMLNVEGVVLEPAGALSIDALNSLPPQELKGKKILLVISGGNFDFERLPDIKERSLRFQGLRKYFIFSFPQHPGALRSFLAQLSPDDDIVRFEYLKKSSRSFGSVLIAIETKKYDNFCLLEKKFQELGWRYRDITDDQTLFDFVI

SEQ ID NO: 90689 - protein, 577 aa, Bartonella henselae str. Houston-1
MLHDTPLITTIVAGLCLAFLLGMIASRLRISPLVGYLLAGVIVGPNTGGFRIDSGIINQLAEIGVILLMFGVGLHFSLKDLLSVKAIAIPAAIAQMAFSTFLGSCLGLIMGWGLSSSVVFGLALSTASTVILLRALQERHLIETEKGRIAVGWLIIEDLAMVLILVLIPSLANILGNTKKEAIDPLIQWLDLSIWGIFGLTILKVILFIILMLVIGRRVIPWLLKVSAHSGSRELFRLSVFATALGVAFGAAHLFGVSLSLGAFFAGMVMSESELSHRAAEESLPLRDAFSVLFFVSVGMLFDPGKILSHFFPLLATLFIIIIGKSAGAFFILKAFRYSNATACTISASLAQIGEFSFILAGLSLSLGLLNNDAHDFILGGAILSILVNPLIFIAFDKIKKHLENLPKNSQDTQKIIDIDPKDPDQEFLPMTSKTNHIVIIGYSRIGKCVALSLINRGDPVVIVEESKRLTDKAIADGFEVICGNIIKQDVMNAANMSNAYKVVITMCNTIEVGECIVNIRDMNKDIQIITHTLSDVDTAYLIDLGADIVVTDEEEIANGVIEHITGQRFIKNIAQS

SEQ ID NO: 90690 - protein, 753 aa, Glycine max
MGKSSKKSAIKVDAAPAVVPPSKSAKKGGKRQAQDEIEKQVSAKKQKIEEVAQKQKKEAKVQKKEAKVQKKKESSSDDSSESEEEKPAPKPVLSKKVPAKNGAALPKKDKPVSSSSEDDSSDEDEVNAKKPHKVVAEKQKNGATVQKNKKESSSDDSSSDSEDEKPVAKAAVPSKKTPAKSSNISTPAKKGKPASSSSSSDSSEDDSSDEDELATKKQMNEVKVQKGKEESSSDDSSSDSEDEKPAAKVAVPSKNQSAKNGTLSTLAKKGKPAASSSSSESSDDNSDEDEAPKTKVAPAAGKNGHASTKKTQPSESSDSDSSDSDSSSDEGKSKKKPTTAKLPTLPVAPAKKVESSDDESSESSDEDNDAKPAVTAVSKPSARAQKKVESSDSDDSSSDEDKMDIDDDDDSSDESEEPQKKKAVKNSKESSDSSEEDSEDESEEKPSKTPQKRGRDVEMVDAALSEKKAPKTPVTPREESGTSKTLFVGNLPFSVERADVEGFFKDAGEVVDVRFATDDTGKFKGFGHVEFATAEAAQNALGLNGQQLFNRELRLDLARERGAYTPNSSNWNNSSQKSERGQSQTIFVRGFDTSLGEDEIRGSLQEHFGSCGDITRVSIPKDYESGAVKGFAYVDFGDADSMGKALELHETELGGYTLTVDEAKPRDNQGSGGRGAGGRSGGGGRFGARGGGGGRFGARGGGGRFGGSGGGGRFGGSGGGRFGGRGGGGRGRGNRPNLAAEGTGKKTKFADDE

SEQ ID NO: 90691 - protein, 328 aa, Frankia sp. EAN1pec
MTAADGRLDTPDGPVTEPVAGTGAPAEPAAAESVAVEPAAVESAPATPAADGVEPAPKAVEPAPKAVEPAPKAVEPAPSGVESATSGARAERVRPATSAGAPAHRGAASKPFNDITHRVLKPPVRQVLNHLVMNVVHEGWENVPHGEPLIFAGNHSSWMDGPLVVIEAPRTVRCLVKSEMYKGILGRLLLFVGQIPINRGRPDRDALHTALDELSRGGAIGVFPEGTRGSGEMAAVQHGIAYLAVHGRCRVLPVACINTGAALPRGAKWPRRSVKVRVVFGKPFEVEVPANPRSRRALAAVAEDIRVRLADHLATVRAGESRDSSAAE

SEQ ID NO: 90692 - protein, 303 aa, Oryza sativa Japonica Group
MKVAVDQGSSGSVEAKRRREAKGRRRSGGGGGGGGGGGGGGGAVVRRTRRRVLLRTPEPAPLLKRLFAACRDVFRGPGTVPAPDDVALIRGILDKIGPGDVNLSAEHNFFKATDAAALPHPLAITRTTIYTCTNFSIVIFFLPPTAVIPLHNHPGMTVFSKLLLGSLHIKSYDWAEPAVFAAGSGDRLRLAEVVRDGGFSAPSDTLVLYPAAGGNMHQFTAATPCALLDVLGPPYSEDRDCTYYQDFPYSHCPSDDIAELRRHGGGMDDEQISRMRQLGWLKETAMPKDLEMYEMPYRGPPIL

SEQ ID NO: 90693 - protein, 1061 aa, Bacillus subtilis subsp. subtilis str. 168
MKETSPIPQPKTFGPLGNLPLIDKDKPTLSLIKLAEEQGPIFQIHTPAGTTIVVSGHELVKEVCDEERFDKSIEGALEKVRAFSGDGLFTSWTHEPNWRKAHNILMPTFSQRAMKDYHEKMVDIAVQLIQKWARLNPNEAVDVPGDMTRLTLDTIGLCGFNYRFNSYYRETPHPFINSMVRALDEAMHQMQRLDVQDKLMVRTKRQFRYDIQTMFSLVDSIIAERRANGDQDEKDLLARMLNVEDPETGEKLDDENIRFQIITFLIAGHETTSGLLSFATYFLLKHPDKLKKAYEEVDRVLTDAAPTYKQVLELTYIRMILNESLRLWPTAPAFSLYPKEDTVIGGKFPITTNDRISVLIPQLHRDRDAWGKDAEEFRPERFEHQDQVPHHAYKPFGNGQRACIGMQFALHEATLVLGMILKYFTLIDHENYELDIKQTLTLKPGDFHISVQSRHQEAIHADVQAAEKAAPDEQKEKTEAKGASVIGLNNRPLLVLYGSDTGTAEGVARELADTASLHGVRTKTAPLNDRIGKLPKEGAVVIVTSSYNGKPPSNAGQFVQWLQEIKPGELEGVHYAVFGCGDHNWASTYQYVPRFIDEQLAEKGATRFSARGEGDVSGDFEGQLDEWKKSMWADAIKAFGLELNENADKERSTLSLQFVRGLGESPLARSYEASHASIAENRELQSADSDRSTRHIEIALPPDVEYQEGDHLGVLPKNSQTNVSRILHRFGLKGTDQVTLSASGRSAGHLPLGRPVSLHDLLSYSVEVQEAATRAQIRELASFTVCPPHRRELEELSAEGVYQEQILKKRISMLDLLEKYEACDMPFERFLELLRPLKPRYYSISSSPRVNPRQASITVGVVRGPAWSGRGEYRGVASNDLAERQAGDDVVMFIRTPESRFQLPKDPETPIIMVGPGTGVAPFRGFLQARDVLKREGKTLGEAHLYFGCRNDRDFIYRDELERFEKDGIVTVHTAFSRKEGMPKTYVQHLMADQADTLISILDRGGRLYVCGDGSKMAPDVEAALQKAYQAVHGTGEQEAQNWLRHLQDTGMYAKDVWAGI

SEQ ID NO: 90694 - protein, 488 aa, Zea mays
MASQPPPPAAAAASGAPPPAQVVGNAFVHQYYNILHQSPELVYRFYQEASCLGRPAGTGADGMDTVTTMDAINDKIVSMGIDRAEIKAVDAQESLCGGVSVLVMGHLTGRNSVSRQFVQSFFLAPQEKGYFVLNDILRYVGEGGGDEGAEKQPAPEVAADAETTTSAPILANGTVGGDATTVPQDASPQPECQVAEPALNPKEEVLNGEVCNSLSDVEKPVAEETPVPDVINEVPNNVAVAPPISSPPVPLKEAPKKSYASIVKVMKEHRPLAPAVPSRPAPPITEKQASPAPTPVTEAPAFSPNPQSGGFQDPEVDAHAIYVRSLPLNATPQQLEEEFKRFGTIKHEGIQVRSNKIQGFCYGFVEFEDASAVQAAIEASPVTIGERQCFVEEKRTTGSRGGGSRGGRFPPGRGGNFRGEGIRGRGTYNGGRGYGRGEFSYRSDYGGRGGGRGGSLHGGDVGYQRVDYSGTSSGRGARAPSAAAAMAK

SEQ ID NO: 90695 - protein, 343 aa, Oryza sativa Japonica Group
MAATAAYLPLRAQAQVGLAPLRPSGSAAAGARLPGRTARRRLAARGGPEAAGIRAEAVPGGGGVARRAAMVPPYNVLITGSTKGIGYALAKEFLKAGDNVVICSRSAERVESAVTDLKKEFGEQHVWGIVCDVREGKDVKALVDFARDKMKYIDIWINNAGSNAYSYKPLVETSDEALMEVITTNTLGLMICCREAINMMRNQPRGGHIFNIDGAGSDGRPTPRFAAYGATKRSVVHLTKSLQAELQMNEVNNVMVHNLSPGMVTTDLLMSGATTKQAKFFINILAEPANVVADYLVPNIRAIPTNQSMKPTYIRFLTGLKAYSRIFSRIAFGARRNKYVAED

SEQ ID NO: 90696 - protein, 404 aa, Arabidopsis thaliana
MQSLTLTRYPTPISPPRLNLYPLRQIAASVLSAPTAGINRRDMASRHQSTSFKPLAVGRNLTGDDDDGYCTLIDFAGSGGGEGKNVGEDLVVLLYHLQHACKRIASLVASPFNSSLGKLSVNSSSGSDRDAPKPLDIVSNDIVLSSLRNSGKVAVMASEENDSPTWIKDDGPYVVVVDPLDGSRNIDASIPTGTIFGIYNRLVELDHLPVEEKAELNSLQRGSRLVASGYVLYSSATIFCVTLGSGTHAFTLDHSTGEFVLTHQNIKIPTRGQIYSVNDARYFDWPEGLRKYIDTVRQGKGQNPKKYSARYICSLVADLHRTLLYGGVAMNPRDHLRLVYEGNPLAFLVEQAGGKSSDGKRGILSIQPVKLHQRLPLFLGSLEDVAELESYGDVQQTVNPGYEV

SEQ ID NO: 90697 - protein, 372 aa, Rhodopseudomonas palustris CGA009
MKPRHARHKGGTELNQSKDQYRIAVIAGDGIGKEVMPEGLRVLEAAAKKHRVKLVFDHFDFASYDYYEKHGQMMPDDWKEKIGGHDAIFFGAVGWPAKIPDHISLWGSLIKFRREFDQYVNLRPVRLMPGVPSPLAGRKPGDIDFWVVRENTEGEYSSVGGRMFPDTEREFVTQQSVMTRVGVDRILKFAFELAQSRPKRHLTSATKSNGISITMPYWDERVEAVAKSYPEVKWDKYHIDILTAHFVLHPDWFDVVVGSNLFGDILSDLGPACTGTIGIAPSGNINPEGDFPSVFEPVHGSAPDIAGQGIANPIGMIWSGAMMLEHLGEKQAADSIVKAIERTLEERTLRTRDLGGQADTSACGKGVAEMVE

SEQ ID NO: 90698 - protein, 212 aa, Populus trichocarpa
MHSILNRIIMPESIDKHGVDWKNVDYLIFNTYIWWMNTFSMKVLRGSFDEGSTEYDEIERPVAYRRVLNTWSKWVEKNVDPNRTTVFFSSMSPLHIKSLDWENPDGIKCAKETAPILNVSMPLNVGTDRRLFVVAANITGSMKVPVHFLNITKLSEYRKDAHTSVHTIRQGKMLTPEQQADPETYADCIHWCLPGLPDTWNEFIYTRIISRT

SEQ ID NO: 90699 - protein, 428 aa, Sorghum bicolor
MQFSLASDANSGPHPIRRSCEGGGIDRLERLSIGGSKQEKALRNRCFGGRVAATTQCILTSDACPETLHFQTQSSRKSYADANHVSAIILGGGTGSQLFPLTSTRATPAVPVGGCYRLIDIPMSNCFNSGINKIFVMTQFNSTSLNRHIHRTYLGGEINFADGSVQVLADTQMPEEPDGWFQGTADSVRKFIWVLEDYYNHKSIEHIVILSGDQLYQMNYMELVQKHVEDNADITVSCAPVDESRASNNGLVKCDHTGRVLQFFEKPKGADLNSMRVDTNFLSYAIGDAQKYQYIASMGIYVFKKDALLDLLKSKYTQLHDFGSEILPRAVLEHNVQTCIFMGYWEDVGTIKSFFDANLALTEQPSKFDFYDPKTPFFTAPRYLPPTQLDKCKIKDASISDGCLLRECSIEHSVIGVCSRVSYGCELK

SEQ ID NO: 90700 - protein, 466 aa, Bartonella henselae str. Houston-1
MDYKQNSENNPKKKLQRGLHNRHVQLIALGGAIGTGLFMGSGKTISVAGPSIILVYAIIGCALYFVMRAMGELLLSNSRYRSLIDFSTDMLGPGIAFFVGWSYWLSWVVTGAADIIAIITYMHFWWPTLNSWIIVFSCVIFFLTLNLLAVKMFGELEFWFGLIKVLAILALIVVGFYMICTGFTSPNGTVASLSHVWNDGNIFPRGIPGFFAGFQIAIFSFGGIEIAGTTAAEVKEPKKVLPKAINAIPLRIVLFYIFSLVVIMSVTPWDQVVPEKSPFVSMFWLAGIPIAAGLINFVVLTSAASSANSGIFSTSRMIYGLATQKGAPRFFGKLSKYHVPANALFFSCLCILLGYTIASSSPSIISAFTIVSSIPAIAFLFVWSVILVSYIVYRHNHPHLHTESVYKMPGGVITCGIILAFFAFMLYLLTLESDTLTALKYSIFWFIFLGITYFMFIRKKTAQDNK

SEQ ID NO: 90701 - protein, 428 aa, Sorghum bicolor
  misc_feature (83)..(95): Xaa can be any naturally occurring amino acid
MQFSLASDANSGPHPIRRSCEGGGIDRLERLSIGGSKQEKALRNRCFGGRVAATTQCILTSDACPETLHFQTQSSRKSYADAXXXXXXXXXXXXXSQLFPLTSTRATPAVPVGGCYRLIDIPMSNCFNSGINKIFVMTQFNSTSLNRHIHRTYLGGEINFADGSVQVLADTQMPEEPDGWFQGTADSVRKFIWVLEDYYNHKSIEHIVILSGDQLYQMNYMELVQKHVEDNADITVSCAPVDESRASNNGLVKCDHTGRVLQFFEKPKGADLNSMRVDTNFLSYAIGDAQKYQYIASMGIYVFKKDALLDLLKSKYTQLHDFGSEILPRAVLEHNVQTCIFMGYWEDVGTIKSFFDANLALTEQPSKFDFYDPKTPFFTAPRYLPPTQLDKCKIKDASISDGCLLRECSIEHSVIGVCSRVSYGCELK

SEQ ID NO: 90702 - protein, 776 aa, Zea mays
MAFAHEQARGDAAGGATSSVVADASELRQRGSKGHKKPGTVAEDDDKESGRGAGAGAGAAGGCEVTVTDSIERVFEAEPVPPWPQQVTPRALVTSLFLAVLFSVIVMKLSLTTGIIPSLNVSAGLLGFFLLRVWTAAVKDPRRPFTRQENTVVQTCVVSAYGIAFSGTIRYGAADSCSALLPVPSLPLSLSVCLLGTGSGGFGSYLFGMSETIASQAAEENNAGNVKEPRLAWMIGFLFLVSFVGLFALVPLRKTEKSEKSKTDKKSETDKKALGFAFQVMIIDYRLTYPSGTATAHLINGFHTPDGSERAKSQVLTLIKSSVASFFWGFFQWFYTAGDGCGFGQFPALGLAAYQNRFYFDFSTTYVGAGMICPHTVNVSVLLGGILSWGLLWPLIAQKRGSWFDAKLPDSSLEGMQGYRVFIAIAIILGDGLYKFATVLLRTVASIAASTEKRKFFGALPVNGDGSNGAAAPAPPPSFDDARRTEFFTKGPDPGAGRHRRLEWYHVLAVYLMAPVLAFCNAYGMGLTDWSLASTYGKLAIFAFGAWAGKPHSGVLVGLATCGIMMNIVSTAADLMQDLKTGYMTLASPRSMFVSQVVGTAMGCVVGPSVFWLFYRAFPGVGTHRSAYPAPYALIYRNMAILGVDGFSKLPDNCLTLCCVFFVGAIAVDMARDMAPEKVAKFVPLPMAMAIPFYIGPYFAIDMFLGSVVLFAWEWVDKDQANFFAYAVASGLICGDGVWSLPQALLSLFNVKPPICMKFLSRHMNDKVDDFIATLS

SEQ ID NO: 90703 - protein, 479 aa, Buchnera aphidicola str. Bp (Baizongia pistaciae)
MIRRFRRTKIVATLGPSTDNHIILENMIKSGVNVFRLNFSHGTREEHIYRAKLVTSIAKRLNCHIALLGDLQGPKIRICKFQDKKVFLKVNNYFILDANLNENLGTSERVGIDYKNLPKDVKKCDILLLDDGKIQLKVINIVDQEIFTKIIIGGVLSNNKGINKLGGGLSARILTKKDKRDIITSIDIGVDYLAVSFPRYGSDLDHARKCAVKFGSKAKIIAKIERAEAVKDLKIIDEIILASDAIMVARGDLGVEIGESELAGIQKTLIRRARQLNRVVITATQMMESMINNPMPTRAEVMDVANAVLDGSDAVMLSAETASGKYPIETIKVMSKVCMGAEKMPSINVSQHRIHDKFHDIEEAIAMSAMYAANHLSGITAIITMTESGKTSLMTSRITSGLPIFALSSHIQTLKLTALYRGVTPIFFNSSKEGVSAANEVINLLVKRGFLEPGNLVIITQGDIMGKVGKTNTSRILKV

SEQ ID NO: 90704 - protein, 374 aa, Arabidopsis thaliana
MTMTAFLARRLIGNGSSQILGTSSSSSGPFISVSRAFFSSSTPIKATLFPGDGIGPEIAESVKQVFTAADVVIDWDEQFVGTEVDPRTNSFLTWDNLQSVLKNKVGLKGPMATPIGKGHRSLNLTLRKELNLYANVRPCYSLPGYKTRYDDVDLITIRENTEGEYSGLEHQVVKGVVESLKIITRKASMRVAEYAFLYAKTHGRKKVSAIHKANIMQKTDGLFLQCCDEVAAKYPEIYYEKVVIDNCCMMLVKNPALFDVLVMPNLYGDIISDLCAGLVGGLGLTPSMNIGEDGIALAEAVHGSAPDIAGMNLANPTALLLSGVMMLRHLKLNKQAEQIHSAIINTIAEGKYRTADLGGSSTTTDFTKAICDHL

SEQ ID NO: 90705 - protein, 490 aa, Buchnera aphidicola str. Bp (Baizongia pistaciae)
MKNKNSGYDLVIFGAKGDLSCRKLLPSLYQLEKKNKLCTHTRIIGVGRANWDKIIYTNVVYKSLIKFLNETIIESIWKKFSSRLEFCNLDINCLHNFKKLKQIIQQNNNIIINYLAMPPHTFGNICLGLESINLNLEPTRIIIEKPLGSSLKTSININNKIGKFFKEKQIFRIDHYLGKETIQNLLAFRFSNSLFYYNWNNKFIDHVQITVSETIGVEGRFNYFDTVGQIKDMVQNHLLQILTITTMSTPIDCHENSIRDEKVKILKSLRPFNINNIHKNVILGQYTSGIINQKKVKSYLDETNNQEYQMNKYTETFVSMKIYIDNDQWSGVPFYLRTGKRLPKKCSEIVIFFKTPPLNIFSKNYNTLSKNKLILSLQPNEAIKIYILNKKPKLTSQYKLDLITLDFNYSKFYKKIQLSDAYEKLLLESMKGIQSLFVRRDEVELAWKWIDSTLQCLHLKPRLPDLYPAGTWGPARSKTMINNDGYEWNE

SEQ ID NO: 90706 - protein, 125 aa, Physcomitrella patens subsp. patens
MAEEDDMPRDAKTVKTILESMGVTRFEPRVINQFLDLWYRYVVDVLGDAQTYAEHAGKAAIDCDDVKLAIQSRVNSSFQQPPPRELLVDLAKARNSIPLPKIIGTHGISLPPEADTLIYPNYQLN

SEQ ID NO: 90707 - protein, 148 aa, Oryza sativa
MGRIAWLPRSPRQLALAPSPINLSPRRTSCGESDRSASDMAASQRSVAVSAKCAAASWAEERRPFTDPIEIPAPSGAATARREDTEYGEGDYGGSGSGCGGEVVPPHVLLARRRAAFSMCSGQGRTLKGRDLRRVRDSVLRMTGFIES

SEQ ID NO: 90708 - protein, 366 aa, Frankia sp. EAN1pec
MTDGPQAVTVEAVVAVEKGAPVALTRIIVPPPGPGEARVRVQACGVCHTDLHYREGAINDDYPFLLGHEAAGTVESVGDGVTSVVPGDYVVLAWRAPCGTCRSCLRGAPWYCFDSRNAVNPMTLQDGTPLSPALGIGAFTPLTLVAAGQCVKVDPAVPPQAAGLIGCGVMAGFGAAVNTGRVTRGETVAVFGCGGVGDAAIAGASVAGARRIIAVDVDDRKLEWARGFGATHVVNSRNEDPVEAVRALTDGNGADVVIEAVGRPETYRQAFFSRDLAGRLVLVGVPDPSMTVELPLIEVFSRGGSLASSWYGDCLPTRDFPIIIDLHRGGRLDLAAFVTETVGIGDVERAFERMRRGDVLRSVVLI

SEQ ID NO: 90709 - protein, 375 aa, Methanosarcina barkeri str. Fusaro
MTQYKIPVLPGDGIGPEIIAEGRKVIDAAGERFGFDVEWIEYPQGADHYLETGELISEDTLKELSGYPAIYLGSIGDPRIAPGVLEKGILLTARFYFDEYVNLRPIKLLDGVWTPLKDKTSKDIDFVVVRENTEDFYVGVGGRAKKGASKDLLEVKRTLYSAKFGLDIETDSEEIGYQIGLISKEGTDRVIEYAFDLAENRRKHVSSVDKANVLSDIYGFWREEFNAISAKHPGVTTDFNFVDAVTMWFVKNPEWFDVVVTPNMFGDIITDLGAMIQGGLGLAPGGNINPTGTSMFEPIHGSAPKYKGQNKVNPIATIWAGAMLIEHLGEKEAADTIVNAIQKNILDSKVKTYDMGGKSTTSDVGDDIARIIKGE

SEQ ID NO: 90710 - protein, 211 aa, Xylella fastidiosa Dixon
MKLTVPTWLTLLRIVMIPVLIVVFYLPYQWSNIVATGVFAIAAITDWLDGWIARRYAQHSLLGAFLDPVADKLMVAIALFLIVQGHPTPSMAFWAAVIVSREIAVSALREWMAEIGHRAKVRVAVLGKVKTTAQMIAVLCLLYSVTPEKKAIHQIWFGHLIFQVGYWTLLISALLTLWSGFQYLRAAWPSLRTGKPVVIKTHISKNRKINS

SEQ ID NO: 90711 - protein, 284 aa, Lactococcus lactis subsp. lactis Il1403
MITLKSQREIEQMERSSKILADIHIGLRELIKPGIDMWEIEEYVRKVCKEKNVLPLQIGVDEGNYNPFPYATCCCLNDEVAHAFPRHQILKDGDLIKVDMVLGLVEDGSVDVSKLNFDDAESMVKYQEEFRGGVADSCWAYAVGQVSDEVKNLMDVTRECLYLGIEQAKVGNRIGDIGAAIQEYAESRGYGVVRDLVGHGVGPTMHEEPMVPHYGRAGRGLRLREGMVLTIEPMINTGGWEIDHDGERGYVTLDGSLSCQYEHQFVITKDGPVILTSQGEERTY

SEQ ID NO: 90712 - protein, 119 aa, Vitis vinifera
ADGMNFADIEKAINTLARKANDGTISIDEMAGGSFTISNGGVYGSLLSTPIINPPQSAILGMHSIVNRPMVVGGNVVSRPMMYIALTYDHRLIDGREAVFFLRRIKDVVEDPRRLLLDI

SEQ ID NO: 90713 - protein, 262 aa, Streptococcus pyogenes MGAS315
METKYAFARQIIKEAGLFIKSKMSEQLDIQVKTQFDDLVTNVDQETQQLLMDRIHQTYPCDAILAEENDVRHPINQGNVWVIDPIDGTVNFIVQGSQFAVMIAYYEQGIGQFGLIYDVMADQLLAGGGDFEVTLNGDKLPAYQEKPLERSLIGCNAGMFARNDRNLAHLIAKTLGVRVYGGAGICMVKVMKQELLAYFSFIQPWDYAAAKVLGDKLGYVLLTIDGYEPDFQTRQKIMFVPKCQLTRIASFLTKDSAVTLEDQ

SEQ ID NO: 90714 - protein, 271 aa, Sporobolus stapfianus
NEVEEEGEEFAAYCRRGKGRRRVEMEDRHVAKVALGGDPKAALFGVFDGHGGKNAAEFAAENMPKFVAEEMTKADGGESEIEGAVKRGYLKTDEEFLRRGESGGACCVTAVLQKGGLVVSNVGDCRAVLSRSGKAEALTSDHRASREDEKERIENLGGFVVNYRGTWRVQGSLAVSRGIGDAHLKQWIVADPDTRTLLVDQHCEFLILASDGLWDKIDNQEAVDLARPLCTSNDKASRMAACRMLVETSISRGSTDDISVVIIQLQNFSSS

SEQ ID NO: 90715 - protein, 604 aa, Candida albicans SC5314
MTSYQSSNNHSSEEDKHLSGDEKTFSPSDIVEKAIVEEKSIGVEKAEILANQWKHTFWFKLLLGFSAFLCGYAYGLDSQTRYVYTAYATASWSEHSLLTTVNAITGVVAAASQPVYARLSDVLGRLELFIVAVLFYVVGTIIECQSPTINAYVAGAVLFQIGYSGIIIMLLFILSDFSSLRWRLFFTLCPSFPFIINTWISGNVTAAVGTRWKWGIGMWAFILPLSCIPLVCCMIHMRWLAGKTEEWRVFKQRKTKFQELGVAGFSKYLFWRLDVIGLLLLTVSLGCLLVPLTLAGGIKETWKKAHIIVPIVIGGVLIPVFLLWEGYGARDPIIPLHLMKDRGIWSVVSISLFFDFVFAVESNFLYTVLMVAVNESQSSATRIASLSSFVSVVTGFIFGLFVVYFRRLKGFVVFGCAMWMVAFGIMYHFRSQLHAHAGIIGGMCLMGFGTGFFSYPINVSAQSCVSHEHMAVISSALYTTYRIGYAVGSSVAGAIWSQMLYSRLVKYLGDSTLATSVYTDPYTFIAQYVWGTPEREAAVKAYGEVQRVLMSVCIAFVAPMIVSALFMRDHKLTNEQSLEDVEKQEEKDSLANFFGNFKKKRVAV

SEQ ID NO: 90716 - protein, 450 aa, Arthrobacter nicotinovorans
MLATLASATSEDAVAALEAACAAQTSWARTAPRVRAEILRRAFDLVTARSEDFALLMTLEMGKPLAEARGEVAYGAEFLRWFSEETVRDYGRYLTTPEGKNKILVQHKPVGPCLLITPWNFPLAMATRKVAPAVAAGCTMVLKPAKLTPLTSQLFAQTMMEAGLPAGVLNVVSSSSASGISGPLLKDSRLRKVSFTGSTPVGKRLMSDASRHVLRTSMELGGNAPFVVFEDADLDKAVEGAMAAKMRNMGEACTAANRFLVQESVAQEFTRKFAAAMGALSTGRGTDPASQVGPLINNGARDDIHALVTAAVDAGAVAVTGGAPVDGPGYFYQPTVLADVPNNAAILGQEIFGPVAPVTTFTTEQDAIKLANASEYGLAAYLYSRDFNRLLRVAEQIEFGMVGFNAGIISNAAAPFGGVKQSGLGREGGSEGIAEYTTTQYIGIADPYEN

SEQ ID NO: 90717 - protein, 276 aa, Rhodopirellula baltica SH 1
MNLEMQLTGLTVIGGGQMARALVGGMLESGCLKASELTIVHKTKSTGEWWSSKYSECTTTTDTVEAVAGAKVVMLAVKPHIIAEVLAVKNSAGKSADWSGKLIVSIAAGIGLDKLIDGVGHDRVVRVMPNTPSLVGEGASGFCVSGGVSDDDVQLIETMLNSVGIAAQVTEPQMNGVTGVSGSGPAYVFLIIEALADGGVAAGLPRATALQLATQTVLGAAKMVRETGEHPGFLKDNVCSPGGTTIAAMSVLEQNAVRGAMIQAVQASANRSRELA

SEQ ID NO: 90718 - protein, 149 aa, Oryza sativa Japonica Group
MEQSFIMIKPDGVQRGLIGDIISRFEKKGFFLRGMKFMNVERSFAQQHYADLSDKPFFPGLVEYIISGPVVAMVWEGKDVVATGRRIIGATRPWEAAPGTIRADYAVEVGRNVIHGSDSVDNGKKEIALWFPEGLAEWRSNLHPWIYES

SEQ ID NO: 90719 - protein, 542 aa, Zea mays
MGLRVAATAPAPAGVRVLGRGAARVTPRPWAAVGGRRRFSVRMSVATTEATTTIAVGASEDQALEARNSKTVVAVILGGGAGTRLFPLTRRRAKPAVPIGGAYRLIDVPMSNCINSGINKVYILTQFNSQSLNRHLSRAYDFSNGVAIGDGFVEVLAATQRPGTEGKRWFQGTADAVRQFDWLFDDAKSKDIEDVLILSGDHLYRMDYMDFVQSHRQRGAGISICCLPIDGSRASDFGLMKIDDTGRVISFSEKPKGDELKAMQVDTTVLGLSKEEAENKPYIASMGIYIFKKDILLNLLRQKGIRILHFMFKYSIQLTAQLLVYLKPDYIIVSKRNRCKGTSAYLFNDYWEDIGTIKSFFEANLALAEQPPRFSFYDADKPMYTSRRNLPPSMVNNSKITDSIISHGCFLDNCRIEHSVVGVRSRIGSNVHLKARSLPLLPGVFHYTDIEKQDTVMLGADYYETAVERGELLAEGKVPIGIGENTTIQKCIIDKNARIGKKVVISNSEGVDEADRTSEGFYIRSGITVVLKNAIIADGLVI

SEQ ID NO: 90720 - protein, 609 aa, Candida albicans SC5314
MSISASKAKREQKRLEREAKKAAVGKSTKKTKKQAEKDAAEDEVEGAEEQIAKMKLQTDEHGLSDRVTTGVLESLETSRDIKLSSVSLLFHGKVLIQDSTLELNYGRRYGLLGENGCGKSTLMKSIAAREFPIPEHIDIYLLNEPAEATEYSALEYVVREAEHEMKRLEDLVEELIVKEGPECPALEGLYEKIDEMDPSTFESRAAIILTGLGFNSVTIKKKTKDMSGGWRMRVALAKALFVKPTLLLLDDPTAHLDLAACVWLEEYLKRFDRILILVSHSQDFLNGVCTNMIDMRLKLLTTYGGNYDSYVKTRAELETNQMKQYNKQQEEIAHIKKFIASAGTYANLVRQAKSRQKILDKMEADGLIQPVVPDKVFTFRFPEVEKLPPPVLAFDDMSFSYSGKPEDNLYEHLDIGIDMDSRVALVGPNGVGKSTLLKLFQGKLQPQTGRVIQHTHIKLGVYSQHSADQLDLTKSPLEFVRDKFANISQDYQYWRGQLGRYGLSGEAQTAQMATLSEGQRSRVVFALLALEGPNLILLDEPTNGLDLGTIDSLADAINAFNGGVVVVSHDFRLLDKVAKDIFVIENKTATRWNGSILDYKKSLASKVVL

SEQ ID NO: 90721 - protein, 378 aa, Frankia sp. EAN1pec
MSAGRRLVVEADGGSRGNPGPAGYGALVRDAGTGQVLAERAASIGTATNNVAEYEGLLAGLRAAAELDPGADIEVRMDSKLVVEQMSGRWKIKHPSMRPLAAQAAEIAAGLGRVRFVWVPRARNGDADRLANEAMDAAAAGRSWEPSVPQSPDPLPHQAPTTNRLSGWMAPPAPPTTTVLLRHGQTPLSVEKRFSGTVEASLTDLGLEQAAAAADRLRGEPFDAVISSPLKRARQTADALGRDYLIDEDLRETDFGAWEGMTFAEVRERFPDELNAWLADPAVPPPGGESLLSTGARVAAARDRIMAQYPAGRVLVVSHVTPIKGLTQLALAAEPTVLYRLHLDLVSITTVDWYSDGPAVLRGFNDTHHVAHLVIPGE

SEQ ID NO: 90722 - protein, 429 aa, Magnetospirillum magnetotacticum MS-1
MFDPTERGTAIDIEVNERLRRTLALILAGGRGARLMDLTDWHAKPAIPFAGKFRIVDFTLSNCINSGIRRIGVLTQYKAHSLLQHIQRGWGFLRGEFNEFIELLPAQQRTQGEDWYKGTADAVFQNLDIIRAHRPEHVLILAGDHVYKMHYGKMLAHHLAAGADVTVGCIEVPLETAKGFGVMAADEDDRVIRFDEKPANPQPMPGHPDQALASMGIYIFNYQLLHDLLIKDSTSAETSHDFGKDIIPALVKSHRVIAHHFQDSCVMHEGAREHYWRDVGTIDAYWEANIDLTTVTPALNLYDESWPIWTDQPQSPPAKFVFDSEHRRGMAVDSLVAGGCIVSGAVVRRSMLFSNVRVNSFCVVEDAVILPNVDIGRHARLKRCIVDQGAVVPPGLVVGEDAALDASRFHRTEKGITLVTAERLKLLGA

SEQ ID NO: 90723 - protein, 249 aa, Haloarcula marismortui ATCC 43049
MERSDSSADTDRSLLRQLLKPVLAFVGLVVAGVAGFVTFGGVGVVNALFWLLDPTSIELHFQSHDGPARLVKGYAIVVLTGLVVAGLWTGETALSAAFGGQIQTELTRMQIAQRIKELDDHVVVCGYGTFGQTVAEQIDDTDTRVVVIEQQMEQYERALDDGHLALEADASREDALTDAGVKRADTVIGAIDDTNANIQIAVLASQLAPTVHLIVRAGDRQDETVARRVGADEVIIPEVVSGKQVCERL

SEQ ID NO: 90724 - protein, 163 aa, Oceanobacter sp. RED65
MRRIISILLENEPGALARVVGLFAQRSYNIETLTVAPTEDESLSRMTITTTGPDRVIEQITKQLNKLIAVVKLVDLTEGAHIERELMLIKVKASGAQRAEIKRTADIFRGQIVDVTSNVYTIQLTGSTDKLEAFIDAIGENCILETVRTGVSGISRGEKTLSL

SEQ ID NO: 90725 - protein, 309 aa, Fusobacterium nucleatum subsp. nucleatum ATCC 25586
MSKKSTRQAYGEALVELGRINNDIVVLDADLSKSTKTDLFKKEFPKRHLNIGIAEADLMGTAAGFATCGKIPFASTFAMFAAGRAFEQIRNTIAYPKLNVKIAPTHAGISVGEDGGSHQSIEDIALMRAIPEMVVLCPCDAVETKKMVFAAAEYNGPVYLRLGRLDVETVLDDNYDFQIGIANTLRDGSDVTIVSTGLLTQEALKAAEELAKENISVRVINCGTIKPLDGEIILKAAQETKFIITAEEHSVIGGLGSAVSEFLSETHPTLVKKLGVYDKFGQSGKGAEMLEKYELTAAKLISMVKENLK

SEQ ID NO: 90726 - protein, 343 aa, Zea mays
  misc_feature (113)..(117): Xaa can be any naturally occurring amino acid
  misc_feature (188)..(189): Xaa can be any naturally occurring amino acid
  misc_feature (228)..(229): Xaa can be any naturally occurring amino acid
MANSAAPGGVRSFLQAVSTVTEETPTPLRVVQMEGLAVLKIIKHCEEFAPALVTGQLLGLDVGSVLEVTNCFPFPMREEDDEADADGANYQLEMMRCLREVNVDNNTIGWYQXXXXXSFQTVELIETFMNYQESIRRCVCIVYDPSRSSQGVLALKALKLTDSFMDLYRNNGLTCCRLREKKLSWVDXXEEIPIKVSNSALVSAFMKELEPESPVTQCDLDRLKLSTXXFMERNLEFLIGCMDDLSSEQNKFQYYNRNLSRQQSQQQAWLQKRRQENMARKAAGEEPLPEEDPSNPIFKPIPEPSRLEGYLVTNQISSYCNHINGVAGQNFDRLYLMKALHED

SEQ ID NO: 90727 - protein, 395 aa, Oryza sativa
  misc_feature (151)..(151): Xaa can be any naturally occurring amino acid
  misc_feature (383)..(383): Xaa can be any naturally occurring amino acid
MATNGSSPRARETESSLEKVKRQLSSGSGRYLLQGPLLKRSETLRKWNERWVILDPTSGKMEYKIRRNETAIKGTIIFDASSTITLSPVNFQGMPKYDGCCFYIGTPQKKDYFLCAETPGAAKAWVSTLLATQLVLQAHKEAVNSLAGNGXSPATLGTVATAVANANATALEATKEIEAAMKVSMRAALGLGANNPKEGQLDDLTIMKETLRVKDEELQNLAKDIRARDATIKEIANKLTETAEAAEAAASAAHTMDEQRRLLCSEIERLRQAMERQMEQSMLKLRQSEEKVISLSKEKDQLLKERDAALQEAHMWRTELGKAREQAVIQEATIARADEKVRASEADAAARIKEAAEKLHAVEKEKEELLSLVGILQSQVQRXAKQHEAGMRREI

SEQ ID NO: 90728 - protein, 600 aa, Physcomitrella patens subsp. patens
MERFANINVERASGRRGSVVVDLDSRVSSKPRKHRELLAKFRGGCYCGGFYLLKALRVSGRGGRKVKHSNGDGERVVFHRSRVGDWGAEFFRITAVECVFEMAASNSLSNGRAVHRRNGFGAGGASQNHKAMSLFQCQPEYHQDCARLYSNDNCGDVKQFRGNFMNSKDASRRKRIFTKVLVNLYLSVADMRNVRVFSKSRFWRSFLSCGSHFYQQHGVLHEVRKHTKTRIGGRGNRSPKLKQCKLDARREQWLSQCSQERQGKAGKQQQNDLSHYRNCVHHPKAEDGECMAQERACPSGHSRSQSLGSIGSVSERTLTGSLVTHSRTSIIGLINEVKDLKEVPARRNGVSCRSSQHFGDEELDEGIGHKQSLKYRRSSSDASKLRSNSSCASNSCTGSDSEDNDESHDVNDAWESAFDALHIQSSLYRSEGSHKCPGSDRTLRSEGKEQHDRKQNGAYHYHTQHGQSKHEYKYKNSSLGSRRGNGGRAWRSDDVSRPPTLPTLAERHKHPTHANNHHQGWGNGNKWGNRPASPSYCPICTEELDMTDSSYMPCPCGFQLCLFCYHRIASDDGRCPGCRKAYNTDVAVQVSRSSAVWLHV

SEQ ID NO: 90729 - protein, 311 aa, Glycine max
MTTMSSLSLSLDWHNESYPAYHDFYLLPIFALFFPSLRFFLDRFIFEKVARRLIFGKGHAALDYQTDERRKKISKFKESTWKCVYYLSAEILALSVTYDEPWFTNTINFWVGPGTQVWPDQKIKLKLKAVYMYAAGFYSYSIFALIFWETRRSDFGVSMSHHVATVILIVLSYIFRFARVGSVVLALHDASDVFLEIGKMSKYSGAETMASFAFILFVLSWIILRLIYYPFWILWSTSYEVLLTLDKEKHRVDGPIYYYVFNSLLYCLLVMHIYWWVLIYRMLVKQIQARGKVSEDVRSDSEDEDAHEHED

SEQ ID NO: 90730 - protein, 380 aa, Mycobacterium avium 104
MIRGVGRDWEIAEIELDPPRSGEVLVRMAVAGICHSDDHLFTGDVVPTPEVVAASGQPAPDWFPLLGGHEGAGVVAEVGPNVTSVRPGDHVALSFIPACGSCRFCVNGQSYICDVGASLFVREMPTDGTCRRHLGAENLLAYGQLGTFAEYAVLSERSVIKIDEAIPFHAASLVSCGVSTGWGSATVSAGTEPGDTVVVIGAGGVGMNALQGARAVGAKYVVAVDPIAAKRDSAKIFGATHTAASARDAIPLVREITAGLMADRVVVCPGVVHVDSIPLALALLRKGGVCVLTGITPFTEPPVPLVLQEMTLSAKQLRGALYGGMNPRTSVPMLLSLYQAGDLKLDELVTRHYRLDEINEAFADLREGRNIRGVIDFAGR

SEQ ID NO: 90731 - protein, 250 aa, Sporobolus stapfianus
MPMRNIAVGNTQEVTHPGALKAALAEFISTLIFVFAGQGSGVAYSKLSGGITTPSSLISAAVAHAFALFVAVSVSANISGGHVNPAVTFGAFLGGNISLFRSILYWIAQLLGSIVACLLLRFVTGGLPTGTFGLTGISVWEALVLEIVMTFGLVYTVYATAVDPKKGSLGTIAPIAIGFIVGANILVGGAFDGASMNPAVSFGPSLVSWSWNNHWVYWVGPFIGAALAALIYDMLFISSHTHEQLPTTDY

SEQ ID NO: 90732 - protein, 327 aa, Triticum aestivum
  misc_feature (99)..(99): Xaa can be any naturally occurring amino acid
MASRAATMVALLLAAAAATCAQAQLHEKFYGETCPSVEDVVRKEMVRALSLAPSLAGPLLRMHFHDCFVRGCDGSVLLDSANKTAEKDAQPNQTLRGFXFVERVKAAVEKACPDTVSCADILALIARDAVWLSKGPFWTVPLGRRDGSVSISNETDALPPPTSNFTVLTQLFAAVNLDAKDLVVLSAGHTIGTSHCFSFSDRLYNFTGMENPSDIDPTLEPQYMMRLKSKCASLNDNTTLVEMDPGSFKTFDTDYFKLVSKRRGLFHSDGALLTDPFTRAYVQRHATGAFKDEFFADFAASMIKMGNANPLTGSQGEIRKKCNVVNH

SEQ ID NO: 90733 - protein, 672 aa, Alkalilimnicola ehrlichei MLHE-1
MRIRLGHRPDALAPSAGRIPAMITLKDITLSRGPEELLHQASLTVYPGQRLGLVGPNGCGKSTLFALLQGEIGPDAGEVGIPRDWRIAHVVQETPALASSALDYVLDGHLELRALQARLAEAEAAGDGEAMGQLHARLDAIDGYTAASRAETLLEGLGFDAAGRARPVSDFSGGWRMRLNLARALIQPSDLLLLDEPTNHLDLEAVLWLEQWLCQYPGALLLISHDRDFLDTVVQGIVHFDGRRLVHYTGGYSDFEKRRAERLAQQQAQYEKQQAEIAHLHKFIDRFRAQANKAKAAQSRIKALERMERIAPAHVDAPFEFHFPDPPRAANPLLVLDRVDLGYGGDPVLRRIQLSLRPGERMGLLGPNGAGKSTFIRALAGELKPQAGQITGSQGLAVGYFAQHQLEQLDGQASPLLHLQRLAPKAQEQTLRNFIGGFGFSGDDADRAVAPFSGGEKARLVLALLVWQRPNLLLLDEPTNHLDLEMRHALTVALQEYEGAVVLVSHDRHLLTTTCDEYYLVAEGRVRPLDGDLETYRQWFLEWREAQKAVNGVASAGTGPAPDGDEPRHGSSPAHTAESRKAQRRAQARQREQLRPLRRKAEQLEKALDELSGELADVERALGEPALYEAAGKDRLTELLHRQGVLKARQEALEADWMEALEALEAAEAALG

SEQ ID NO: 90734 - protein, 290 aa, Rhodopseudomonas palustris CGA009
MFTDQLLAGRRILVTGGGTGLGKAMAARFLQLGAEVHICGRRKGVCDETATELMDQYGGKVMTYGVDIRDAAAVDHMVETIFESGPLTDLINNAAGNFISRSEDLSPRGFDAVANIVMHGTFYVTHAVGKRWIAGGHRGNVVSITTTWVRNGSPYVVPSAMSKSAIHAMTMSLATEWGKYGIRLNTIAPGEIPTEGMSKRIKPGDEAGARTIKMNPMGRVGTMEELQNLATFLISGGCDWISGETIAMDGAQGLAMGGNFYQLRDWSNADWDQAKASIKAQNEKDRAQRG

SEQ ID NO: 90735 - protein, 406 aa, Candida albicans SC5314
MKVIVSADDTGSAKEVICNEGTDTSKQNATQPISIDNCLLEPSSSVKSRIIHFLSFNYQYLIGARLGGQVSVYELSDEESEEKFKLLHNFELPVDAQDKPVALLRVEILDSILVAFESSKVFLIHINDSFDFKPLELVLPEYKPISAFAINPQAENIVALGGKEHDLQILQLFNKNINSTVFKKNNYENEFKPQIIFKAKNVRNDHLELRVPIWITNILFAKAAKGYKLVTSTRYGQIRLYDTAEGRKPRKDYKVTEKPIVTLTFANDEQTEIIVTDTHSLIAKYSLTQVDEKAFKTISASAGEIVKPVPKLLGKFTGGNTGATFGVHAYERIVAFAGLDRYLRVFDLESREILAKVYLGVEVSALLILDDEDTEDEETKKRKRKEEEDDEELWNQLDTKKKTHTI

SEQ ID NO: 90736 - protein, 366 aa, Anaplasma marginale str. St. Maries
MIYGRHDAVLVLSDGRHFFGTSLGKRQDCVGEVCFTTGFTGYQYTITDPSFAGQIVVFSFPHIGNVGVNSRDFECEHVLARGIVVREMSHASHVSSLADLNSWMEASGVSGISGVDTRALTLHLREHGSQNGVIHCFDDPDLLDLQKLKSAAMAPTVPTVATELPHLKSHQVSHTGLRICVIDVGAKRGIMQTLSTLGCAIHVVAARDDFVTQIMDLRPQGIVISNGPGDPHAVPTDTIEQLRVLLQQGIPMLGICLGHQLLAIAIGAKTVKMRHGHRGSNHPVYNVATKAVEVTSQNHGFAVDAQTLPENAEVTHISLFDGTIEGMKLLDRPVLSVQYHPEGHPGPHDSHYIFRDFVNLARAYRW

SEQ ID NO: 90737 - protein, 289 aa, Oceanobacter sp. RED65
MEKIGFIGIGLMGLPMCQRLLAAHCDLTVYNRTPSKTQALQEQGAKAVDSIESLVSSVDIIMLCVSDTLAVESVMAEALPYLKPKQIIVDFSSISPAATRQLATSVEAKQCAWIDSPVSGGVAGAEAGSLAIMVGGDTHILKTIEPILQNLGQRITHMGPNGAGQTSKICNQMLVSCNVLVMAEVMALAKKSGVDAARLPEALKGGFADSLPLQLTGPRMAEQDFDEVKWKVKTLLKDLDMANTLAHDMTSSVPMAGLGAELMRQHAARGFAEQDPSTLVMLYEALLEK

SEQ ID NO: 90738 - protein, 595 aa, Azoarcus sp. EbN1
MKPTDLRAPDYLHKVVDCQWACPAHTPVPEYIRLIAAGRYAEAYALNWQYNVFPGILGRVCDRPCEPACRRGRVEREPVAICRLKRVAADHKGDVGALLVPSPVQRNGKRVACVGAGPASLAVARDLATRGYAVTVFDSGTQAGGMVRSQIPKFRLPDAVIDEECGYIEALGVEVRLGHWVPSLQGLLAEGWDAVFVGTGAPRGRDADIAGREAAAANIYLGIDWLANVAFGHVDTIGKRLIVLGGGNTAMDCCRTARRLGGEDVRVVVRSGFEEMKASPWEKEEAMHEGIPIHNYLVPLEFTHEGGRLTGVRFERVRAEYDAAERRSLVPTGEAPVHMPCDDVLVAIGQENSFPWIERDIGLEFDRWGLPVLDARTFQSTLAPVFFGGDAAFGPKNIITAVAQGHEAAISIDRFCQGQAVAERPEAVVELVSQKMGIHDWSYGNRVSEEARRKVPTCELAAALRDVRLELELGFDERQALAEAERCLNCDVHTVFSAPACIECNACVDICPSECITFTADGEETELRARLTAPATNPAQPLYVADGVKSGRIMVKDENLCLHCGMCSERCPTAAWDMQKLNLRPAREQAETTAQ

SEQ ID NO: 90739 - protein, 255 aa, Brassica napus
  misc_feature (243)..(243): Xaa can be any naturally occurring amino acid
KEKNGKHFNVSVEASKIVKSKGKYLNVGTQFIGTVPGVEVGDEFQYRIELNFLGIHRAIQAGIDYMRDANKELLAASIVPSGGYDDDLCNSDVLIYTGQGGNLSTKFQQGNITNEPKDQQLLRGNLALANSIDKQNPVRVIRGNKKTPSSDNNTKNYVYDGLYLVEEFWKEVGSYGKLVFKFRLRRIAGQPELTWKVVKKAKSSKARDGLCCEDISGGKERLPICAVNEIDDEKPPVFDYTVXMIYPDWCQPIPP

SEQ ID NO: 90740 - protein, 392 aa, Bradyrhizobium japonicum USDA 110
MSKSSSLNKVFADLPVTIFEAMSQAARDNAAINLGQGFPDDPGPEDIRRAAADASLNGYNQYPSMMGLPELRQAIATHYGHWHGLKLDPMSEVMVTSGGTEALTSAILAVVQPGDEVVCFQPVYDSYLPIIRQAGGIPRLVRLEPPHWRLNEDMLKSVFNSKTKAVLFNNPLNPSAVVYPREDLELLARYCQEFDVIAICDEVWEHVTFDEHKHIPLITIPGMRERTIKVGSAGKIFSLTGWKIGFVCAAPPLLRVAAKVHQFLTFTTAPNLQAAVAYGLGKSDDYFLSMRKDLTRSRDRLTKGLESLGFPVLKSQGTYFLTVDLSPLGLNESDTEFCWRIVKDYKVAAIPVSAFYEQDPVTSVVRFCFAKKDQTLDTALERLSDAVRGRKR

SEQ ID NO: 90741 - protein, 371 aa, Selaginella moellendorffii
MEPEEDSSAEELQLKESKEVVPLNTWVLISNLKLAYNLTRNSDGSFNRNLDEFLDRKVPVSSVEREDDPVTFMDVTIDRTSGIWSRIFIPRASHNNNASSTTHGTPIFFYFHGGSFVHMSANSAVYHTVCQQLARLCQAVVISVNYRRAPEHKYPAAYNDCYAALTWLKVQVLRGVAHAWLPRTADLGRCFLVGDSNGGNIVHHVGVRAAESGAELGPLRVAGHILIIPMFGGNRRTQSELRFDGQYFVTIKDRDFYWQSFLPAGADRDHPACNIFGPSSRSLEGVVLPPSLVAVAGLDMIKDWQLQYVEGMRNAGKDVELLFLEEATVGFFIFPNTGHFHRLMDKITAFIDRDGDQHLTRRTGITRRTTT

SEQ ID NO: 90742 - protein, 468 aa, Candida albicans SC5314
MKFTHLFFIGLLTKVYTETVTVLSTRSYRLATTESTPTDGTVYLTLTRQQSSSTSLNASTITTPPSNSSASVQTTAVTDCHFHNSVQYCVDGYGNEGSILPVPTNTNNLPTSYDGCHSHDGDTFCMDGDKEVQFVKLEDEDDEESSSSSGKKCHFHAGVEHCVDDNNHDAVTCERVKRDYDIPLRIGLLFVILVTSGIGSFGPIVLKQFVNLSQENYIIVIIKQFGTGIIISTAFVHLMTHAQLMWSNSCLKIKYEGTGASITMAGIFIAFIIEYIALRIVNARDTEKVDKKEIEETSSNEQSLHGISVNDKISVMILEAGIIFHSILIGITLVVTDDVYFITLFIVIVFHQFFEGLALSSRIISITNASLSTKLVMALMFALITPIGMAIGIGVLNKFNGNDPSTLIALGTLDSFSAGVLLWTGLIEMWSHDWLHGHLRNSSFVKTTVALVSLILGMLLMSLLGNWA

SEQ ID NO: 90743 - protein, 440 aa, Haloarcula marismortui ATCC 43049
MGLIKMTKYRTLLLATIGFNFSFLIWFSFAPFTGPMAEEFGLSTAEIGILASSAIWMAPFGRMLTGWLSDKFGAPAIFAIVLAYVGVFSIGSAFAQDYSVFFVLRLIVATAGITFVIGIQHVAEWFEEENLGLAEGIYAGVGNAGAAGGALILPRVFGSGWNGPLFSTNWRAAFFYTGIVSILLAIAYYTLGEAAKTEAKRQATKENTNFKGWLHTATRYGTVVLAAAYIMSFGLELSMNGWLATYYREAFNQDNLVIASTFAATFSIAAGLLRPFGGYGSDLLARKEKNLLPFFKGQYREQWTFLGLCFIVVMMFAMTLAGLSGVLLNAVVIGFLVGTGCAWAEGAIFAQVPAMFPNDSGSVAGVVGGVGTVGGIVYPLFYSAPWLANLHLGYSVAAVTMIPIVLLSAWVFQPEIAKVANTAGFVGSTQEGTTVASGDD

SEQ ID NO: 90744 - protein, 493 aa, Physcomitrella patens subsp. patens
MASKGRLVQTVARFALSSRLQGRVPVIVQSHAQSTSTQPSDSQQPPSVTLSTEDLIQMEHKFSAHNYHPISVVFAKAKDVEVWDPEGSKYLDFLSAYSAVNQGHGNQKIIDALIEQAQRLTLSSRAFHNDKFPVFAKMLTSMFGYEMMLPMNTGAEGVETSIKLARKWAYEKKGISKDEAVVISCCGCFHGRTMAAISMSCDNEATRGFGPLLGGQAKVDFGDASALEKLLQEKGDKVAAFLFEPIQGEAGVVMPPDGYLKKVRQLCTKYNVLMIADEIQTGIARTGRLLACDWEDVRPDVVILGKALGAGVLPVSAVLADADIMLCIRPGEHGSTFGGNPLASAVGIAALEVVTEQNLSERSDKMGQEFREQLRGIQKDYPNLIKEVRGRGLLNAVVLNQADLGNATAYDVCMGLKNRGILAKPTHGNIIRLSPPLTIKREQVAQASKALREVFEFDLADMKLHAEDRSPPKTPDACDRCGRYKYVMPETEL

SEQ ID NO: 90745 - protein, 435 aa, Bradyrhizobium sp. BTAi1
MSSTKKSVRTLPSPVVGTSKPRLLDTLGPGLITGASDDDPSGIATYSQAGAQFGYTLSWTMLLTYPLMAAVQMISGRIGRTTGRGLAGNLRQHYPNWLLQTFVALLAAANIINIGADLGAMADSTSLVLGGSKTFYVALFGVVCIGLQVLLQYTRYVSYLKWLTLALLAYVATLFMVDVHWGEALRQFVWPSITWKTEYIQTIVAVFGTTISPYLLFWQASQEAEDIRAVPERQVLKRAPEQGPDAIKRIELDTLIGMGVSNLIALAIILTTAATLNVSGVTDIETSAQAAEALRPIADNYAATMFALGVLGTGLLAIPVLAGSAAYAIGEARKWPIGLTRQPKEAKAFYATIVMATLVGILLNFAPINPIKALYWCAVINGIVAVPVMGLMMLMVANAKIMGEFTIGGWLTGLGWIATAVMAAAAVAMGVTYFM

SEQ ID NO: 90746 - protein, 1459 aa, Penicillium chrysogenum
MDFEQYGQSSQQPRQRRRRAGKRRLNNKTPIAARLALDPQLRGKVGILSEDLANDLFQQQALQDVTTSDDGVLYVAIAPHTPTYTSVEDQAWTILPVRIQPTERSPVAMSHSTVLFPESADSLQPFLQALGKVDSSRNSLQAHRSVEIRILDVAPIHLDTIFVTVERHLLRNHDDVQTKFGGGFTNAQGPNGLWGKTGKSVEAKKYSKRAAADAEQRLTAAVREALGAQRIVHTGDVLPLPLPSHPITYAPPPPARISFCEPVSQGLLMSTTKIVLVQARPQGIRAQQTMPSRSALLKQVAEDEADDTSNEQFYSAAEDKPGESGTEMEVTSAAEESETEGSAGSMSDSSDDSLEDMISLSAPELPQPPSGVMSSLTSATPRAGGRRSDGIHTPGSVASNFTSATMRPGRGGGKTFKVEGLLQQVPNEVLHPRPRDDEDVDSFVFVDISTLAKIGCFSGDWVRIEAAEEPQLNMFASLKFGSFNDSPEDSGDWRPVKIFGLSGLPSSKPRYAINHSGERRPSISQRPPTRLTPSVFVPPLLLGNIENPKYLRISPMTFATPNGSSKPGILQHMKNTAAKNPPLAKEVTLLKVSTPLSMDRVLQPALFAGLKQYFESRRRILKSGDLVGISVDEGLGRAVFSGTGSGDSASQEEDITIRLGQGANATNAGTRKIGVAWFRVGQVAPTTVEELEETGEDQWGGVAVLDPATTRMVQAGSDVSRVPGVLGNGWEYWLGVKTIPKTVHDAPTPHGIVADPPQSVIPPLQQRIRDLMSAATSPRAIQLGMKPVFILLRSQQRHIGKATVATRACSDIGIHTFPIDAYDILTEGGANGGDVKTEAYLKARAERAFHCGANCTALLIRHIEVLTADRIVTAMSDILNDARVVIATTTDVETIPEGIRSLITHEFEMGAPEEKEREGILQNAVTERGIRLSADVDLGSIALKTAALVAGDLVDVVERAAGARTARLESLAEASKKISGSEVFVRDVLLAGGDGARGVTKADFDAAVEAARKNFADSIGAPKIPNVGWDDVGGLTNVKDALVETIQLPLERPELFAKGMKKRSGILFYGPPGTGKTLLAKAIATEFSLNFFSVKGPELLNMYIGESEANVRRVFQRARDARPCVVFFDELDSVAPKRGNQGDSGGVMDRIVSQLLAELDGMNGGEENSGGVFVIGATNRPDLLDTALLRPGRFDKMLYLGVSDTHRKQATILEALTRKFALHPDVSLDRVAEQLPLTYTGADLYALCSDAMLKAITRKATAVDEKINALPNGPVSTAWFFDHLATKEDVNVMVTEEDFLSAQGELVPSVSAKELEHFERIRQTFEAVDKSKQDPAAAAPQTIAEAMEAFSLGGSAIPEEAPTINGDSLTPGGIHGRIKGLNRWPGNPVRSTSGQSTTSSKGKGKSVSKKGKSRTGAESDGSVDGDDEDMADANSKEDEDEDDYVVRTDHLRNPMEEVE

SEQ ID NO: 90747 - protein, 385 aa, Methanosarcina barkeri str. Fusaro
MYSDRINALPPYLFATIDEAKDELIARGVDVIDLGVGDPDLPTHPHIVEAMREAVCDPKTHQYPSYAGMPEFRKAAADWCKKYKGVELDPATEVLALIGSKEAVAHIPLAFVNPGDVVLYTDPGYPVYKIGTMFAGGEPYPLPLTAENNFLPDLDSIPENILKKAKLFFFNYPNNPTAATADMQFFEKVVKFCKKYDIIAVHDNAYCQMTYDGYESPSFLAANGAMDIGMELYSHSKTYNMTGWRLGFAVGNKDLIMGLGKVKSNVDSGVFDAIQIAGIAALCSSQTCVEETTKIYQERRDALIEGLKAMGLKVKLPKATFYIWAPVPEGFTSMSFAKLLLEEAGIIATPGVGFGEAGEGYIRFALTKSVERIREAVERMKKLKF

SEQ ID NO: 90748 - protein, 1275 aa, Schizosaccharomyces pombe
MRGRGIDVNSSHYPHISRPRTSSDSQKMYTRAPVDYYYIQENPYFNNIDQDSISDKSLPSTNQSLHHSEEDTESDNDFSESIHPEFDIDVFYKVSNILYDESDLQDPEKRERLEWHSMLSSVLKGDVMQTEKRRLRLTEPDGHSGTYISEVWLGLQAWLHGRLNADQAEVIRKSREGVEPVLREVIDFQIQDEETTKPPLEQVTEILEKVEQCKQFYISSREMEENVPLSASKEFNYKLNALISWSNVMESIQVETLVLQKWVGNDEFDLTMRTPQFNYDGVENTSSFVERIFRQSGLQRTFEQRTLTTLNRIIHQAKQTISENAQAFEEMKLPTYEDKLLPLVRFPIKLLEEALRLRLAYAKKIKGPNFLIVDSMLDDFKIALSVAVRIKREYIKIASPSPGWSLPTNVDEDYDNVLLDSLKFYFKLLTLKLSSGNKNLYFKEIDFLENEWAFLNEHIYWINGGDIHMAGQFSYLSNSLLLNVHRYVESHLNGPTERTAASLTNWYSTLLKNTQIRFRKILRFSETLNSRFENASDFVISEGHLPDLVNRLSTTGHFLAYTANLERDGVFVIADHTLSENPEALKALLFSKDISNLETIQQNCSYVLILCPVHPIVWKGRIEKVDVPDFSVDLKTNRVRIIASNKREHLQAAKSVFQSISGDLVTLAVECRSSITRVYKEFIRLSKLCMRISSTVVDCVSAVREACSGVNCHDLIYHVFSFAAEFGQRILRFLSFDSYWQTKLKRKITSLAVEWISFICDECDLMDRKTFRWGVGALEFLMLMIRGNNILLIDDAMFLKIREKVGKSMAFLLTHFDVLGAKSKVAAKLQRESTEVSSSPRLTSFGDVEEEALSIQLLQKETMLRIDELEIERNNTLLERLAIGHVLDDSVFRNRDFIKLASSFSNITIRWQQGHFVRSGMFGDVYTGVNMETGDLLAVKEIKLQDSRTFRSTVDQIHNEMTVLERLNHPNVVTYYGVEVHREKVYIFMEFCQGGSLADLLAHGRIEDENVLKVYVVQLLEGLAYIHSQHILHRDIKPANILLDHRGMIKYSDFGSALYVSPPTDPEVRYEDIQPELQHLAGTPMYMAPEIILGTKKGDFGAMDIWSLGCVILEMMTGSTPWSEMDNEWAIMYHVAAMHTPSIPQNEKISSLARDFIEQCFERDPEQRPRAVDLLTHPWITDFRKKTIITMPPATITKKTSLSHTITEEKTAQLLAGRHVDSKAETDSLAASYKEESALPVASNVGLRQPNELRIDSINLPPAIVTPDTINYSVD

SEQ ID NO: 90749 - protein, 253 aa, Alkalilimnicola ehrlichei MLHE-1
MMRAVTEGRGPEGLVLVHGWGFDHRVFDPWLPRLTQRWRVTRTDLPGHGGSAPLPADAGLEAWADAVRLAVPEDAIWVGWSLGALPLLAAAARGARPRALLLLAATPCFCQRDGWPYGLLREELDAMIGGLAEDARRTLRGFHALLGRAGAGDREALRPWRRRGPGPATALEPGLSLLRDTDLRGRLAAIDRPTTWLAGGRDPLVPDGAAKEAARAMPRARMAYHPEAGHLPFLTHPEWVAGHLHLLSQQCRP

SEQ ID NO: 90750 - protein, 500 aa, Arabidopsis thaliana
MAHYINIYGKRLFDIGLYLKTSVDLILQQQHVLMSQQKFTDISLCHREAPNPKLDLPDDNRLSPLTELEDIGQQSKTLGTAIHRKISEQKRVIESGSVASIVEHKRTNLSAIMATRANIPEQVRGAPLVDGLKIQNKNGAVKNRRALGDIGNLVSVPGVQGGKAQPPINRPITLSFRAQLLANAQLERKPINGDNKVPALGPKSHDRDEEEVAMSPKNKKVTYSYVLSAQSKAACGIVNKPKILDIDESDKDNHVAAVEYVDDMYSFYKEVEKESQPKMYMHIQTEMNEKMRAILIDWLLEVHIKFELNLETLYLTVNIIDRFLYVKAVPKRELQVNDLVYVTDNAYSSRQILVMKKAILGNLEWYLTIPTQYVFLFCFIKASISDPEVLHVQKKNLQASKTKSFSIQVLRKESSINSQIILPSFSSHKSIVKSDQFCKKFNLCQEVTAPASEFHLGNCEAWRETVTKLKDPETKLKLRISLKCLKVVFEYTASDACGYG

SEQ ID NO: 90751 - protein, 280 aa, Methanosarcina barkeri str. Fusaro
MTDQVQPLVNLSKKPTEPKMIINLRRIKRKILIMSGKGGVGKSTIAANLAIGLVLHGYRVGLLDCDIHGPTIPTIFGMESMKPEVSEEGIMPVEVLPNLLLMSVGFLLEDKDSPIIWRGPLKMGIIEKLLEDVVWGELDFLIIDLPPGTGDEPLSLALLIPEIDGSVLVTTPQDVALVSVRKSIGFSKELNVPVIGIVDNMHGLICPHCGKPIKVFRNGGVEKASKDFNIPILARLPIEPKVAKMEDKGTVVQEMLKHDTEWQKNFENFVIAVEKILKEK

SEQ ID NO: 90752 - protein, 149 aa, Anaplasma marginale str. St. Maries
MQNSLNVLIVIGDFYPEISKLMIAGAVAKLQSYGAASVEHEVITVPGSFEVPAAISFAIMSDRERHDGYIALGCIVKGATNHHNVISSSVSASLGDIAVQHVVPLGFGIITSDSMELALERADPNGKDVGGNAATAVLRMIELYKRFLG

SEQ ID NO: 90753 - protein, 439 aa, Chlamydomonas reinhardtii
MFARFRHDKAAAPQGPPHNGHHGAGAKAGLNAPSDSLTQPPLRFAGRRDYDIEPGADEWGLTPNQQEAAVESFRRQLVDIDPRLWDPQRHDFFTLRRFLRARSYHTARAVDMWRAHLEWRQANDVDRVLQDFSFPERGEFLRHAPQGYYHTDRQVGRPVYVQLLGSADLGALRRIATEERMFRFMVHEHEYVCKVILPLCSRLAGRHVDTIFNIVDVKGECHAGGVAGGEMQGWRVQGLRLSQLTSDTLRFFQRVTKTDQDHYPEMLAHVAVVNAPPVFRLVWGMILGPNYLSALEQWIEPDNLLPLFAAEEAPKGLLHLTALRASPGDGPAVSADITPMPAAAAGVGAAGYVGSGRVWCREGAPGAGSSGNTAGPPAPLPAAALAAAAVAGSQDCSLGGTGRQQGSIRTLMPPPDSPPPPGRCGDPTCPGCGSGCAVM

SEQ ID NO: 90754 - protein, 276 aa, Arabidopsis thaliana
MAASTLYKSCLLQPKSGSTTRRLNPSLVNPLTNPTRVSVLGKSRRDVFAKASIEMAESNSIPSVVVNSSKQHGPIIVIDNYDSFTYNLCQYMGELGCHFEVYRNDELTVEELKKKNPRGVLISPGPGTPQDSGISLQTVLELGPLVPLFGVCMGLQCIGEAFGGKIVRSPFGVMHGKSSMVHYDEKGEEGLFSGLSNPFIVGRYHSLVIEKDTFPSDELEVTAWTEDGLVMAARHRKYKHIQGVQFHPESIITTEGKTIVRNFIKIVEKKESEKLT

SEQ ID NO: 90755 - protein, 367 aa, Glycine max
MESASELVEFPLLLTPIDSNYRACTIPYRFPSDNPRKPTPTEISWIDLFLNSIPSFKKRAESDTSVPDAAAKAEKFAQRYADILEDLKKDPESHGGPPDCILLCRLRELVLRELGFRDIFKKVKDEENAKAISLFENVVHLNDAIEDEGKRLENLVRGIFAGNIFDLGSAQLAEVFSKDGMSFLASCQNLVPRPWVIDDLDTFKLKWSKNPWKKVIIFVDNSGADIILGIMPFARELLRRGSQVVLAANDLPSINDVTCSELVEIISKLKDEDGQLVGVSTSNLLIANSGNDLPVIDLTRVSQELAYLASDADLVILEGMGRGIETNLYAQFKCDSLKIGMVKHPEVAQFLGGRLYDCVFKYNEVSS

SEQ ID NO: 90756 - protein, 446 aa, Candida albicans SC5314
MRDLIVLGGSSHPNLTKSICRSLTLEQGLVDSRKFSNGEISIEVKNSVREKDVFIIQSGCGHVNDNFLELLITIAACKTASAKRVTAVLPLFPYSRQPDIPYLANATGAPSISTKKEEYTFESAPATPNPLSKSSSEKSFLSSASSSIVSENKAATTGVNNISSGNRIKSPVPKKYTPKLIHTNASATNFLPQVDAYGKTESGYKQWISPNGTLIANLLTTAGADRVITMDLHDPQFQGFFNIPVDNLYSKPILKHYILNFIPNYKDCVIVSPDSGGAKRATAIADSLGCPFALIHKERRAKLPKNPPSTSMSNSHSHNHYNSQHKPTMVATTMLVGDVAGKVCVLVDDLVDTSYTITRAAKLLKDQGAEYVYALVTHGIFSGDAINRIQQSAIDKLVVTNSTPQSEHVEILGDRMEVLDVSRVFAESIRRINNGESVSMLFDHGW

SEQ ID NO: 90757 - protein, 330 aa, Haloarcula marismortui ATCC 43049
MSSASPSPDRTRPTPAAPISRVPVSRATSAYGTETGFSPGSHPPDMIIPGADTQAFAATLAEATGERLGRVEYERFPDGEHVVQVPKAVSGERAVVVASTVDSDAHLQLLQLQDAARESGASEVITVIPYMGYARQDEAFKPGEPVSSRAMARAISTGTDRVLTVNPHEPAVCDFFDVPATNVDAASVLADPLPADLQDPLFLSPDEGAIALATTVRDAYGEGETDFFEKDRDYNTGDIEISPSDAPVEGRDVVLVDDIIATGSTMSESVSVLDDRDAQRVFVSCVHPMLASNALTKLNSAGVEAVYGTDTLERAVSEVSAAPVLSERLE

SEQ ID NO: 90758 - protein, 499 aa, Haloarcula marismortui ATCC 43049
MAQDSRPRYGIEGNWEELYINGDWCEPDSGDSLAVENPSTRETVAQVPRGNEADVDAAYEAAERAQEEWRQTPPAHREELTQDLLQAIEQRREEIVSLLAAEAGQVPPVGHTSVDLTTDQVAEAATMPRRMKGEHAVSNIPGKEHIVEREPQGVVTVISPWNFPLNLSVRALAPAIAAGNTVVLKPATNTPITGGLLFARLFEDVGFPDGVLNIVTGRGSEIGDAVAGHEHSDVVAFTGSSEVGRRVAATAGENLSEAAMELGGNNAHIVTADADIDAAVDAGLFGSFTHQGQVCISINRHIVEADVYDEYVEKLTARVADLPAGSAHDEVVVGPIIDESQRDEILTYIQQTIEAGATLETGGDVVELNGVDDSLVVAPTVLSDVTNEMAAACNEHFGPVVPIIQAADVDEAVALANDTPLGLSGSVHAGDVGAGKRIAQRMETGMVHVNDQPINDEAHVPFSGTGASGVGGYNSDDFLAEVTEKKWISLQHEAREFPF

SEQ ID NO: 90759 - protein, 77 aa, Silicibacter sp. TM1040
MSDVADRVKKIVVEHLGVEEDKVTESASFIDDLGADSLDTVELVMAFEEEFGIEIPDDAAETIQTFGDAVKFISEAS

SEQ ID NO: 90760 - protein, 283 aa, Staphylococcus aureus
EIISNKYNFNYQIEHHEFGGASIDTFGEPLTEKTLNACKRADAILLGAIGGPKWTDPNNRPEQGLLKLRKSLNLFANIRPTTVVKGSSSLSPLKEERVEGTDLVIVRELTSGIYFGEPRHFNNHEALDSLTYTREEIERIVHVAFKLAASRRGKLTSVDKENVLASSKLWRKVVNEVSQLYPEVTVNHLLVDACSMHLITNPKQFDVIVCENLFGDILSDEASVIPGSLGLSPSASFSNDGPRLYEPIHGSAPDIAGKNVANPFGMILSLAMCLRESLNQPDA

SEQ ID NO: 90761 - protein, 283 aa, Staphylococcus aureus
EIISNKYNFNYQIEHHEFGGASIDTFGEPLTEKTLNACKRADAILLGAIGGPKWTDPNNRPEQGLLKLRKSLNLFANIRPTTVVKGASSLSPLKAERVEGTDLVIVRELTSGIYFGEPRYFNNHEALDSLTYTREEIERIVHVAFKLAASRRRKLTSVDKENVLASSKLWRKVVNEVSQLYPEVTVNHLLVDACSMHLITNPKQFDVIVCENLFGDILSDEASVIPGSLGLSPSASFSNDGPRLYEPIHGSAPDIAGKNVANPFGMILSLAMCLRESLNQPDA

SEQ ID NO: 90762 - protein, 283 aa, Staphylococcus aureus
EIISNKYNFNYQIEHHEFGGASIDTFGEPLTEKTLNACKRADAILLGAIGGPKWTDPNNRPEQGLLKLRKSLNLFANIRPTTVVKGASSLSPLKQERVEGTDLVIVRELTSGIYFGEPRHFNNHEALDSLTYTREEIERIVHVAFKLAASRRGKLTSVDKENVLASSKLWRKVVNEVSQLYPEVTVNHLLVDACSMHLITNPKQFDVIVCENLFGDILSDEASVIPGSLGLSPSASFSNDGPRLYEPIHGSAPDIAGKNVANPFGMILSLAMCLRESLNQPDA

SEQ ID NO: 90763 - protein, 283 aa, Staphylococcus aureus
EIISNKYNFNYQIEHHEFGGASIDTFGEPLTEKTLNACKRADAILLGAIGGPKWTDPNNRPEQGLLKLRKSLNLFANIRPTTVVKGASSLSPLKEERVEGTDLVIVRELTSGIYFGEPRHFNNHEALDSLTYTREEIERIVHVAFKLAASRRGKLTSVDKENVLASSKLWRKVVNEVSQLYPEVTVNHLLVDACSMHLITNPKQFDVIVCENLFGDILSDEASVIPGSLGLSPSASFSNDGPRLYEPIHGSAPDIAGKNVANPFGMILSLAMCLRESLNQPDA

SEQ ID NO: 90764 - protein, 804 aa, Oryza sativa Japonica Group
LFAYSCGYRIFVDRGFSRRFVKLREDLKQDNALQRWYMGIWYHKTREHTKLWVANRQAPLTDPESSQLSISSDGNMVLLDRATRSPVWSTNITGIAAAANSTVGVILNTGNLVLADASNTSAVLWQSFDHLDNTWLPGSKLRRNKLTGEATRLVAWKGSNDPTPGMFSLELDAGGGGASQHLRLAWNGSHQYWRGGGGNWTTAPEESGPEGQSPYTFLYVDAENESYVVFEVKDEALLSRIVVGVAGQIMLWGWVESAATWVLFWSEPTLCDVYSLCGSFSVCTDGSVPECGCLQGFVERQPRQWLYGDQTAGCARITGLQMPCGGGGQASGKTTKRDDTFFTMPKANSLPTGGVAAPSATASAHDDCELACLGNCSCTAYSYNGSCTLWYGDLINLRGANGSGTDGYRISIRLGVASDLSGTGNTKKMTIGLVVAGVVAAAVTLAVLVAVLVMRSRRAKALRRLEDSSSFLTVFTYRDLQLVTNNFSDKIGGGAFGSVFKGALPGDATPVAVKKLEGVGQGEKQFRAEVSTIGMIQHVNLIRLLGFCTDRTRRLLVYEHMPNGSLDRHLFGSGSGHGGGVLSWKTRYQIALGVARGLHYLHDKCRDRIIHCDVKPENILLDGAFAAKVADLGLAKLMGRDDSSRVLTTTRGTVGYLAPEWIAGTAVTAKADVYSYGMMLFEIVSGRRNVEQRRRQAEAADDDEYDSGAGGTVEADFFPLTAVRMLFDGDGDLRDAVDGNLGGEVDMGEVERACKVACWCVQDAESARPTMGMVVKALEGLVDVNFPPMPRLFMVGLSTGSSHT

SEQ ID NO: 90765 - protein, 486 aa, Triticum aestivum
  misc_feature (403)..(403): Xaa can be any naturally occurring amino acid
MASLADSFLADLDELSDNEAYPEEDNAEAVGMDEDGDDDMPDLESLNYDDLDSVSKLQKTQRYSDIMQKVEGALEKDTYLSNQGFILEEDPEYQLIVDCNALSVDIENELIIIHNFIRDKYRLKFPELESLVHHPIDYARVVKKIANEVDITLVDLEGLLPSAVIMVVSVTASTTSGKPLSQENLVKTIEACDRALNLDAAKKKVLDFVEGKMGYIAPNLSAIVGSAVAAKLMGIAGGLGALAKMPACNVQLLGAKKKNLAGFSSATSQFRVGYLEQAEVFQSTPPALRTRACRVIAAKATLAARIDSTRGDPTGKAGRNLLEEIRKKIEKWQEPPPAKLPKPLPVPDSEPKKKRGGRRLRKMKERYAVTDMMKLANRMQFGIPEESSLGDGLGEGYGMLGQXAGSGKLRVSAAQNKLAAKVAKKFKERSYGSGGATSGLTSSLAFTPVQGIELSNPHAHGNHLGSGTQSTYFSETGTFSRINNRP

SEQ ID NO: 90766 - protein, 283 aa, Staphylococcus aureus
EIISNKYNFNYQIEHHEFGGASIDTFGEPLTEKTLNACKRADAILLGAIGGPKWTDPNNRPEQGLLKLRKSLNLFVNIRPTTVVKGASSLSPLKEERVEGTDLVIVRELTSGIYFGEPRHFNNHEALDSLTYTREEIERIVHVAFKLAASRRGKLTSVDKENVLASSKLWRKVVNEVSQLYPEVTVNHLLVDACSMHLITNPKQFDVIVCENLFGDILSDEASVIPGSLGLSPSASFSNDGPRLYEPIHGSAPDIAGKNVANPFGMILSLAMCLRESLNQPDA

SEQ ID NO: 90767 - protein, 291 aa, Glycine max
  misc_feature (156)..(156): Xaa can be any naturally occurring amino acid
MALGTVTRRLGNKLFTVLSPTPRLLHSHATSFGFKQVNEDEKARMVGDVFTSVASSYDLMNDLMSVGLHRLWKDRLVSKLNPFPGMKHLDVAGGTGDVAFRILESIHKVKLRGLRGAFQDTLEAETQIYVCDINPKMLNVGKRRASEKGFGEDGSXLVWVEGNAESLSFQNDSMDGYTIAFGIRNVTHIEKVLSEAHRVLKPGGRFLCLELSHVGIPVFKDLYDYYSFSVIPYMGELVAGDRESYQYLVESIRRFPSQEKFASMIADAGFQKVEYENLVGGVVAIHSGLKI

SEQ ID NO: 90768 - protein, 179 aa, Brassica napus
  misc_feature (31)..(32): Xaa can be any naturally occurring amino acid
  misc_feature (47)..(48): Xaa can be any naturally occurring amino acid
GHGHGHGHGHVHGGLELGSGARHVVVSQVLXXGIVSHSIIIGISLGXXQSPCTIRPLIAALSFHQFFEGFALGGCISQAQFRNKSATIMACFFALTTPIGIGIGTAVASSFNSHSVGALVTEGILDSLSAGILVYMALVDLIAADFLSKRMSCNFRLQIVSYMMLFLGAGLMSSLAIWA

SEQ ID NO: 90769 - protein, 401 aa, Gibberella zeae PH-1
MAPKKPEAVIDNVVAFGRVRKNLKMGCVGLPNVGKSSLFNLLTEQSAAAENYPFCTIEPNEARCAVPDARYDFLCDLWKPPSMYPAYLQVTDIAGLIKGASQGEGLGNAFLSHIQAVDGIFHIVRAFDNDQVLHVDDSIDPVRDLNTIQSELCKKDLDILDKQIVAEEMIVKKAGGKYKMLPLFYETTSKIRAMLEEGKPVRDGSWTPAEIALINEKIQLITTKPVIYLVNLTMKDYLRQKSKYLPSIAKWVTEHGGTARDIIPFSIEFEEKLHSMKDDPDAQAEFLKESKVKSKLEKIITEGFTKLGLQYYFTAGEKEIRCWTIPRGCLAPQAAGAIHSDFERGFIKAEVVAYQDFHDLCEGNKSMAPIKAAGKYRQEGKSYVVQDGDIIHFQFNVSNKK

SEQ ID NO: 90770 - protein, 737 aa, Oryza sativa
  misc_feature (243)..(243): Xaa can be any naturally occurring amino acid
MMGTAHHNQTAGSALGVGVGDANDAVPGAGGGGYSDPDGGPTSGVQPPPQVCWERFIQKKTIKVLLVDSDDSTRQVVSALLRHCMYEVIPAENGQQAWTYLEDMQNSIDLVLTEVVMPGVSGISLLSRIMNHNICKNIPVIMMSSNDAMGTVFKCLSKGAVDFLVKPIRKNELKNLWQHVWRRCHSSSGSGSESGIQTQKCAKSKSGDESNNNNGSNDDDDDDGVIMGLNARDGSDNGSGTQXTSSWTKRAVEIDSPQAMSPDQLADPPDSTCAQVIHLKSDICSNRWLPCTSNKNSKKQKETNDDFKGKDLEIGSPRNLNTAYQSSPNERSIKPTDRRNEYPLQNNSKEAAMENLEESSVRAADLIGSMAKNMDAQQAARAANAPNCSSKVPEGKDKNRDNIMPSLELSLKRSRSTGDGANAIQEEQRNVLRRSDLSAFTRYHTPVASNQGGTGFMGSCSLHDNSSEAMKTDSAYNMKSNSDAAPIKQGSNGSSNNNDMGSTTKNVVTKPSTNKERVMSPSAVKANGHTSAFHPAQHWTSPANTTGKEKTDEVANNAAKRAQPGEVQSNLVQHPRPILHYVHFDVSRENGGSGAPQCGSSNVFDPPVEGHAANYGVNGSNSGSNNGSNGQNGSTTAVNAERPNMEIANGTINKSGPGGGNGSGSGSGNDMYLKRFTQREHRVAAVIKFRQKRKERNFGKKVRYQSRKRLAEQRPRVRGQFVRQAVQDQQQQGGGRE

SEQ ID NO: 90771 - protein, 500 aa, Streptococcus pyogenes MGAS315
MNKRVKIVATLGPAVEIRGGKKYGEDGYWAGQLDVEESAKKIAELIEAGANVFRFNFSHGDHKEQGDRMATVRLAEEIARQKVGFLLDTKGPEMRTELFADDAKEFSYVTGEKIRVATTQGIQSTRDVIALNVAGSLDIYDEVEVGHTILIDDGKLGLKVIDKDIATRQFIVEVENDGIIAKQKGVNIPNTKIPFPALAERDNADIRFGLEQGLNFIAISFVRTAKDVEEVREICRETGNDHVQLFAKIENQQGIDNLDEIIEAADGIMIARGDMGIEVPFEMVPVFQKMIITKVNAAGKAVITATNMLETMTEKPRATRSEVSDVFNAVIDGTDATMLSGESANGKYPVESVRTMATIDRNAQTLLNEYGRLDSSAFPRTNKTDVIASAVKDATHSMDIKLVVTITETGNTARAISKFRPDADILAVTFDEKVQRALMINWAVIPVLAEKPASTDDMFEVAERVAVEAGLVQSGDNIVIVAGVPVGTGGTNTMRVRTVK

SEQ ID NO: 90772 - protein, 286 aa, Nicotiana tabacum
MAENKEEDVNLGANKYRETQPLGTAAQTENKDYIEPPPAPLFEPGELSSWSFYRAGIAEFMATFLFLYITILTVMGLKRSDSLCSSVGIQGVAWAFGGMIFALVYCTAGISGGHINPAVTFGLFLARKLSLTRAVFYMVMQCLGAICGAGVVKGFMKGPYQRLGGGANVVNPGYTKGDGLGAEIIGTFVLVYTVFSATDAKRNARDSHVPILAPLPIGFAVFLVHLATIPITGTGINPARSLGAAIIFNKKQAWDDHWIFWVGPFIGAALAAVYHQIIIRAIPFKS

SEQ ID NO: 90773 - protein, 284 aa, Nicotiana tabacum
MSKDVIEEGQVHQQHGKDYVDPPPAPLLDFAELKLWSFHRALIAEFIATLLFLYVTVATVIGHKKLNGADKCDGVGILGISWAFGGMIFVLVYCTAGISGGHINPAVTFGLFLARKVSLLRAVGYIIAQSLGAICGVGLVKGFMKHYYNTLGGGANFVQPGYNKGTALGAEIIGTFVLVYTVFSATDPKRSARDSHVPVLAPLPIGFAVFMVHLATIPITGTGINPARTFGAAVIYNTEKIWDDQWIFWVGPFVGALVAAVYHQYILRGSAIKALGSFRSNPTN

SEQ ID NO: 90774 - protein, 401 aa, Glycine max
MDYFNAPGRNHLFVPGPVNIPDQIIRAMNRNNEDYRSPAIPAMTKTLLEDVKKIFKTTTGTPFLIPTTGTGAWESALTNTLSPGDRIVSFLIGQFSLLWIDQQQRLKFNVDVVESEWGHGAKLDVLESKIASDTSHTIKAICIVHNETATGVTNDLAKVRQILDSYQHPALLIVDGVSSICALDFRMDEWGVDVAITGSQKALSLPTGIGIVVAGPKAIEASKHAKSLRVFFDWKDYLKFYQLGTYWPYTPSIHLLYGLRAALDLIFEEGLENVIARHSRLGKATRLAVEAWGLKNCTQKEEWYSDTVTAVLVPAYIDSTEIVRRAWKRYNLSLGLGLNKVAGKVFRIGHLGHLNELQLLGCLAGVEMILKDVGYPVKLGSGVAAASAYLQNTIPMIPSRI

SEQ ID NO: 90775 - protein, 283 aa, Gibberella zeae PH-1
MAPPRAFDFSGDVAIVTGAGSRMDGEIGNGRAAAILLARHGAKVALVDFNVDWAKETKRMIDEEGGISEVIQADVTKEESCKNAVDKTVELWGAVHILVNIVGVGGAIGDATNINLDAWERDFRINVTSMVMMSRHAIPEMRKQGRGSIINMSSVSGLLGGNPSLLYPTTKGAIIQMTRAMAAHHGQENIRVNCVAPGMVFTPMTRGRGMTDEMRQARINQNLMKKEGTGWDVGYAILFLASKEAGWITGLIMPVDGGTTAGKADRPALKADSLAAENTGIKN

SEQ ID NO: 90776 - protein, 1482 aa, Glycine max
MDGNNISRSISRSISRSSWKMEEVFASGRYSRRTSHVEEDEEALKWAAIEKLPTYDRLRTSIIQTFAEGDQTGVHKEIDVRKLDVNDRQQIIDKIFRVAEEDNEKFLKKFRNRIDKVGIRLPTVEVRFQNLTVEADSYVGSRALPTLPNVALNLLESALGIFGISTAKRTKLTILKNASGIVKPARMALLLGPPSSGKTTLLLALAGKLDPELRVKGEITYNGHKLNEFVPRKTSAYISQNDVHVGEMTVKETLDFSARCQGVGTRYDLLTELARREKEAGIFPEADVDLFMKATAMEGTESSLITDYTLKILGLDICKDTIVGDEMHRGVSGGQKKRVTTGEMIVGPTKTLFMDEISTGLDSSTTYQIVKCLQQIVHLNEGTILMSLLQPAPETFNLFDDIILISEGQIVYQGPRDHIVEFFESCGFRCPERKGTADFLQEVTSRKDQEQYWADKNMPYRYVTVTEFANKFKRFHVGIRLESELSVPFDKSSAHKAALVYSKNSVPTMDLFKACWDKEWLLIKRNSFVYIFKTAQIIFIAFIAATLFLRTEMHRNNEDDAALYIGAILFTMIMNMFNGFAELALTIGRLPVFYKHRDHLFHPAWTYTLPNFLLRIPISVFESLVWVGVTYYIIGFAPDASRFFKQLLLVFLIQQMAAGMFRVISGVCRTMIIANTGGALMLLLVFLLGGFILPKREIPDWWVWAYWVSPLTYGFNALAVNEMLAPRWMHPQTSSDKTTTLGLSILRNFDVYAKKDWYWIGAAALLGFTVLYNVLFTLALMYLNPLGKKQAIISEEDASEMEAGGDANEEPRLVRPPSNRESMLRSLSTADGNNSREVAMQRMGSQATSGLRKVDSANDSATGVTPKKGMILPFQPLAMSFDTVNYYVDMPAEMRDQGVTEDRLQLLRGVTSSFRPGVLTALMGVSGAGKTTLMDVLAGRKTGGYIEGDIRISGFPKNQETFARVSGYCEQTDIHSPQVTIRESLLYSAFLRLPKEVSKEEKIQFVDQVMDLVELDNLKDAIVGLPGVTGLSTEQRKRLTIAVELVANPSIIFMDEPTSGLDARAAAIVMRTVRNTVDTGRTVVCTIHQPSIDIFEAFDELLLMKRGGQVIYSGPLGRNSHKIVEYFEAIPGVPKIKEMYNPATWMLEVSSVAAEVRLGMDFAEYYKTSSLFQRNKALVKELSTPPPGATDLYFPTKYSQSTLGQFKSCFWKQWLTYWRSPDYNLVRYFFTLACALMIGTVFWRIGKNRESSADLTMIIGAMYAAVIFVGINNCQTVQPIVAVERTVFYRERAAGMYAPLPYALAQVFCEVPYVFFQTVYYSLIVYAMVSFEWKVEKFFWFFFVSFFSFLYFTYYGMMTVSITPNHQVASIFAAAFYGLFNLFSGFFIPRPKIPKWWVWYYWICPVAWTVYGLIVSQYRDIEDPLFVPGSTTQNFTVKGYIEDHYGFKSDFMGPVAAVLVAFTVFFAFVFSFCIKALNFQTR

SEQ ID NO: 90777 - protein, 500 aa, Candida albicans SC5314
MPSLSDLDYENPVKIASTQIETVAIIGGGASGAIILDTLLKEPSNIKKIVVFERQKKLGGIWLFNKDIRSTPNDLIKSGSYNLENDPQLPNPFHKQQEKAKKILLPKNTQERFIETPSYYGITTNIIEKMMTYSDVNKWDVEGDAETRKYVEGSIVQDYIEKYFDKNLNDPRTELRLNSTVEDVERITRDDNSNGSDKIPYRFKLTVRNPQDDDHDVWYQEEFDTVVIATGHYHVPFIPHVPGLKTVQEKYPSKIQHAKFYRDSSSYKNKTVVVVGSRASGADLTKFIAREDGTTVYQSVRNFDNTKFVTQKTNVVKKPQIEKFESSKGSIKIVFEDGTLLENPDYVIYCTGYLFSYPYLNRLTNNQITEGITIPNLYQHTFLINEPLITIIGVPIDGISFRVFEYQAVLLARYLTGKISLPPRSKQSEWVNKRYEDKKNTRAYHTIGVLDAFNYSNDLIKLGEVSDKVEVGRKFPILSSDDILLYKEAGEKLKKFWDER

SEQ ID NO: 90778 - protein, 213 aa, Gossypium hirsutum
YWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGG

SEQ ID NO: 90779 - protein, 319 aa, Gibberella moniliformis
MSANYWHSTQCRFWSFTKEQLVTMRQKLEEDNAELVRMFPLPQQRRLYIYFNQQLIRLAKRLTIRQQSMATAQVYMKRFYSKVEIRRTNPYLVIATAIYLACKIEESPQHIRLIVTEARQMWGDLVAIDTSKLGECEFFMISEMRSQLIVFQPYRTITALRNELSLVDDEVQLARSVINDHFMTDLPLLYPPHIIAMVAILLALVLRPNNSGPGQSTSGAAAAAGLAAAQQALMRAQGQQAQGGMPEPAAAEPKEKRQQDRVSRVQKFAKWLVDSNVEIASMVDATQEIISFYECYEHYNDKLTREQINRFVKARGLDK

SEQ ID NO: 90780 - protein, 497 aa, Gibberella zeae PH-1
MGSRMTPEAIKPVMLIDGQANACLIQLVGASDGNSFPLFNPATGEKVADVPEATEDDTNRAVAAAQRAFPEWSAMDPAKRGSYLKKLASLIKEHNEELALLEAKSMGRPLAEFFEGHIAASSYEHYAEAWPHIQGQASLNTPGYVTMTLRQPFGVVAAIIPWNASLLFFASKSAPALIAGNTVVVKSSEKAPLGAAKFAELIHKAGFPPGVFNVLSGHGNPSGATLASHMDVRAISFTGSSPTGRAIQEAAAKSNLKKVILELGGKSPVIIFDDADLEQAAKDTMYSIQWNSGQVCMANSRVYVQDSIADNFIQACKKALSAAKSGNPTEKGINHGPQADKVQYEKVMSYINEGKKSGTLELGGNGNLDKTGGFFVEPTIFLNTPEDAKVMKEEIFGPVVNINVIKTEEEAIEKANDTEYGLYAAVYTKNVDRAMRVTQKLNSGYVGINCTSPTTARDLPFGGYKSSGQGREGWLYSLDNFLEVKSVMMKVDSGSKL

SEQ ID NO: 90781 - protein, 489 aa, Listeria innocua Clip11262
MGKATGFMEYDRIPSPGRDPKSRTRDWNEYSLPMPVADLTLQAARCMDCGVPFCSVGMEIKNGVSGCPLHNLIPEWNDAVYRGDWYEALQLLLKTNNFPEFTGRICPAPCEGGCTVAISEPAVGIKSIEKAIIDRGFEEGWIKPQPPKKRTGKRIAVIGSGPAGLACADQLNKAGHSVTVIEKSDRIGGLLMYGIPTMKLEKEQVTRRVNLMAEEGIEFVTGVAAGTDVTFAELRAEYDSIVLATGAGNARDIPLAGRDAAGIHFAVPYLTQSTRDNLDNGGVQTLSAKDKNVVIIGGGDTGADCVATALRQGAKSIYQFGIQDKLPELRNGENPWPQYPRVFKMDYAHEEAEAVYGRDPREYLINTTSFEKDAAGNLVGLHTVEVTEDKETRQYTPVEGSEKYFEVDMVLIAIGFSGTTEDIFTNFGVGKTERHTIDAAKGFYRTSEEGVFACGDARHGQSLVVTAIAEGREAAREVDFYLMGETFLP

SEQ ID NO: 90782 - protein, 283 aa, Staphylococcus aureus
EIISNKYNFNYQIEHHEFGGASIDTFGEPLTEKTLNACKRADAILLGAIGGPNWTDPNNRPEQGLLKLRKSLNLFANIRPTTVVKGASSLSPLKQERVEGTDLVIVRELTSGIYFGEPRHFNNHEALDSLTYTREEIERIVHVAFKLAASRRGKLTSVDKENVLASSKLWRKVVNEVSQLYPEVTVNHLLVDACSMHLITNPKQFDVIVCENLFGDILSDEASVIPGSLGLSPSASFSNDGPRLYEPIHGSAPDIAGKNVANPFGMILSLAMCLRESLNQPDA

SEQ ID NO: 90783 - protein, 542 aa, Arabidopsis thaliana
MERIMINPLLSIQNSPTKFLKPPLSSIHRQQQQQERQSNNNTLFMGEARPRRATTFACLSIRRRRNNNGVSEFEETARFEQVGGKGISVLCGLGYWVQGSRCFPWLALNFHMVHSLALQPSTLQLVQYSCSLPMVAKPLYGVLSDVLYIGSGRRVPYIAIGVFLQVLAWGSMGIFQGAREVLPSLVACVLLSNLGASITEVAKDALVAEYGLRYRINGLQSYALMASAAGGVLGNLLGGYLLLTTPPKISFLVFSALLSLQLVVSLSSKEESFGLPRIAETSSVLESVKKQISNLKEAIQADEISQPLIWAVVSIAMVPLLSGSVFCYQTQVLNLDPSVIGMSKVIGQLMLLCLTVVYDRYLKTLPMRPLIHIIQLLYGLSILLDYILVKQINLGFGISNEVYVLCFSSLAEILAQFKILPFAVRLASMCPQGCEGSVTSFLASTLCLSQIVSAFLGVGLANLIGITSSNYSNLSSGILIQSLAALAPLCFMHLVPMSEPVIEKEGKRGISKRSRRNRRVGRVVDKESVTYRRERESEEAQR

SEQ ID NO: 90784 - protein, 181 aa, Rickettsia prowazekii str. Madrid E
MRIDKNLPNYLTIARIMVIPVIILLFYINNSLARKLGALLFVLASITDFFDGYIARKYNLVTSFGKMFDPIADKLLVGCVTIMLLKKDNVDEIPCLLILAREFLVSGLREFLALVKVSVPVSRLAKLKTFLQMFALSILILGSKGSGIIYLDIVGEIILWIAAFLTIITGYSYFKACKTYF

SEQ ID NO: 90785 - protein, 371 aa, Candida albicans SC5314
MASICAAPHCGKETESALKCPVCLKEGVSSVFCNQICFRSSWAIHKGIHKAEDGSEDYNPFPNFEFTGELRPHYPLTPRRAVPKHIKLPDYAQDGKPISEIKNDRIGKIPVLTPKEIEKIRKVTKIAREVLDITASNVKPGITTDELDAILHKECVKRNAYPSPLNYYNFPKSLCTSINEVICHGIPDKTKLQDGDIINLDVTIYYLGFHADLNETYYVGDKAKCNPELVNLVETTRECLDLAIKHVKPGIAFRELGNIIEKHASENNCSVVRTYCGHGCGALFHCQPNIPHYAKNKAIGIAKPGQVFTIEPMLNVGTYKDLSWPDKWTAVTQDGKCSAQFEHMLLVTEDGCEVLSARTETSPGGPGPRIK

SEQ ID NO: 90786 - protein, 415 aa, Fusobacterium nucleatum subsp. nucleatum ATCC 25586
MLAKRYTGKKLVDNIFATSKKAKQAIVKFGKENVINATIGSLYNEDEKLAVYDVVESVYRNLPPEDLYAYATNVIGEDDYLEEVIKAVFFDDYKEALKELHIASIATTGGTGAISNTVKNYMDTGDKVLLPNWMWGTYKNIVIENGGKIETYQLFNENGDFNFEDFKNKVLELAKIQKNVVLILNEPSHNPTGFRMTYEEWVNLLDFFKSIKDTNIIVIRDVAYFEYDDRGEEETKKLRKLLIGMPKNILFMYAFSLSKSLSIYGMRIGAQIAVSSDEEVIQEFKDALPFSCRTTWSNIPKGGMKLFATIMKNPELKANFLKEKQGYMNLLNERANIFLKEAKEENLKVLPYKSGFFVTVPVGETVDKIIEDLESKNIFVIKFDTGIRIGLCSVPKRKIKGLAKKIKDSINKFKN

SEQ ID NO: 90787 - protein, 397 aa, Selaginella moellendorffii
MAVQSRPAGFPSFASSPRRDRHTKERIPRSLLQLQSSTATTSESAAALERQNICKLSALLKDTNLLPERYVIPESHRARLSHDAFLPEVELPMIDFETLKSGAGTESLAREVGNACRDWGFFQIVNHGVPDDLIQEMLLHADQFFHLPYEQKEKAAIFPRPLGYNGRYKDLSSSAPWVEAMAMQQTPYSTVDETVDRVWPGEGNPRLRRALRRYHAEMEKLGQSVVQLIALSLGLERRTFSRHFEESSSTFRWNHYPPCPLPSKALGLLAHSDPSAITILHQDSVGGLQIRKDGRWIAVKPRPDTFVINLGDVFQAWTNGRYKSVEHRAVVNQKQGRLSMVFFYGPQEDYVITPPDELIDEDHPLRYRPFTWGDYSAARLSIPAHGKRHLDVFAGAL

SEQ ID NO: 90788 - protein, 127 aa, Medicago truncatula
MYQAIPYRTSVSTVTRNLPITTGILESNVTTMVSENAVIIIGTRGCCLCHVVKRLLQGLGVNPPVYEVDQDHETAVAAQLSTNTAETVQFPAVFVGGKLLGGLERVMASHISGELVPILKDAGALWL

SEQ ID NO: 90789 - protein, 283 aa, Staphylococcus aureus
EIISNKYNFNYQIEHHEFGGASIDTFGEPLTEKTLNACKRADAILLGAIGGPKWTDPNNRPEQGLLKLRKSLNLFANIRPTTVVKGASSLSPLKEERVEGTDLVIVRELTSGIYFGEPRHFNNHEALDSLTYTREEIERIVHVAFKLAASRRGKLTSVDKENVLASSKLWRKVVNEVSQLYPEVTVNHLLVDACSMHLITNPKQFDVIVCENLFGDILSDEASVIPGSLGLSPSASFSNDGPRLYESIHGSAPDIAGKNVANPFGMILSLAMCLRESLNQPDA

SEQ ID NO: 90790 - protein, 706 aa, Bradyrhizobium japonicum USDA 110
MTALWLIVLCGVLSVVYAIWATSSVLSADAGSPRMQEIAAAVREGAQAYLRRQYTTIGIVGIVIFVLLVYFLGFYVAIGFAIGAILSGAAGFIGMNVSVRANVRTAQAATTSLAGGLELAFKAGAITGMLVAGLALLGVTLYFGFLVYSLKLAPDSRVVVDAMVALGFGASLISIFARLGGGIFTKGADVGGDLVGKVEAGIPEDDPRNPATIADNVGDNVGDCAGMAADLFETYAVTAVATMVLAAIFFAKTPILMSMMTLPLAIGGICIITSIIGTFFVKLGPSQSIMGALYKGLIATGVLSLIGIAVVIYTLIGFGKLDGVDYTGMSLFECGVVGLIVTALIIWITEYYTGTDYRPVKSIAAASVTGHGTNVIQGLAISMEATALPAIVIIAGILVTYSLAGLFGIAIATATMLALAGMIVALDAFGPVTDNAGGIAEMAGLPKEVRKSTDALDAVGNTTKAVTKGYAIGSAGLGALVLFAAYNQDLKFFVADSAHHTYFAGVNPDFSLNNPYVVVGLLFGGLLPYLFGAMGMTAVGRAASAIVEEVRRQFREKPGIMQGTDKPDYGKAVDLLTKAAIKEMIIPSLLPVLSPIVVYFLIYAIAGGGATGKSAAFSAVGAMLLGVIVTGLFVAISMTSGGGAWDNAKKYIEDGHYGGKGSDAHKSAVTGDTVGDPYKDTAGPAVNPMIKITNIVALLLLAILAH

SEQ ID NO: 90791 - protein, 195 aa, Mycobacterium avium 104
MPLLTIGDQFPAYELTALIAGDLSKVDAKQPGDYFTTITSEDHAGKWRVVFFWPKDFTFVCPTEIATFGKLNDEFEDRDAQVLGVSIDSEFVHFNWRAQHEDLKNLPFPMLSDIKRELSLATGVLNADGVADRATFIVDPNNEIQFVSVTAGSVGRNVEEVLRVLDALQSDELCACNWRKGDPTLNATELLKASA

SEQ ID NO: 90792 - protein, 215 aa, Gossypium hirsutum
QKFELSPEALYLTINLIDRFLSVKVVPRRELQLLGMRAMLISTKYEEIWPPEVNDLVCIADRAYTHEQILIMEKTILGRLEWTLTVPTHYVFLARFIKASIPDPKMENMVYFLAELGIMHYETIRYCPSMVAASAVYAARCTLKKTPAWTDTLKFHTGYTEQQLMECAKLLACFHSKAVDSRLQVVYRKYSSSLRGAVALIPACQNLLSGVVSSA

SEQ ID NO: 90793 - protein, 1196 aa, Arabidopsis thaliana
MDLDFDDQPSDHAAPAVRAGARFKPKGRPQPKKKQVSLSTTQTTLSPDVAQEKLSTQSEDLVPLDGSSEIPSNALPSETNVPDSGSINKSTIGTLSEENEDAFPRGVHWSVKPSILRACNNVNLVGNRRDDGIEATTSFPDDPRTQDSAIFGDYVTPETGADEGRVDMETLDIVQEEGTTSSYVQHTGKLQPKPRLLETVVEEPEPHYSAGDTGYFPMGTNESEFMANVESRNGFSTYEDLQEEELNIPEAPRETVGEMEAQNASGGWEQEEQGVSPCINNTVTGEEENCMGNTVEEQSKRESKTGKSKRATSRKRKKTSEEPNKSSEKTEQKKFKHSSRRQKRTLEKELLETPDHEIRSLPLRDMLRLVEYKEWMQKKEAKGAGVQPSQESNNMNGSGSQYHSQGFDEEDEFGDFGIESSEYQENNVVKPDSPVNYQTYMNKTSRTRWSKEDTELFYEGIQEFGSNLSMIQQLFPERTREQMKLKFKLEERRNPLKLNDALSSRSKHFTHFKNVIKKLQQEAAAAKEGEEEEEAGAEAETTDVPENEEPEKSEETERASDGVAAGVKESDGGDVENGVRSDGGDECDDDEDFWNSYKSDIDEKKERKSDFENSEDERRTRIGSLKKKAINASTKFKHSLKKKRRKSDVRVSSVSIEDVRDVEELQAVDEFRQALVMEELLPHKHDDYHMMLRFLKARKFDIEKAKHMWADMIQWRKEFGTDTIIQDFQFEEIDEVLKYYPHGYHSVDKEGRPVYIERLGKVDPNKLMQVTTLDRYIRYHVKEFERSFMLKFPACTIAAKKYIDSSTTILDVQGVGLKNFTKSARELITRLQKIDGDNYPETLHQMFIINAGPGFRLLWSTVKSFLDPKTTSKIHVLGCKYQSKLLEIIDSSELPEFLGGACTCADQGGCMLSDKGPWKNPEIVKMVLHGGAHRAKQVVKVLNSDGKVIAYAKPSYPWIKGSDTSTAESGSEAEDIVVSPKAVKSYSHLRLTPVREEAKVGSGETSFAGSFAGYDEYVPMVDKAVDATWKVKPTAINRAPSKGAHMPPNVPKDHESFSARVLVTFMAFVMAILTFFRTVSNRVVTKQLPPPPSQPQIEGSAAAEEADLLNSVLKKLTELEEKIGALQSKPSEMPYEKEELLNAAVCRVDALEAELIATKKALYEALMRQEELLAYIDRQEAAQHQKKNKRKQMFCF

SEQ ID NO: 90794 - protein, 532 aa, Nostoc punctiforme PCC 73102
MTKAPVAPVVLVILDGWGYCEEKRGNAIVAAKTPIVDSLWAAYPHTLIRTSGKAVGLPEGQMGNSEVGHLNIGAGRVVPQELVRISDAVEDGSIALNPALVKICQEVRSRNSKLHLVGLCSEGGVHSHITHLFGLLDLAKNQQIPEVCIHAITDGRDTAPTDGVRAITMLQNYIDRTGIGRIVTLSGRYYAMDRDHRWDRVKRAYDVMTQDGVGDNRTAVEILQASYAEGVKDEFVNPIRIAPGAIEPGDGVIFFNFRPDRSRQLTQALVSPTFNGFERQQITPLSFVTFTQYDSDLPVAVAFEPQNLSNILGEVIANHGLNQFRTAETEKYAHVTYFFNGGLEEPFAGEDRELVSSPMVATYDHAPAMSAVAVTDVAIAAIQKGTYSLVVINYANPDMVGHTGQIDATITAIETVDRCLGRLLESVIKAGGTTIITADHGNAEYMLDDGGNPWTAHTTNPVPFILVEGEKVKIPGYGTNVELRSDGKLSDIAPTILEILQLPQPPEMTGRSLLKTADYELQRTRTPVQVGL

SEQ ID NO: 90795 - protein, 358 aa, Spinacia oleracea
AAVGEAATQTKARTRSKYEIETLTGWLLKQPMAGVIDAELTIVLSSISLACKQIASLVQRAGISNLTGIQGAVNIQGEDQKKLDVVSNEVFSSCLRSSGRTGIIASEEEDVPVAVEESYSGNYIVVFDPLDGSSNIDAAVSTGSIFGIYSPNDECIVDSDHDDESQLSAEEQRCVVNVCQPGDNLLAAGYCMYSSSVIFVLTIGKGVYAFTLDPMYGEFVLTSEKIQIPKAGKIYSFNEGNYKMWPDKLKKYMDDLKEPGESQKPYSSRYIGSLVGDFHRTLLYGGIYGYPRDAKSKNGKLRLLYECAPMSFIVEQAGGKGSDGHQRILDIQPTEIHQRVPLYIGSVEEVEKLEKYLA

SEQ ID NO: 90796 - protein, 912 aa, Chlamydomonas reinhardtii
MAEREGGFGQNVLGKLKLVGGKVVDLGGTFAGKVVDVGGTVGGKLGDIGGRIGSQIASLAETDFERMRQLNQIAKQQQDLRRKYTEEELQAVEKRADLVLGQLYSGYFEANFDPVAYELSKLNDHDNQDHIDELVERLTLGVETVSGRLSRHVNKKRDVLLAGIDRVAEVEDDLKAAYHISRSSRASLKAAAEEVQRNMRVVGQTRRKQAFMEMMEVVSKIKRARDLQHLLKKSQELGEYGDAILTCVQCFQGMDSLRQLAVSGDLRASVQRAYVDTLRRMDGALTNICSEFDPDKYTKILEGYLLQGIDGKALADKVLQCFTDAIHDVTTRVVVFDILASYHVMAHWHVMAVAKQGQMEAAAQGMNEEARRAQAATASFLTSVNDMLKASRVEVLEVAARRVRDLLGLDNLFKGEDFLQAVDWCGKFGGCCEAFLSGPTELRPAVMASCARFLPAYHRSNLESLTTCLNNEAWQDIGAVTGAAGAVTLELEEAIRDSPYYVPAWGEPGAVQSFDKWMVEGNPFKRGLGQGNAPEGKQKSLALKYIRHYGQIMKPLQGNSEALWRHLSELFDLYLLYCFSAFGGMGLEDLVWRDDLVSPRLKGALLRILTAEGSRYRTLVEELVRNRPLNSRGAPIASTGLGLLDRFGDRMESFADSMERSVSRMAVKLGDSKLAQVMGGAEGSGHGAGGVQLALPGRCSRDVETYFARTVEAAADLKEHLFRAATRVMMQGVWDGERGIPAAIGVTNYNVREPAVRQSPWADFSVRALQTFRERVLAARLPMPLIASLWEYAAGVVAEGILTGLAGVRKCSLEGRANMSLDLSHVERQMRAMGPPGFKPAALAAVDAYIKAFYLPWDDLPKWCQTHISEYGKQRLFTLVEVAAEFNKVKRGQKNDVLEAIEEAADATGRAF

SEQ ID NO: 90797 - protein, 812 aa, Chlamydomonas reinhardtii
MEKYLDLTAIGQGQYGTAYRAKDKYDNQLYCIKRIPMSAKDDHAGALREAQLLDSLDHPNIIRYRESFVDKDGSLCIVTSFCEEGDLFNRIRKKAAAKEYFTEDEVMNMFVQIASAISYIHSKRVLHRDLKTQNIFIAKGGIIKLGDFGISKVLERTDSFATTVTGTPYYMAPEICTNQPYTYKSDIWSLGCVLYELCTLRHAFAADSLLSLVYQIVRGNFPPIPTDQFSNGLSDLVNRLLWRDPATRPSLSEVFKLQFVQKHLDRFKGEEQRRNLKQSTSISRRKQLLDAQPGPGYSEYDGNLTPKQKLERKKQVDRERRELEMRVAAMSANKNREQVAARKKEMIYGSNVGLPGAQVHHQPPPQERGFEDDDMPNLGSVRIDDGPRAAAPPTRPGNRSIWDVDVPEPGPSVNPYAATLPSQARQQQQQQAARPQTSQQGARASPAGSAGRPGAGAPLQRPATTQGGSRGTPGAYGGGMWDDSDDVLQGSVRGTQRTVRAGLQGTASAMDAGGGGGGNNGWTYGRNDDMPNMGTVQFTQGPGSSAFGVGARGSPARPLEYTAGNRTGASDSPLMGSVVLGNTRTMGGVGAGAGASAGRPGSAHSRGGPGGSILSAGPERPASPYTGGAPPYGHARQSPAPDARRPAAQYGTPPGGRAGGGYGAAAGGSHHGHGHHGSHGHDDEDGYSDDFEEDDDDEGVVQQRNRIIANVEDMANRGYDGRDGIAAVQERVLNTGAKHDKARMLRANCERDLGSKFSAVYDYLSRVRSQNPPPEEREVQRRLLEIVGDKSKMNGTFQVDQLVFTEQMYRDS

SEQ ID NO: 90798 - protein, 463 aa, Gibberella zeae PH-1
MKSPIPDYLNQVLENARPIEGGKPASYIETLAKADTSKVAVALAMVDGEIYSAGDDDVEFSIQSISKAFVYALAIEDAGLDKVLEKIGVEPSGDAFNSLSLERGSNRPMNPMINAGAITAHSLIGKPDWTMEQRTERILNALSLLAGRQLHVCEEVYEAELRGADRNMGIGYMLKAAGIITGDAQQIVTGYIRQCAINVNVRDLATMAATLCNAGIHPISGDRIIPQDSVRQILSVMSTCGMYDAAGDWLSRIGIPAKSGVAGGIIGALPGQMGIAVFSPKLDHRGNSVRGVAICEQLSSDMGLHMMDVSQIAQATVRTSVATIVAGDNEPNHSNCNKEILIFSLRGVVRFAGSERLTREITRVLGAPNPDDPGCGSSRHACAIVFSFRDVFSFNAVAQRIIQADITRLLLDGRTIVVIDPSGVLTIDTARAGAKLKVVKSETDARDFIGGIGCHTVSKSDEW

SEQ ID NO: 90799 - protein, 135 aa, Physcomitrella patens subsp. patens
MGLGYICPAYECYKVVDRPRADLENLRFWCQYWMIIAVVTVLERLGDIFISWMPMYCEAKLAFIIYLWYSKTMGTTCLYSKLLKPFVAKHESEIDHNLNELKTRAGEIALVWWQKWSIHVQARFHELLQFLARQS

SEQ ID NO: 90800 - protein, 498 aa, Rickettsia prowazekii str. Madrid E
MSTSKSENYLSELRKIIWPIEQYENKKFLPLAFMMFCILLNYSTLRSIKDGFVVTDIGTESISFLKTYIVLPSAVIAMIIYVKLCDILKQENVFYVITSFFLGYFALFAFVLYPYPDLVHPDHKTIESLSLAYPNFKWFIKIVGKWSFASFYTIAELWGTMMLSLLFWQFANQITKIAEAKRFYSMFGLLANLALPVTSVVIGYFLHEKTQIVAEHLKFVPLFVIMITSSFLIILTYRWMNKNVLTDPRLYDPALVKEKKTKAKLSFIESLKMIFTSKYVGYIALLIIAYGVSVNLVEGVWKSKVKELYPTKEAYTIYMGQFQFYQGWVAIAFMLIGSNILRKVSWLTAAMITPLMMFITGAAFFSFIFFDSVIAMNLTGILASSPLTLAVMIGMIQNVLSKGVKYSLFDATKNMAYIPLDKDLRVKGQAAVEVIGGRLGKSGGAIIQSTFFILFPVFGFIEATPYFASIFFIIVILWIFAVKGLNKEYQVLVNKNEK

SEQ ID NO: 90801 - protein, 363 aa, Zea mays
MGVYLSTPKTDKLSADGENSRVRFGLSSMQGWRTTMEDAHAALPDLDECTSFFGVYDGHGGKAVSKFCARHLHKQVLINDANSSGDLPTSLHKAFLRMDEMMKGQRGWRELTELGDKGNKISGMIDDIIWPPKGGDSDKIREDWDTEEGPNSNFPGPTSGSTACVAVIRNDKLIVANAGDSRCVISRKGQAYNLSTDHKPDLEEERERILGAGGFVVAGRVNASLNLSRAIGDMELKQNDLLPVERQIVTAEPELKTVQLSEDDEFIVLACDGIWDCMSSQEVVDFVHKQLKTEDKISSVCEKLLNRCVAPTSGGEGCDNMTVIVVQFKKPALAVATSSAEQSATTAEGMRPNEVDGPDYPPK

SEQ ID NO: 90802 - protein, 108 aa, Glycine max
  misc_feature (15)..(23): Xaa can be any naturally occurring amino acid
  misc_feature (84)..(87): Xaa can be any naturally occurring amino acid
ISPVLHLQNGEAQDXXXXXXXXXVDPVTEFRFDESASQLSGALNGASIIDLKRTQIRDDLLVITSGKAVSELQPKLDAIVKCPXXXXMVSAIAPPGSGFDFYIRFFIL

SEQ ID NO: 90803 - protein, 140 aa, Rickettsia prowazekii str. Madrid E
MTIQYTFSMIKPDVIKRNKIGQVNTYLENAGLKIVAQKMKFLTKYEAECFYDEHRARSFFNSLVEYITSGAVVLQVLKGEDAITLNRTIMGATNPAEAKEGTIRKDLGESIEANSIHGSDSENSAKREIKFFFSKSEIIE

SEQ ID NO: 90804 - protein, 283 aa, Staphylococcus aureus
EIISNKYNFNYQIEHHEFGGASIDTFGEPLTEKTLNACKRADAILLGAIGGPKWTDPNNRPEQGLLKLRKSLNLFANIRPTIVVKGASSLSPLKEDRVEGTDLVIVRELTSGIYFGEPRHFNNHEALDSLTYTREEIERIVHVAFKLAASRRGKLTSVDKENVLASSKLWRKVVNEVSQLYPEVTVNHLLVDACSMHLITNPKQFDVIVCENLFGDILSDEASVIPGSLGLSPSASFSNDGPRLYEPIHGSAPDIAGKNVANPFGMILSLAMCLRESLNQPDA

SEQ ID NO: 90805 - protein, 391 aa, Haloarcula marismortui ATCC 43049
MRVVAKFGGTSLGSGDRINRAADSIAAAVQQGHEVAVVASAMGNTTDELLEEINYDADSADRAEIVSMGERTSVRMLKGALAARGIEAVFLEPGSEDWPIITDEYGEVDVEETQKRAHALAGQLKDVVPVITGFLAQDYQGNVTTLVRGGSDTSAVMMGDYMDADEVVIVTDVEGVMTGDPRVVEGARNVGKISVDELRSLSFRGAEVVAPSALSYKSEDLGVRVVHYQHGDLLSGGTSIEGEFQNLIDLQEQPIACVTVAGRAIRNSPGILADLSGAIADEDINIEANSSGMDSLTFYVDEDDAEEAEALLHARIVDDETLSSVTVEDEIAVIRVTGGDPSQSALAHQVVAPLADAHIHLYDVITSATSVSVFVPWEDREQALSLVQDVF

SEQ ID NO: 90806 - protein, 217 aa, Escherichia coli
MAQTLLSSFGTPFERVENALAALREGRGVMVLDDEDRENEGDMIFPAETMTVEQMALTIRHGSGIVCLCITEDRRKQLDLPMMVENNTSAYGTGFTVTIEAAEGVTTGVSAADRITTVRAAIADGAKPSDLNRPGHVFPLRAQAGGVLTRGGHTEATIDLMTLAGFKPAGVLCELTNDDGTMARAPECIEFANKHNMALVTIEDLVAYRQAHERKAS

SEQ ID NO: 90807 - protein, 167 aa, Fusobacterium nucleatum subsp. nucleatum ATCC 25586
MSLQAIIKTNKGEINLNLFSDVAPVTVLNFITLAKTGYYNGLKFHRVIEDFMVQGGDPTGTGAGGPGYQFGDEFKEGVVFNKKGLLAMANAGPNTNGSQFFITHVPTEWLNYKHTIFGEVVSQKDQDVVDSIKQGDTMNEVTIIGDTDRLIEDNKEFYTQLKNFLKI

SEQ ID NO: 90808 - protein, 550 aa, Brassica napus
MSHSIQFSTPSRTLHLPPTRLHPPLSSFSFRQFPLTSTFKHTSLRASSSPSPDSSSSSSLLHSPNGTPAVKSEERSSGIDVDTVTEAELKENGFRSTRRTKLICTIGPATCGFEQLEALAEGGMNVARLNMCHGTRDWHRDVIRSVRRLNEEKGFAVAIMMDTEGSEIHMGDLGGEASAKAEDGEVWTFTVRAFDASRPERTISVSYDGFAEDVRVGDELLVDGGMVRFDVIEKMGPDVKCLCTDPGLLLPRANLTFWRDGSLVRERNAMLPTISSKDWLDIDFGIAEGVDFIAVSFVKSAEVINHLKSYLAARPGGGDIGVIAKIESIDSLTNLEEIILASDGAMVARGDLGAQIPLEQVPAAQQRIVKVCRELNKPVIVASQLLESMIEYPTPTRAEVADVSEAVRQRSDALMLSGESAMGQFPDKALTVLRSVSLRIERWWREEKRYESTPLQPIGSGFSDRISEEICNSAAKMANNLGVDAVFVYTKDGHMASLVSRTRLSQFSEDMESNLNKTFSLLKSRGMIKSGDLVIAVSDMLQSIQVMNVP

SEQ ID NO: 90809 - protein, 343 aa, Gibberella zeae PH-1
MAADDSPTFEEHFSRLSIDHKSVGSQSKRVPKTKIPQSQPVPGPAQPKCLLPVKGPVVANRVDTPTPHKDQDTNSPSPSSPQKPTTKSSTTKSATLYKHLHLGMFEIGRPMGKGKFGRVYLARERSSGFICALKVLYKTELRQSRMESQVRREIEIQTNLRHPNIVQLYSHFHDSKRIVLVLEFAAKGELYKHLQKETRFTERKAARFIAQVVSALQYLHRKNIIHRDIKPENILVGMHDELKMSDFGWSVHSPSKRRETMCGTLDYLPPEMIKLGAVDAGRFYDEKVDVWSLGVLTYEFLVGVPPFEDTPVRTQRRIARADMQIPDFISSKAKHLIKSACSL

SEQ ID NO: 90810 - protein, 724 aa, Debaryomyces hansenii CBS767
MSFSLTVAAKAPLVAYPSLIGVGFIDASDSEISIPIEFVDEKTVDSTDAGVKLVTPEGKTYSNQLDILNYLAEKFPSILGEQAKSQEWVKFALDKLSNKNFKELAGDLEKLDAHLNFRSFVIGYSYSLADVAIWGVLRANALMGSVIKNGVYTNVSRWYNLLAADKKFDGSVENMTKLVNELRKSAKSSKNGGKKETHKANFEIDLPNAEVGKVVTRFPPEPSGYLHIGHAKAAVLNEYFAHAYKGKLIIRFDDTNPTKEKIEFQDSIIEDLALLGIKGDKITYSSDYFQDMYDLAIKLIKEGKAYCDDTPLEKMREERMVGDASARRERSIEENLKIFTEEMKNGTEGGLKNCLRAKIDYTALNKTLRDPVIYRCNVTPHHRTGSEWKIYPTYDFCAPVVDSIEGVTHALRTNEYRDRNAQYNWIIDALGLRKVDIWDFARVNFVRTLLSKRKLQWFVDKNYVSNWDDPRFPTVRGVRRRGMTVEGIRNFIIAQGPSRNIINLDWSVIWALNKKIIDPAAPRHTAVDAKNVVPVKLLNGPSEPFTEEKPKHKKNPEVGNKPVIYSNQVLIDQADAEGLVDGEEITFMDWGNVIISKVVKEGDVVKSIEANLHLEGDFRKTSKKITWLADTKDKVEVELMDFDHLITKDKLEEGDSFEDFLTPQTEFTVEAIADLSVRNMKAGDIIQFERKGYYRVDQPYSEGKRPVLYNIPDGKTVSRYGTKK

SEQ ID NO: 90811 - protein, 163 aa, Bradyrhizobium japonicum USDA 110
MADARRAPLKDQTDISGARALIVEARFYDDLQDALLDGAVAELKAAGLTHDVITVPGALEIPAAVAIAVDAAAANGKPYDAVIALGCVIRGDTIHFEIVSQESSRALMDLAVSRKLPLGNGILTVNTEAQAWARARASELNKGGDAARAALAMLRIKRRLARA

SEQ ID NO: 90812 - protein, 331 aa, Candida albicans SC5314
MFIDFTVVVLLTKLISSHIISLHQRYNTQKKNKEKKNVYNKLFHLLFAHQTPTKFNKDMSRTGVLVLGPAGVGKSTFCNSMIAYMQSIGRRAHIVNLDPAANPTEYEFTIDVKDLISLQDVMEEMELGPNGGLVYCFEFLLNNLDWLDEEIGDYNDEYLIFDCPGQIELYTHIPVLPTIVRHLQTSLNFNLCATYLLEAPFIIDNSKFFSGALSAMSAMILLELPHINILSKIDLVKDEYSKKQLKKFLNPDPLLLAKQEDYINPKFAKLTQSIANLVDDFGMVQFLPLDCSKDSRSVETILSYIDDVTQWSEAQEPKEPHDEVELPDEVF

SEQ ID NO: 90813 - protein, 121 aa, Oryza sativa Indica Group
MTMTMSNEQGKPEANVRGGRRSGHRVHARHLPGLPTLAAAPARTNGSSWAPGKTEHCTAQHKRRLQAVRDKPQQASVMASEGAVSPAFAYTVVYVKDVAKSAAFYSAAFGYTVRRLDQSHK

SEQ ID NO: 90814 - protein, 244 aa, Triticum aestivum
  misc_feature (92)..(92): Xaa can be any naturally occurring amino acid
MSSSSKLFQSACKAARSFLASSSAPAAASSVLADGRNAALATLANLGRNSTLPAAYAHHLHTNAASSQGYAWIAAIPAAVYMLQDQEVHAAXEMERTFIAIKPDGVQRGLISEIVSRFERKGYKLVAIKLVVPSKQFAEKHYHDLKERPFFNGLCDFLSSGPVLAMVWEGEGVIKYGRKLIGATDPSKSEPGTIRGDLAVVVGRNIIHGSDGPETAKDEIALWFQPKELVSYTSNEEKWIYGVN

SEQ ID NO: 90815 - protein, 216 aa, Zea mays
MAEVEAPAAAVEAPAAAVAPTTPEVAAPEAGAATEAKGPHKLHRQWTFWYDIQTKTKSGAAWGTSLKKAYTFDTVEEFWSMYDQIFRPSKLSGSADFHLFKAGVEPKWEDPECANGGKWTVPCNRKATFETMWLETLMALIGEQFDETEDICGIVASVRARGDKLALWTRTASNEAVQVNIGKKWKDVIDYNDKITYTFHDDSKRDKPSRGGRYTV

SEQ ID NO: 90816 - protein, 320 aa, Mycobacterium avium 104
MPRLDNPADEKPGIDPILQKVLDAVPFRLSTEDGIDAARQRFRDLPRRPLHPELRVEDRTIPGPQGAIAVRIYWPPIHSESRPAPVVLYFHGGGFVIGDLDTHDGTARQHAVGAGAIVVSVDYRLAPEHPYPAAVEDAWAATLWAAENAAGLHGDPGRIAVAGDSAGGTLAAVTAQRARDRGGPPVRFQLLWYPSTMWDASLPSFAENATAPILDVKAVAEFSRWYAGDVDLSDPPADMAPGRATDLSNLPPAYIGVAGYDPLRDDGIRYGERLAAAGVAAQVHNAETLVHGYLGYAGVVPAATAAMERGLVALRTALQG

SEQ ID NO: 90817 - protein, 492 aa, Gibberella zeae PH-1
MASNILPGNGHGHGHGHNSSGHRDESTPLLPQISSHIAHEGESGRSGFHPRHFLAVLWRSSCTASMWVNVLWPIVPVAIILQFFPGMHLWKFATAYVAVIPTANLLGFAGQEFARKMPKVAGILIETTFGSIIEIILFIVLLAKHENQGPNDNGDEGNLIPIIQAAILGSILTNLLLCLGLCFFVGGLKQASQKFHAIVSEVGTGLLLVAAFGLLIPSAFYSALKAEVVPDFPGFRVLHERFTEDKLQEDVVRISQSTSVALIVAFFMYIWYQASSQHSIFDEVIEMDEHRDADREADMEKPKFTMTETIVALLLALVFVTALLIFLVEKIEHVVEAGIPDQFLGLILLPFVEKAAEHLTAIDEAYDGVINVALYHCLGPSIQTALFNGPLVVLVGWAIGKPMDLNFEIFMIVLLVLSILVVGNFLRDGESNWLEGALLVVIYAIIAIACWYYPNPDVATSNGLEGSEMVNVTMSVDTLRQLQQLLNAHLPL

SEQ ID NO: 90818 - protein, 504 aa, Matthiola incana
MLAAYAIPILTAILSIFWYLLKRVQRRPPLPPGPRGLPIVGNLPFLDPDLHTYFTSLAQTHGSIFKLNLGSKLTVVISSPSLAREILKDQDINFANHDVPLTGRAATYGGLDILWSPYGAEWRMLRKVCLLKLLSRKTLDSFYELRRKEIRERTRFLYKQSRGEAPVNVGDQLFLTMMNLTMNMLWGGSVKAEEMASVGTEFKGVISEITRLIGEPNVSDFFPWLARFDIQGLVKSMRVSARQLDAVFDRAIKQMQQITSSDGECKDFLQYLMKLKDQESDSEVPITLNHVKAVLTDMVVGGTDTSMNTVEFAMAELINKPELMKKAQQELDQVVGKDNIVEESHITKLPYIVAIMKETLRLHPTLPLLVPRRPAEAAVVGGYTIPKDTKIFINVWCIQRDPNVWEKPTEFRPERFLDNNKPRDFTGTDYSYFPFGSGRRICAGVALAERMVLYTLATLLHSFDWKIPQGHVLDLEEKIGIVLKLKTPLVALPVPRLSDSNLYI

SEQ ID NO: 90819 - protein, 510 aa, Clostridium acetobutylicum ATCC 824
MAKKPVMLMILDGFGISDKVDGNAVKAASKPNFDKYFNNYPHTHLGASGLSVGLPDGQMGNSEVGHLNIGAGRIVYQSLTKITKAIEDGDFFKNAALNKAVNNVLENDSTLHLMGLLSPGGVHSHTNHLKGLLQLAKKKNVKKVFVHAFLDGRDVPPSSAKEFIKDIEDYMNEIGLGEIATVSGRYYAMDRDNRWEREELAYNAMVLGKGEEAESAIKAVDASYHDNKTDEFVLPTVIVKEGKPVATIKDKDSVIFFNFRPDRARQITRAIAEEAFDGFKRDRLNIEFVTMTEYDASFKGVDVAFGPENITNTLGEYVSNKGLNQLRIAETEKYAHVTFFFNGGVEEPNKNEDRALISSPKVATYDLKPEMSAYEVTDELLKRLDEDKYDMVILNFANPDMVGHTGILEAAKKAVETVDECLGKIVDKVLKLDGSVFITADHGNSEQMIDYSNGKPMTAHTVNPVPFVYVSNHTEAKKLNEGVLADIAPTMLQEMGLEKPEEMTGKSLFE

SEQ ID NO: 90820 - protein, 87 aa, Oryza sativa Japonica Group
MAAAGGGGAGAAGGRKVSFSVPEAAPFTAVLKFAAEEFKVPPQTSAIITNDGVGINPQQSAGNVFLKHGSELRLIPRDRVGALAAPF

SEQ ID NO: 90821 - protein, 431 aa, Clostridium acetobutylicum ATCC 824 [sequence omitted]

SEQ ID NO: 90822 - protein, 399 aa, Bartonella henselae str. Houston-1
MTQTIPSPKPWSINKPTALLVLANGTVIEGKGAGATGFAEAEICFNTAMTGYEEILTDPSYKKQIVNFTFPHIGNVGTNSEDIEDLIPLNCHGAVGAIFKADITHPSNYRANENLNQWLKKRKIIALCGIDTRALTVLIREKGALNGIIAHDPNGNFDINTLKKRAQKWTGLVNLDLAQEVTSKQSMKWNEKPWVWNKGYKTNNDASNFHIVAIDYGIKRNILRLIAAHSAHITIVPANTNIEEILAMNPDGVFLSNGPGDPAATANYAVPTIQALIDSNIPLFGICLGHQLLALAVGAKTIKMHQGHHGANHPVKDFITGKVEIVSMNHGFTVDTTSLPQHVEETHISLFDNSNCGLRIIGKPVFSVQHHPEASPGPQDSHYLFQRFFNLIMDYKKTA

SEQ ID NO: 90823 - protein, 265 aa, Petunia x hybrida
MAQLRADDLSFIFGLLGNIVSFMVFLAPVPTFYKIYKRKSSEGYQAIPYMVALFSAGLLLYYAYLRKNAYLIVSINGFGCAIELTYISLFLFYAPRKSKIFTGWLMLLELGALGMVMPITYLLAEGSHRVMIVGWICAAINVAVFAAPLSIMRQVIKTKSVEFMPFTLSLFLTLCATMWFFYGFFKKDFYIAFPNILGFLFGIVQMLLYFVYKDSKRIDDEKSDPVREATKSKEGVEIIINIEDDNSDNALQSMEKDFSRLRTSK

SEQ ID NO: 90824 - protein, 401 aa, Methanopyrus kandleri
  misc_feature (400)..(400): Xaa can be any naturally occurring amino acid
MEDLVSVGITHKEAEVEELEKARFESDEAVRDIVESFGLSGSVLLQTSNRVEVYASGARDRAEELGDLIHDDAWVKRGSEAVRHLFRVASGLESMMVGEQEILRQVKKAYDRAARLGTLDEALKIVFRRAINLGKRAREETRISEGAVSIGSAAVELAERELGSLHDKTVLVVGAGEMGKTVAKSLVDRGVRAVLVANRTYERAVELARDLGGEAVRFDELVDHLARSDVVVSATAAPHPVIHVDDVREALRKRDRRSPILIIDIANPRDVEEGVENIEDVEVRTIDDLRVIARENLERRRKEIPKVEKLIEEELSTVEEELEKLKERRLVADVAKSLHEIKDRELERALRRLKTVLQDFAEAYTKRLINVLTSAIMELPDEYRRAASRALRRASELNGXE

SEQ ID NO: 90825 - protein, 268 aa, Oceanobacter sp. RED65
MHNHTESLFAGLWQDYVNHTPSAMSIHELLGATQDKPIINDHIALRTFNHDKVNLDKLAEHFIRLGYKEGGEYHFKAKKLYAKHFEHEDPTLPKVFISQLLCEQLSEQAQHLINQLVDSVDEQAYLADDFLYSGIHWSVERQVYETLAAESEYAAWMSAWGFRANHFTVSINELEQYDTIEAVNQKLKDSGYTLNSAGGEIKGSPEVLLEQSSTMADTKTLDFSDGQLTIPSCFYEFALRYKKPDGKLYSGFVEASADKIFESTNKAD

SEQ ID NO: 90826 - protein, 205 aa, Zea mays
EYLPKELIFNINYLGAEQASFTLNFSKGASQVIGQYYQMIRLGKRGYRSIMTNITRTADYLAEQLEQLGFVIMSERGGKGLPLVAFRLPADRDSEQFDEFALAHQLRERGWIVPAYTMAPNSNSLKLMRVVVREDFSKNRCDALLADIKLALKTLSDMDKAMLERYTHHVRVHSTNSHKSKHVHPHYKNETHSLQGKHGKTPGVC

SEQ ID NO: 90827 - protein, 400 aa, Bartonella henselae str. Houston-1
MAFIADKLSHIKPSATIAVSQKARNLKVLGRDVITLGAGEPDFDTPENIKNAAIEAIRRGETKYTPISGIPELRQAISAKFKRENNLTYQPEQIIVGTGGKQILFNALMATLNKGDEVIIPSPYWVSYPEMVTLNGGIPVFLETKAEFSYKLQPQELEAAITHKTKWFIFNSPSNPSGAAYTHEELKKLTDVLIKYPHVYILTDDIYEHLTYEGFTFVTPAQVEPNLYDRTLTMNGVSKAYAMTGWRIGYAGGPQELIKAMDTIQGQQTSGTSSISQWAAVEALNGPQDFIAKNKTVFQTRRDLVVSMLNQAPGIECPTPEGAFYVYPSCAKLIGKKTPEGKVIAHDEDFVTALLEAESIAVVHGSAFGLGPAFRISYATSEKFLEEACSRIKHFCESLL

SEQ ID NO: 90828 - protein, 218 aa, Gossypium hirsutum
VYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDR

SEQ ID NO: 90829 - protein, 331 aa, Methanosarcina acetivorans C2A
MKLAVIEGDGIGREVIPAAVEVLDAFGLELEKVSLELGYARWERTGSAISEEDIATIKGCDAVLFGAVTTVPDPSYKSVLLTIRKELDLYANVRPVKPLPGITGVTGRNDFDFIIVRENTEGLYSGIEEIGPDLSWTKRVVTRKGSERVAEYACKLAKQRKNKLTIVHKSNVLKSDKLFLDVCRQVASSHGVEYGDMLVDSMAYSLMMRPDKYDVVVTTNIFGDILSDMCAALVGSLGLVPSANIGEKYAFFEPVHGSAPDIAGKGIANPLAAILCVKMLLEWSGRGKEAALIDRAISYILEKKLITPDLGGVSTTAEVGQTVAKYVMQNL

SEQ ID NO: 90830 - protein, 283 aa, Staphylococcus aureus
EIISNKYNFNYQIEHHEFGGASIDTFGEPLTEKTLNACKRADAILLGAIGGPKWTDPNNRPEQGLLKLRKSLNLFANIRPTTVVKGASSLSPLKAERVEGTDLVIVRELTSGIYFGEPRYFNNHEALDSLTYTREEIERIVHVAFKLAASRRGKLTSVDKENVLASSKLWRKVVNEVSQLYPEVTVNHLLVDACSMHLITNPKQFDVIVCENLFGDILSDEASVIPGSLGLSPSASFSNDGPRLYEPIHGSAPDIAGKNVANPFGMILSLAMCLRESLNQPDA

SEQ ID NO: 90831 - protein, 121 aa, Gibberella zeae PH-1
MVHHITSNDELQKLLSSTTYVAVDFFADWCPPCKAIAPVYEQLSTKHSVPDVLAFAKVNVDHVQDAAQQYGITAMPTFMFFKEGKQVAVNGQAVIKGADPRTLGAAAEKLGGLAQKRVAGA

SEQ ID NO: 90832 - protein, 241 aa, Medicago truncatula
MEIDRPDGRSPNQLRPLACSHSVLHRAHGSATWAQGETKVLAAVYGPKAGTKKNENPEKASIEVIWKPNTGHVGQADREYEMILKKTLESICIRTIYPNTTTSVIVVHDDGALLPCAINAACAALVDAGIPLRHLAVAICCSVTDNNSIILDPSKKEEEKSKAFAYLVFPNTTVSVVPEKSSQVGNDPMAHGIITSVTHGAMSVDDYLHCLERGRATTQRLSEFLRKNIAPKSTREASKAG

SEQ ID NO: 90833 - protein, 139 aa, Oryza sativa Indica Group
MASEGAVSPAFAYTVVYVKDVAKSAAFYSAAFGYTIRRLDQSHKWAELESGTTTIAFTPLHQRETDALTGAVQLPDSAGERGPVEICFDYADVDAAYRRAVDSGAVPVSPPEQKSWGQKVGYVRDIDGIIVRMGSHVRA

SEQ ID NO: 90834 - protein, 650 aa, Candida albicans SC5314
MSRFLRSTLAKSVLAASAAVGGTVVYLDFIRPKNEPHLATSYKPFNKDIPPPPSRESLIGNLKKVPQFDVLVIGGGAVGTGTAVDAATRGLNVCLLEKTDFGAGTSSKSTKMAHGGVRYLEKAIFQLSRAQLDLVIEALNERGNMLRTAPHLCTVLPIMIPVYNWWQVPYFFAGCKMYDWFAGKQNLRSSTIFSTEQAAAIAPMMDTSNLKATCVYHDGSFNDTRYNVTLALTAIENGATVLNYFEVEQLLKDSNGKLYGVKAKDLETNESYEIKAKSVVNATGPFADKILEMDEDPQGLPPKVEQSPRMVVPSSGVHVVLPEYYCPTTYGLLDPSTSDGRVMFFLPWQGKVLAGTTDTPLKKVPENPVPTEEEIQDILNEMQKYLVFPIDRNDVLSAWSGIRPLVRDPSTIPKGQEASGKTEGLVRSHLLVQSPTGLVTISGGKWTTYREMAQETIDYVVKHFDFGDKKILPCQTNKLILVGGTDYSKNYSARLIHEYHIPLKLAKHLSHNYGSRAPLILDLYAESDYNKLPVTLAATEEFEPSEKKANEDNQLSYQRFDEPFSIAELKYSLKYEYPRTPLDFLARRTRLAFLNAREALSAVDGVVEIMSKEYGWDKETEEKLRKEARQYIGNMGISPKKFDVEKIVIQ

SEQ ID NO: 90835 - protein, 572 aa, Escherichia coli
MSMSEKHPGPLVVEGKLTDAERMKLESNYLRGTIAEDLNDGLTGGFKGDNFLLIRFHGMYQQDDRDIRAERAEQKLEPRHAMLLRCRLPGGVITTKQWQAIDKFAGENTIYGSIRLTNRQTFQFHGILKKNVKPVHQMLHSVGLDALATANDMNRNVLCTSNPYESQLHAEAYEWAKKISEHLLPRTRAYAEIWLDQEKVATTDEEPILGQTYLPRKFKTTVVIPPQNDIDLHANDMNFVAIAENGKLVGFNLLVGGGLSIEHGNKKTYARTASEFGYLPLEHTLAVAEAVVTTQRDWGNRTDRKNAKTKYTLERVGVETFKAEVERRAGIKFEPIRPYEFTGRGDRIGWVKGIDDNWHLTLFIENGRILDYPARPLKTGLLEIAKIHKGDFRITANQNLIIAGVPESEKAKIEKIAKESGLMNAVTPQRENSMACVSFPTCPLAMAEAERFLPSFIDNIDNLMAKHGVSDEHIVMRVTGCPNGCGRAMLAEVGLVGKAPGRYNLHLGGNRIGTRIPRMYKENITEPEILASLDELIGRWAKEREAGEGFGDFTVRAGIIRPVLDPARDLWD

SEQ ID NO: 90836 - protein, 283 aa, Staphylococcus aureus
EIISNKYNFNYQIEHHEFGGASIDTFGEPLTEKTLNACKRADAILLGAIGGPKWTDPNNRPEQGLLKLRKSLNLFANIRPTTVVKGASSLSPLKAERVEGTDLVIVRELTSGIYFGEPRYFNNHEALDSLTYTREEIERIVHVAFKLAASRRGKLTSVDKENVLASSKLWRKVVNEVSQLYPEVTVNHLLVDACSMHLITNPKQFDVIVYENLFGDILSDEASVIPGSLGLSPSASFSNDGPRLYEPIHGSAPDIAGKNVANPFGMILSLAMCLRESLNQPDA

SEQ ID NO: 90837 - protein, 283 aa, Staphylococcus aureus
EIISNKYNFNYQIEHHEFGGASIDTFGEPLTEKTLNACKRADAILLGAIGGPKWTDPNNRPEQGLLKLRKSLNLFANIRPTTVVKGASSLSPLKEECVEGTDLVIVRELTSGIYFGEPRHFNNHEALDSLTYTREEIERIVHVAFKLAASRRGKLTSVDKENVLASSKLWRKVVNEVSQLYPEVTVNHLLVDACSMHLITNPKQFDVIVCENLFGDILSDEASVIPGSLGLSPSASFSNDGPRLYEPIHGSAPDIAGKNVANPFGMILSLAMCLRESLNQPDA

SEQ ID NO: 90838 - protein, 283 aa, Staphylococcus aureus
EIISNKYNFNYQIEHHEFGGASIDTFGEPLTEKTLNACKRADAILLGAIGGPKWTDPNNRPEQGLLKLRKSLNLFANIRPTTVVKGASSLSPLKQERVEGTDLVIVRELTSGIYFGEPRHFNNHEALDSLTYTREEIERIVHVAFKLAASRRGKLTSVDKENVLASSKLWRKVVNEMSQLYPEVTVNHLLVDACSMHLITNPKQFDVIVCENLFGDILSDEASVIPGSLGLSPSASFSNDGPRLYEPIHGSAPDIAGKNVANPFGMILSLAMCLRESLNQPDA

SEQ ID NO: 90839 - protein, 140 aa, Glycine max
MASAWCLLAPAATGAAPGALGVSASESRGVFAARAAVPERTRRRWDSLVVCVAPDEEKITRRSPLDFPIEWEKPKPGRRPDIFPKFSPMKTPLPHPLPADDPLDDDEEEEEEEAQPQEEPQEDDPDKEDPEEDDPDKPTE

SEQ ID NO: 90840 - protein, 323 aa, Escherichia coli
MSKIFEDNSLTIGHTPLVRLNRIGNGRILAKVESRNPSFSVKCRIGANMIWDAEKRGVLKPGVELVEPTSGNTGIALAYVAAARGYKLTLTMPETMSIERRKLLKALGANLVLTEGAKGMKGAIQKAEEIVASNPEKYLLLQQFSNPANPEIHEKTTGPEIWEDTDGQVDVFIAGVGTGGTWTGVTPYIKGTKGKTDLISVAVEPTDSPVIAQALAGEEIKPGPHKIQGIGAGFIPANLDLKLVDKVIGITNEEAISTARRLMEEEGILAGISSGAAVAAALKLQEDESFTNKNIVVILPSSGERYLSTALFADLFTEKELQQ

SEQ ID NO: 90841 - protein, 283 aa, Staphylococcus aureus
EIISNKYNFNYQIEHHEFGGASIDTFGEPLTEKTLNACKRADAILLGAIGGPKWTDPNNRPEQGLLKLRKSLNLFANIRPTTVVKGASSLSPLKQERVEGTDLVIVRELTSGIYFGEPRHFNNHEALDSLTYTREEIERIVHVAFKLAASRRGKLTSVDIENVLASSKLWRKVVNEVSQLYPEVTVNHLLVDACSMHLITNPKQFDVIVCENLFGDILSDEASVIPGSLGLSPSASFSNDGPRLYEPIHGSAPDIAGKNVANPFGMILSLAMCLRESLNQPDA

SEQ ID NO: 90842 - protein, 347 aa, Alkaliphilus metalliredigens QYMF
MYSRCVEDRIKDLSNLIGNTPLLEIEFTYKGERRRIFAKAEHYNLTGSIKDRMALHIIKKGYESGELKVGDIIAEATSGNTGIAFSAIGSSLGHNVTIFMPDWMSEERKNLMKSYGADIQLVSKEQGGFLGSIAMAEEFAKDNENVFLPCQFSNENNCQAHYLTTGPEIWTQLQDLNLIPDGIVAGVGTGGTIMGIGNYLKEKNPDVKVYPLEPISSPTLTTGYKVGNHRMQGISDEFIPSIVKLNELDEVIAVDDGDAIIMAQKLANALGIGVGISSGGNFLGALRVQEILGKECIIVTIFSDDNKKYLSTDLMKKEPIKEGFMSTEVELISVISHKRQCVTCLAK

SEQ ID NO: 90843 - protein, 450 aa, Bradyrhizobium japonicum USDA 110
MDARSPDLTTDAAGWRTDVPTTKSLAEVNASVALPTAGVWWRRLLAFVGPGYLVSVGYMDPGNWATDLAGGSKFGYTLLSVILLSNLMAILLQSLAARLGIVTDRDLAQACRATYSPAVNFLLWLACEAAIIACDLAEVIGTAIALKLLFGIPLIGGALIAALDAFLLLLLMNRGFRFLEAFVIALLAVIAVCFAVQIVAAAPPVAEVLHGFMPKSEIFTNPEMLYIAIGIIGATVMPHNLYLHSSIVQTRAYERNETGRREAIKWATTDSTIALMLALFINAAILVVAAATFHKSGHSDVAEIGQAFELLSPLLGLGIASTLFAIALLASGLNSTVTATLAGQIVMEGFLDLRLPSWARRLLTRGIAIIPVIIVTAIYGERGTADLLVFSQVVLSMQLPFAVIPLVRFVSDRRKMGKFAISPYVAAIAWIVAGVIVVLNLKLLADTLLG

SEQ ID NO: 90844 - protein, 500 aa, Xylella fastidiosa Ann-1
MLLTQTKTPPHQPTLTSESETRSMHNTLLLFGATGDLAQRYLFPSLLQLFTDGLLPQDFRIRALALSPHNTTQFRDILRPRLEQALPIANTAHIQALLQRVDYLSVDLNDPTSIAEAVRDLTEHPCISYLAIPPGLYTNTALGLAQGGALQTPHRLMLEKPIGRDSINAREILNTIGTLIDEDRIFRVDHYLGKAAVQNLVALRFGNTLLEAVWNRNHIESVHILIAETEGVDGRNAYYARAGALRDMMQSHILQLLCLVAMEPPASLEADRIRDEKVKVLRALRPLNAQNAAMHSVRGRYSAGTINSQPVPAYQPPEGSNVETFVGVTAYIDNWRWAGVPFHLCTGKRLAERSTQIVVTLKPVTHWLFERPNRNNAAPNRLCFKLQPQENIELNLMSSLAGPEWGTLELQPLELELSVPTGKHRHIAYERLFLDAFNGNPALFVRHDEVTAAWAWIDSISNAWELSDLPLQPYPAGGWGPPQAHQFLPPLGIDGHGNNA

SEQ ID NO: 90845 - protein, 286 aa, Arabidopsis thaliana
MTKEVVGDKRSFSGKDYQDPPPEPLFDATELGKWSFYRALIAEFIATLLFLYVTIMTVIGYKSQTDPALNPDQCTGVGVLGIAWAFGGMIFILVYCTAGISGGHINPAVTFGLLLARKVTLVRAVMYMVAQCLGAICGVALVKAFQSAYFTRYGGGANGLSDGYSIGTGVAAEIIGTFVLVYTVFSATDPKRSARDSHVPVLAPLPIGFAVFIVHLATIPITGTGINPARSLGAAIIYNKDKAWDHHWIFWVGPFAGAAIAAFYHQFVLRAGAIKALGSFRSQPHV

SEQ ID NO: 90846 - protein, 305 aa, Glycine max
  misc_feature (182)..(182): Xaa can be any naturally occurring amino acid
GLPSVHTNAYRLINSEGDRLSGLIIDVFGGVAVVASSAAWVEKYKSEIEACIMKINYINHVHWRPFVDILKEDGVNESDLNKMHSSTCPERTKCGWVGAYYLLQLGWNYTRRNVKFTDLLILGHVVPICQIVENEIVYTISLKGQKTGFYADQRENRQFISRISDGQKVLDICCYSGGFALXAVRGDALNFTGIAISRKESWDIVIIDPPKLAPTKKVLHSASSLYRNLNSLAMQLTKRGGLLMTCSCSGAVTQSGIFMRILQGAASMAGRRITVLRQAGAACDHPIDPSYPEGAYLTNILLRVS

SEQ ID NO: 90847 - protein, 460 aa, Clostridium acetobutylicum ATCC 824
MEKKELSRGLKARHIELIALGGTIGVGLFMGSASTIKWAGPSVLLAYGVAGIAMYIIMRIMGEMLYLEPLAGSFANYANKYISPLAGYITAWCYWFMWIAVGMSEITAIGIYVKFWFPALPAWIPALIGVAILAAANMASVKFYGEFEFWFSLIKVVTIVVMLIVGVGLIFFGIGNHGVPIGFKNLTAHGGFFAGGLKGWLFALCMVTASYQGVELIGITAGEAQDPKNTLRKATKNIIWRILIFYVGAIFVIVTIYPWDKISTLGSPSVLTFAKIGIAAAAGIINFVVLTAAMSGCNSGIYSCGRMLYTLATNGQAPKFLGKLNKDGVPANGIRTTLVCLLIGVILNYIYPNSKLFVYIYSASVLPGMAPWFVLCISQIKFRKEHAEEMKMHPFKSRLFPYANYIVVAYLCLVLIGMCFNSSTQIPLFIGAVFCAIVTIAYFAFGIHKGKVSKVEELQE

SEQ ID NO: 90848 - protein, 302 aa, Brassica napus
  misc_feature (290)..(290): Xaa can be any naturally occurring amino acid
MMRSVDVHVKTLTPSVRTLLSSIFTPKQKPPSLPLPLYYSSRSSSPHAAFRLFSNAVALSSSPIRGFNGIRSFESLFAVRAFSSSTAASLQPQQNRNQNQPEEGSEKVPTLEVADGNHGGLEEETKLSLPVRAYFFSTSVDLKGLVEQNKHNFIPPTSRMTNYPRVRFGNHTDPTGTGGCISGSECIYMVVFQYGSIVLFNVREHEVDEYLKVVERHSSGLLSEMRKDEYEVRENPDLNTWMQGGLDYIMLQFLNIDGIRTIGSVLGQSIALDYYGRQVDDMVAEFTDIXRGMEKTRTFTMD

SEQ ID NO: 90849 - protein, 315 aa, Arabidopsis thaliana
MVEPYETRNNGEASQMIRYQSYNHHNSRLPSSLSSPLLDLRVFYVRISNFKVDHSTPEVLTITHIPLDPDSLLEINGVRMSMYSEGVSSQLRRDRVDKKSEVATFISTDNIRLSGSVKFEVYDKDELVLSGTLEMSGSNGFTGESKHSVKRWNMNCEAEITAESGFLKEKHIGGSELSSPLPTIEVYVTGCFSGTPIILTKTLQLGFRKKHGRVTALDSIPEYETDEPHKGNSSELDYQVTEYGSYKQEYEGEHSDMYWNREYADGEDGEMSWFNAGVRVGVGIGLGVCVGLGIGVGLLVRTYQSTTRNFRRRII

SEQ ID NO: 90850 - protein, 391 aa, Picea sitchensis
MDIGRICKARGRTPFALLRHPCEQRLPRSFIKLSSSSSASLFSCKNKNIAALTFNSNSDSRGRRHLCGVSNSWRSRMDVAPLQTAQVDFPISETFFRNALASMEKTYLSKNLTVSSVLDFVRTYDGGQVCYDHFAFRTFNVDNCGISALAQFFLDFGYITRGELSFPGKHLRALWFSPPQHLLDCNGEGVNGPLPRIFISELLVDKLSPESQAIIKKYTSISSGGSKYAALASVLGSLTWPTPLLSDYHRLARESEYAAWTLVNGYALNHLTISVHRLKSDVQKIGKLNELIQSNKFKLNTEGGILKVSPDGRLLQSSTVADSMVFHFAEGISESVPASYIEFAERLVLPEYENLSVDKILELHRRDGFEVGNADKIFESTSAEQLRRKVA

SEQ ID NO: 90851 - protein, 184 aa, Frankia sp. EAN1pec
MTSVDSQPDLSAAEAVLGAHVRDVMDFPKPGVVFKDITPLLSTPAAFGVVVGALADLARGLGATTIAGIEARGFLLAAPVADRVGAGIVPIRKQGKLPGRTRSEAYALEYGTAVLEIHEDAVPTGERVLIVDDVLATGGTAAAAHTLLRGCGADVVGLAVLMELTFLSGRDRTGTLDVTSIMKI

SEQ ID NO: 90852 - protein, 143 aa, Oryza sativa Japonica Group
MKERGVRNKQGVIMKALLDRCLSKHRNGGRPEPPEGSFAVYVGGGGGGGGAARERFVVRTECVNHPLFRALLEEAEEEYGYVADGPLELPCDAGEFVAVLARIEREMAEERTVGCAGGLVFRLHPAAHLMLVAPATPPPMIVG

SEQ ID NO: 90853 - protein, 245 aa, Prochlorococcus marinus str. MIT 9211
MSIFVGNLPFRAEQEDVIQLFAPFGEVANCSLPLERDTGRKRGFAFIEMADEAAESSAIEALQGAELMGRPLRINKAEPRGGGGGPRRGGYGGGGYGGGYGGGGQGGYGGGYGGGGGQGGYGGGGGQGGYGGGGQGGYGGGGGQGGYGGGGQGGYGGGGQGGYGGGGYGGGYGGGGGQGGYGGGGGQGGYGGDQDPGQRSSGAKGWEDRSYGSSDTSDRDENRSRRRRGAASETDETSDYGGAEG

SEQ ID NO: 90854 - protein, 333 aa, Prochlorococcus marinus str. MIT 9211
MVATYTPRITNAYRFSIAPMLDCTDRHFRVIFRQVSRRSLLYTEMIVAKALQHQKGRRLLDFDEIEHPISLQVGGDNPKELADAAKLAEDWGYDEINLNLGCPSPRVQSGNFGACLMATPNQVAKCIEAMKNATQIPVTIKHRTGIDNFDSEEFLFSFVDQIAKAGADRFAIHARKAWLEGLNPKQNRTIPPLEYLKVKKLKLKRPELKIEFNGGLHTPEECVKTLKIFDGAMVGRSAYSNPMLWQEMDSLIYGEDYFPVKASQVIQNLIPYAQKHLDNEGRLWDISKHLLQLVQAVPGARAWRHNLSTKAQKSSAKLIILEKAAQQLEEVGL

SEQ ID NO: 90855 - protein, 500 aa, Medicago truncatula
METPPSTGAVKKKETRGRKPKPKEDKREEPSQVKSPRESKKEKQQQQLHQQQQQQASVDEKYSQWKSLVPVLYDWLANHNLVWPSLSCRWGPQLEQATYKNRQRLYLSEQTDGSVPNTLVIANCEVVKTRVAAAEHISQFNEEARSPFVKKYKTIIHPGEVNRIRELPQNSKIVATHTDSPDVLIWDVESQPNRHAVLGATNSRPDLILTGHQDNAEFALAMCPTQPYVLSGGKDKTVVLWSIEDHITSAATDSNKSGGSIAKTADSPTVGPRGIYSGHEDTVEDVAFCPSSAQEFCSVGDDSCLILWDARVGSSPVVKVEKAHDADLHCVDWNPHDDNLILTGSADNSIRMFDRRNLTSNGVGSPIHKFEAHKAAVLCVQWSPDKSSVFGSSAEDGLLNIWDYEKVGKKIERAGKTINSPPGLFFQHAGHRDKVVDFHWNAHDPWTLVSVSDDCESTGGGGTLQIWRMSDLLYRPEDEVLAELEKFKSHVVACAAKTDK

SEQ ID NO: 90856 - protein, 460 aa, Clostridium perfringens str. 13
MEIFKKQSLKRILSEANENKERTLSALDLTLMSVGSVIGTGVMVLTGIVAAKQSGPATSIAFIGGGIAAAIIVLCYAEFSSSIPSAGGSYSFTYVSLGEIIAYISGLCIVIGYTLSTATVASGWGAYLLSLLDILGIKLPKTFTAIPSEGGIVNLPAMISILFIVFVISLGTKESKKVNDIMVFIKIVVIALFIGVGAFHVNTSNWHPFAPFGVKGIVTGTASLFFAYCGFDATASAAEEVKNPQKSLPLGLISSLVICTIIYIAVSLVLTGVTSYTNLNVGDALSYALKLVGQRGVAFVVSLGTVIGILAVIFAGNFTTSHILLAMSRDGLLPKFFSKVDKKDVPYTALWTVGIIGALLAGFFNLGQLANFANIAFLLTYTLVCISLIAFRKKYPHVKRGFKTPLVPFIPLLGAFSCLFLMSNLSEETWKIFIVVLVLLITSYLVYGRKHSLINKNNDN

SEQ ID NO: 90857 - protein, 168 aa, Prochlorococcus marinus str. MIT 9211
MYNNFLSLNRRSILLGIWSGFLGLLFTPKTVFAASKAADEDWNLTDEDWKKRLSLEAYKVLREEGTERPFSSLLNEEKRLGVFHCAGCDLPLFESAKKFDSGTGWPSFWESLPNAIDTKTDFKLIVPRTEYHCHRCGGHQGHVFNDGPRPTGKRYCNNGIALAFRPSK

SEQ ID NO: 90858 - protein, 133 aa, Triticum aestivum
HLISLAFTQLILLASPLPSDLLPPSSVPAKMSTVTRAYLDQRLAAAKRCSKEAAMAGAKAAAVATVATAVPTLASVRMLPWAKAHLNPTGQALIISTVAGMAYFIVADKTILSMARKHSYETAPEHLKNTSFN

SEQ ID NO: 90859 - protein, 562 aa, Corynebacterium glutamicum ATCC 13032
MTSAHFESRRIGPPLRDNYDVIVIGGGISGVQIARHAQGRGLRTVMFEARDYSSGTSSTTSKMIHGGLRYLEQYDFGVVQEAVKERRYLGIAAPHLVAPRSFMLTAFDWSEPKAPMLGAGVALYETMAWQRNQGQSKENHSPRFRWIPKNALLKEVPWLDPEGLKGAWRHDDTLNLHAERLLLAVIKAFAADGGTAINHAKVTRILRNVEEGRVKGVEVTDQVTNTTHEVNAPVVINAAGPWVAQALGDLAEVTKLKVRQSKGVHLLTGDLGSQSGVFVRGKNGKHVIVNPWMGRTLIGPTDTMIDGDADDAAADESDIDLLLETIDSVRATPLDRKEIISTLVGVRPLVDDGTDTYTSSRRFDISDHANVGIDGLVSVSGGKWTTSRVMGYKVIEHVVEHQAAVLPPLRHFDSRQMPLSTSFGAYESVADSFESALRSHPELDVDDEIRVHLARLYGTEHEKVLDLVAKQPDLGRRLDPDNLDIAAQAVFAVAEEAAVDLADVLDRRIVLGTLGYVQPAAVRATAEAMAQVTGWSAELIDAQCQSYLAKQDKIQAVLKPYR

SEQ ID NO: 90860 - protein, 181 aa, Oryza sativa Japonica Group
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIANKA

SEQ ID NO: 90861 - protein, 529 aa, Pseudomonas aeruginosa UCBPP-PA14
MKTRNDVANKGRLSLPGKPTKTSGNEQPGEPHMIDGLLRSLGLDPNAFRDGELAVHTPIDGSRLAAVPLEGRAAVAAKVERAEQAFRAWRQVPAPRRGELVRLFGEELRRHKAELGELVSWEAGKITQEGLGEVQEMIDICDFAVGLSRQLYGLTIASERPGHHMRETWHPLGVVGVISAFNFPVAVWSWNTALALVCGNSVVWKPSEKTPLTALACQALFERAARAFGGDAPAHLSQLLIGDREAGEALVDDRRVALVSATGSTRMGREVAPRVAARFARCILELGGNNAMILAPSADLDLAVRGILFGAVGTAGQRCTTLRRLIAHESVKDEIVERLKAAYSRVRIGHPLEGNLVGPLIDERSYLAMQDALARAREEGGRVFGGERQLQERYPDAYYVSPAIVEMPGQTEVVRTETFAPILYVVGYRDFDEALRLNNEVPQGLSSCIFTTDLREAELFQGAAGSDCGIANVNIGTSGAEIGGAFGGEKETGGGRESGSDAWKAYMRRQTNTVNYSRELPLAQGITFD

SEQ ID NO: 90862 - protein, 557 aa, Candidatus Pelagibacter ubique HTCC1002
MNKNTKVLALKYRPQTFNDLIGQDVVAETISNSIKANKVPNAYLFTGIRGIGKTTTARIVAKSLNCSNGIDNLCKEELCENCNAISNSNHIDVLEMDAASKTGVDDVRDLIEFSRYGPTTAKYKIFIIDEVHMLSKQAFNALLKTLEEPPEYLKFIFATTEIKKIPITVVSRCQRFDLSRIKSLELFDFIKKIKEKENGNASDDALKLIVKISEGSVRDALSLLDRALLTLDKDKELDLAAAQKIFGYFDKSQLIDLFELIFEGKETEVLNTYREIYNQGVEPKIFINDFLELLYYFKNIDSLNLDGNNFLLNDEEFNKIKDLSEKVNNETLILFWQFTIKTLEELDIVSNQHLSMEMFLIRLIHLKSIKQESDKYKEDSKLLSESENQTSFSSKKTNEDIFGIKDKSETIGQMKNIVQEKDIKEKENNNIETNTSLINSFDDLLKACSSKKEIKLKYELEKNVNLVSFENKRIEISFNEDLDKDFIKDLSTKLFEWTNERWIISLSKTKGQPSKKEEEINQKKELIESVKNSSIYKDILKSFPDAELIDVKPRKED

SEQ ID NO: 90863 - protein, 276 aa, Candidatus Pelagibacter ubique HTCC1002
MTKIYFQGTFGAYSHLAALEIDPKAEIIPCKTFDECFLKTSQDKNSRMVIPESNRITGNIGIEYLIFKYRLNIYAEHFQKIEHNLLGQPDSNLSDIKDVYSHAQALSQCSKFIKKNNLVEHIRADTAGSAETISKTKIKTEAAIASTLSAEIYDLKILSKNIENEKGNATRFLVMGNEVLQPDFGDKKYITSFLFKLKSKPAALYQSLGGFAINGVNLTKLQSYPEQNSFESYFFLCDLEGHIDNPKIQKSLEELGLHCQDFHVLGVFEADKFREK

SEQ ID NO: 90864 - protein, 473 aa, Burkholderia pseudomallei K96243
MNLTIIGSGYVGLVTGACLADIGHDVFCLDVDSKKIDVLNNGGVPIHEPGLGEIIARNRAAGRLQFSTDVEAAVAHGDVQFIAVGTPPDEDGSADLQYVLAAARNIGRHMNGFKVIVDKSTVPVGTAERVRAAVADELKARGEDSMFSVVSNPEFLKEGAAVEDFTRPDRIVIGCDDDVPGERARELMKKLYAPFNRNHERTLYMDVRSAEFTKYAANAMLATRISFMNELANLAERFGADIEAVRRGIGSDPRIGYHFLYAGCGYGGSCFPKDVEALIRTAAEHGQALRVLQAVSAVNDEQKHVLARKVVARFGGDLTGRRFGVWGLAFKPNTDDMREAPSRALIAALLSRGAHVVAYDPVAQDEARRVLAIDLGEYPDALGRLAFADDEAQVAQDADALVIVTEWKAFKSPDFAALGKRWKTPVIFDGRNLYEPIAMRELGIEYYPIGRPGAAPRTAAGESDAARAARAGA

SEQ ID NO: 90865 - protein, 159 aa, Brassica napus
MDSVRLPTAPSTLRSQMLGHTLPHRLPRIPLPPCNRHFESKPLIAITRSRNRVSPIAVISGNETSISPPDSPPPRLKVNPSSLQYPAGYLGAVPDRASDPENGSITEAMEYLTSILSTKVYDVAIETPLHLAKKLSERLGVSMFLKREDLQPVFSFKIR

SEQ ID NO: 90866 - protein, 486 aa, Burkholderia pseudomallei K96243
MQPVVLAGGSGTRLWPMSRERHPKQLINLLGDESLLQSTARRLDGLSGVHPVSERMIVVCGEDHRFTTAEQLRLAGKDATLVLEPLGRDTAPALTVAALRAVGGGDDAVLTVMPADHAVADVARFQQAIAAAVRYAEQGMIATLGIVPTHAETGYGYIRVGAAANAADAGAEAGVAVRKLDRFVEKPHLELARQYVASGEYWWNSGIFIVRASVWLKAIRHFQPAIHDACARAVAQGSEDGPFFRVDRDSFAASPSNSIDYAVMEPLSNLPAVCEGVVVPLDAGWSDVGSWDTLWQISEKDDEGNVARGRVCFEQASSTFAHSEGRLIACVGTQDLVVVETPDAILVADRAHVQDVKKIVGRLKAESGTEASDHRKVHRPWGHYDSVDSGERFQVKRIVVKPGARLSLQMHHHRAEHWIVVRGTARITRGDETFLLSENESTYIPLGVSHRLENPGKMPLELIEVQSGAYLGEDDIVRFEDNYGRH

SEQ ID NO: 90867 - protein, 443 aa, Clostridium acetobutylicum ATCC 824
MEILKHVMDDVIKRNPNEPEFHQAVKEVLLSLEIVAEKHPEWVKDKIFDKIVEPERQIIFRVPWVDDNGEEHINRGFRIQFNSAIGPYKGGLRFHPSVNLGIVKFLGFEQIFKNSLTGLPIGGGKGGSDFNPKSKSNSEIKRFCQSFMLELNKYIGANTDVPAGDIGVGSREIGYLYGMFKKIRNESTGVLTGKGLTLGGSLVRTEATGYGLCYFMNEALKAKGKSFDGATVIISGSGNVAIYANQKATQLGAKVVAMSDSNGYIYDANGINLNTIRKIKEVERKRIHEYTKYHPNASYTEGCDGIWKLKCDIALPCATQNEIDENSAKTLIANGCYAVGEGANMPSTIEAVDLFIKNKVIFGPAKAANAGGVATSALEMSQNSMRYSWTFEEVDTKLQNIMKNIYIKCSNAANEYGFEDNLVAGANIAGFTKVAEAMYSLGF

SEQ ID NO: 90868 - protein, 293 aa, Oceanobacter sp. RED65
MEAQFLTKVFLPVSLFIIMLGMGLSLRPIDFKLVIVKPKAVVLGLIAQMILLPMLAYLVVIGFGMTGGLAVGVMILALCPGGTTSNLYTYLAKGDIALSVTLTSVVSLIAPFTVPLLIVFFMELLMGQEEYIKLPVLKTILQLVVITIIPISLGMLIRRYKPELSQKLEKPVKLFSIVVLFVIIAAIVFKNRAHIGDYVAQAGLVTLILNVACMMMGYGIAKLAQLNEAQSKAIGIEVGFQNGTLAILIALTLLENDQMAIAATTYSLIMFATGGLFAWVLHRKTQVPVEVDA

SEQ ID NO: 90869 - protein, 684 aa, Aspergillus oryzae
MAQPTGELTHPSQQQQLQLQQQFFQSIFGGASDTTEEIDTETDSNHRRPHSFGAAATTPAKLANKNVAPFLVKHIPEQYGPLGSRRTDKLEDLSSPNSKFCYRHRPDLKCRRQADEPSMDKLQRELETLPPSDQQGIAHVWSLFSAAPAKHRKLILQGIMAQCCFPQLSFVSATVRDLIRIDFLTALPPEISFKILCYLDTTSLCKAAQVSSRWRALADDDVVWHRMCEQHIHRKCKKCGWGLPLLERKRLRESKREIELRATTWDVSGPAQNAGGAECSAPHADDVITQKRKADSSDDETAIVKRHCSSLDARPEPDEDYYTTRYRPWKEVYKDRFKVGTNWKYGRCSTKVFKGHTNGVMCLQFEDNILATGSYDATIKIWDTETGEELRTLRGHQSGIRCLQFDDTKLISGSMDRSLKVWNWRTGECISTYTGHRGGVIGLHFDATILASASVDKTVKIWNFEDKSTFLLRGHTDWVNAVRVDTTSRTVFSASDDCTVRLWDLDTKACLRTFHGHVGQVQQVVPLPREFEFEDHDAECDNDNMSTTSGDTESNSLQATLGLESNATETSVFGPSFDNGRPAPPRYIVTSALDSTIRLWETTTGRCLRTFFGHLEGVWALGADTLRIVSGAEDRMVKIWDPRTGKCERTFTGHSGPVTCIGLGDSRFATGSEDCEVRMYSFRN

SEQ ID NO: 90870 - protein, 162 aa, Triticum aestivum
GKELTALYSSFASKYPIVSIEDAFDQDDWEAWTHLNETSEFQLVGDDLLVTNPKRIATAIEKKSCNALLLKVNQIGTLTESIQAAKDSQAAGWGVMVSHRSGETEDTTIADLVVGLRTGQIKTGAPCRSERLAKYNQLLRIEEELGENCIYAGENFRNAHEL

SEQ ID NO: 90871 - protein, 215 aa, Aspergillus oryzae
MSQPTPNSHQQPDAAAAQVAGQSPSSSTPTAELASLKISLRAALRQFPDFPSPGILFEDILPIFANPTLHEALLRSLELHILQNHGDQKPDVIVGLEARGFLIGPSLALRLGASFVPVRKQGKLPGPCATQAYEKEYGQDFFQMQADSIKPGQKVIVVDDIIATGGSAWAAGELIKKMGGELMSFLFILELEFLKGREKLPAPVYTLLSGQEEKH

SEQ ID NO: 90872 - protein, 348 aa, Azoarcus sp. BH72
MPTDSFATPLRLAINGYGRIGRCFLRALRESGRRDAFRVVAINEPADLASIAYLTRFDSTHGRFPGRVDADEDSLLIDGERIAVSHATTPEAVDWAGLEIDLVVECSGQYGDRAGLTRFLDAGCPRLLLSHPANSAADVDATIVHGINQHLLRGHERIVSNASCTTNAVVPVLDLLHAELGLEQVLLTTLHSVMNDQPLIDGYHHSDLRRTRSAMQSIIPVSTGLARGVERLLPGLAGRVQAKAIRVPTHNVSAIDLVLALERDTDAGQVNRLLRDAAAGPYAGLLAYSDDPHASIDFNHDPHSAIVDGAQTRMNGPRLLNLMVWFDNEWGFANRMVDVAAHWLRPRA

SEQ ID NO: 90873 - protein, 459 aa, Prochlorococcus marinus subsp. pastoris str. CCMP1986
MILKVLEFEFDLIVLGAGSGGLAAAKRAASYGAKVAIIEVNKIGGTCVIRGCVPKKLMVYAANNRRNMLSSEGYGLISKEITFESNILLKNVREEVSRLSVLHSNSLKKLNVKVFEGLGRFLNQNTVEVVCPKTKNILRKVSAKSILISVGGKPKKLNIPGTDFAWTSDDIFELKDFPKKLLIVGGGYIACEFASIFKNLGTEVTQLIRGENLLNGFDKDLSECLEKSMTSLGINLKFKNQLKSIKKINDGLESTLESGSKLLTDNILVATGREPSLKRLNLDTLNLKMDGIYLEVNELNKTSISNIFAIGDIVKRPNLTPVAIEQGRVFADNYFAALKRKVNYENIPKAVFTIPEISTVGLSEEKANEIYSEVNVQVFKCNFTPMSNTFKKNKSKCMLKLVVNKKNDKVLGCHMFGEAASEIIQMVAVSLNTGITKKDFDTTMALHPTISEEFVTMYG

SEQ ID NO: 90874 - protein, 412 aa, Rickettsia prowazekii str. Madrid E
MNNIKNLLIRAQIMSIISTRLNSIKPSPTLAVVKKTLELKKAGVNIIALGAGEPDFDTPDNIKEVAITSIKDGFTKYTNVDGIPLLKQAIKNKFKRENNIDYELDEIIVSTGGKQVIYNLFMASLDKGDEVIIPVPYWVSYPDMVALSTGTPVFVNCGIENNFKLSVEALEHSITDKTKWLIINSPSNPTGAGYNCKELENIAKTLRKYPNVNIMSDDIYEHITFDDFKFYTLAQIAPDLKERIFTVNGVSKAYSMTGWRIGYGAGSKALIKAMTIIQSQSTSNPCSISQMAAIEALNGTQDYIKSNALNFQKKRDLALSILEEVTYFECYKPEGAFYLFVKCDKIFGTKTKSGRIIANSNNFSEYLLEEAKVAVVPGIAFGLDGYFRISYATSMQELEEACIRIKHACNAL

SEQ ID NO: 90875 - protein, 340 aa, Prochlorococcus marinus str. MIT 9211
MTLRVAINGFGRIGRNFMRCWLSRGSNTGLEVVGVNVTSDPKTNAHLLRYDSILGELKDTEIGYTDDNFIINGKEIKCFSDRNPLNLPWKDWGVDLVIESTGVFNTYEGASKHLAIGAKKVILTAPGKGDGVGTFVVGVNADQYNHSDFNVLSNASCTTNCLAPVVKVLDQTFGINKGLMTTIHSYTGDQRILDNSHRDLRRARAAAMNIVPTSTGAAKAVALVYPEMKGKLTGIAMRVPTPNVSAVDIVFEAGCSITAEDINAAMKTASEGSMKGIIKYGDLPLVSSDYAGTNESSIIDTDLTMAIGNNMGKVVAWYDNEWGYSQRVVDLAEIVAKNWK

SEQ ID NO: 90876 - protein, 120 aa, Oryza sativa Japonica Group
MSGGVQEQFEIKFRLPDGTDIGPKRYPAASTVATLKESIVAQWPKADKEKGPRTVNDLKLINAGKILENNKTLSECKSPICDFSGLTTMHVVVRAPTSDKQSNKIVAKKPKDFRCGCSIM

SEQ ID NO: 90877 - protein, 495 aa, Gibberella zeae PH-1
MGNFEVKSIAVVGAGAAGAITAATLKAENYFDRIRVFERRETPGGTWIYDADPSVATIQPGALPTEIDKPLVIPEDLPTTTTPNQQERYAHTPIYQNLTTNVPQIAMSFSDMSFSYGPFVPHYVPRQYIESYFSFHKTDGYLSLNTTVEDISQLPLTSRDGLNLWRLTLRKYDPLRRVDVWWQEDFDAVILANGHYAVPWVPPIRGLEAYVEKFPGRVIHSKFYRSPWIYAGKKVLVIGNSASGHDISVDLLQAVQLPLYQSRRSRGRLDGDEPPAGVEWKTVIKEYRLDGTIVFEDDSELADIDHVLYCTGYLPSYPFWNTQANGRPLFDYKKKKLINNYWHTFFQDIPNLAIVGMPRVLTFRSFEYQAIAIARLFSGRSAVPLPSKETQKKWELDRESRCRQEGRRFHEIEWENGETFRWLDGFFQISGLGTLHGDGRIPPVLGKDIIWAIEHVRKYPVPGKDKHQESGGSLEYKEGEWTLVHRPKKDPLLFI

SEQ ID NO: 90878 - protein, 480 aa, Pseudomonas putida KT2440
MSHKTYNNYIDGQWCEGHATLGNYSPSDTGDLIGQYHQASAEQARQAIQAARAAQPLWAASGLESRQQVLMAIGDELIARKEELGELLSREEGKPLAEGIGEVNRSGQFFHYYAAEVLRQMGETAASVRPGVDIEVHREPVGVVGIITPWNFPMATAAWKIAPALAFGNAVVFKPANLVPASAWALTEIISRQGLPSGTFNLVMGSGADVGEALIQSAEIDALTFTGSLQTGRRVAVATAGNLVRCQLEMGSKNALVVMDDADLELAVECALNGAFFGTGQKCTASSRLIVCDGIHDRFVEALRLRMRQLKVGHALEAGVQIGPVADARQLEQNLAYLQLAQAEGATLIEGGERLQLACDGYYMRPALFINSRNDMRINREEVFGPIACVIRVRDFEEALATLNDTEYGLTAGIITQSLRHASHFKRRAQTGCVMVNLPTAGTDYHVPFGGRKASSFGPREQGQYARDFYTVVKTTYLRP

SEQ ID NO: 90879 - protein, 605 aa, Kluyveromyces lactis NRRL Y-1140
MRIKKRNTRGNARNFITRSQAVRKLQISLADFRRLCIFKGIYPREPRNKKKANKGSTAPTTFYYYKDIQYLMHEPVLAKFREHKTFAKKLTKALGRGEVSAAKRLEENRPNYQLDNIIKERYPSFADALRDVDDALNMLFLFANLPATDQVSSRITQSAQQMCDQWSAYIAKERCVRKVFVSIKGVYYQASVKGEDVRWLVPYKFPENIPSDVDFRIMLTFLEFYSTLLHFVLFKLYTDAGLVYPPKLDIKKNKLIGGLSAYILESNDEKSSLAVKPKELSENVEVQELGANTLKTALKADSNEHDEEEQDQDQEQNVEDVELDKFEDTNKNQGDQLEQPSKFDSPVATLFSEFVFYVGREVPLDIVEFLILSCGGSAVSEATLDQLTDKQDIDLSKVTHQIVDRPVLKNKVANRTYVQPQWIFDSINKCELVPANLYLPGEPLPPHLSPWGDSTGYDPTAENDEDVEGSDAEEIDESADEDAESEEVEEDDTAAVALNEDDEDDEDELRQQKELELEAQGISYSEAKDVIDSESSDKKKKKKRKATEEEEEKDLKLIMMSNKQRKLYKKMKYSNEKKDEKIEQLKQKKKQIAKTKAKLAKLDKK

SEQ ID NO: 90880 - protein, 267 aa, Oryza sativa Indica Group
MANLFLKQAKQYAATRPAYPPELFDFIASKTARHDLAWDVGTGSGQAIPPLAKLYKDVVGTDTSAQQLSYAPRLPNVRYVHTPPDLPLDGIHAAVAPPGSVDLVTVAQAFHWLDLPRFYAQVRSVLRAPQPQQAAGVLAAWCYTEPCVDAAVDDAFWRLYNGSQPYWAPNRRLVDDRYSGVDFPFDPVDGEAHTGPFEFSTERRMDLDGYLAYITSWSAYQTAKEKGVELLDEATVRGFADAWGGDRVEVKTVRYPIFLRIGKVRPE

SEQ ID NO: 90881 - protein, 237 aa, delta proteobacterium MLMS-1
MDKPEEKKKFVKSKFAAISSRYDLLNSVLSLQVDRYWRWVVARQLRPFPQGAVLDLCAGTLPLALELARQAPERTVLAVDFCEEMLRAGLENSRRDRKLARIMALAGDGEQIPVAANSVWGVTVAFGVRNLARTEQGLNEMHRVLKPGGKLLILEFSRPTNIFIKPLYNFYLNRILPRVAGAVSGDRDAYEYLASSIAAFYEPRELMAMMQRAGFATISRRPLTLGIVTVYIGVKGE

SEQ ID NO: 90882 - protein, 165 aa, Coprinopsis cinerea okayama7#130
MVNTPPSLSFVGRSVHGSFPYNCGGEGHVSRDCTQAAKPKSCYRCGEEGHLSRDCTSDNAAAGGVSRGGECYRCGKTGHLARSCPDSGYGSFGGSQKTCYTCGGVGHLSRDCVQGSKCYNCSSIGHISRDCPQPQKRACYQCGQEGHISRDCPGTGAAGDATAAA

SEQ ID NO: 90883 - protein, 166 aa, Pseudomonas putida KT2440
MIKTGDQLPDVTLYQYNNDAGACAIGPKAFSIRERCKHKKVLIFALPGAFTPTCSERHVPGYVAAAPALFAAGIDEILCVSVNDAFVMNAWGNSLQVGDAVKMIGDGNGEFSEALGLTQDLSARGLGRRSQRYAMLVDDQVVQYIAVESPGKFEVSDAASLLAVLR

SEQ ID NO: 90884 - protein, 309 aa, Candidatus Pelagibacter ubique HTCC1002
MKHFINLKDIPSADLKKIFIDAKNRKQKRKNYNTLEVDKDKPLKGKLLIQMFEKASLRTRLSFYLAIKQLGGGTITLRANELHLGKGGESLADTAKILSTYGDGFMLRTDSDKKIEEFSRYLKIPVINGLSPSSHPTQVLSDIFTVEEIKKKSISKLNICWIGDSNNVLNSLIAASVKFSFNLNIGCPKNYGPKKFVLDWVKKNKRKIHIFNDAKKAVKNADVIFSDKVISLNDKVNKNKKIKDFRNFQINSKLMSFAKKDTTFLHCLPRGEEVTTDVFLGKNSEVWLQALNRVHVQKSILLYCFGKLR

SEQ ID NO: 90885 - protein, 290 aa, Exiguobacterium sibiricum 255-15
MNICVVTGANSGMGMVTIQELLERGDRVIATVRSQKKATLLIQLLREHAVSDANLEVEIVQLDQLDSVRRFADVLFDRIGRIDRLILNAGIMVPPYHVTKDGFESQFQVNYLSHFYLIERLLPLIEQGHDPRVISISSLAGEGGMIRTDIELEAIAHVRKEQYNPMKSYRESKLLQMVHMRELAEQYGTLATFVSVHPGIVNTDLFYRGKYGKVLKTVLKPVAQVGYWTGKLYTPEYGAKTALYLATTDDVIDNGGYYADSAPRLSNPVVEDEAYRQQARALSKRWVGLD

SEQ ID NO: 90886 - protein, 388 aa, Candidatus Pelagibacter ubique HTCC1002
MSALAKNYNRKKISFKYGKGSFLYSTNGKKYLDFVQGIAVNSLGHANPYLIKAVNKQSKKLWHVSNAFIIPEGEKLAKRLAKKTFADFIIFQNSGAEATEAAIKIARRYFYSIGQPSKNRILCVKNSFHGRTLATIYASGSKKMTEGFGPKVDGFDHFEFGNHKDFKKKITKKTAAIMVETVMGEGGIKVIPNWCLKELRKVCDKRKILLILDEVQCGIGRSGNFFAFENSKIKPDIVPIAKGIGGGFPLGAVLMNKKVASGMTAGTHGSTFGGNPLAMSVGNAVLDQILKKGFLSNVKKLSKYFYSELNKLRKKFPKIIKEVRGVGLLIGLQLHDDQTKFIQKLMDNKLLTIRAAENVIRILPPLNVKKEEIDIAINIIKKVCSTYK

SEQ ID NO: 90887 - protein, 2530 aa, Mycosphaerella zeae-maydis
MSSIHMSADGSTPIAIVGLSFRGPGDATSAENLLRMVAESRESRSPIPSQKWNASGHYHPDPSRQGSHIVEYGHWFQQDVYEFDAPFFNLSAVESAALDPQQRMLLECTYEAFENSGMPLNKLVGTDTSVFTAVFCTDYTDMLWRDPEMVPMYQCTNSGATRANMANRVSYSFDLKGPSITVDTACSGGLTALHLACQSLVTGESTQAVVSGSSLILGPETMVTMSMMRFLSPDGRCYAFDDRANGYARGEGVTVLLLKRLDDALANGDTIRAVIRGTGRNPDGKTTGIAMPSGLAQEALIRSVYAKTGLDLLDTAYIECHGTGTQAGDTTEARAISNVFGPGRQVPLAIGSVKTNIGHLEAASGLAGVLKCILMLENEIILPNRNFKHANLNIPLEEWKLRVPTTVEPWNSMTTRRASVNSFGYGGTNVHAILESADNFLRARGLDQTKFTRRPMHRIMAIRNALELEPEQNGNPFSSSGAKYMGQRADPQVFAVSAFDPTAGEACAKNLAYYVEERQDMADATFLSSLAFTLSDRRTVHPWKATVTASSSAELISGLRKVRFSSVKSTHNLAFVFTGQGAHWCGMGKELIKVYPAFRKSLEKCGAMLKRFGAPFDVIDELEAGFETSQLDKALYSQSLCTALQIALIDMLSDWDIQPKSVTGHSSGEIGAAYAAGALKLEDAMLVAYARGLAMSDLSTKGPKGAMVAVGMDRQELNLILVGLKSGKAVIACSNSPKSFTVSGDKCALDELQGALRQRGVYNRRLNVEVAYHSHHMELVADSYRNTINNIKVLADSPVRFFSSVMGELTDKSKLGPDYWVSNLVGEVKFAESLHALVTHSNTDSTEQIQTIIEIGPHSALAGPIRETLEAAEFSHKTSIDYLSVLVRRKDAVVTALTLASKLFVAGFAVRLAAVNQNACSTVPPLNDLPSYAWNHSKSYSAESRISRSYRERPHTRMSLIGVLDVQSSALEPRWRQILRISELPWLRDHNIQSNVVYPAAGYLTMAIEAAAQRNAVRAPGTKIEGFQFREVNISSALIIPETPGEVEVFITLKAFSESLRSPSNLWDEFSVSSVSESNRWTEHCRGLIAVKTVSRSPNLVSGEAQEASDVEVYKGHVDDFEAACQSSWDAKEMYNGLWQTGMHFGPTFANISDLRIAPDKCIGRVQIPDTAAVMPMKYQEAFVVHPATLDSIIQTFLPALAAQTRKFNDAIVPVSIDDLFVSHEITRSPGHAFDCYTSTYRKDHRFTFVDITVFATPFVPGSKPVITVGSMTVATLQRQDPSENNDQVPSRAYNLEWAPDIEYLTPEQLVNVTSSSTGAEHQVTKQKLDRASVELIREALARTHEQQSVEVGGSAHVLRKLLDSRAEHATSDSSTDRDSSLTSASATIAQAAERLPNLLVGGAEQDDPAQLYDLMDVATTPGLFAKNHSIATYLQLLSHKKPDLTVLTIGPQSGPASLNLLLLLSDLGCDAGPFKAFHHSDAELNIDHAAKTRFPSWANSITFVDLKIKDSVALESSSNVEQTYDVVVAFNMAGSSIQLAATLSAASALQTYRGKVLLADHAVQSPLATLVWSSLPSFVSSQKEGAELDLSDAHDVAQEKGYQAHAMLADRVHVMQKAREEHEVETAIDTLIVATDQDLESVDIALLQRLCEEQGSAVQLVSLEAAHPEPKQACIVLNELSQPVLVEPTDGEWEALKRITHCGAGVLWVTRGAGSDTCADPQAALIQGLARTVRAEVGDRPMATLDLDEEVRLNAVEAAKCIAGVFRHVMRAASAELELRERNGVVHVPRLIEDLDASRQLQAEDGIAAATETLTLQQAGSCRLFAGTPGLLDSLHFAPDERVSVELAAGDIEVEVQAAGINFKDVMMAMGQIPIEDLGLECSGMVTSVGSQVQCFAVGDRVVTMGPGSFCTRLRVDARLAYRIPDSMSWETAAALPITHVTAYHAVRHLGRIVRGDTVLVHAAAGGLGQALVELSIMAGARVLVTVGSADKKHFVMERFGIPEHHVLYSRDTSFASHVMRLTQGVGVDVVMNSLAGEALRQSWTCIAANGRFVELGQRDITVNSRLDMAPFARNASFIAFNLAKMLRQDPQMACEMLGEVLKLYDRGTLRGYQSLETYTYSHLGDAFRKMQTGRHMGKLVAVARPADIVRFQGTPALSPPLFDPDAAYLLVGGLGGLGSATALWMAERGARHLVLLSRSGASPSQDSILARLRATNCATTVLACDVAERDLLASALATVKDTLPPIRGVIQGAMVLRDGMLAQLSRSDYLAVLRPKLHGTWNLHALLPDLDFFIVESSISGIVGNAAQAAYAAANTFLDAFARYRRSLGLPATAIDIGAVEGIGYLARNPELKRAMERQGFSFTDEARLMRLLDFSISHPARQPRRSHIITGLGAWHPDCSLPVLGAPLFSRHRLLSSRGISAPAAINSLRNTLKHATTHDAEIALLAALVDHVVARTDIPVENVDTSKGLQDYGIDSLAAVELRNWLSRETDSVIPILELLGAESLTDLAAKIVARSRPITVANGAA

SEQ ID NO: 90888 - protein, 110 aa, Magnetospirillum magnetotacticum MS-1
  misc_feature (90)..(90): Xaa can be any naturally occurring amino acid
MTDFRTLDDAGPLAGKRVLLRVDLNVPMEGGRVTDATRIERVVPTIREIADQGGRVILLAHFGRPKGKPDPKDSLKPILPTLSEKLGRPXSPSVRIGRRRRAPPPPPSRR

SEQ ID NO: 90889 - protein, 338 aa, Enterobacter cloacae
MNLNRFERYPLTFGPSPITPLKRLSQHLGGKVELYAKREDCNSGLAFGGNKTRKLEYLIPEAIEQGCDTLVSIGGIQSNQTRQVAAVAAHLGMKCVLVQENWVNYSDAVYDRVGNIEMSRIMGADVRLDAAGFDIGIRPSWEKAMSDVVEQGGKPFPIPAGCSEHPYGGLGFVGFAKKLRQQEKELGFKFNYIVVCSVTGSTQAGMVVGFAADGRSKNVIGVDASAKPEQTKAQILRIARHTAELVELGREITEEDVVLDTRFAYPEYGLPNEGTLEAIRLCGSLEGVLTDPVYEGKSMHGMIEMVRRGEFPEGSKVLYAHLGGAPALNAYSFLFRDG

SEQ ID NO: 90890 - protein, 524 aa, Venturia inaequalis
  misc_feature (10)..(10): Xaa can be any naturally occurring amino acid
MGLLSPLLAXLPGSDRSWLFYTLASFGFTVAIVAANLVKQLLFSNPNEPPVVFHWFPFFGNTVVYGIDPIKFFAECKEKHGDIFTFILLGRKTTVYIGTKGNEFILNGKQSHVNAEEIYSPLTTPVFGSDVVYDCPNSKLMEQKKFVKYGLTTEALKSYVTLIQQEVEDYTKRYPQFKGEKGSFDVCASMAEITIFTASRSLQGKEVRDKFDASFADLFHDLDMGFSPINFMLPWAPLPHNRRRDAANKKMTETYLEIIQSRKAEGVKKDSEDMIWNLMQCVYKNGTPIPDKEIAHMMIALLMAGQHSSSSTSSWILLRLATRPDIQEELYQEQIRVCGADLPPLQYEDLARMPLHNQIIKETLRMHSPIHSILRAVKQPMPVEGTPYTIPTSHVLLAAPIASGGSPMYFPAPEKWEPHRWDEGSGGTNISGGENGGEEKEDYGYGLITKGASSPYLPFGAGRHRCIGEQFAYMQLNTVLATQVREFKFSLREGESFPKTDFSSLFSGPLRPAWLNWERREKSS

SEQ ID NO: 90891 - protein, 258 aa, Pseudomonas sp. KS-E1806
MRLEDKVAILTGAASGIGEAVAQRYLDEGARCVLVDVKPAGGSLARLIEANPGRAVAVTADVTRRDDITRIVATAVERFGGVDILFNNAALFDMRPLLDESWDVFDRLFSVNVKGLFFLMQAVAQRMVEQGRGGKIVNMSSQAGRRGEALVSHYCATKAAVISYTQSAALALAPHRINVNGIAPGVVDTPMWEQVDALFARYENRPLGEKKRLVGEAVPLGRMGVPGDLTGAALFLASADADYITAQTLNVDGGNWMS

SEQ ID NO: 90892 - protein, 250 aa, Oceanobacter sp. RED65
MRRTFVAGNWKMNGSKAENQSRLEALVAALGQRQDIDMAVFPSMPYVAQCQQILGGSTVAWGAQNVSEHTGGAFTGETSSQMLRDFECRYVLVGHSERRELFAESNQQVAEKFKAAVDSELVPVLCVGETLEQREAGETQRIISEQIEAVLSLVGSDVFANGVVAYEPVWAIGTGKTASPEQAQEVHSAIRAQLAEANIAMAEAMQILYGGSVKPENAAAIFAQQDVDGALVGGASLKAEDFIAICDAAA

SEQ ID NO: 90893 - protein, 509 aa, Bradyrhizobium japonicum USDA 110
MNIPSKPASIDVETHGNFIDGREVEAGNGAMLDVRNPATGDVIARIPNSTAEDIDRAMKSARAAFEGKAWGGMDTRARARLVNKLADAFEANLDSLYRLETLNNGRPVNETRAQLSRLPDFFRYFAGVALARRDSVIPVEGAYLNYTLRTPIGIVANCTPFNHPLMILCKSLAVVLATGCVTVVKPSEYTPLTTLKLAQIFTEAGLPPGVFNIVLGHGQSAGKMLAEHGDIDKLVLTGGTEAGRIAGSAAARVFAHQTMELGGKTPVMVFDDFDVDRAVNYAAFGAFIGAGQTCVCASRHIVQASIYDEFVEKLQAKTRTIRVGDPFDASTQMGPVISARQRDRVLTYAGYGHEDGARLVTGGVAAKVPGHDNGYFVEPTVFADVTSDMRIFQEEVFGPFTSVTPFKDEADALRLANDSPFGLAAAIRTRDVARAHRVAASVKAGIVWINDHHRLDPASPWGGVDDSGIGRECGTESFNDHFNTKSVMVATHEQPFDWYRDTANQKRLN

SEQ ID NO: 90894 - protein, 460 aa, Methanosarcina acetivorans C2A
MEMKGIKSIILAGGSGTRLWPLSREMYPKQFLKFGDTSLFQETVLRCLEVSDISEIFVVTNEAQKFFVIGQIKEIGYSIPPENVLIEPEGKNTLPAIFFGMKEIEQKFGNSIVGVFSSDHVLDRAAMATIFSAEKLTSDYLVTFGVVPAFPHTGYGYIKAAESCEPGYRVSEFREKPDFETAQKYIEEGCLWNSGMFLFETRLFFEEVKKHAPSIFACFEKGGSIDEIYACVDNVSIDYGIMEKSDRVAVVKLDQKWSDLGNFAAIYDELEKDSVGNVVHECDSMLLNSDGNLVYSKCGKIVSLIDIKDMVIVDTSDALLICPKSSSQRVKEIVSDLKGRNDERAFIGQTVYRPWGSYTLLDASPGHKIKNITVLSDHRLSLQLHYHRSEHWVVVKGMACVEVNGEQFFLRPGESTFIRAGQRHRLSNPGKVPLEIIEVQLGELVDEDDIVRFDDEYGRS

SEQ ID NO: 90895 - protein, 118 aa, Taraxacum officinale
ECKERATPEQVADYTLKLLHRRIPPAVPGIMFLSGGQSEVEATLNLNAMNQSPNPWHVSFSYARALQNTCLKTWGGRPENVKAAQDALLQRASSNSLAQLGKYTGQGESEEAKKGMFV

SEQ ID NO: 90896 - protein, 577 aa, Aspergillus oryzae
MSKHLSRFSHHPRAASGPLECPYEGRDIITSCQFNKGSAFSEEERNVFKLHGLLPPNIQTLEEQVQRAFQQYKSRPDALAKNTFMASMKAQNEVLYYKLIQTHLKEMFSVIYTPTEGDAIQNYSRLFRRPEGCFLNIKDQDRIEECLCNFGRGIDVDYIVVSDGEEILGIGDQGVGSILISVAKLVLATLCAGIHPSRQLPVVLDCGTDNKDLLNDELYLGLRQPRVRGDEYDRFVEKFVTTARKMFPKAYIHFEDFGLHNASRLLNQYRPHIPCFNDDIQGTGCVTLAALMAAFHVSNIGLADVRVVVFGSGSAGTGIAKQVADTIATDTGRTKQEASAQIWCLDKPGILLKSLGDQLTAAQAPFARDDNEWPKEKGTDLLSVVKEVKPHVLIGTSTKPKAFTENIIREMAKHVEHPIVFPLSNPTRLHEASPEDINHWTEGRALMATGSPFPPVERNGVEYEVAECNNSTCFPGIGLGAVLSRTQILSDKMLVAAARALASQSPALQDPNRPLLPDVENVREISVHIARAIIETAIEEGYAQEKDIPSHEEELEEWIRVQMWEPIYRPLVKAGEK

SEQ ID NO: 90897 - protein, 302 aa, Prochlorococcus marinus str. MIT 9211
MLEKVVKQSHQFSPNSKLLIFGGGFSGQHIAAAARRLGAKVLCSRRSFNKTGADFIYDSASESIPEESVLKDVTHLISCIPPLDTGEDPVLKNLSAAIKKMPLKWAGYLSTTGVYGDCKGAWVNENDCANPKQARSIRRLACEKAWQSSGLPVQIIRLPGIYGPGRSTLEAIKNKKSKVIHKPGQVFSRIHIDDIAGGILHLINLISQGINPEIINLADNFPASNIEVMQYAAYLLNQELPPIESFEIAAETMSPMALSFWQENRKVSNKVLCKELGYSLIHPDYKSGLKDCLISYESKNEP

SEQ ID NO: 90898 - protein, 244 aa, Brassica napus
EGLKPFCAIYSSFMQRAYDQVVHDVDLQKLPVRFAMDRAGLVGADGPTHCGAFDVTFMACLPNMIVMAPSDEAELFNMVATAAAIDDHPSCFRYPRGNGVGVSLPPGNKGVPLEVGKGRILREGERVALLGYGSAVQNCLEASSILDKRGLKMTVADARFCKPLDIALIRNLAKSHEVLITVEEGSIGGFGSHVVQFLALDGLLDGKLKWRPMVLPDRYIEHGSPLDQLAEAGLTASHIAATVL

SEQ ID NO: 90899 - protein, 487 aa, Exiguobacterium sibiricum 255-15
MNEGTVLLLAGILLLLAIVTTKFSVRLNVPTLILFVFVGILAGTDVSGLIDFADFEQARLFGTIALVIILFDGGLNTKWRDFKTVLPAALSLATVGVLVTTGLIAGVAHYLLDFSWPIALLIGALIGSTDAAAVFSLLNGRPIDQKVKHTLEAESGTNDPMAVFLTILFTEFALDPAAFSALHGILLLFYEMGLGLVIGLFVGWLLTSLMNRIQLQSSALYPTLLISGALLSYGVATSLHASGFLAVYVTGIWLSNHDLIYRDILVRFSGSLSHLAEVGMFIMLGLLVFPRQLFDPQTLFVSGIIVLTLILVARPLAVYLSLLPFRYNFREQSVITAAGLRGAVPIILATYPLSSGLPDAYPLFNIVFFTVMTSALLQGTALPWVVKLMKLDAKPTIDIEPLIQFMTVANPNAEIVEVSVPSYCRIDGKTLQEIEMPQDLLVVAVIRQNAIITPRGKTRLIGGDQLLILTPKQSEERIRKLIASLGI

SEQ ID NO: 90900 - protein, 385 aa, Prochlorococcus marinus str. MIT 9211
MKEKLALMIPGPTPVPERVLKALSQHPIGHRTPEFQEIVKKTTQLLQWLHQTEGDVLTITGSGTAAMEAGIINTLKKGDKVICGENGKFGERWVKIAKAYGLNVEIIKSNWGEPLEPEKFRNILQADNEIRAVILTHSETSTGVINNLEAISKEVRKHEKAITIADCVTSLGACNVPMDEWGIDVLASGSQKGYMMPPGLSFVAMNQRAWKASERSDLPSFYLNLKSYKKTSDKNSNPFTPSVNLYFALEEALNMMKEEGLEKIFSRHNRHKEATQKAMEAIGLKLFAAPGYGSPSITAVEPKDIDADLIRKVVKENFDILLAGGQDHLKGKVFRIGHLGFVNDRDIITAIASIESALNQLGALKEPIGTGVATASKILFKENRV

SEQ ID NO: 90901 - protein, 548 aa, Prochlorococcus marinus str. MIT 9211
MKFCLDVFSSLTLCRFLFDMSSDSLLKSQRSPSIVILDFGSQYSELIARRIRETEVYSIVLSYSTSAAELRKLAPKGIILSGGPSSVYTASAPLSDPEIWDLDIPVLGVCYGMQVMVQQLGGHVTAAVGKAEYGKAPLHVDDPTALLTNVESGSTMWMSHGDSVDKLPRGFVRLAHTSNTLEAAIALHTKRFYGVQFHPEVVHSTQGMVMIRNFVYNICCCQPDWTTSTFIDEAISTVRSQVGDKKVLLALSGGVDSSTLAFLLKRAIGDQLTCMFIDQGFMRKGEPEFLMEFFDQKFKINVQYINARERFISKLQGISDPEDKRKVIGREFIRVFEEESERLGPFDYLAQGTLYPDVIESSGTNLDPKTGERIAVKIKSHHNVGGLPKDLQFKLVEPLRMLFKDEVRKVGRALGLPEEIVGRHPFPGPGLAIRILGEVTDEKLNCLRDADLIVREEINRAGLYHEIWQAFAVLLPVCSVGVMGDQRTYAWPIVVRCVSSEDGMTADWSRLPDSLLQIISNRVVNEVKGVNRVVLDITSKPPGTIEWE

SEQ ID NO: 90902 - protein, 527 aa, Desulfococcus oleovorans Hxd3
MSNTPATVDSVARSWDLVVIGGGITGAAVFREAVRMGLRTLLLEQNDFAWGTSSRSSKMVHGGLRYLKEGKVLLTRASVKERQRLLAEVPGLVDPLGFMMPVYSDGGPSRLVMGLGLSVYSLMALEKQYISYSAGQMADLVPGLRTQNLTGGFYFKDAQVDDARLVLRLIQEGVANGGTALNYTKVQAVGRDSRGRVAAITAQDTETGATAGFDTKVVINATGAWAEKLGRVPESGVHIRPLRGSHLIFPASVFPLDRVVSFMHPADKRPVFIFPWEGTAFLGTTDVDHDHDLNTEPVLTKAEADYLMEGLDFILPGLKISVSSCIASMAGVRPVLSHGRAAASAESREHAVWDEKGLVTVTGGKLTTFRLLANDALKAARDYLPAKNLPSKSEPVFDAPKNRSSKMAPLNKTVQTRLYGRYGNQANTLVETCGPDLLAPVFSTETLWAEIDFAARHGQVRHLSDLLLRRVRVGILLADGGAACFERLEPICKSALGWNQEQWESEKAAYVKLWREAYAPPSVLFAK

SEQ ID NO: 90903 - protein, 259 aa, Triticum aestivum
VFVKALVSSGRTCVLVSEENEAAIFVDAPLRGKYCVCFDPLDGSSNIDCGVSIGTIFGIYMIKDKDNATLEDVLQPGTDMIAAGYCMYGSSCTLVLSTGNGVNGFTLDPSLGEFILTHPNIKIPNKGKIYSVNEGNARNWDAPTAKYAERCKFPQDGSSPKSLRYIGSMVADVHRTLLYGGIFLYPADKKSPNGKLRVLYEVFPMSFLMEQAGGQSFTGKQRALEIVPYEIHQRSPIFLGSYDDVEEIKSLYASESSTA

SEQ ID NO: 90904 - protein, 218 aa, Brassica napus
  misc_feature (186)..(186): Xaa can be any naturally occurring amino acid
  misc_feature (199)..(199): Xaa can be any naturally occurring amino acid
  misc_feature (201)..(201): Xaa can be any naturally occurring amino acid
  misc_feature (203)..(203): Xaa can be any naturally occurring amino acid
  misc_feature (205)..(208): Xaa can be any naturally occurring amino acid
  misc_feature (215)..(215): Xaa can be any naturally occurring amino acid
  misc_feature (217)..(217): Xaa can be any naturally occurring amino acid
MEMVTSFVYPPPPSILLNTMSVVGLVSLAKVGWSEVRGIHLKYSKFNNNKTSSSSSSPQPQKLPLGSFSSRTGMLLLYTPAFLAAASSFFVLPSDDLRFLLLKSALALHFFKRIFEVMFIHKYSGEMAIDSALTITTSYFSSTALLLYSQNFTLGLPEPGFDLKPLGIVMFVVGIVGNLYHHVLLXKLRNEDGTKEYKXPXGXLXXXXICPHYLXEXL

SEQ ID NO: 90905 - protein, 173 aa, Desulfococcus oleovorans Hxd3
MDLKATIRTLPNWPIEGVMFRDITTLLQDPAAFKEAINRFYDRYRTMKIDKIVGIDARGLIFGAPLAYKLEVGFVPVRKKGKIPFRTIGAAYSLEYGESMVEIHEDAILKGERVVVVDDLIATGGTVKATIDLVEKLGGEVVECAFVIDLPDLKGREKIRDYKMFALMEFEGE

SEQ ID NO: 90906 - protein, 213 aa, Oryza sativa Japonica Group
MSEEDTNAAAGQPRRAPKLNERILSSLSRRSVAAHPWHDLEIGPGAPAVFNVVVEITKGSKVKYELDKKTGLIKVDRVLYSSVVYPHNYGFIPRTLCEDNDPMDVLVLMQEPVIPGSFLRARAIGLMPMIDQGEKDDKIIAVCADDPEYRHYNDISELSPHRLQEIKRFFEDYKKNENKEVAVDAFLPANTARDAIQYSMDLYAQYILQSLRQ

SEQ ID NO: 90907 - protein, 733 aa, Oryza sativa
MAIIIPGSFHRSTALRVISVLFVLAVVVPDAGGRHQHHRHDCLPFTCGRLSNVSSPFRRRGDPSGCGFTSYELTCTDDKATIQIYEGTYSVTGINYSDSTFWVVDANISDSPNTLPQRIVPPYPTTTLNTGCHTIHIELEPASSRWSAFVNCSQEINNNEKYRPVACLNNTSRSFVYVLIGSIYSCYIDNLEPSCGHLAITPLHGNDTRVLEENPSCEDVVKIMRGGFAVRFPYTIDAAYSFKECRAETFRHFREEPASSAGIKYTMADTATFDIRYMACVIRVARLPAAVKLFVLLTIIAMWLLKWIADDPYCYILVLDCLAFYPQVSCTLAAFTNEICSGPTKSNSRYRYFTLGMTGIVRSNDRKQFGAVKYRYLEVGGGGGAPLVVMTFLAHKCWKKRITIDAVDKFLRMQLMLGPTRSLQGSEKLGQGGYGSVYQGVLLPGNIHVAVKILANYSCDGEEFINEVSTIGSIHHVNVVSLVGFCAEETRRALVYEYMPNGSLEKYIFSPEKSFSWEKLNEIALGIARGINYLHRGCEMQILHFDIKPHNILLDSKFIPKVADFGLAKLYPQDNSFVPVSAARGTIGYIAPEMISWSFGVISSKSDVYSFGMLLLEMVGGRRNSKQDMSSSSQAYYPSWVYNQLAQQELGEVVTSAFNMHELEKKLCIVGLHCIQMNSYDRPTMSEVIEMLEGDVDGLRLPSRPFFCDDEPMPHLVDVGFDRIDLAQSGTIN

SEQ ID NO: 90908 - protein, 352 aa, Gibberella zeae PH-1
MAALVAQSEDQPRDVVFRNYSSQQASNYAEGRLGYSEALIEFVLKQHNSSGGRNGVLLDVGCGPGPATRMLAPHFDVAYGADPGLSMIEKAQQMGGISKAGAQIEYKVSGAEELDKIDGPEHSSVDLITAATAAHWFDMPKFWNAAAKLLKPGGTVALWTAFRQSGMHRGTETRPSAPQLTLIDLSGGDKVQTLLEDFKENVLRPYSSAGSQITNDGYVDLLMPWDDPTTASLYDRGSSSRHELTAKDGYFPKPYLMDNNPGDDSLDEKLQRFEKLVNSFGTVNRWQKANPEIIGTEDDIVKILMRKLRAAAEDDGGILNLSSLADKYAIAVIIVKKIRPISLPRSIPFTEG

SEQ ID NO: 90909 - protein, 187 aa, Carica papaya
INPAVTFGLLLARKLSLTRAIFYMVMQCLGAICGAGVVKGFEGSATFELKGGGANVRQPWIHKGDGLGAEIVGTFVLVYTVLSATDAKRNARDSHVPILAPLPIGFAVFLVHLATIPITGTGINPARSLGAAIIFNRDKAWDDHWIFWVGPFIGAALAALYQQVVIRAIPFKSKCKFPKWVSIKYVI

SEQ ID NO: 90910 - protein, 124 aa, Zea mays
VVAAEVPAYDAQAAAVSALYNVAEVNMDCRLKLASERWAVDRLLKIVKTPHPVPEVCRKASMILESLVSEPQNRMHLLVHENTFAEILTSEGKYSDTFARIVYELTARPSNKVTSGHAIWGNIN

SEQ ID NO: 90911 - protein, 256 aa, Burkholderia pseudomallei K96243
MSAPNLFDLSGKIAVVTGGSRGIGAEVAKLLGAFGAHVVVTSRRLDDCRAIADEIVAAGGSAEAAACHIGELEQIDALYASLEGRHGRLDVLVNNAATNPYYGPIVDTDLGAFQKTVDVNIRGYFFMSNRGAKLMGKNGGGSIVNVASVNGVIPGYWQGIYSITKAAVISMTKAFAIECAASGVRCNALLPGLTDTKFASALTQTPEVLKQVLAHVPMRRAAQPTEMAGAVLYLASAASSYTTGTVLNVDGGYLSV

SEQ ID NO: 90912 - protein, 325 aa, Lilium longiflorum
GINGFGRIGRLVARVALQSDDIELVAVNDPFITTDYMTYMFKYDTVHGQWKHHEIKVKDSKTLLFGEKPVTIFGVRNPEEIPWGEAGADFVVESTGVFTDKDKAAAHLKGGAKKVIISAPSKDAPMFVMGVNHTEYKSDIHIVSNASCTTNCLAPLAKVINDKFGIVEGLMTTVHAITATQKTVDGPSSKDWRGGRAASFNIIPSSTGAAKAVGKVLPALNGKLTGMAFRVPTVDVSVVDLTVRLEKAATYDQIKAAIKEESEGGLKGILGYIDEDLVSTDFVGDSRSSIFGAKAGIALNDNFVKLVAWYDNEWGYSTRVVDLLR

SEQ ID NO: 90913 - protein, 423 aa, Brassica napus
  misc_feature (379)..(379): Xaa can be any naturally occurring amino acid
MEGFDLFTKRFFLLMITAFCLSSSFVLSLQMGETCSSSSRCDAGLSCQSCPTNGNTGSTCSRIRPLNPTSKVNGLPFNKYSWLTTHNSYSITSAKSTIGSFIISPRNQEDSITNQLKYGVRGIMLDVYDFRNDIWLCHSAGGTCFNFTAFQPAVNALKEINDFLESNLSEIVTIILEDYVTSSRGLTKVFKASGLSKFLFPVSRMPKDGKDWPTVDDMVKQNQRLVVFTSKNGNEASEGFAYQWDYMVENQYGNDGMNDGSCSNRNESPPLDTKSRSLVLQNYFITNPNATQACADNSSPLIKMMTTCHEAAGKRWPNFIAVDYYQRSDGGGAAEAVDAANGRLTCGCDSLSLCKTNATFGTCDAPPPKAAPKPAPGGXLHEILAIFRLVVLFIQEQDCHLLLRSLWLLSCCGGSFVIELKFF

SEQ ID NO: 90914 - protein, 520 aa, Gibberella zeae PH-1
MPSTSIYKSVIYPGNHEKLSSPTDTQNFIDNKLVSSKTTKWIDVHDPATNNIITRVPESTKDELEEAVRSAKAAFPGWKRTSIIKRQQIMFKLTHLIREHMDNLATSIVTEQGKTFADAKGDVLRGLQVCETACGITTQLTGEVLEVAKDMETRSYRQPLGITAAICPFNFPAMIPLWSLPLATVTGNCMIVKPSERDPGAAMMIAELCREAGFPPGVVNVVHGSKDTVNFLLDEPEIQAISFVGSNKAGEYIYQRGSANGKRVQANLGAKNHALLSLDANKEHALDSIAGAAFGAAGQRCMALSVLITLGDAKQWVDDLVKKAKNHVAGSGFDSKSDFGPLITPQARDRCEALITSAEKEGAKILLDGRGWKPEGFPDGNWVGPTVIAGVTPEMECYREEIFGPVLLCMEADTLQSGINIINSNAWGNGAVIFTNNGAKASLFQQEIDAGQVGINVPIPVPLPMFSFTGNKRSVAGTGLANFYGKDGLRFYTQWKTVTSLWKADDASTGEKLTSMPTSS

SEQ ID NO: 90915 - protein, 549 aa, Oceanobacter sp. RED65
MNMAQVNVTVPDLGGIEEVEVIEISVGKGDSVDADDSIVVLESDKATMEVPAPSAGTIAEISVSVGDKVSTGSQVAVMDSDSADAGEKNPSPEQKDADEPKPQQVDQQAQTESKQESSSSSAEPQEIEVRVPDLGGIDEVEVIEIPVSKGDQLQQDDSILVLESDKATMEVPAPQEGELVSIEVKVGDKVSQDTLVAKMKVVGSSGSPTDSSSKAKTQEPAEKTSSPSQATQKSAPAKASPEPQQTQTTSGKVHAGPAVRKLAREFGVDLTDVSATGPKGRILKEDVQAFVKQRVKQPAVASGGPMGVVGSNEDFSKFGPITEQPLNKIKQATARNMVKSWSEIPQVTQFDQADITELEAYRKGKMQSMLPEGVRVSPLAFIARACVKALQAYPTFNSSLKGQGESLVLKQYYNIGIAVDTPEGLLVPVIKDADKKGIVELAQDSSELAKKARDKKLPMDAMQGGCFTISSLGGIGGTSFTPIVTAPQVAILGVSKAKMEPVWNGEEFEPRLMLPLSLSYDHRVIDGAEAARFTRYLCELLTDVRHLLL

SEQ ID NO: 90916 - protein, 469 aa, Methanosarcina acetivorans C2A
MQEVQGEKPGKAKKERTPMPEQPAEERRKNFNEVTLGYTKEDALAEASRCLACKDPKCVEGCPVNVDIPGFIQLICEENFEGAIERIKATNALPAICGRVCPQETQCEARCVLGKKSQPVAIGRLERFCADYEREKGVKAPEVMPPTGKKVAVVGSGPAGLTAAADLAKLGHKVTIFESLHKAGGVLSYGIPEFRLPKEIVRQEVEYIEKLGVEVKPNYIIGRIKTLDELCDDFDAVFLVTGAGLPNFMGIEGENLNGVYSANEFLTRVNLMKAYDPEYDTMVRHGKHVVVVGGGNVAMDAARSALRLGADEVSIVYRRGEDEMPARREEIEHAKEEGIIFRLLTNPVRILGDEKFNVTGVECIKMELGEPDKSGRRSPVPVEGTEFLVQADVVIIAIGTSPNPIIFKGSEGLEQNRRGTVVADEETGATSKCGVFAGGDAVTGAATVISAMGAGKKAAKAIDAFLKEK

SEQ ID NO: 90917 - protein, 484 aa, Azoarcus sp. BH72
MKQIHNFINGEFVATAKPFDKCSPLDNRRIALVHEAGKTEVDAAVAAAQAALKGPWGRMTVAERVDLLNAVADGINRRFDDFLAAECADTGKPKSLASHIDIPRGAANFKVFADVIKSVPTEFFEMATPDGRGALNYALRRPVGVVGVICPWNLPLLLMTWKVGPALACGNTVVVKPSEETPQTATLLGEVMNEVGMPKGVYNVVHGFGPGSAGEFVTTHPKVNAITFTGETRTGAAIMKAAADGARPVSLEMGGKNPAIVFADCDFDAAIEGTMRSVFANCGQVCLGTERVYVERPIFDRFVAALKAGAEGLKLGVPDDASTGMGPLISQEHKNKVLSYYNKARELGATVVTGGGVPQMPGELANGAWVQPTIWTGLDDNSPIAREEIFGPCTLIQPFDAEDEVIRRANDTDYGLACSVWTKDLARAHRVAGQIEAGLVWVNSWFLRDLRTPFGGAKQSGIGREGGVHSLEFYTEQKNICIKL

SEQ ID NO: 90918 - protein, 161 aa, Methanosarcina acetivorans C2A
MKHTLAVLVENKSGVLSRVASLFSRRGYNIDSLAVGVTEDPDISRITIVVHGDDHVLEQVTKQLNKLIDVIKVSDIGGDDAVERELALIKVSADVNTRAEIIQIANIFRARIVDVAPKSMTVEVTGDESKIQAIEKLLRQFGIKEMVRTGKIAMVRGPKKV

SEQ ID NO: 90919 - protein, 109 aa, Taraxacum officinale
EYTVRALQRTMPPAVPAVVFLSGGQSEEEATVNLNAMNQYKGKKPWTLTFSFGRALQQSTLKAWSGKVENVEKAQAAFLARCKANSEATLGIYKGGSGLSEGASESLHI

SEQ ID NO: 90920 - protein, 267 aa, Glycine max
MGYAQLVIGPAGSGKSTYCSSLYEHCVAARRSIHVVNLDPAAENFDYPVAMDIRELISLDDVMEELGLGPNGGLVYCMEHLEDNLDDWLTEELDNYLDDDYLVFDCPGQIELYSHVPVLKNFVEHLKRKNFSVCAVYLLDSQFMTDVTKFISGCMACLSAMVQLELPHVNILSKMDLVTKKKDLEDFLDPEPTFLLSELNQRMGPQYAKLNKALIELVNNYSMVSFIPLDLRKEKSIQYVLAQIDNCIQYGEDADVKVKDFDPEDDE

SEQ ID NO: 90921 - protein, 467 aa, Clostridium perfringens str. 13
MRRTKLVCTIGPASENEEILTKIIEAGMNASRHNFSHGDHEEHKGRMVKVREISKKLGKEVAILLDTKGPEIRTGKFEPSKVELTAGTEFTIYAGAEDVIGDTTKCSVTYAGLAKDVKAGDTILIDDGLVGLEVVSVEGNAVKCVVRNTGLVGTHKGVNVPGVSIKLPAMTDKDRADLIFGCEMGVNMVAASFIRKAEDVKAIREVLVANGGADIQIFSKIENQEGVDNIDAIIEASDGIMVARGDLGVEIPMEDVPSVQKMIIEKCNNAGKPVITATQMLDSMMRNPRPTRAEVSDVTNAILDGTDAIMLSGESANGSWPVEAVETMVKIATKSEEMLSYELASSKAKKHIPAVPGVISRAACNAAHELKSAAIVSLTQSGATAKRISQCRPDAPIVTVTPNERVAKKVALCFGVYPVVAENATMENAVEIAKNAGFVKANDTAVVVAGVPANEGNTNIVKVEVVK

SEQ ID NO: 90922 - protein, 241 aa, Moorella thermoacetica ATCC 39073
MRALWRRIKRDIEVVFERDPAARSVLEVILCYPGFHALILHRLAHACYRRGLVLLARLISQFNRFLTGIEIHPGAKLGEGIFIDHGMGVVIGETAEVGNNVTLYQGVTLGGTGKEKGKRHPTIGNNVVISAGAKVLGNITIGDNVKIGAGSVVLRDVPANCTVVGVPGKVVVRNGRKIADAEVSEVDLRHEELPDPMAEMLLCLQRQIQRLEQRVEELEAEKDWHVSLQYADGTQGRVHPS

SEQ ID NO: 90923 - protein, 163 aa, Moorella thermoacetica ATCC 39073
MRIGYGYDVHGLVPGRKLVLGGVTIPYDRGLAGHSDADVLLHALADALLGAAALGDIGHYFPPGDPRYKDADSMLLLREVYRHVQTAGYRLANADATITAQEPRLAPYIDAMRERIAAALGVTKEQISVKATTTEGLGFTGRGEGISAQAVVLLLDREAGAGL

SEQ ID NO: 90924 - protein, 256 aa, Kluyveromyces lactis NRRL Y-1140
MSEYSFAGKIALVTGASTGVGEGIARALFVRGATVVITSRHLSEVQETAGNIDPSGSRVIGKEVDVTVAKAVEDLIQEIREEFGALHYLVNNAGITGPHQTGIEDYDIDSWRQVIDTNINGTFYTLKYALPLMESSSSPDSEAAVVNLSAVNGLVGIPGISPYTATKHAVIGITQSVALEYAERNVRVNAVAPGYVSTPKIQALPKETQQWMSSQHPMKRMATMTEVSNTVLFLLSPLTGFTTGSVYPIDGGFLAQ

SEQ ID NO: 90925 - protein, 294 aa, Scutellaria baicalensis
MEQYEKVEKIGEGTYGVVYKARDRVTNETFALKKIRLEQEDEGVPSTAIREISLLKEMQHGNIVRLQDVIHSEKRLYLVFEFLDLDLKKHMDSCPEFSKDPRLVKTFLNQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRIMGTPNEDTWPGVTSLPDFKSAFPKWPSKELATVVPNLDAPGLDLLGKMLCLDPSKRITARHALEHDYFKDIGFVP

SEQ ID NO: 90926 - protein, 539 aa, Kluyveromyces lactis NRRL Y-1140
MSKDKYDRSLKNLNMLRRPVLNNVTNTTESTFGKVLRQAKSRLQNSRTNNLPQGTANSYSNTKPAPLRDDIMVPEDKENYNPLAKIDEREELDSNLVHNHKSLGTQKHVTIDERQEIIGYSHLDTEKSAPSSSTYSSEHTENDGVHDVNPNVQRSDNEADFKMQTTNAFHENVNDGSDATDDASSGSKSSNECPAVNVGNSLAPMPIDENANNSASSVELRAKQLQVEDSKKRPISTVVEQTLPKKFKVCEKGKEYEWEDLDEEDINDPFMVSEYVTDIFEYLHRLEMMTLPNRHELFKHANIQQNRDILVNWMVKIHNKFGLLPETLYLALNIMDRFLCKELVQLEKLQLVGTACLFIASKYEEVYSPSVKHFAYETDGACDEEEIKEGEKFILKTLEFNLNYPNPMNFLRRISKADDYDIQSRTLAKYLLEISIVDFKFIGILPSLCAAASMFLSRKMLGKGQWDGNLIHYSGGYTKDELAPVCNMVMEYLVQPVVHDELFKKYASRRFMKASVISRQWAKKVMSHNYDIMTLHDSE

SEQ ID NO: 90927 - protein, 310 aa, Ustilago maydis 521
MAELELMDELGKGNYGTVRKVRHTQTHVEMAMKEIRLELDESKLNAIIMELDILHRATAPQIVEFYGAFFIESCVYYCMEYMNAGSLDKLYGDRGSVPEDVLARITGSMVRGLSFLKDELQIMHRDVKPTNVLINRKGQVKLCDFGVSGQLEKSLAKTNIGCQSYMAPERIKGESQNMLGTYTVASDVWSLGLSMVETTLGTYPYPPETYSNVFAQLQAIVHGDPPELPPELYSETARDFVAKCLEKIPARRPTYAQLLEHEFLTEDAAKGEEGVDMVGWVERAIDARTRKKEQVNGTSAPGSSSTPSEA

SEQ ID NO: 90928 - protein, 408 aa, Kluyveromyces lactis NRRL Y-1140
MRPRTRSSWSVSDAEAMEKSSHQRKRVALSEQPLHDNKLKSSVGSLRNSQVDEGKNKIYGNSSQTTSSVSLKRQIYRDDDDEEQKSDVRSDDDILEPRKSHKRLKCESLERRREELDSQDKEDVTMCYDYSDDIFDHLYTRQFETTPKINYLKDKNYEFYLRPTMRSILVDWIIEVHCKFQLLPETLYLSINLMDRYLSFNKVTLPKLQLIAITSLLIAAKFEEVNLPKLSNYSYITDNAYSNDEIKQAEFVILNKLEYNIGWPNPLNFLRRISRCDEYDSITRTLGKCLIGYMISCPHFIDVVPSKIASVAMFTAQRIVHEDFQWDELWDYYSCFSFKDNEIELKELSQILINDIAKPTTQLNALIHKYKKIGTWNKIHDWCLKHCTYEELNPSDYASSSPASSTSL

SEQ ID NO: 90929 - protein, 139 aa, Desulfococcus oleovorans Hxd3
MERTLSIVKPDGVERGLIGEVVRRLEKEGLKIIAMKMIHMTRAQAEGFYAVHRERPFFESLTTFMSSGPVVVMVLEGEDAILRYRTLMGATNYKDAAEGTIRRDFATEIERNVVHGSDAPDTAAFEIGYFFNSFEIMGR

SEQ ID NO: 90930 - protein, 78 aa, Blastopirellula marina DSM 3645
MSVQERVFEIVASQLGVDQDKITMESSFVNDLGADSLDTVELVMELEEEFDIDIPEDAADKIETVGQAIKFIEEAKNS

SEQ ID NO: 90931 - protein, 516 aa, Oryza sativa Indica Group
MEKERKQGFFAALKEEVVRGLSPARSRGKSPARSASPGRMLIPRRRKEKQQQPPPEKLLQQYFAEPLISRSGSLRPGGEALAPLIEGPDPERLAAGGDFAGGEESARREGFGRWVRGQLARTPSVASSAAAAASPGGSGDSFRRSDLRLLLGVMGAPLAPIPSKLADPLPLLSIKGTPIESSSAQYILQQYMAASGGYRLLQSVRNAYAMGKVRMVASEFETATRVVKNRGPSGRGAASVEQGGFVLWQMAPDMWYVELAVGGSKVHAGSNGRLVWRHTPWLGAHAAKGPVRPLRRVLQGLDPLTTAGLFAEARCVGEKKVNGEDCFILKLSADPQTLKQRSEGPAEIIRHVLFGYFSQRTGLIVHIEDSHLTRIQPHSGGDAVYWETTISSALEDYRPVEGIMIAHAGRSAVTLFRFGEAAMSHTKTRMEEAWSIEEVAFNVPGLSVDCFIPPADIRSGPVGESCELPPPAAAPHGERARHPARVAAVDRAPPHHNAGGANVGRRGDKIMWRVEV

SEQ ID NO: 90932 - protein, 137 aa, Gossypium hirsutum
TVACLLLKFATGDLAVPAFGLSSGVGVSNALVFEIVMTFGLVYTVYATAVDPKKGSLGTIAPLAIGFIVGANILAGGAFDGASMNPAVSFGPALVSWTWDNHWIYWVGPLIGGGLAGLIYEFIFISNTHEQLPTTDY

SEQ ID NO: 90933 - protein, 225 aa, Magnetospirillum magnetotacticum MS-1
MSTLTALSRRAQAVAPFLAMDVMAAAGARERRGEGVVHMEVGQPSAPAPRAVIAAAQAALADGRIPYTEALGLPALRARIARHYAETYGVTVSPERVVVTTGSSAGFVLAFLALFDAGARIGVPRPGYPAYDGILRALDLIPQPLTLQAEDRYAPTSALVGAVHAAHPLSGLLVMSPANPSGTVIAPARLAELCATARGLGLAFISDEIYHGLSYGVPTATALQF

SEQ ID NO: 90934 - protein, 205 aa, Triticum aestivum
  misc_feature (195)..(196): Xaa can be any naturally occurring amino acid
MSDNSIQRALLPDNPDANVLQTKPSQGAKRFRRCRSAPRSETDEKPQENGSSLPAKELFSVVRPSFRLVGFLLFLYLLAGVIVFYLVMDQLSGKRTNRVLDALYFCIVTMTSVGYGDLVPNTDTTKLLACVFVFTGMAIIALFVSKSADYLVEKQEVLFFKALHMNMKCGEAKMLRQIETNKTKYKFTRPLALVXXIVVGLFSWR

SEQ ID NO: 90935 - protein, 459 aa, Oryza sativa
MAKPAPAPAAGAREDEDAPALRRRLRRLVAAATAGAASESVLDEAAAALAALRDAEVGVGRKGVGGGEEAAAAAVPALFLCPISSGIMRDPVVIESGQTYDRRSIQEWFSAGNQICPQTQQVLSHTIVIPNHLVRTMISQWCTENGLTLPEIENQEQDHVTNSEEKTFDEIFVKITSSANSGGRKQAIKDLRLLTKRNSEFRAVLGQRPDSIAQMILARSTPGLQNDPQVLEDMVTIILNFSIHDSNKKIIGDDSEAIQFLIWALKSGDMGSRSNSAAAIFTLSALDSNKEKIGKLGAMDPLIDLLEHGSIIAKKDAASAIFNLCLLHENRSIAARSGIVDVAMRAIDDQSLVEESLAILALLSRNQEMVEIITEFNGTASMLRSIRESECKRSKENAMVVLFAICTYNRTKLKEVEADESINGSLTFLAQTGTQRARRKASGILEKMKRTMHNRHCSC

SEQ ID NO: 90936 - protein, 310 aa, Oryza sativa Japonica Group
MALLRAHHLLLMRPRAAFSSRPPPLSSSPCRRALPTTAIASRLLCSHHASSPPEDASASASPSIVADLLDYLNESWTQFHATAEAKRQLLDAGFTLLSENDDWDLQPGGRYFFTRNMSCLIAFAVGEKYKLGNGFNIIAAHTDSPCLKLKPRSASFKSGHQMVNVQTYGGGLWHTWFDRDLTLAGRVILKDADGSFKHELVKVLSDEIGCKSGEIIGIELNVCDTQPSCLGGGNNEFIYSGRLDNLASCYCALRSLMDSSKMPEELSNEKAIRMIALFDNEEFRQTWLMPCTQIIQTSMKSTTDQSYRKD

SEQ ID NO: 90937 - protein, 289 aa, Amanita muscaria
LETDLDVVAINDPFIDLAYMVYMFKYDSVHGRFSGSVETKDGKLWINQKPITVFRKRDPVQIPWGSAGAEYIVESTGVFTTTEKASAHLKGGAKKIVISAPSADAPMFVCGVNLDKYDPKFQVVSNASCTTNCLAPLAKVVNDKFGIVEGLMTTVHATTATQKTVDGPSAKDWRGGRSVNNNIIPSSTGAAKAVGKVIPELNGKLTGLSFRVPTLDVSVVDLVVRIEQSATYDEIKEAFREASKGSLKGIIEYTDEHVVSTDFIGHTASSIFDSLAGIQLNANFVKLIA

SEQ ID NO: 90938 - protein, 411 aa, Clostridium acetobutylicum ATCC 824
MDNPNLLSEEANRCLLCKNPRCKANCPINTPIPEIISLYKEGKIMEAGEILFNNNPLSVICSLVCIHEDQCKGNCVRGIKSEPIKFHEIEEEISEKYLKEAKLKNVQKDKDRIAIVGGGPAGITVAFVLANKGYNVTIFEAHDKIGGVLRYGIPEYRLTKKLVDKLEERLIEVGVKIRPNTVIGPVISLDRLLEDSYKAVFIGTGVWNPKTLDVKGETLGNVHFAIDYLKSPESYRLGKKVAVIGAGNVAMDAARTAKRNGAEVTILYRKSFNEMPASKQEIRETKEDGVEFKLFRAPIEITEEGIKVAFTENVTDAEGKIRTKIIEGKEEFFECDSVVVAVSQAPKDNIVSNTTGLDTKWGLIVTDEKGNTTKKGTFACGDVVTGAKTVVEAAAQAKVVAETIDEYCKNN

SEQ ID NO: 90939 - protein, 337 aa, Glomerella lindemuthiana
MAPIKVGINGFGRIGRIVFRNAVEHPDVEIVAVNDPFIETKYAAYMLKYDSTHGIFNGEIAQDGNDLVINGKKVKFYTERDPAVIPWKETGADYVVESTGVFTTIDKAKAHLQGGAKKVIISAPSADAPMYVMGVNEKSYDGSAVISQASCTTNCLAPLAKVINDKYTIIEGLMTTVHSYTATQKTVDGPSAKDWRGGRTAAQNIIPSSTGAPKAVGKVIPELNGKLTGMSMRVPTANVSVVDLTVRIEKGATYDEIKQAIKEAAEGPLKGVLAYTEDDFVSTDMIGNPNSSIFDAKAGISLNNNFVKLVSWYDNEWGYSRRVLDLLAHVAKVDASK

SEQ ID NO: 90940 - protein, 290 aa, Lactarius deliciosus var. deterrimus
LLDPRVKVLAVSDPFIDLQYMVYMFKYDSVHGRFKGTVEIKDGKLVIDGHPITVFQERDPANIQWGSVGADYVVESSGVFTTVDKASAHLKGGAKKVIISAPSADAPMFVVGVNLDAYDSKYTVISNASCTTNCLAPLAKVINDKFGIVEGLMSTIHATTATQKTVDGPSNKDWRGGRAVNGNIIPSSTGAAKAVGKVIPALNGKLTGLAFRVPTNDVSVVDLVVRLEKEATYDEIKLAVKEAADGPLKGIIEYTDDLVVSTDFIGSTASSIFDAGAGIQLNKNFAKLIS

SEQ ID NO: 90941 - protein, 164 aa, Burkholderia xenovorans LB400
MASVAQLLRSKTSQRVWSTQASASVYDAIAVMAHRQVGALIVAHEGRIAGIVTERDYARKIVLMDRSSRHTPVRDIMSTAVRYIGPDQTTEECMALMTEHRIRYLPVITAGQVIGMVSIGDLVQNLIVEHEQTIQQLEHYIHGNGFQAAQSGSQARRAASLTRQ

SEQ ID NO: 90942 - protein, 668 aa, Saccharomyces cerevisiae
MEDKFANLSLHEKTGKSSIQLNEQTGSDNGSAVKRTSSTSSHYNNINADLHARVKAFQEQRALKRSASVGSNQSEQDKGSSQSPKHIQQIVNKPLPPLPVAGSSKVSQRMSSQVVQASSKSTLKNVLDNQETQNITDVNINIDTTKITATTIGVNTGLPATDITPSVSNTASATHKAQLLNPNRRAPRRPLSTQHPTRPNVAPHKAPAIINTPKQSLSARRGLKLPPGGMSLKMPTKTAQQPQQFAPSPSNKKHIETLSNSKVVEGKRSNPGSLINGVQSTSTSSSTEGPHDTVGTTPRTGNSNNSSNSGSSGGGGLFANFSKYVDIKSGSLNFAGKLSLSSKGIDFSNGSSSRITLDELEFLDELGHGNYGNVSKVLHKPTNVIMATKEVRLELDEAKFRQILMELEVLHKCNSPYIVDFYGAFFIEGAVYMCMEYMDGGSLDKIYDESSEIGGIDEPQLAFIANAVIHGLKELKEQHNIIHRDVKPTNILCSANQGTVKLCDFGVSGNLVASLAKTNIGCQSYMAPERIKSLNPDRATYTVQSDIWSLGLSILEMALGRYPYPPETYDNIFSQLSAIVDGPPPRLPSDKFSSDAQDFVSLCLQKIPERRPTYAALTEHPWLVKYRNQDVHMSEYITERLERRNKILRERGENGLSKNVPALHMGGL

SEQ ID NO: 90943 - protein, 77 aa, Sideroxylon saxorum
TIQCLSGTGSLRVGAEFLARHYHKRTIYIPQPTWGNHPKIFTLGGLSVKTYRYYDPPTRGLNFEGLVEDLGSASSGA

SEQ ID NO: 90944 - protein, 294 aa, Scutellaria baicalensis
MDQYEKVEKIGEGTYGVVYKARDRVTNETIALKKIRLEQEDEGVPSTAIREISLLKEMQHGNIVRLQDVVHSEKRLYLVFEYLDLDLKKHMDSCPEFSQDPRTVKMFLYQILRGIAYCHSHRVLHRDLKPQNLLIDRRTNALKLADFGLARAFGIPVRTFTHEVVTLWYRAPEILLGSRHYSTPVDVWSVGCIFAEMVTQRALFPGDSEIDELFRIFRVMGTPTEETWPGVTSLPDFKSSFPKWPTKELATVVPSLDSAGLDLLGKMLILDPSKRITARSALEHEYFKDIGFVP

SEQ ID NO: 90945 - protein, 318 aa, Rickettsia prowazekii str. Madrid E
MANLHQQQIIDKIQNITFKDGTFLNEVISDIIIKGNNIGFSIDISGKNKLEAEEIRLKAINKLNNIKEVNKITIVFTQSKTIDKKAQKPKHFVENVKKIILVASGKGGVGKSTISALIAQQLSLENYRVGIVDADIYGPSIPHIFGINGIPKTVEGRIVPILAQNIQIISIGFFVKAHSAIIYRGPMASKIIYQLLSNTRWNNLDYLIIDMPPGTGDIHLSIIENYHLDGVIVVTTQQKISEIDVIRSIDLYRKLGLPILGIIENMIYMLESDHCGYLSKKYHIPLIAQIPIMPQIANACDKSLPLTNLLTLPLEKYL

SEQ ID NO: 90946 - protein, 381 aa, Ustilago maydis 521
MASTLPRSLVGIARSSVRALHSSVATAASTSTLSPVAAAHMRPVNGFVGAIGNTPLIRLNKISDETGCEVLGKAEFMEPGGSVKDRAALYVVKDAEERGLIKPGGTVVEGTAGNTGIGLAHVCRSKGYRCVIYMPNTQSQEKIDLLRMLGAEVHPVPAVAFDNPDNYNHQAKRHAERLENAVWTNQFDNTANRRAHIETTGPEIWDQIDGNLDGFICATGTGGTLAGITSYLKQKSNGKVQCWLADPPGSVLHSYIQTKGKLMDREGGSITEGIGQGRVTENLKPDVEKLDNSVHVPDEESISMVYDLLHEEGIYVGASSALNVVAAKKMAQQLGPNKTIVTILCDGAYRYQARLFSRKWLESKKLDTAIPEHLQKYIVLP

SEQ ID NO: 90947 - protein, 151 aa, Prochlorococcus marinus str. MIT 9211
MVAERTFLAIKPDGVQRGLVGEILSRFERKGFKLIALKQLIPSRALAEQHYGVHRERPFFKGLVDFITSGPVIAMIWEGEGVILGARKLIGSTKPLDADPGTIRGDLAIDIGRNVIHGSDGPETASFEIGLWFESSELSDWNPSDQLWRVE

SEQ ID NO: 90948 - protein, 75 aa, Sideroxylon saxorum
QCLSGTGSLRVGAEFLARHYHERTIYIPQPTWGNHPKIFTLGGLSVKTYRYYDPPTRGLNFEGLVEDLGSASSGA

SEQ ID NO: 90949 - protein, 347 aa, Scutellaria baicalensis
MHLLHKLTSPSLSLSHSDLSFSLWNQFQEREREAQILSPINSSMEKYEKLEKVGEGTYGKVYKAKEKATGQVVALKKTRLEMDEEGVPPTALREVSLLQMLSQSLYVVRLLCVEHVDNKNGKPLLYLVFEYLDTDLKKFIDSHRKGPNPRPLPPPQIQSFLYQLCKGVAHCHSHGVLHRDLKPQNLLLDKDKGILKIADLGLGRAFTVPLKSYTHEIVTLWYRAPEVLLGSTHYSTAVDMWSVGCIFAEMARRQALFPGDSEFQQLLHIFRLLGTPTEKDWPGVSSLRDWHVYPQWEPQNLARAVPALGPDGVDLLSKMLKFDPADRISAKEAMDHPYFDTLDKCQF

SEQ ID NO: 90950 - protein, 77 aa, Listeria innocua Clip11262
MAEVLEKVTKIIVDRLGVEESKVTLEASFKEDLGADSLDVVELVMELEDEFGVEISDGDAENINTVGDAVKYIEANA

SEQ ID NO: 90951 - protein, 1514 aa, Magnaporthe grisea 70-15
MYPGSSQSRPYQVPPPPPMSPPLSQMHQQMSFRSAPSSSRASSGKCTEPASSVEWGPGGGVPAPRQAYDNRSGMYAQAPIQQYNPQAHAATAPGLNIPPPPLQTDAPMSDTYNPGQDPMFDGFMPDLSFDLEQETMGSSQTWQTTSSSSTNTASVNDNVQSNAPTEERTRRNNSASITGTQSSSNVPGIPSDITASWSLDKVIAWLQMNSFSRDWQETFKSLNIHGAQFLELGSGHFGRGNFGMMHQQVYPKLAKVCTASGTGWDQPREREEGKRMRRLIRGLVHARAVPDSARVPSSHGRQGSINSRGNDKGTHDGSDSPNTPIMKTPSSQSRSTTIPTFPDGSSFSNHRGVLKNIDIDRHSSPKLNGDSPAASPNPVMASSTPKSSTLSVSPHSSRFGNNVRNSTDSVKAIYGSGIPADAQKMMSNSNLDELINGRGARQSPSDLGDNSAGTDSPVSARDTKLPFRQRMQAKDIDGNLSSPNGEGSLSPQMYRNGLGLDDYLRFKKPGGSIYLMATADGWNYRVVDVTDVETVLDLRSEISRGLGIPDEDGVEFYLTELGKSDHSQPLDDNQLMNHNKSRADAEGTLKLFVKPPPMSQQSTWSAGDTGQRHRFGTSSSMSRQQNTLKDDQSEEARLRAQREYKAEIDRKGREYLAIRKAKLESNNNGLSSSTEGIGIVGKPVDFDTPRHSPYEDKNTDRMFPTRNAPAPPVAPSATLNRVNSLMTGQRRVQGSMDGYPSQRVPPGVGTTTSPKEMSEDRRRQPMSGSQPMGGITSALVDMGRNLGGVALPNRGVSANNVPSKPSPPYRVATAPVSGRDFVSPDNRAAFPRSQTAGDLSPISQMPANFAAYQEPNPSPRGFGAAPVSSAAHKRAPSGPDIDFTEPEVSFDRPAPSTAQNEAQSDDDSGDDSDDGLFVIPIAARKASMKKAKSRASVTFDASDSGDGKRPALTVNTARDRKSVSFNSPQSARTGDDDDDSGRQRRTPKSDMWDSEDGKLGRRKSFKMDVWANRPPAEALINNLEDFFPGMDVDQPVLEEGDQEQNIDGSPVAPSPIAEVDETQSPGHLQINATPLNSLPPSRVQSMYNESDTLGSDESTLKALERPPSFQSLAQRSVRRSGGLGRMKSIREKARGAHEAHKRYTQTSMAAPQGLSRSGGTPATETQPTQNNSSALLRRKSTKMFNANIVQIRPNRDSMLVPDIPQDSISSSSRGAPKHPTTFRWFKGQLIGKGTYGRVYLGMNATTGEFLAVKEVEVNPRAAAGDKKRMKELVAALDQEIETMQHLDHVNIVQYLGCERKETSISIFLEYISGGSIGSCLRKNGKFEESVVQSLTRQTLSGLAYLHREGILHRDLKADNILLDVDGTAKISDFGISKKTDNIYGNDKSNSMQGSVFWMAPEVIRSQGEGYSAKVDIWSLGCVVLEMFAGRRPWAKEEAVGAIYKIANGEIPPIPEDVQDTISPIAVAFMMDCFTVDSHDRPTANKLLSQHPFCELDPNYNFLDSELYAKIRGTY

SEQ ID NO: 90952 - protein, 496 aa, Scutellaria baicalensis
MASSAGVRRPTTSSLAKRHASSASDNVGKVASSASASKKRPALANVTNQRHGTGSANAGRAPLPESSKIAPCTTKIVSIKKGPSASTNSGFPGAILPTSSSVKQNIVAVGRSTFIPKSDVVLPKTLAAPVSCSMDVSPDKSDSLSVSMDESMSTCDSLKSPDVEHVDYIDVAAVDSIERKASNMLCISDHMEIAGNLCKRDALASLESGDKIVDVDENLDDPQLCATIACDIYKHLRASEAKKRPATNFMERVQKDINASMRAILIDWLVEVAEEYRLVPDTLYLTVNYIDRYLSGNVMDRQRLQLLGIACMMIASKYEEICAPQVEEFCYITDNTYFKDEVLEMESAVLNYLKFEMTAPTAKCFLRRFVRAAQGVNETPLLQFECLANYITELSLLEYSMLCFAPSLIAAASIFLARFILLPSKRPWNHTLRHYTLYQPYDLRDCVLALHGFCCNSHNSSLPAIREKYSQHKYKFVAKKYCPLSIPPEYFHNVSS

SEQ ID NO: 90953 - protein, 504 aa, Botryotinia fuckeliana
PLAQEISQRSTGVVVAAGVAAFIVLSVVLNVLNQVLFANPNEPPMVFHWLPVIGSTITYGMDPYKFFFDCRAKYGDIFTFVLLGKKTTVYLGRKGNDFILNGKLKDLNAEEIYTVLTTPVFGKDVVYDCPNAKLMEQKKFMKIGLSTEAFRSYVPIIQMEVENFMKRSSAFKGPKGTADIGPAMAEITIYTASHTLQGKEVRDRFDTSFASLYHDLDMGFSPINFMLHWAPLPHNRARDHAQRTVAKTYMDIIQNRRAQATEAEFKSDIMWQLMRSSYKDGTPVPDKEIANMMIALLMAGQHSSSSSISWIMLRLASRPDIMEELYQEQIQVLGADLPALKYEDLSKLPLHQNVLKETLRLHTPIHSIMRKVTTPMPISGTKYVIPTSHTLMASPGCTSRDDEFFPEALEWDPHRWDLGSGRVVGNDQDEEFQDYGYGMISKGASSPYLPFGAGRHRCIGEQFATVQLVTIMATVVRLFKFKNIDGSKDVIGTDYASLFTRPLA

SEQ ID NO: 90954 - protein, 337 aa, Monascus pilosus
MVVPKVGINGFGRIGRIVFRNALEHEGVDIVAVNDPFIEVHYAAYMLKYDSTHGRFNGTVEFDGNSLIVNGKKIKFYAERDPAQIPWSETGAEYVVESTGVFTKHEKASLHLKGGAKKVIISAPSSDSPMFVMGVNNDQYTKDITVLSNASCTTNCLAPLAKVINDKFGIVEGLMTTVHSYTATQKVVDGPSNKDWRGGRTAAQNIIPSSTGAAKAVGKVIPSLNGKLTGMSMRVPTSNVSVVDLTARLEKAATYDEIKQAIKEASEGPLKGILGYTEDDVVSSDLNGDPHSSIFDAKAGIALNSNFVKLVSWYDNEWGYSRRVIDLIAYIAQVDAQ

SEQ ID NO: 90955 - protein, 500 aa, Botryotinia fuckeliana
PLAQEISQRSTGVVVAAGVAAFIVLSVVLNVLNQVLFANPNEPPMVFHWLPVIGSTITYGMDPYKFFFDCRAKYGDIFTFVLLGKKTTVYLGRKGNDFILNGKLKDLNAEEIYTVLTTPVFGKDVVYDCPNAKLMEQKKFMKIGLSTEAFRSYVPIIQMEVENFMKRSSAFKGPKGTADIGPAMAEITIYTASHTLQGKEVRDRFDTSFASLYHDLDMGFSPINFMLHWAPLPHNRARDHAQRTVAKTYMDIIQNRRAQATEAEFKSDIMWQLMRSSYKDGTPVPDKEIANMMIALLMAGQHSSSSSISWIMLRLASRPDIMEELYQEQIQVLGADLPALKYEDLSKLPLHQNVLKETLRLHTPIHSIMRKVTTPMPISGTKYVIPTSHTLMASPGCTSRDDEFFPEALEWDPHRWDLGSGRVVGNDQDEEFQDYGYGMISKGASSPYLPFGAGRHRCIGEQFATVQLVTIMATVVRLFKFKNIDGSKDVIGTDYASLFT

SEQ ID NO: 90956 - protein, 471 aa, Xanthomonas axonopodis pv. citri str. 306
MSSWLRRKSIDQVTVHEAGRQLVRSLSWPHLIALGIGAIVGTGIYTLIGVGADKAGPAVLLSFVAAGIVCACAALAYAEMATMMPAAGSAYTYSYTALGESIAWVVGWSLVLEYSLVVSTVAVGWSGYFVGFLQWLGVGLPQALIAGPHAGGIVNLPAVAITFLVAGLLMAGTKESATLNAVLVVLKIIALGVFVAIALPAFNSANLQPFMPYGFSKAMGPDGIERGVMAAAAIIFFAFYGFDAISTAAEETKNPGRDLSIGIVGSMIGCTLIYVLVALAAVGAMSFTVFGKSPEPLALILRELGHGKAALVIGAVAIIALPTVLLAFLYGQSRIFFVMSRDGLLPRGLSKVNARTGTPVAITLFTAVLVAALAGVARLDEIAALANAGTLAAFTAVAACLLVLRVREPGRARAFRTPLAWVVGPVAIGGCLYLFWSLPSKTQGWFLLWNALGVVVYLAYGRRNSRLNQAG

SEQ ID NO: 90957 - protein, 501 aa, Botryotinia fuckeliana
PLAQEFSQRSTGVVVAAGVAAFIVLSVVLNVLNQVLFANPNEPPMVFHWLPVIGSTITYGMDPYKFFFDCRAKYGDIFTFVLLGKKTTVYLGRKGSDFILNGKLKDLNAEEIYTVLTTPVFGKDVVYDCPNAKLMEQKKFMKIGLSTEAFRSYVPIIQMEVENFMKRSSAFKGPKGTADIGPAMAEITIYTASHTLQGKEVRDRFDTSFASLYHDLDMGFSPINFMLHWAPLPHNRARDHAQRTVAKTYMDIIQNRRAQATEAEFKSDIMWQLMRSSYKDGTPVPDKEIANMMIALLMAGQHSSSSSISWIMLRLASRPDIMEELYQEQIQVLGADLPALKYEDLSKLPLHQNVLKETLRLHTPIHSIMRKVTTPMPISGTKYVIPTSHTLMASPGCTSRDDEFFPEALEWDPHRWDLGSGRVVGNDQDEEFQDYGYGMISKGASSPYLPFGAGRHRCIGEQFATVQLVTIMATVVRLFKFKNIDGSKDVIGTDYASLFTR

SEQ ID NO: 90958 - protein, 498 aa, Botryotinia fuckeliana
ISQRSTGVVVAAGVAAFIVLSVVLNVLNQVLFANPNEPPMVFHWLPVIGSTITYGMDPYKFFFDCRAKYGDIFTFVLLGKKTTVYLGRKGNDFILNGKLKDLNAEEIYTVLTTPVFGKDVVYDCPNAKLMEQKKFMKIGLSTEAFRSYVPIIQMEVENFMKRSSAFKGPKGTADIGPAMAEITIYTASHTLQGKEVRDRFDTSFASLYHDLDMGFSPINFMLHWAPLPHNRARDHAQRTVAKTYMDIIQNRRAQATEAEFKSDIMWQLMRSSYKDGTPVPDKEIANMMIALLMAGQHSSSSSISWIMLRLASRPDIMEELYQEQIQVLGADLPALKYEDLSKLPLHQNVLKETLRLHTPIHSIMRKVTTPMPISGTKYVIPTSHTLMASPGCTSRDDEFFPEALEWDPHRWDLGSGRVVGNDQDEEFQDYGYGMISKGASSPYLPFGAGRHRCIGEQFATVQLVTIMATVVRLFKFKNIDGSKDVIGTDYASLFTRPL

SEQ ID NO: 90959 - protein, 241 aa, Synechococcus sp. RS9917
MSRWRRSGDCWCLWPAQPRALVEFIGGSYLAATPQISYRRLLEGLAQQGWAIHAWSYVPAFDHQLQARQAWDAFRSCRSILIQRVGELPPSLRLGHSLGCKLHLLAPDGGRNSSGLAALSFNNFAADRSIPLLGTLAPSLGVSTEFSPSPEETLRLIARHYLPARNLVVRFGTDSLDQSAALLACLQSRAGDQSTWLPMEGDHLTPASAGLRQGLLGDWADDPKRSRRLRQLIEALVAWAP

SEQ ID NO: 90960 - protein, 248 aa, Populus trichocarpa
MADNSKPSFDRNNNDGEEASPLLNKNLEEQNDKKPTKVSPDAKTATASPGSASPEYGWAVNGLPLSHGSVVGEPMGRNQWDSSLFACLGRNDEFCSSDLEVCLLGSTVPCMLYGSNVERLGSAPGTFASHCLSYCGLYLIGTSFFGRNCIAPWFSYSSRTAIRRKFNLEGSCEALDRSCGCCGSFVEDDLQREQCETACDFATHVFCHPLALCQEGREIRRWVPHPGFNAQPVLVMIPPGEQSMGRGA

SEQ ID NO: 90961 - protein, 153 aa, Zea mays
  misc_feature (60)..(60): Xaa can be any naturally occurring amino acid
AAASPNFQLVLSPRISQSLSRGRPGDRGSVGGGAFHGAAGVKAGAAAVHVAKHGCSYHKXLMEKNKHYVVDPPTIDKCKDLSKQLFYTRLASLPGRYESFWKEVDGAKLLWKNGSRLKIEDASVAAMFGIELYAWFCLGEIVGRGFTVTGYHV

SEQ ID NO: 90962 - protein, 868 aa, Xylella fastidiosa Ann-1
MSASPTVERWIVLKFGGTSVSRRHRWDTIAMVVRKRLEEHGTRVLIVVSALSGVTNELTAIAQGVVDSAQRVAALEQRHRDFLAELGLDAQAVLGTRFAMLSDLLQDARAVTRSLDWQAELLGQGELLSSTLGAAYLGASGVDIGWMDARDWLTALPPQPNQSEWSQRLSVSCQWKSDVEWRTRFDAQRAQVLITPGFISRHQDGGTAILGRGGSDTSAAYFGALLGAACVEIWTDVPGMFSANPKEVPDARLLTRLDYYEAQEIATTGAKVLHPRSIKPCRDTDVPMLILDTERPDVLGTRIDAEVEPVLGVKAISRRDGIVLVSMEGIGMWQQVGFLADVFTLFKKHGLSVDLIGSAETNVTVSLDPSENLVNTDVLTALSTDLSQICKVKIIVPCAAITLVGRGMRSLLHKLSEVWATFGKERVHMISQSSNDLNLTFVIDETDADGLLAVLHFKLIESGAMPVQDRAVFGSPWREIIGHVRTRVMPWWHSARMRLLAMRDEEGIGPCYVYHLPTVRERARQLNSVAAVDQRYYAIKANPHPAILRTLIEEGFGLECVSLGELRHVFAVVPHLVPSRVLFTPSFASRVEYEQAFLLGVNVTLDNVEALRLWPEVFRDRTLWLRIDLGYGDGHHEKVTTGGKTSKFGLSVKRIDEFIDVAKTLNITVTGLHAHLGSGVERGNHWSRMYDELAGFASRIGSVSTLDIGGGLPIPYRPDDEPFDVGAWGASLAEVKALHPKFQLVIEPGRFLVAEAGVLLTRVTQVIEKDDILRVGLEAGMHTLIRPALYDAWHGVENLSRLDETPHVLCDVVGPICESSDVFGRRRRLPAATASGDLMLIADAGAYGFSMASTYNLRGLPAEVVLDA

SEQ ID NO: 90963 - protein, 333 aa, Streptomyces arenae
MTVRIGINGFGRIGRNVFRAAAARSSELEIVAVNDLGDVPTMAHLLAYDSILGRFPEEVTAEPGAIRVGDRTIKVLAERDPGALPWGDLGVDIVIESTGIFTDAAKARSHVDGGAKKVIIAAPASGEDFTVVLGVNDGDYDPERHTIISNASCTTNCLGVLAKVLHDAVGIDSGMMTTVHAYTQDQNLQDAPHKDLRRARAAALNIVPTSSGAAKAIGLVLPELAGRLDAFALRVPVPTGSVTDLTVTTRRGTSVEEVKEAYAAAASGPYKGLLSYVDAPLVSTDIVGDPASLFDAGLTRVCGPQVKVVGWYDNEWGYSNRLIDLATLIGSSL

SEQ ID NO: 90964 - protein, 776 aa, Arabidopsis thaliana
MMMSDLSLDLVEEILSRVPATSLKRLRSTCKLWNALFKNPGFTKKQFLKAPKESLVLMLKEYSVCPMIANLSVSAPSIEFKGALNLKNYPPYSEEVDIHEACHCDGLLLCTTMDYRIVVWNPCLGETRWIRWPKNIYSRFALGYEKNKYGRIYKILRCWDRHNSPTGRVDEFEIYEFSSDSWRVLDLVALDCHIASHIGVSFKGNTYWLASDKKDKYGLLLCFDFTTERFTRLCLPPSQDVSKMALSVVGGKQLSLLSQSDSTSKIMEMWVTNIIEDVLMWSKSFTVDIPIRGDYCPYLTSYLVDEEKKVAAQVKERMSGKILCCWNTPNTIGAITSPMSFRLVVMHVGDETESFFSLGDQITNREPFMMSDLPLDLVEKILSRVPATSLKRLRSTCRRWNALLKDRRFTEKHFHKAPKESRVLMLKEYRVFPISVNLKVTPPSVDFKGALGYSHSNSEQVVITEVFHCDGLLLCTTNDDRLVVWNPCLGETKWIQLKVDYRRYVSIFALGYIQNNESCRSYKILWTWYSYDYNSSPPQRGLGFEIYEFSSDSSWRVLDDVNHDSVVNHNSIIRSGVSLKGNTYMLAYDIEENSKFLLMFDFTTERLKRLCLPHFQDVGEMDLSVREEQLSVLNWSRITSKMEIWITNNFDTEATLLWKRVHLDSQCNCVRIFSSLYFDEEKKVVLYCNVKDGETSKKVVYIIGEDDGHYIEIPFVKSIKIERLQLIHTTRCAEGKERNLKDFVLADYSKTPSEPLLKFSQANLPQHQNSSNCCLR

SEQ ID NO: 90965 - protein, 335 aa, Xanthobacter flavus
MSVKVAINGFGRIGRNVLRAIIESGRTDIEVVAINDLGPVETNAHLFRFDSVHGRFPGEVKVAGDTIDVGRGPIKVTAVRNPAELPHKELGVDIALECTGIFTSRDKAAAHLAAGAKRVLVSAPADGADLTVVYGVNHEKLTNEHLVVSNASCTTNCLAPVAKVLNDAVGIEKGFMTTIHAYTGDQPTLDTMHKDLYRARAAAMSMIPTSTGAAKAVGLVLPELAGKLDGTSIRVPTPNVSVIDLKFVAKRATSKEEINEAIIAAASQQLKGILGFTDQPNVSIDFNHNPNSSTFHLDQTKVMEGTLVRVLSWYDNEWGFSNRMSDTAVAMGKLG

SEQ ID NO: 90966 - protein, 133 aa, Oryza sativa
GFWGNKIGKPPPVPCKVTGKCGSVTVRMVPAPRGSGIVAARVPKKVLQFAGIDDVFTSSRGSPKTLGTFVKATFDCLMKTYGFLPPEFWKEARFSKSPFQEYPDLLAKPSGKSLFLEEERVDASFASFALWMF

SEQ ID NO: 90967 - protein, 568 aa, Clarkia arcuata
MASPALISETEAWKDLKAHLEGIKRTHLRELMGDTERCQSMMVEFDNIFLDYSRQQASSDTINKLYKLADAAHLKQKIDRMYNGDHINSTENRSVLHVALRAPRNSAICSDGKNVVPDVWNVLDKIKDFSDRVRNGSWIGATGKKLKDVIAVGIGGSFLGPLFVHTALQTDPEASKNARGRELRFLANVDPIDVARNISGLNPESTLVVVVSKTFTTAETMLNARTLREWISSALGPSAVAKHMVAVSTNLPLVEKFGIDPINAFAFWDWVGGRYSVCSAVGVLPLSLQYGFAVVEKFLQGAHSIDQHFSSASFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSISILLPTLDGYRIGQLLAIYEHRVAVQGFVWGINSFDQWGVELGKSLATQVRKQLHASRVKGEPVEGFNFSTKTLLERYLEATSDVPADPSTLLPNI

SEQ ID NO: 90968 - protein, 319 aa, Salmonella typhimurium LT2
MKAMNKVWVIGDASVDLVPEKQNSYLKCPGGASANVGVCVARLGGECGFIGCLGDDDAGRFLRQVFQDNGVDVTFLRLDADLTSAVLIVNLTADGERSFTYLVHPGADTYVSPQDLPPFRQYEWFYFSSIGLTDRPAREACLEGARRMREAGGYVLFDVNLRSKMWGNTDEIPELIARSAALASICKVSADELCQLSGASHWQDARYYLRDLGCDTTIISLGADGALLITAEGEFHFPAPRVDVVDTTGAGDAFVGGLLFTLSRANCWDHALLAEAISNANACGAMAVTAKGAMTALPFPDQLNTFLSSHSLAQAMTVK

SEQ ID NO: 90969 - protein, 569 aa, Clarkia concinna
MASPALISETEAWKDLKSHLEGIKKTHLRELMGDTERCQSMMVEFDNIFLDYSRQQASPDTISKLYKLADEAHLKQKIDRMYNGDHINSTENRSVLHVALRASRNSAISSDGKNVVPDVWNVLDKIKDFSDRARNGSWVGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLAIYEHRVAVQGFVWGINSFDQWGVELGKSLATQVRKQLHASRVKGEPVEEGFNFSTKTLLTRYLEATSDVPADPSTLLPNI

SEQ ID NO: 90970 - protein, 127 aa, Phaseolus vulgaris
MQMAPQANILFFTVVSSTYVPCNPPPKTPKHPPVPKPPSTKSGSCPENTLKFGVCADVLGLIGVELGKPPKTPCCNLIQGLADLEAAVCLCTALRANVLGINLNVPIKLNLLLNYCGKKTPKDFVCY

SEQ ID NO: 90971 - protein, 568 aa, Clarkia franciscana
MASPALISETEAWKDLKAHLEGIKTTHLRELMGDTERCQSMMVEFDNIFLDYSRQQASPDTINKLYKLADAAHLKQKIDRMYNGDHINITENRSVLHVALRAPRNSAICSDGKNVVPDVWNVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPINTFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLAIYEHRVAVQGFVWGINSFDQWGVELGKSLATQVRKQLHASRVKGEPVEGFNFSTKTLLTRYLEATSDVPADPSTLLPNI

SEQ ID NO: 90972 - protein, 568 aa, Clarkia mildrediae
MASPALISETEAWKDLKAHLEGIKRTHLRELMGDTERCQSMMVEFDNIFLDYSRQQAIPDTIKKLYKLADAAHLKQKIDRMYNGDHINSTENRSVLHVALRAPRDSAICSDGKNVVPDVWNVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPTAVAKHMVAVSTNIPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKNENVAEHLIPHKTFTGNRPSLSILLPTLDAYRIGQLLAIYEHRVAVQGFVWGINSFDQWGVELGKSLATQVRKQLHGSRVKGEPVEGFNFSTKTLLTKYLEATSDVPADPSTLLPNI

SEQ ID NO: 90973 - protein, 77 aa, Sideroxylon saxorum
TIQCLSGTGSLRVGAEFLARHYHERTIYIPQPTWGNHPKIFTLGGLSVKTYRYYDPPTCGLNFEGLVEDLGSASSGA

SEQ ID NO: 90974 - protein, 428 aa, Pseudomonas aeruginosa UCBPP-PA14
MGTHVIKMPDIGEGIAEVELVEWHVQVGDSVNEDQVLAEVMTDKATVEIPSPVAGRILALGGQPGQVMAVGGELIRLEVEGAGNLAESPAAATPAAPVAAAPEEPKETPVAAPKAAAEAPRALRDSEAPRQRRQPGERPLASPAVRQRARDLGIELQFVQGSGPAGRVLHEDLDAYLTQDGSVTRSGGAAQGYAERHDEQAVPVIGLRRKIAQKMQDAKRRIPHFSYVEEVDVTDLEALRAHLNQKWGGQRGKLTLLPFLVRAMVVALRDFPQLNARYDDEAEVVTRYGAVHVGIATQSDNGLMVPVLRHAESRDLWGNASEVARLAEAARSGKAQRQELSGSTITLSSLGALGGIVSTPVINHPEVAIVGVNRIVERPMVVGGNIVVRKMMNLSSSFDHRVVDGMDAAAFIQAVRGLLEHPATLFLE

SEQ ID NO: 90975 - protein, 77 aa, Sideroxylon saxorum
TIQCLSGTGSLRVGAEFLARHYHERTIYIPQPTWGNHPKIFTLGGLSVKTYPYYDPPTCGLNFEGLVEDLGSASSGA

SEQ ID NO: 90976 - protein, 472 aa, Aspergillus oryzae
MAPSRVDDDIQSRPNTQILPNVKPNGEGHLLHRSLIEHPVMVEKAKGLTLHLSDGRTVLDACAGAAVALIGHGREEVHQAIMKQMQNVSYIHTQSYTTSSAEDLADFLLSGNPYGLEKAFFVGSGSEAVESALKLARQYHYENNEPDRLHFVSRQQSYHGNSIAAMSISSNLARKVPFTGFMYPHTSHVTPAYAYRHQMAGETEAEFTARLLRELEEEFLRIGPEKIIAFVAEPIVGATAGCVTAPAGYFTGVRAMCDRYGILLILDEIMCGVGRSGTFFAFEQENVVPDIMTIAKGLGGGYAPIAGVLVHKKVIDVLRKGSNAFNHGHTYQAHPVSCAAALAVQQIVRREKLVERCAALGQILEQQLRTELAHCPSVGDIRGRGLFWAVEFVQDSTTKETFDPTFKFGLRVQQAAFDRGLAVYPGAGTVDGMRGDHILLAPPFTVTEAELRQICEVLREAIKSQEKEYMTC

SEQ ID NO: 90977 - protein, 1078 aa, Ustilago maydis 521
MQEPLTWTARKVLAFMLPVNTSARPRSTLDEIKPSQPTDSRTWRNRDDARRTLRGHDTHIEFEARYLPLLHRPSSDAEAQQLYNHIRTVAWYLDSIPLLSSRLPFNIGVESIVGVIPGVGDYIGLVLGLYQVMLCSLYGLPLSVLLWMLFNVLVDCAIGIVPIIGDALDVLFKANLRNLRLLEDYLHRSGGKCGSGIFYVEFAPSDTFLPLHQASRRRPSSTQQPPAAFVESSRIPQRPRPTDNARAHFLSLPSSVAELQSSPVAGSSRRDAPNSYKAQAIQPETDENTRHETSAIQTDRPIEVEPFAIPDELSSSDLAVPQSKASGRDADSKSLRALDRQLSADDMTQQHHCFAAASSASSEARPFETDTEVSATGTERAARLEEERPRVSWQDSTRTSTSLLTKPASKRPPYYNGDAEEDFDDDFENQRLLKGTSTERGREMEDPRALWRRRRGLYLLVYSAIFCVAYVSSLDSNTGYLYLNFACSEYGALASFSTVAIVQQMVFAIAKPPIAKLSDVVGRPQAYVLSLVFYVCGYIVVATTASLRSLIGGICLQSAGTTGIQVLQSIIIADTTTAKWRGLVIGIVNLPFLINFAVAGPMVDLVMRHGGWRFGFAIWTVVMPLAATPLLLTLLVGQRRARRAGLATRSTLTDKPWRQALWQLARELDLVGLLLFTGGWLLILLPLTLAGHGERQAQVPMATFVLGGAGLLVVFGWWETRASVPILPYQFLTNSAVVCTCVVGVLDFASFYISWTFLSSFVQILKGWDQTKTGYFATTQNVTSTITGIIVGSLMAMTRRYKALLVIGLVTRLLGVSLMVRYRTADDPTFMLVLCQLLQGIGGGSIAITMQVAVQVTVRHADVAIVTALELLTTEIGAAMGSATAGWMFQTYLPTKLQANLPHMDAEELKLVYGSLQKALSYPIGSAERNGIIRSWVEVMRMLSIVALITLVPALFFGLAIPDTALPDVHGAPGHSSHHHHHHGSRRGDRRNLRRRPSFLSASRPASPLEIRAGYPDTTLGEALDVAANEDNTNAGFLVATGSKRSRSASRNRGSERESRDVSSAGRKKRITRKAVLR

SEQ ID NO: 90978 - protein, 426 aa, Escherichia coli
MSFNLENYKIGIIGLGYVGLPLAVEFGKKIKTLGFDINEKRIKELSAGNDFTLECSSDELAQAYYLQYSCDYKELATCNVFIVTVPTPIDEYKQPDLTPLVKASETLGKIIKKDDIIIYESTVYPGATEEVCIPVIEKISGLVFNIDFFAGYSPERINPGDKEHRVTTIKKVTSGSTPEIAEIVDKLYGTIITAGTHKASSIRVAEAAKVIENTQRDLNIALINELAMIFNKLGIDTEEVLKAAGTKWNFLPFRPGLVGGHCIGVDPYYLTHKAQAIGYHPEVILAGRRINDGMSKYVASQFIKAMLKKKFQIEGANVLIMGLTFKENCPDLRNTKVVDILAELKEYNVNVDIYDPWVDVEEAYYEYGINVLNTLPDKKYDGVIFAVAHSQFKNMSKEEVHGIIRNDGVIYDLKYIIDPNLVDIRL

SEQ ID NO: 90979 - protein, 349 aa, Escherichia coli
MCQRGCLMKYKKIEDALSSKSETWLITGVAGFIGSNLLEALLKLNQKVVGLDNFATGHQANLDEVKESVSAEQWSAFTFVEGDICEPETCVEVVKGVDHVLHQAALGSVPRSIKDPITTNNTNISGFINMLVAAKDANVRSFTYAASSSTYGDHPALPKIEENIGNPLSPYAVTKYVNELYAQVFARTYGFKSIGLRYFNVFGKRQDPNGAYAAVIPKWTAAMINDEPLYINGDGETSRDFCFIENVVQMNILAAQSDASARDQVYNVAVGDRTTLKQLFTVLKNALNENGVSYNKEPEYKDFRAGDVRHSQADITKAKTRLGYEPQFSISEGILKAMPWYVNSLGNKK

SEQ ID NO: 90980 - protein, 417 aa, Trichoderma viride
MSLSNKLSITDVDVKGKRVLIRVDFNVPLDENKNITNPQRIAGAIPTIKHALDNGAKAVILMSHLGRPNGAVNAKYSLKPVVPKLEELLGKPVTFAPDCVGPEVEAIVNKADNGAVILLENLRFHIEEEGSSKDKEGNKTKADKAKVEEFRKGLTALGDVYVNDAFGTAHRAHSSMVGVDLPQKAAGFLMKKELDYFAKALESPQRPFLAILGGAKVSDKIQLIDNLLDKVNTLIICGGMAFTFKKVLDNLAIGDSLFDKAGAETVPKLVEKAKAKNVKIVLPTDFITADKFDKDANTGLATDKDGIPDGWMGLDCGDESIKLYKEAIDEAKTILWNGPAGVFEFEKFAGGTKATLDAVVEGCKNGKIVIIGGGDTATVAAKYGVEDKLSHVSTGGGASLELLEGKELPGVTALSSK

SEQ ID NO: 90981 - protein, 77 aa, Sideroxylon betsimisarakum
TIQCLSGTGSLRVGAEFLARHYHERTIYIPQPTWGNHPKIFTLGGLSVKTYRYYDPPTRGLNFEGLVEDLGSASSGA

SEQ ID NO: 90982 - protein, 334 aa, Oryza sativa Japonica Group
MEERYEALKELGAGNFGVARLVRDKRSKELVAVKYIERGKKIDENVQREIINHRSLRHPNIIRFKEVCLTPTHLAIVMEYAAGGELFEQICTAGRFSEDEARYFFQQLISGVSYCHSLEICHRDLKLENTLLDGSPTPRVKICDFGYSKSALLHSKPKSTVGTPAYIAPEVLSREEYDGKVADVWSCGVTLYVMLVGSYPFEDPGDPRNFRKTISRILGVQYSIPDYVRVSSDCRRLLSQIFVADPSKRITIPEIKKHTWFLKNLPKEISEREKADYKDTDAAPPTQAVEEIMRIIQEAKVPGDMAAADPALLAELAELKSDDEEEAADEYDTY

SEQ ID NO: 90983 - protein, 310 aa, Oryza sativa Indica Group
MPPSVATHASLLLKAAAAAAHLHPKPFFSPRAAPPRIPSAPAPPAAGGSRYRPTTTTTAAATATSATAACRWFRWPPPAQAPVRGLCSLPHSGGGGGGGEGMGSEGVGRRRRVVAPAVNGVAKDGAPQPPPPKLLTLPTVLTIGRVAAVPLLISTFYMEGPWAATATTGIFLAAAVTDWLDGYIARKMQLGTPFGAFLDPVADKLMVAATLVLLCTKPLEISLLRDGPWLLTVPAIAIIGREAVAVNNLGKWKTATQMTALTILLASRDKSLPAQDALVTSGVALLYVSAGLAIWSLVVYMRKIWRILLK

SEQ ID NO: 90984 - protein, 372 aa, Scutellaria baicalensis
MVSEFQEHESLLQNPIFDALYCDEERFDECVGGAGSGFKEPEINDFNEIHNNPFAFLFEHDLFWESEELDALLTKEKTQTHLTFDEINSDASLKAMRNEAINWMLKVIAHYGFNALTAVLAVNYYDRFITSVCFQKDKPWMSQLAAVACLSVAAKVEETQVPLLLDLQVEESKYLFEAKTIQRMELLVLSTLQWRMNPVTPISFFDHIARRFEFVKNLHSVFLRRCESLILSIITDCRLVKYFPSVIASAAMIYAIREFETPDALEYEDQLLSVLRTSKDKVDDCRKLIVDAMYGGFSHKPCYKRKYESIPSSPSGVIDAYLSSDSSVDSWAVTLSVSSSPEPSFKRSKAQDQHMRLAPLSSVSLGLAHRIN

SEQ ID NO: 90985 - protein, 168 aa, Brassica rapa
FRCVQQGDDENGKTGVSLSKDITDVAGRTVKKHIATLGPLILPLSEKLLFFVTFMGKKLFKDKIKHYYVPDFKLAIDHFCIHAGGRAVIDVLEKNLALAPIDVEASRSTLHRFGNTSSSSIWYELAYIEAKGRMKKGNKVWQIALGSGFKCNSAVWVALNNVKASTNS

SEQ ID NO: 90986 - protein, 218 aa, Listeria innocua Clip11262
MGKIAPSILSADFANLARDIKEVENYGADYIHVDVMDGHFVPNITFGPAVVKAIRPETKLPLDVHLMIENPDTYIPEFAKAGADYITVHVEACTHLHRTLQLIRSYGVKAGAVLNPATPIDVLQHVLNELDMVLFMTVNPGFGGQKFIPEVLEKISAFKKIVDEKGLDIEIEVDGGVDHETAKLCRDAGANVFVAGSYIYGNKNRQTPIDKLRAIVGE

SEQ ID NO: 90987 - protein, 168 aa, Brassica oleracea
FRCVQQGDDENGKTGVSLSKDITDVAGRTVKKHIATLGPLILPLSEKLLFSVTFMGKKLFKDKIKHYYVPDFKLAIDHFCIHAGGKAVIDVLEKNLGLAPIDVEASRSTLHRFGNTSSSSIWYELAYIEAKGRMKKGNKVWQIALGSGFKCNSAVWVALNNVKASTNS

SEQ ID NO: 90988 - protein, 802 aa, Oryza sativa Indica Group
MGSACEAGTDEPSRDDVKGTGNGILENGHSHKSEEEEWRNGMGEDLPNGHSTPPEPQQTDEQKEHQVRIVRWERFLPVKTLRVLLVENDDSTRQVVSALLRKCCYEDSRGFCASRFPSAVIPAENGLHAWQCLEDLQNHIDLVLTEVVMPRLSGIGLLSKITSHKICKDIPVIMMSSNDSMGTVFKCLSKGAVDFLVKPIRKNELKNLWQHVWRRCHSSSGSGSESGIRTQKCTKPKVDDEYENNSGSNNDNEDDDDNDEDDDDLSVGHNARDGSDNGSGTQFSLNVGQLCQCILMPSACFKTQSSWTKRAVEIDSPQQMSPDQPSDLPDSTCAQVIHPTSEICSNRWLPTANKRSGKKHKENNDDSMGKYLEIGAPRNSSMEYQSSPREMSVNPTEKQHETLMPQSKTTRETDSRNTQNEPTTQTVDLISSIARSTDDKQVVRINNAPDCSSKVPDGNDKNRDSLIDMTSEELGLKRLKTTGSATEIHDERNILKRSDLSAFTRYHTTVASNQGGAGFGGSCSPQDNSSEALKTDSNCKVKSNSDAAEIKQGSNGSSNNNDMGSSTKNAITKPSSNRGKVISPSAVKATQHTSAFHPVQRQTSPANVVGKDKVDEGIANGVNVGHPVDVQNSFMQHHHHVHYYVHVMTQQQQQPSIERGSSDAQCGSSNVFDPPIEGHAANYSVNGSFSGGHNGNNGQRGPSTAPNVGRPNMETVNGIVDENGAGGGNGSGSGSGNDLYQNGVCYREAALNKFRQKRKVRNFGKKVRYQSRKRLAEQRPRIRGQFVRQSGQEDQAGQDEDR

SEQ ID NO: 90989 - protein, 159 aa, Desulfotomaculum thermocisternum
MHITLLCVGKLKEDFLLLAQKEYLKRLSPYARIELVEVREESLPASGRAGALEAVLKKEGTRLLERIPDNCVTIALDRKGMMLSSKEFAGYLAELGLRGQNKLCFIIGGSAGLAGDVLARASLRLSFSKFTFPHQLMRIILLEQIYRAFKIIRGEKYHL

SEQ ID NO: 90990 - protein, 494 aa, Botryotinia fuckeliana
ISQRTTGVVVAAGVAAFIVLSVVLNVLNQVLFANPNEPPMVFHWLPVIGSTITYGMDPYKFFFDCRAKYGDIFTFVLLGKKTTVYLGRKGNDFILNGKLKDLNAEEIYTVLTTPVFGKDVVYDCPNAKLMEQKKFMKIGLSTEAFRSYVPIIQMEVENFMKRSSAFKGPKGTADIGPAMAEITIYTASHTLQGKEVRDRFDTSFASLYHDLDMGFSPINFMLHWAPLPHNRARDHAQRTVAKTYMDIIQNRRAQATEAEFKSDIMWQLMRSSYKDGTPVPDKEIANMMIALLMAGQHSSSSSISWIMLRLASRPDIMEELYQEQIQVLGADLPALKYEDLSKLPLHQNVLKETLRLHTPIHSIMRKVTTPMPISGTKYVIPTSHTLMASPGCTSRDDEFFPEALEWDPHRWDLGSGRVVGNDQDEEFQDYGYGMISKGASSPYLPFGAGRHRCIGEQFATVQLVTIMATVVRLFKFKNIDGSKDVIGTDYASLF

SEQ ID NO: 90991 - protein, 262 aa, Zea mays
  misc_feature (198)..(198): Xaa can be any naturally occurring amino acid
TRRSAPRPPTRCSSSRATCGGQKAVAKKNRDLADRLLNRPPTYKLDRLVLERYPTFVDALRDLDDCLTMVHLFAALPAVDGERVEVKRIHNCRRLSHEWQAYISRTHSLRKTFISVKGIYYQAEVQGQKITWLTPHALQQVLTDDVDFNVMLSFLEFYETLLGFVNFKLYHLINVNYPPILDPRLEALAAELYALCRXYMSAGSRRMIGNSQTDEVMEDKDEKSKAEEVIEEEKVVKNKASSKADESHANGLLYHFDGGLSL

SEQ ID NO: 90992 - protein, 502 aa, Botryotinia fuckeliana
PLAQEISQRSTGVVVAAGVAAFIVLSVVLNVLNQVLFANPNEPPMVFHWLPVIGSTITYGMDPYKFFFDCRAKYGDIFTFVLLGKKTTVYLGRKGNDFILNGKLKDLNAEEIYTVLTTPVFGKDVVYDCPNAKLMEQKKFMKIGLSTEAFRSYVPIIQMEVENFMKRSSAFKGPKGTADIGPAMAEITIYTASHTLQGKEVRDRFDTSFASLYHDLDMGFSPINFMLHWAPLPHNRARDHAQRTVAKTYMDIIQNRRAQATEAEFKSDIMWQLMRSSYKDGTPVPDKEIANMMIALLMAGQHSSSSSISWIMLRLASRPDIMEELYQEQIQVLGADLPALKYEDLSKLPLHQNVLKETLRLHTPIHSIMRKVTTPMPISGTKYVIPTSHTLMASPGCTSRDDEFFPEALEWDPHRWDLGSGRVVGNDQDEEFQDYGYGMISKGASSPYLPFGAGRHRCIGEQFATVQLVTIMATVVRLFKFKNIDGSKDVIGTDYASLFTRP

SEQ ID NO: 90993 - protein, 388 aa, Xanthomonas axonopodis pv. citri str. 306
MNIPVPVVRLKNAWRSSHPWIFQKLVEKPAAKPKPGSIVDVVGMDGEWIGRGFYNGHSRIAVRILETDRSVPVDAGWFSRKIAAAVSLRRDWLKLDGVSDAWRVVHSEGDGLSGLVVDRYGDLVVVEFFAAGMFRHREWIYEALREQFPGCRFHSFADEHVQKQESFDFHSNTTTEAAVITEHGIKFRADPAGAHKTGFFADQRDNRQWLSEQVEGKSVLDLCCNTGGFAVYAAARGAAEVLGVDIDEDVIAIAKGNAKLNNVRPKFVQADIFPWLRDAANRGEQFDVVILDPAKMTRDREQVIPALKKYLDMNKLALGVVKPGGLFATFSCTGLVAEQEFLDMLRRASYFSGRTIQILKVAGAGPDHPFMAHVQESRYLKAVFCRVV

SEQ ID NO: 90994 - protein, 297 aa, Triticum aestivum
  misc_feature (33)..(33): Xaa can be any naturally occurring amino acid
MVKKGIQYVVVDAFTAQPFKGNPAAVCFLEDDXAPPAGDGRWMQSVAVEFNLSQTAFFSRDSSCAADATTPRFHLRWFTPVTEVALCGHATLATAHFLFTSVLAERHGVVEFATKSGVLTAKKVPAPEAEEQGKLFIELDFPMSDYVGCDPADELPSIPETLNGAPVVSVHKSVATNDFIVELSSGKEVADVLPNIEEIRKCAGRGVIVTAPAPAGSGYDFFTRFFCPKFGIDEDPVCGSAHCVLAPYWGGKLGKQKLIAFQVSPRSGALYLELDVANQRVRIQGEAVTVMAGTLFA

SEQ ID NO: 90995 - protein, 194 aa, Triticum aestivum
LKDKRVLIRVDFNVPMKDGAITNNNRIVQALPTVKYALDNGASAVILMSHLGRPNGEAVAKYSLKPVAAEVEKLLGKPVEFLNDCVGTDVEKTCQSAKDGKVILLENLRFHIEEEGSAKVDGQKVKADAEAVKKFRASLTTLADIYINDAFGTAHRAHSSMVGVNLSQRAARFLMQKELEYFAKALENPSRPFL

SEQ ID NO: 90996 - protein, 570 aa, Clarkia rostrata
MASPALISETEAWKDLKAHLEGIKMTHLRELMGDTERCQSMMVEFDNIFLDYSRQQASPDTISKLYKLADEAHLKQKIDRMYNGDHINTTENRSVLHVALRAPRNSAICSDGKNVVPDVWSVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSVDGLPLPFESGEIDFGEPGTNGQHSFYQLIHQGRVIPCDFIGVVKSQQPVYLKGEVVNNHDELMSNFFAQPDALAYGKTPEELKKENVSEHLIPHKTFTGNRPSISILLPTLDAYRIGQVLAIYEHRVAVQGFVWGINSFDQWGVELGKSLATQVRKQLHGSRVKGEPVEEGFNFSTKTLLTRYLQATSDVPADPSTLLPNII

SEQ ID NO: 90997 - protein, 568 aa, Clarkia williamsonii
MASPALISETEAWKDLKAHLEGIKMTHLRELMGDTERCQSMMLEFDNIFLDYSRQQASPDTISKLYRLADAAHLKQKIDHMYNGDHINSTENRSVLHVALRAPRNLAICSDGKNVVPDVWNVLDKIKDFSDRVRNGSWIGATGKELKDVIAVGIGGSFLGPLFVHTALQTDPEASKNARGRELRFLANVDPIDVARNISGLSPETTLVVVVSKTFTTAETMLNARTLREWISSALGPSAVAKHMVAVSTNIPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSISLLLPTLDAYRIGQLLAIYEHRVAVQGFVWGINSFDQWGVELGKSLATQVRKQLHGSRVKGEPVEGFNFSTKTLLTRYLEATSDVPADPSTLLPNI

SEQ ID NO: 90998 - protein, 384 aa, Synechococcus sp. RS9917
MTVADSGAQARATARLVLADGTVFEGLACGARGSVVGEVVFNTGMTGYQEVLTDPSYAGQLVTFTYPELGNTGVNPEDQEAEKPHALGLIARQLAPRPSNWRCHQPLPDWLDAHGVVGIHGIDTRALVRHLRETGAMNGVISSDGQSPQALLDTVRSAPSMQGLNLADQVSTEQPYTWTSACSAAFDQRLQPSPSQRYRVVAIDFGIKRAILDRLVGHGCEVTVMPADVDLATVLAQQPEGVFLSNGPGDPAAVTNGIALARGLLAEKTLPLFGICLGHQILGLALGGSSFKLTYGHRGLNHPCGTTGQVEITSQNHGFALDAASLDPEAIAITHLNLNDRTVAAMAHRHQPVFGVQYHPEASPGPHDADHHFARFVALMAEQR

SEQ ID NO: 90999 - protein, 568 aa, Clarkia xantiana
MASPALISETEAWKDLKAHLEGIKMIHLRELMGDTERCQSMMVEFDNIFLDYSRQQASPDTISKLYKLADAAHLKQKIDRMYNGDHINSTENRSVLHVALRAPRNSAICSDGKNVVPDVWNVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGIVKSQQPVYLKGEVVNNHDELMSNFFAQPDALAYGKTPEQLKNENVSEHLIPHKTFTGNRPSISILLPTLDAYRIGQLLAIYEHRVAVQGFVWGINSFDQWGVELGKSLATQVRKQLHASRVKGEPVEGFNFSTKTLLTRYLEATSDVPADPSTLLPNI

SEQ ID NO: 91000 - protein, 569 aa, Clarkia concinna
MATPSLISETEAWKDLKAHLEGIKRTHLRELMGDTERCQSMMVEFDNIFLDYSRQQASPDTINKLFKLADAAHLKRKIDRMYNGDHINSTENRSVLHVALRAPRNSAICSDGKNVVPDVWSVLDKIKDFSERVRNGSWVGATGKELKDVIAVGIGGSFLGPLFVHTALQTDPEASKNAIGRELRFLANVDPIDAAKNISGLNPETTLVVVVSKTFTTAETMLNARTLREWISSALGASAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSVDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFNGNRPSLSILLPTLDAYRIGQLLAVYEHRVAVQGFVWGINSFDQWGVELGKSLATQVRKQLHASRVKGEAVEEGFNFSTKTLLTRYLEASSDVPADPSTLLPKI

SEQ ID NO: 91001 - protein, 312 aa, Populus trichocarpa
MWACRLTQRTDFSFEGYRWQPENCKMLEFEKSAFLRRMQDRTIAFIGDSLGRQQFQSLMCMASGGERREDIENVGKEYGLVKARGAIRPDGWAYRFSNTNTTILYYWSASLADLEPLNITDKATDVAMHLDRAPAFMRRFLHRFDVLVLNTGHHWNRGKITANRWVMYVNGKPLKDRKLLEIGNAKNFTVHSVARWVDSQLPSHPRLKAFFRTISPRHFRNGDWNTGGNCDNTTPLTGGSEISQDESSDPVIAAAVKGTNITLLDITALSELRDEGHISRYSVKATTGVNDCLHWCLPGIPDTWNELLIAQV

SEQ ID NO: 91002 - protein, 569 aa, Clarkia xantiana
MATPSLISETEAWKDLKAHLEGIKRTHLRELMGDTERCQSMMVEFDNIFLDYSRQQASPDTINKLYKLAEAAHLKQKIDRMYNGDHINSTENRSVLHVALRAPRNSAICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLAIYEHRVAVQGFVWGINSFDQWGVELGKSLATQVRKQLHASRVKGEPVEEGFNFSTKTLLTRYLEATSDVPADPSTLLPKI

SEQ ID NO: 91003 - protein, 554 aa, Triticum aestivum
  misc_feature (504)..(504): Xaa can be any naturally occurring amino acid
MAPPAAAPPPAMSALPTFASSHPYPSLTTPKTAALKPRLNLAYAGAAAAPNAVPHRSAAASNDRLRGLVRRGDLEEALRLVESMAGIEPSAAAAGPCAALIKKLCASGRTAEARRVLAACEPDVMAYNAMVAGYCVTGQLDNARRLVAAMPMEPDAYTYNTLIRGLCGRGRTDNALAVLDDMLRRGCVPDVVTYTILLEATCKRSGYKQAMKLLDEMRDKGCAPDIITYNVVVNGICQEGRVDDAMEFLKSLLSYGCEPNTVSYNIVLKGLCTAERWEDAEKLMAEMSRKGCPPNVVTFNMLISFLCRRGLVEPAMEILEQIPKYGCTPNSLSYNPILHAFCKQKKMDRAMAFVELMVSSGCYPDIVSYNTLLTALCRGGEVDAAVELLHQLKDKGCTPVLISYNTVIDGLTKAGKTEEALELLNEMVTKGLQPDIITYSTISSGLCREDRIEEAIKAFCKVQDMGIRPNTVLYNAILLGLCKRRETHSAIDLFTYMISNGCMXPNESTYTILIEGLAYEGLVKEAREMLAELCSRGVVSKTLVNKGAIRLLDA

SEQ ID NO: 91004 - protein, 565 aa, Burkholderia xenovorans LB400
MRDFLTSITARAGVLKGILPLNRAAAARDALAGVQLASMDIPQVLGYARIAGMPAVTGLYTVFLPLIAFAFFGASRHLVVAADSATATIFASRLSTMAPASSAEYAALAATVALLTGVLLFIARIFKLGFLADFLSRTVLVGFLAGVGVQVGISMLGDMSGVPGRASRSIDQLMLVVRETAQIHWPTLAISLLVVGTTLAFKRIRPRLPVPLIAVVAGIAASDLYHFSAHGIAVLGPVAGGLPPLRMPQVTWQQVLDLLPVAASCFVMIVAQSAAASRVFAERYHESVDTNADLLGIAVANAAAAFSGAFVVNGSPTQTAMGDIAGTRSQFAQLVFAAVAVAVLLFFSRFLQYLPHCILASIVFTIAIGLINLRTLFAIRRESPGEFALAVFTAAAVVLIGVEHGILVAVALSLLRHVRHSYRPHTMILVPGDNGVWVPEPAVPGMQTRPGLIVYRFGADLFYANDHFFVDDARRLIDQAPSKVRCFVIDASAITDIDYSAARSVGELCATLKHAGIEVFFARVNQYLRSDMDRHGITPIIDASCIFNTLHEALRAAGVVSPTGT

SEQ ID NO: 91005 - protein, 337 aa, Yersinia pseudotuberculosis IP 32953
MKTLGEFIVEKQLDFSHATGELTALLSAIKLGAKIIHRDINKAGLVDILGASGVSNIQGEDQMKLDLFANEKLKAALKARGEVAGIASEEEDDIVIFDGGRAENAKYVVLMDPLDGSSNIDVNVSVGTIFSIYRRITPFGTPITEEDFLQPGTKQVAAGYVVYGSSTMLVYTTGYGVHAFTYDPSLGVFCLSHEKVRYPATGCMYSINEGNYIKFPLGVKKYIKYCQEQDEATKRPYTSRYIGSLVADFHRNLLKGGIYIYPSTASHPQGKLRLLYECNPMAFLAEQAGGKATDGVNRILDIVPEKLHQRAPFFVGTKSMVEDAEGFIAKFPDEEAK

SEQ ID NO: 91006 - protein, 500 aa, Streptococcus agalactiae 2603V/R
MNKRVKIVATLGPAVEFRGGKKFGESGYWGESLDVEASAEKIAQLIKEGANVFRFNFSHGDHAEQGARMATVRKAEEIAGQKVGFLLDTKGPEIRTELFEDGADFHSYTTGTKLRVATKQGIKSTPEVIALNVAGGLDIFDDVEVGKQILVDDGKLGLTVFAKDKDTREFEVVVENDGLIGKQKGVNIPYTKIPFPALAERDNADIRFGLEQGLNFIAISFVRTAKDVNEVRAICEETGNGHVKLFAKIENQQGIDNIDEIIEAADGIMIARGDMGIEVPFEMVPVYQKMIITKVNAAGKAVITATNMLETMTDKPRATRSEVSDVFNAVIDGTDATMLSGESANGKYPVESVRTMATIDKNAQTLLNEYGRLDSSAFPRNNKTDVIASAVKDATHSMDIKLVVTITETGNTARAISKFRPDADILAVTFDEKVQRSLMINWGVIPVLADKPASTDDMFEVAERVALEAGFVESGDNIVIVAGVPVGTGGTNTMRVRTVK

SEQ ID NO: 91007 - protein, 562 aa, Zea mays
  misc_feature (131)..(131): Xaa can be any naturally occurring amino acid
MATPDDRGSWLLYLSLAAKCAGDQPYRLTGFLAVCAVAFVVTCLLHWCFPGGPAWGRWWWTRRLGAGAGGGATAAAAALPGPRGLPVVGSMWLMTGLAHRKLAAAAGSLGARRLMAFSLGGTRVVVASHPXDVAREILSSPAFADRPIKESAYGLLFHRAIGFAPYGAYWRALRRVASTHLFSPRQVAASAAQRAVIARQMVGAVKELSAASPGRRGGVEVRRVLRRGSLHSVMWSVFGRRYDLELDPARESPETRELRRLVDEGYDLLGQLNWSDHLPGLACLDLQSTRARCDRLVPLVTRFVGGIVDEHRARNHLRAAPPGVVDFTDVLLSLPADDRLTDADMIAVLWEMVFRGTDTVAVLMEWVLARLVLHPDVQARVHDELDRVVGPDRAVTESDTASLVYLHAVIKEVLRMHPPGPLLSWARLATSDVHVDGHLIPAGTTAMVNMWAITHDPDVWAEPTEFQPERFMGSTEFPIMGSDLRLAPFGAGRRSCPGKSLAMATVAFWLATLLHEFELLPSPVDLSEVLKLSCEMAVPLALAVTARPRQAVQKSVGVSVSL

SEQ ID NO: 91008 - protein, 254 aa, Salmonella typhimurium LT2
MNSQFAGLTREACVALLASYPLSVGILAGQWIALHRYLQQLEALNQPLLHLDLMDGQFCPQFTVGPWAVGQLPQTFIKDVHLMVADQWTAAQACVKAGAHCITLQAEGDIHLHHTLSWLGQQTVPVIGGEMPVIRGISLCPATPLDVIIPILSDVEVIQLLAVNPGYGSKMRSSDLHERVAQLLCLLGDKREGKIIVIDGSLTQDQLPSLIAQGIDRVVSGSALFRDDRLVENTRSWRAMFKVAGDTTFLPSTA

SEQ ID NO: 91009 - protein, 255 aa, Salmonella typhimurium LT2
MRHPLVMGNWKLNGSRHMVNELVANLRKELTGVAGCDVAIAPPEMYIDLAKRAAAGSHIMLGAQNVDLNLSGAFTGETSAEMLKDIGAQYIIIGHSERRTYHKESDELIAKKFAVLKEQGLTPVLCIGETEAENEAGKTEEVCARQIDAVLKTQGAAAFEGAVIAYEPVWAIGTGKSATPAQAQAVHKFIRDHIAKADAKIAEQVIIQYGGSVNASNAAELFAQPDIDGALVGGASLKADAFAVIVKAAEAAKQA

SEQ ID NO: 91010 - protein, 374 aa, Physcomitrella patens subsp. patens
MLTTASYSPPSWASKLHPLPSQFCTLGQFPTPIHRWNLPGLPKDTEVWIKRDDLTGMQLSGNKVRKLEFLIADAKAQGADCVITIGGIQSNHCRATAVAAKYFNLDCYLILRTSRTVVEQDPGLEGNLLVERMVGAHVSLVSKEEYVQLGSVGLGKLLTEKLKAEGRKPYVIPVGGSNSLGTWGYIEFVKELQGQLEGGKVSGIKHFDDIVMACGSGGTTAGLALAAHLSNLQTKIHAYAVCDTPEYFYEYVQGLIDGLDAGVKSEDIVKVVNAKGLGYAMSTTEELKLVKEVAELTGVILDPVYSGKALIGMLKDMAENPSEWEGKKVLFVHTGGLLGMYDKVQQLQPLTSKWERFKIAETVLQGGDGKGKMF

SEQ ID NO: 91011 - protein, 143 aa, Physcomitrella patens subsp. patens
MAAIIFNLFVINKSGGLIFYKDYGTQGRLDTNDSLRLASLWHSMHAISKELSPVNGCNGIEVLEADTFDLHCFQALTGTKIFVATEPGTPGIDSLLKTIYEIYTDYVLKNPFYEVEMPIRCELWDLNLALAVRKDGKAGLVGR

SEQ ID NO: 91012 - protein, 328 aa, Escherichia coli CFT073
MPLHNLTRFPRLEFIGAPTPLEYLPRFSDYLGREIFIKRDDVTPMAMGGNKLRKLEFLAADALREGADTLITAGAIQSNHVRQTAAVAAKLGLHCVALLENPIGTTAENYLTNGNRLLLDLFNTQIEMCDALTDPNAQLEVLATRVEAQGFRPYVIPVGGSNALGALGYVESALEIAQQCEGAVNISSVVVASGSAGTHAGLAVGLEHLMPESELIGVTVSRSVADQLPKVVNLQQAIAKELELTASAEILLWDDYFAPGYGVPNDEGMEAVKLLARLEGILLDPVYTGKAMAGLIDGISQKRFKDEGPILFIHTGGAPALFAYHPHV

SEQ ID NO: 91013 - protein, 173 aa, Escherichia coli
MIKIVNEDLHAFTKNGSFASKVKCTIISHTFHLVLMIRLGQFLSKIPVIGAFFRLVIEYSIRIIFSSDISLRARIGGGLVIMHGHDIVIGRDVVIGRNCKILNGVTLGNKDTESTENQQPVVGDNVIIGTGAKILGKVVIGNNVKIGANSVVISDIAPDSVAVGIPARVTKGI

SEQ ID NO: 91014 - protein, 1372 aa, Cercospora zeae-maydis
MPTSNGGRTSPASLRSHHVRYASDSNIALRSTIMEQPEGPPELETYDSSGTNSSGNDGDEYAGTQESHSDSDGISSRHFVPGSGQAYAQDEVTPLTNVSTYGWSQPGSSNVSRTTTRGSVGSALPGTPAYEGTGTAMTNGTRRPANTRKESSNIYAPNRGPGSSMRYALNTGTRPRNGFTHMRRRNPNDEYRAQEKAYVQRIRQDGPDNDFQTEPRTPSLDYSFGSEDDEESPTNANYADHDPAEVDTLLYYGQEDLEPSVEELNIPANRERLEWHAMLANVLTGDVVKQEKKRLIGGPEQQGENTLKTEVWIGVRAKTCGRSIAAQKRLVEDGRSKVKQTIESIVAFEIKGEAEVGQSPMQQVQDVVKKIEKIEGLYPPRQAFRAAHPPAASSAYEHTCDAVIAWNNTTELIGTELGILQSWVGNMELDFTTARVRPEGEQHNELFDDSSFIDRILKEDGLKSLQGDKNLLNGVNTVIHKAKATLIANAEAFSDRHLPPYIEELLTLINFPSRLIQEIIRMRLSYAKKMKDAAQQGVMTAEQMILQFQILLQLAVKIKEQYLLIGQPEPGWDLPPCIDDNFDSVVLDALKFYFKMLNWKLMANKNTFKEAEILEQEWDFSNELGRHLDGGDVEVAEQFSSLTSKSMGRLAAPFEKELQRPADEVAGTAEMDKRYKSILDSVRVRQRKIFRFSRILSQRFENATEYNINIDNELYEDFLLALRLSGHFLVETNAESSVPTPGENEKAGGKVYILASPVLKERPKDIQSMLGTCYHAEDSPEDPSNPYVLILRPELPLVWEGDRMDASHSGKETLKVPQTLDLKTGRLRLVADGSLQRLQNANMAFTTATGNFDLTILVEQRANLCRESTKNWQRFAKLHTSSPTHSWTRSPLFALRSKPREGKAKAKNSTHPELLCFCYGIWSAFCHSHGRTTAGGQSHKLTKLALDWVSFICDDCVASDRKTFRWAVVALEFAMVMTRGQNILSISDEEYALLRSKVAGCRSLLISHFDIMGARGTVAAQAEKQRMDAMVGKLRLDIGKLKDDDESSRIVRAQWLDELEKLDQARKDREAERQALGRVLEDSNDADRALTHLSASAGNVHLRWQQGQFVGGGTFGSVYAAINLDSGHLMAVKEIRLQDPKMIPTVVSQIRDEMGVLQVLDHPNVVQYYGIEPHRDKVYIFMEYCSGGSLAGLLEHGRIEDETVVQVYALQLLEGLGYLHEASVVHRDIKPDNILLDHNGVIKFVDFGAAKVIAKQGKTMVADGPTGNGRQRSVQGTPMYMSPEVIKGGKHTGRLGAADIWSLGCVISEMATGSRPWANMDNDFAIMYNIANGNSPQMPTRDQMSDVGLDFLQAMLRTRPCEACVRCGASAT

SEQ ID NO: 91015 - protein, 240 aa, Prochlorococcus marinus subsp. pastoris str. CCMP1986
MTFTKYQFNNYCYWPSNPKKIIEFIGGSYLASKPDLTYKRFIKSLIDKNYAVHAYKYTPQFDHQELAMKAWKDFKNCQRSLSKRIGTSIPSIRIGHSLGCKLHLISPDGGRNCEKFISISFNNFSANRSIPFLKKISQKLEFNSEFSPSPERTFGIIKRTYNQKNNFLIKFNSDELDQTDKLLSCLRARKEDNSKGIKLKGTHTIIASAGLRENFLGDWADDDFKRNTIKQISNLIDKSI

SEQ ID NO: 91016 - protein, 319 aa, Pseudomonas putida KT2440
MNDTPPLLFALQGSQDYGNAVAQRLGRKLSAHEERDYEDGEHKCWPGESVDGRSVIVFHSLYGDAHHSAHDKLCRLLFFCGALKDAAARQVTAVTPYLCYGRKDRKVEFQDAIITRHVARLMESCGVDRIVALDVHNPSAFDNAYRIPSWNLQCTQLFAQRLAPLLGEQAVTVVSPDIGGVKRAEQFRQALAHLLARPVSVAMMEKHRQQAGLSGEHLVGNVAGSTVIVFDDLISTGQTLLRAAQACRQAGASRMLAAATHGLFTTGGELFDSGAFERVLVADSIAPFRLPVRCLEQLDIVDTSALVAELLANRSGPGA

SEQ ID NO: 91017 - protein, 335 aa, Blastopirellula marina DSM 3645
MTNASPHDQLMQMICGYQVSQIVLTVGELGLPDLLKQGPTSVEDLAQACSANPDRLYRLLRAAASLGVFTETEPRVFAATPLSEILQSDHPTSLQPLTLMMGSEHYAAWGRLRRAVQSNENEFEQEFGLPFFDYLSQHPESAAIFDAAMTSIHGRETAAILEAYDFSQFGLIADVGGGNGSKLIALLTKHPQVRGMLVDLPHVVERAAPNFVAAGVNERMTLIGGDFFVEVPSGADAYMMRHIIHDWDDEKSTLILKNCRAAMQPGQKLLLVEYVIPSGDEPFFGKLLDLTMMLIPGGKERTEAEYRDLVAGCGFQLQRVIRTDQPISILESTAI

SEQ ID NO: 91018 - protein, 916 aa, Desulfococcus oleovorans Hxd3
MKTTKWVYLFDELDQAMANVGNDWDAVRGLFGGKGANLADMQRLGVPVPPGFTVTTEACNAYLEGGGVFPDDMWDQELRALLAIEKNTGKIFGDSENPLLVSCRSGAKFSMPGMMDTVLNIGLTDETAQGMIRLTQDPRFVYDAYRRLIQMFGAVVMGVPDEPFESAIDRAKQKAGVSADTELTAEQWHLLTEQFKTIFHSHTQIDFPQDPVEQLKMSTEAVFKSWNGRRAVDYRNAAGIAHDLGTAVNIVTMVFGNMGDDCATGVAMTRNGATGEPGLEGDYLINAQGEDVVAGIRMTRNIDQLATEMPESYRQLQEIARILENHYRDMQDMEFTIEKGKLWMLQTRDGKRTAQAAVRIAVDMVEEGRITKEEAVARVSPGQVDFFLHPQFDNQAVAEARAGGKVLARGLNVSPGAAVGKVVFEADLAATWAREQGRQVLLVRPETKPDDVHGMLAANGILTSRGGRTSHAALVARQFGKPAVVGVSDLQINLVKRCMTVGDLTIQEGDWLSLDGNTGEVFIGQIKTMEPDIKDPWLIKLLEWADRIRSLDVMANADYPVDAGRAREYGAQGIGLCRTEHMFFESERLPHVQKMIMATLPFDRREALAALLPFQREDFAGLFRVMDGLPVIIRLIDPPLHEFMPDLVELINELADLKMRVNHATNMADIDSLLQQIRGKERIRQRTVQLQEQNPMLGLRGVRLGIQIPELTGMQVRALFEAACEVTREGIRVFPKIMIPLTTHANELKRQREVLEETAKKVMAEQGITIDYKFGTMIELPRAALTADRIAAHAEFFSFGTNDLTQTTFGISRDDAESGFLMSYLNQDILPDNPFATLDRDGVGELMRIGVTKGRSVRPDLECGICGEHGGDPESIALCHELGLDYVSCSPFRVPVARLAAAHAALKSKNRKPAGA

SEQ ID NO: 91019 - protein, 357 aa, Oryza sativa Indica Group
MTHGGRYLLYDIFGNKFEVTNKYQPPIMPIGRGAYGIVCSVMNFETREMVAIKKIANAFNNDMDAKRTLREIKLLRHLDHENIIGIRDVIPPPIPQAFNDVYIATELMDTDLHHIIRSNQELSEEHCQYFLYQILRGLKYIHSANVIHRDLKPSNLLLNANCDLKICDFGLARPSSESDMMTEYVVTRWYRAPELLLNSTDYSAAIDVWSVGCIFMELINRQPLFPGRDHMHQMRLITEVIGTPTDDELGFIRNEDARKYMRHLPQYPRRTFASMFPRVQPAALDLIERMLTFNPLQRITVEEALDHPYLERLHDIADEPICLEPFSFDFEQKALNEDQMKQLIFNEAIEMNPNFRY

SEQ ID NO: 91020 - protein, 325 aa, Desulfococcus oleovorans Hxd3
MALPDAALLEKYRHQAHMLANRAKKQYRHLKKRFARQNIEVFRIYDWDIPEIRAVVDWYAGHLVVGEYTRKQSTPDWLPMMGAAVAEALEVPPAKVHLKTRRTGTQGQKRYERLARTERKIVMSERDFKFYVNLDDYVDTGLFSDHRDTRRMVREMADGKDFLNLFCYSGTFTCYAARGGARSTTSVDRSRTAIRWARENMALNSIPSKGHTLVQAHVFDFLEKAAADARRFDLAIVDPPSFATSRDGAHNMDIVKDHPRLLEMTVALMKPGGTILFSTNHQAFAPRMERLGVAGIQEITSATTPEDYRNRKTPIHRCWKITVCP

SEQ ID NO: 91021 - protein, 121 aa, Brassica napus
MYRTAASRAKALKGSLSRGLAPARYASSNAVATSSSSTGFFGWLTGGSSSSLASLDMPLQGVSLPPPLADHVEPSKLKITTLPNGLKIASEMSPNPAASIGLYVDCGSIYEAPYFHGATHL

SEQ ID NO: 91022 - protein, 335 aa, Pseudomonas aeruginosa
MTIRLAINGFGRIGRNVLRALYTGHYREQLQVVAINDLGDAAVNAHLFQYDSVHGHFPGEVEHDAESLRVMGDRIAVSAIRNPAELPWKSLGVDIVLECTGLFTSRDKAAAHLQAGAGKVLISAPGKDVEATVVYGVNHRGVVRASHRIVSNASCTTNCLAPVAQVLHRELGIEHGLMTTIHAYTNDQNLSDVYHPDLYRARSATQSMIPTKTGAAEAVGLVLPELAGKLTGLAVRVPVINVSLVDLTVQVARDTSVDEVNRLLREASKGSPVLGYNTQPLVSVDFNHDPRSSIFDANHTKVSGRLVKAMAWYDNEWGFSNRMLDSALALAAARD

SEQ ID NO: 91023 - protein, 510 aa, Hordeum vulgare
NAEYAGQVAGVGILLQISMLVLSFVLGHVLRRHRFYYLPEASASLLIGLVVGGLANISNTETNTRTWFNFHEEFFFLFLLPPIIFQSGFSLSPKPFFANFGAIVTFAILGTFIASIVTGMLVYLGGLTFLMYKLPLVECLMFGALISATDPVTVLSIFQELGSDVNLYALVFGESVLNDAMAISLYRTMSSVRSNAAGGENIFMMILQFLEIFVGSMSSGVGVGFISSLLFKYAGLDIDNLQNLECCLFVLFPYFSYMLAEGLGLSGIVSILFTGMVMKHYTYSNLSDNSQRFVSAFFHLLSSLAETFVFIYMGFDIAMEEHSWSHVGFIIFSIIFIIVARAANVFSCAYLVNISRPEHRRIPLNHQKALCFSGLRGAMAFALALQSVHELPEGHGKTILTATTAIVVLTVLLIGGSTGTMLEALDVIGDENTSIETYEDNNGYIPPTYEEGTSSGGGLRMKLKEFHKSTTSFTALDKNYLTPFFTSQTDDDADDFGDQPQNQRQGFYDQ

SEQ ID NO: 91024 - protein, 223 aa, Triticum aestivum
HGADIIRFTQRNILRIYPKGTRINSSNYDPMKAWTHGAQMVAFNMQGHDKSLRLMQGFFRANGGCGYVKKPDFLLKTGPNGEVFDPKASLPVKKTLKVKVYMGDGWRMDFSKTHFDAFSPPDFYARVGIAGVRADCVMKKTRTIEDQWVPVWDEEFTFPLTVPELALLRVEVQEYDMSEKHDFGGQTCLPVMELKQGIRAVPLHDRKGNRYKSVRLLMRFELI

SEQ ID NO: 91025 - protein, 568 aa, Oenothera mexicana
MASPALISETEAWKDLKAHVEDIKRTHLRELMGDTERCQSMMVEFDNIFLDYSRQQASPDTINKLYKLADAAHLKQKIDRMYNGDHINSTENRSVLHVALRAPRNSAICSDGKNVVPDVWNVLDKIKDFSERVRNGSWVGATGKELKDVIAVGIGGSFLGPLFVHTALQTDPEASKNARGRELRFLANVDPIDAARNISGLDPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHNIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSVSILLPTLDAYRIGQLLAIYEHRVAVQGFIWGINSFDQWGVELGKSLATQVRKQLHASRVKGESVEGFNFSTKTLLTRYLEATSDVPAAPSTLLPKI

SEQ ID NO: 91026 - protein, 434 aa, Candida albicans SC5314
MSPRSIILSVVATAAVTIGLVEAFHCYERKKIHPQPPKETPAKRDHSKELIREQLARNYAFLTEDGMDKVRKQRVVVVGAGGVGSWVATMLARSGVESLRIIDFDQVSLSSLNRHAVATLKDVGIPKVECIKNHLLEIAPWIEIDTRNQLWNLESAEELIYGDDFQPTFIVDCIDNLDTKCDLLAYCHEKKLPIVSSGGAATKSDPTRINLADISKTEEDPLMKKIRVVLKKRGIINGIPVVFSAEKPDPRKAKLLPLPDDEFTKGNVDQLSALKDFRVRILPVLGTMPGIFGLAIATYILSTVAGYPMEPVEGKNRYKIYDDLLQSLAGQQTRIGKTDQRVQIAMHEVNYILEEVFRGKSPISNYSTRLTLSRWDPSKEISLQNVVVMTKDEQRNHEKRVLNGGEKIEDVYSKEVVDLVKSRFEDEKYFSQFR

SEQ ID NO: 91027 - protein, 257 aa, Mesorhizobium loti MAFF303099
MRNASLFDLAGRKALVTGASRGIGRSIAEALSAAGADVAVTARSLASLDGTTAAIRAAGGVAHAVALDVTDVNRCRTATAEAAGLLGGLDILVNNAGMEEVRPSLDVDEALWDRIVDTNLKGAFFCAQAAARQMRDAGHGGAIINLCSLTSEVGIPTAVPYGSSKSGLLGMTRALAAEWAGLGIRVNAIAPGYFRTAMTDVFYSNEAWQQSMLAKIPQHRFGDLGDLHGVAVFLASDAAAYITGQSIPVDGGFLASI

SEQ ID NO: 91028 - protein, 534 aa, Bordetella parapertussis 12822
MTAPTLAPIDPPARAQLLADLQGAPDWDVIVIGGGATGLGTAVDAAARGYRTLLVEAADFAKGTSSKATKLVHGGVRYLAQGNISLVREALHERGLLNRNAPHLVWPLGFVVPAYSLLDQPFYGVGLKMYDMLAGKLNLAPSRWLSRGETLRHAATVAERVNGRALRGGILYYDGQFDDARLAIALMRTLYDLGGVALNYARAVGLTRTDGRVDGVTVADALGELRVTLRAKCVVNATGVWVDAVRRMDDPAAQTMVAPSQGVHLTLPRDFLPGEDAILIPKTDDGRVLFVVPWNGHTIVGTTDTPRTDLPLDPQAGQNEIDFILATAARYLSRKPTRADVTSVWAGLRPLVKATGEASTKSLSREHTIVVSKGGLVTVTGGKWTTYRKMAQDVVDTAIQHKLLAAAPCRTSELPLHGAPTDGQPSGAPHGTPDSYYGTDLATLRALPGADRMLVKASALTEAHVRYAARHELARTVEDVLARRNRALFLDAEAALLAAPEVARILAQELGHDEAWSRATLAEFEAVAAHYRLA

SEQ ID NO: 91029 - protein, 485 aa, Azoarcus sp. BH72
MHTLMDQAVWQDKLMCDGWRASEARAAVTDKATGEQIGSIGVADAESVVRAAALARAAQPAWHAMPYEDRAAIFRKAARLVEEHWEELATWIVRESGAIRPKADVELKAAAGILYEAAGMLTEPQGLLLPSNPGRMSFARRLPHGVVGVIAPFNFPLILAIRAVAPALATGNAVVLKPDLRTAVSGGVLIARIFEEAGLPPGVLHMLPGGADAGGALCTDPNIAMVAFTGSTRVGRTVGELCGRHLKKVSLELGGKNSLIVLDDADLDLAAGCAAFGAWLHQGQICMATGRILAHESIAEQLLAKLAEKADHLPVGDPASGRVALGPIISDGQLRQIDAVVKDSVAAGARLCAGGTYDQLFYRPTVLGGVKPGMRAFEEEIFGPVACVTTFRDEDEAVALANATEYGLSAAVISRSTGRALALGNRLNTGLLHINDQTVADEPHVPFGGRAASGNGGRVGGPANWEEFTQWQWVTVKDTPPAYPF

SEQ ID NO: 91030 - protein, 215 aa, Picea sitchensis
MDAEFWTSRMTAAKRQAALNTDQYFCLDDLEGDDMRVDFHCPFCYVDFDIASLCCLEEEHSFETTVAACPVCAVNVGNDIVGHITSQHSHLFKGQRRRKYLRGRIQSNSVQGRERLHSSVGGGSSRLGGCSSNDAPDPLLSSFIYGLPIIESHEQEKTCSSMDDTSTKNSSDSQAVISANSSVTEEESKRMFEEGVQRAQYVQQLVLSTILPDEF

SEQ ID NO: 91031 - protein, 778 aa, Oryza sativa
MPRTDNAASANSVEPDKSEECLEFDDEEEEVEEEEIEYEEIEEEIEEEEEVEEDEDVVEEVEEVDEEEDEEEDEESDETEGVSKTKGVHQKDVTEKGKHAELLALPPHGSEVYVGGISSDVSSEDLKRLCEPVGEVVEVRMMRGKDDSRGYAFVNFRTKGLALKVVKELNNAKLKGKRIRVSSSQAKNKLFIGNVPHSWTDDDFRKAVEEVGPGVLKADLMKVSSANRNRGYGFVEYYNHACAEYARQEMSSPTFKLDSNAPTVSWADPKNNDSVSTSQVKSVYVKNLPKNVTQAQLKRLFEHHGEIEKVVLPPSRGGHDNRYGFVHFKDRSMAMRALQNTERYELDGQVLDCSLAKPPAADKKDDRVPLPSSNGAPLLPSYPPLGYGIMSVPGAYGAAPASTAQPMLYAPRAPPGAAMVPMMLPDGRLVYVVQQPGGQLPLASPPPQQAGHRSGSGGRHGGSGSRYGGGGGSSGSSRPEEFVSETRLYMRIYQYFPISQIAESEEALYRQFTSVSHMEYEISGQESEVDSEVWLGWVAQRRVCSRLETRLPLPKLNTSCCLVTLSRGGRASNLSRGRRLRPVLLLDEPPPPGNLVQGGAGPPLQIPVDRESTKHRTHGDDTAIRRSWVLAAGESSDDDSCGGDKAKPKKGRKPLGNREAVRKYRQKKKAHTAHLEEEVKRLRAINQQLVKRLQGQAALEAEVVWLRSLLVDVRSRINGALGSYPFQAQCGVNNVLGCDGMAQCFAGKPELDTLSNFMGGWVWGYSLGVVNYALVLLL

SEQ ID NO: 91032 - protein, 342 aa, Picea sitchensis
MEAAKFSTELESSKQQTNYAADISSIQEARDRIGPYIDKTPVLSSSSLNIIAGRTLFFKCEIFQKGGAFKFRGACNAVFSLPVDLADKGVVTHSSGNHAAALALAAKLRGIPAYIVIPKNAPICKVENVKRYGGQVIWCEPTMQERESVSAKVQEETGAVLIHPFNDGRIISGQGTISLELLEQVAQLDAIVVPISGGGLISGVAVAAKALKPNILIFAAEPKGADDAARSKAAGHIVTLTETKTIADGLRAYLGDLTWPIVRDLVDEIIVVEEGEIVEAMKICYEILKLAVEPSGAIGLAAVLSHQFQDNMRWSHCQNIGIVLSGGNVDLSVLWESFQKAH

SEQ ID NO: 91033 - protein, 516 aa, Halobacterium sp. NRC-1
MTMEERIEDLREQTERALLGGGEARIESQHEKGKLTARERIDYFLDDGTFNELDQLRTHRSTNFDMDETKLPGDGVVTGYGDVNGRTTFVFAHDFTVFGGSLGEVFAEKVTKVMDRAMEVGAPVVGLNDSAGARIQEGVDALGGFAEIFTRNEKASGVVPQISAIMGPCAGGAVYSPAITDFTVMVKDTSHMFITGPDVIETVTGEQVGFEELGGATTHAAESGVAHFACDSEEAALDNIKRLLSYLPQNNVEDPPRVEPYDDPERRDDALETIVPDEPRKPYDMTDVVDSVVDEQSFFEVQADYAKNIVVGFARLDGRSVGIVANQPRVNAGTLDIDASEKGSRFVRFCDSFNVPILTLVDVPGFLPGTDQEHGGIIRHGAKLLYAFSEASVPLMTVITRKAYGGAYDVMASKHIGADVNYAWPTAEIAVMGPKGAVNVLYSDELEAADDTAARRQELIDEYREEFANPYTAADRGYLDAVIEPTETRPRLIDDLDMLASKREETPDKKHGNIPL

SEQ ID NO: 91034 - protein, 405 aa, Idiomarina baltica OS145
MSLNVEQIRAQFPVLQEQANGQPLVYLDNAATTQKPQAVIDALVEYYSTYNSNVHRGAHFLSDKATRRYEEARQVVAHYLNASRTEEVIWTSGTTESINLIANGVAQRLEAGDEVVVTEMEHHANLVTWQQACKKAGATLKVAPINDAGELDITAFEGLVTERTAFVAFPHISNALGTINPVQELTQIAKAVDALVLVDGAQGVAHGAVDVQAIGCDFYVFSGHKVFGPTGVGALWGRYELLQDWPVWLVGGEMIATVTYQDATWGELPNRLEAGTPNIAGVIGLAAALRWLQQFDADAILAHEQDLLTYATECASTIEGMRLIGTAKNKIGVMSFVLEGTHPADVGFILDKQGVAIRTGDHCAQPLMKRLGVPGTARASFSIYNTRADIDRLFSAIKKAQMMLA

SEQ ID NO: 91035 - protein, 440 aa, Glycine max
MELEVTAATSPPSRVLLISAGASHTVALLSGNVVCSWGRGEDGQLGHGDTDDRLLPTHLSALDAQQIDSIACGADHTLAYSESRNELYSWGWGDFGRLGHGNSSDLLIPQPIIALQGLRIKQIACGDSHCLAVTMEGEVQSWGRNQNGQLGLGTSEDSLVPQKIQTFQGVPIKMVAAGAEHSVAITENGELYGWGWGRYGNLGLGDRNDRWIPEKVSSVDCDKMVMVACGWRHTISVSSLGGLYTYGWSKYGQLGHGNFEDSLVPQKLQALSDKLISQVSGGWRHSMALTSTGLLYGWGWNKFGQVGVGDNVDRCSPVQVKFPHDQKVVQISCGWRHTIAVTEKENVFSWGRGTNGQLGHGDTVDRNSPKIIEALSVDGSSGPHIESSNTDLLSGKSGASLSERYAVVPDETVSGQTASSSSGDRLDISVPESDVKRIRV

SEQ ID NO: 91036 - protein, 126 aa, Ustilago maydis 521
MSAPNPKAFPLADATLTNQILDLIQQASHYKQLKKGANEATKTLNRGICEFIVMAADVEPIEIVLHLPLLCEDKNVPYVFVPSKTALGRACGVSRPVVSASVTTNEARELQSQIQTVKLAIERLLI

SEQ ID NO: 91037 - protein, 280 aa, Lactobacillus plantarum WCFS1
MHLTKTWLAQLPLTDIQQVQPVSGGDINAAFQIITRHHQYFLKVQPHNDVTFFDHEVAGLRLLGAVTKTPRVIASGTIATDGYLLLDWLATGTGSQSALGAAVAKVHHQHHAQFGLDHDFTAGKLPKINHWQTDWATFYTQQRLDVLVNLAKEHHLWSETREMHYHRLRQQLLQDSHMHTVKPSLLHGDLWSGNYLFDTTGTPVLIDPDVFYGDREMDLAMTTIFGGFDTDFYQAYQAAYPVAPGMQDRLPSYQLYYLLAHLNLFGETYGPAVDRILMQY

SEQ ID NO: 91038 - protein, 150 aa, Picea sitchensis
MQGLRYSSSADSDVTVGDDAACKLRPAKQLELMGCNLLMKTVVESPVDKIRRLTTENAVLVFSMTSCCMCHVVKRLLCSLGVHPTVCELDEEEEGVEMEKILRALVGAQKSSVPAVFIGGNLIGGLDRVMAMHIEGDLVPKLKEAKALWL

SEQ ID NO: 91039 - protein, 266 aa, Desulfococcus oleovorans Hxd3
MEISKLFSLENKTALVTGGSMGIGRATALAFADAGADVAIVSRKMENLAPVAEEIKAKGKRCLPVAAHVGRMDQLPAIVEQVVAEFGQIDILVNNAATSPAYATIFEAQEKLWDSIIGLNLKGLYFLSQAVARVMEEKGAGGSIINVSSIDGFAPQAQVGIYSISKAGVNMATRSMALELAPHKIRVNAIAPGATRTKLFEGLFAFLPEDEREKQIQQIGQAFPLGRVAVPDDMVGLMLYLASDASAYMTGQVVAVEGGVLLHGGL

SEQ ID NO: 91040 - protein, 399 aa, Zea mays
MERRLSATSRRSAPSAIQRLSHLAQRVGAVNLAEGFPDFPAPPHVKAAAVAAIAADLNQYRHVQGICDILANTMKRDHDLDVDPLTDFVICCGQSEAFAAAIFAIIDQGDEVLIFDPAYETYETSIELARGVPVYVPLDPPSWTLNEEKFLKSFTSRTKALVLNSPHNPTGKVFSKEELLIISQACQKMDCFVITDEVYEYITYDANKHISLASLPGMQERTIITSSLSKTYSVTGWRLGWACAAASIASAIRNIHIKLTDSAPAPFQEAALIALTSTADYYISLRKDYEVKRDFILLLLKDLGFKISVKPQGSVFVFAELPRSCQLSDVEFVTKLINDAGVVAVPGRGFFHKTCDGESYCHRYVRFAFCKGDDTLKAAAMKMRKLASRQGEPWLTGRQ

SEQ ID NO: 91041 - protein, 198 aa, Oryza sativa
  misc_feature (16)..(16): Xaa can be any naturally occurring amino acid
  misc_feature (59)..(59): Xaa can be any naturally occurring amino acid
  misc_feature (76)..(76): Xaa can be any naturally occurring amino acid
GTHGYIPGKGTFIGGXIFTLYKAQGLSVGSSLVEEDQLELATSLLAKAKERGVSLRLPXSDVILADKFAPGMLTAXLFPASAIPDGWMGLDIGPDSVASFSSTLETTQTVIWNGPMGVFEFDKFAVGTEAIAKKLADLSGKGVTTIIGGGDSVAAVEKVGVADVMSHISTGGGASLELLEGKELPGVIALDEAVTVAV

SEQ ID NO: 91042 - protein, 293 aa, Xanthomonas campestris pv. vesicatoria str. 85-10
MTTRRFLQLDVFSARPGSGNPLAVVLDAQGLDDAAMQAIARWTKLPETTFVFPAESTHSSYRLRMFSPQKEVPFAGHPSVGTAHAVLEAGLAAPQDGVLVQDGIAGRLPLRVEQRGGHRSIAIRTPRARVAEQVDANDPRLRDALQGWPLGRLPPALMDGGRTWWVVELASEAALRGLQPDWDAIAGLAESTGSMGVFAYARAGAPGTYDLAVRAFVGNGRRFEDAASGAANAVLAAWLDSRDALPGTDRRYTVSQGREIGFDALLELHIDADGDVWSGGQVQTVIRGTLDWA

SEQ ID NO: 91043 - protein, 272 aa, Magnetospirillum magnetotacticum MS-1
MTRTRTFRRDQRAPRAHLAWTELAAVGAIEDTDESRQAAVAQHFVAVSTALDKVAAFGIDPANAFGFWDWVGGRYSVDSAIGTSLAIAIGPDRFAELLAGFHAIDEHVRRTPFERNVPVLMGLLNVWYVNFLDAHTHAVLPYAQYLHRFPAYLQQLTMESNGKRVRWDGSPVTTETGEIFWGEPGTNGQHAFYQLIHQGTRLIPADFIAVANPAHPLVDAVGDGGAVQPGADVHGLFLANFFAQTKALAFGKTADESGPRAPRKPRGGSSRV

SEQ ID NO: 91044 - protein, 147 aa, Triticum aestivum
  misc_feature (45)..(45): Xaa can be any naturally occurring amino acid
  misc_feature (124)..(124): Xaa can be any naturally occurring amino acid
MAGGGNRRGAGAEELRIGSGNVFAALETLKKKKPAAAEKKQAPVXKSPEVFSAPAPLTAKSWADVEDDDDDDYFATTAPLCPVREAQGDDADAGHEDDKEHSALETGIESEDDSLDDEGDAAAXDEHEAGDAVLSEPAVQKAIAPLV

SEQ ID NO: 91045 - protein, 169 aa, Triticum aestivum
HYRTSLYKKAGWYRSGIPGISSTHASAEVFDPKKPQPVKKTLKVKVYMGDGWRMDFKQTHFDQYSPPDFYARVGIAGVPADSVMKKTKAVEDNWVPVWGEEFSFDLTVPELALLRVEAHEYDMSEKDDFAGQTVLPVSELQPGIRAVALFDRKGNKLPNVKLLMRFEFV

SEQ ID NO: 91046 - protein, 502 aa, Novosphingobium aromaticivorans DSM 12444
MASSEGQLSKLGEAARTFLATRPGLLIAGRNTPAASGARRDVLDPSTGLVVTDVAEGGAADVDAAVAAARATFQSAEWRDMRPLARERLLHRLADLIERDADILAELEVIDTGKILPMARHGDLVIALDSLRYMAGWTTKIEGTTIDPSFSYIPPIRFSARTVRQPVGVVGQIIPWNFPLVMAIWKIAPALAAGCTVVLKPAEDTPLTALYLGRLIAEAGFPAGAVNIVTGGREVGMAIVEHPGIDKIAFTGSTAAGQDIQRRAAATMKRLSLELGGKSPVVILEDCPVPMAVEGAAGAIFFNHGQVCTAGSRLLVHRSIYEDVVQGLAHAANGMVLGEGMDPAGQMGPLISARQRDRVAGYVQGALDQGARLLAGGEAPDRDGFFYRPTVLADGTPSMTIFQEEVFGPVVIAMPFDTEEEALALANDSCFALGASVWTQNLAAANRFAGALRSGNVWINAHNILDPAVPFGGWKMSGYGRELGHSAVELYTEAKSITMPLL

SEQ ID NO: 91047 - protein, 359 aa, Glycine max
MASQLLRRTFGSRFLANPRAFSSAASTPIRATLFPGDGIGPEIADSVKQIFQAADVPIEWEEHYVGTEIDPRTQSFLTWESLESVRKNKVGLKGPMATPIGKGHRSLNLTLRKELNLYANVRPCYSLPGYKTRYDNVNLITIRENTEGEYSGLEHQVVREVVESLKIITRQASLRVAEYAFHYAKAHGRERVSAIHKANIMQKTDGLFLKCCREVAEKYPEITYEEVVIDNCCMMLVKNPALFDVLVMPNLYGDIISDLCAGLIGGLGLTPSCNIGEGGIALAEAVHGSAPDIAGKNLANPTALLLSGVTMLRHLNLHDKAEQIQKAILNTIAEGKYRTADLGGSSKTTEFTKAIIDHL

SEQ ID NO: 91048 - protein, 335 aa, Streptococcus oralis
MVVKVGINGFGRIGRLAFRRIQNVEGVEVTRINDLTDPVMLAHLLKYDTTQGRFDGTVEVKEGGFEVNGKFVKVSAERDPEQIDWATDGVEIVLEATGFFAKKDAAEKHLKGGAKKVVITAPGGNDVKTVVFNTNHDVLDGTETVISGASCTTNCLAPMAKALQDNFGVVEGLMTTIHAYTGDQMILDGPHRGGDLRRARAGAVNIVPNSTGAAKAIGLVIPELNGKLDGAAQRVPVPAGSVTELVAVLEKSVTVDEVNAAMKAASNESYGYTEDPIVSSDILGMSYGSLFDATQTKVLDVDGKQLVKVVSWYDNEMSYTAQLVRTLEYFAKIAK

SEQ ID NO: 91049 - protein, 335 aa, Gracilaria gracilis
MTVPQVGINGFGRIGRLVLRAAIEKDTMSVVAINDPFIDLEYMAYMFKFDSTHGRYAGSVETKDGKLIVNGKSITIYGHRDPAEIPWAEAGADYVVESTGVFTLKEKAEKHFTGGAKKVIISAPSKDAPMFVCGVNEDKYTPDLNVISNASCTTNCLAPLVKVIHEKYGIEEGLMTTVHATTATQKTVDGPSQKDWRGGRGAGANIIPSSTGAAKAVGKVLPELNGKLTGMAFRVPTSDVSVVDLTVRLATETSYDDIKATMKAAAEDSMKGILKYTEEAVVSTDFIHEEASCVFDAGAGIMLNSRFCKLVAWYDNEWGYSNRVVDLIAHVAKLQ

SEQ ID NO: 91050 - protein, 185 aa, Triticum aestivum
MPSCLQIRPAHPLSVITVSTRSTSTSGMAASKGARKSLVSRTLERCRSGLNSGGKSSAAVAPGCFSVYVGPERERFVVRADRANHPLFRRLLDDAEQEYGYAAQGPLALPCSVDAFLDVLWHMDHDVHDDDDGEVALAPSTPICGLQRGGSGNIKVRPAGYRVLSPAKSTPASFFFSQTAAGGRW

SEQ ID NO: 91051 - protein, 336 aa, Streptococcus gordonii
MVVKVGINGFGRIGRLAFRRIQNVEGVEVTRINDLTDPVMLAHLLKYDTTQGRFDGTVEVKEGGFEVNGKFVKVSAERDPENIDWANDGVEIVLEATGFFATKAAAEKHLHAGGAKKVVITAPGGSDVKTVVFNTNHDILDGTETVISGASCTTNCLAPMAKALQDNFGVVEGLMTTIHAYTGDQMILDGPHRKGDLRRARAGAANIVPNSTGAAKAIGLVIPELNGKLDGAAQRVPTPTGSVTELVVVLEKNVTVDEVNAAMKAVANESYGYTEDPIVSSDVVGMSYGSLFDATQTKVLDVDGKQLVKVVSWYDNEMSYTAQLVRTLEYFAKIAK

SEQ ID NO: 91052 - protein, 335 aa, Streptococcus sanguinis
MVVKVGINGFGRIGRLAFRRIQNVEGVEVTRINDLTDPVMLAHLLKYDTTQGRFDGTVEVKEGGFEVNGKFVKVSAERDPEQIDWATDGVEIVLEATGFFAKKDAAEKHLKGGAKKVVITAPGGNDVKTVVFNTNHDVLDGTETVISGASCTTNCLAPMAKALQDNFGVVEGLMTTIHAYTGDQMILDGPHRGGDLRRARAGAVNIVPNSTGAAKAIGRVIPELNGKLDGAAQRVPVPAGSVTELVAVLEKSVTVDEVNAAMKAASNESYGYTEDPIVSSDILGMSYGSLFDATQTKVLDVDGKQLVKVVSWYDNEMSYTAQLVRTLEYFAKIAK

SEQ ID NO: 91053 - protein, 536 aa, Rhizobium leguminosarum bv. viciae 3841
MTVISTAIDRDGDSFKANASKNKALIDELHNRSAKAREGGSQTARERHTGKGKLLPRDRIQLLIDAGSPFLEIGTLAANGMYDDEAPGAGIITGIGRVAGREVMIVANDATVKGGAYFPMTVKKHLRAQEIAMQNRLPCLYLVDSGGANLPHQAEVFPDRDHFGAIFYNQAQMSAEGIPQIACVMGSCTAGGAYVPAMSDETVIVRNQGTIFLAGPPLVKAATGEIISAEELGGAETHGRRSGVVDHVAENDEHALLLVRDIAATLNSVKSVDIDLQPPRPPKLDAEDLCGLIPEDVRSPYDVREVIGRIVDGSELHEFKPLYGTTLVCGFARIWGMPVAVIANNGVLFSESALKGAHFIELACQRRVPLLFLQNISGFMVGGRYEAGGIAKDGAKLVTAVATATVPKVTVIIGGSFGAGNYGMCGRAYRPRFLFTWPNSRISVMGGEQAASVLATIRRDSMEARGENWPIEEEEAFKAPIRAGYEAEGNPYYATARLWDDGIIDPRQTRDVLGLAFSACLNAPIPKGPRFGLFRM

SEQ ID NO: 91054 - protein, 459 aa, Mesorhizobium loti MAFF303099
MLNQSNELNAWDRDHFFHPSTHMGTHARGESPTRIMAGGEGVTVWDNNGRKSIDAFAGLYCVNVGYGRQKIADAIATQAKNLAYYHAYVGHGTEASITLAKMIIDRAPKGMSRVYFGLSGSDANETNIKLIWYYNNVLGRPEKKKIISRWRGYHGSGVMTGSLTGLDLFHNAFDLPRAPVLHTEAPYYFRRTDRSMSEEQFSQHCADKLEEMILAEGPETIAAFIGEPILGTGGIVPPPAGYWEKIQAVLKKYDVLLVADEVVTGFGRLGTMFGSDHYGIKPDLITIAKGLTSAYAPLSGVIVADRVWQVLVQGSDKLGSLGHGWTYSAHPICVAAGVANLELIDEMDLVTNAGETGAYFRAELAKAVGGHKNVGEVRGDGMLAAVEFVADKDDRVFFDASQKIGPQVATALAASGVIGRAMPQGDILGFAPPLCLTREQADIVVSKTADAVKSVFANL

SEQ ID NO: 91055 - protein, 375 aa, Streptococcus agalactiae 2603V/R
MHIIIQITIILLASVLATLISKRIGIPAVVGQLLVGIIIGPAMLGLVHQNQVLHVLSEIGVILLMFLAGLEANFDLLKKYLKPSLLVAITGVIVPMALFYFLTRLFGFQINTAIFYGLVFAATSISITVEVLQEYNRVKTDTGAIILGAAVADDVLAVLLLSVFIATNGSSSNIGLQIIIQLLFFVFLFICMKYLVPALFKLIEKVHFFEKYTILAILICFSLSILADKVGMSSIIGSFFAGLAIGQTSFVDKVEHKISLLSYTFFIPIFFASIALPLKFDGMMSHLHTILIFTALAVLSKLIPGYFVGRGFNFSKLESLTIGGGMVSRGEMALIIVQVGLAAKIISSTTYSELVIVVILSTIIAPFILKYSFKD

SEQ ID NO: 91056 - protein, 497 aa, Mesorhizobium loti MAFF303099
MSAHFARSHRHEALDRLADRRLLRELAYVDGHWTASEAAESFEVTDPATGSTVAFVAALDARQTTQAIDAAALAFPAWRSLLPQERSRILRKWFELIITAKDDLALLMTLEQGKPLQESLGEIDYAASFVEWYAEEAKRLNAESVTSHLANAEMMVRREPLGVVGIVTPWNFPSAMLTRKAAAALAAGCTIVAHPSSETPLSALALAELGERAGLPAGVFNIVTGKAATIVGRMCEDTRVRAMSFTGSTEIGRLIAAQSAPTMKRLVMELGGHAPLIVFADADLDKAVSIAIDAKFATSGQDCLAANRIYVQRPIHDRFCAAFAKRIEALRTGNGLDDMTDIGPLLHERAVQKVEEQVADALAHGARCLAGGKRHQAGPLFYQPTLLADVSDAALIMREETFGPVAAVTPFDSEDEVIARANATEYGLVAYVVTDNGARQQRMGRALDYGMVAINRVKITGAPIPFGGVKQSGIGREGSRHGLEAFTDLKYLCLDVA

SEQ ID NO: 91057 - protein, 411 aa, Yersinia pestis biovar Microtus str. 91001
MAELPAKRRFTRIDRLPPYVFNITSELKMAARRRGEDIIDFSMGNPDGPTPPHIVEKMCSVAQREDTHGYSTSRGIPRLRRAISRWYADRYQVDIDPENEAIVTIGSKEGLAHLMLATLDHGDTVLVPNPSYPIHIYGAVIAGAQVRSVPLTEGIDFFGELERAIRETIPKPKMMILGFPSNPTAQCVELDFFERVVALAKQYDVLVVHDLAYADIVYDGWKAPSIMQVPGAKDIAVEFFTLSKSYNMAGWRIGFMVGNPELVSALARIKSYHDYGTFTPLQVAAIAALEGDQQCVRDIAEQYRQRRNALVRGLHEAGWMVDNPKASMYVWAKIPEPYAHLGSLEFAKRLLAEAKVCVSPGIGFGDYGDTHVRFALIENQDRIRQAVRGIKSMFRADGLLKPGKSSPNEMA

SEQ ID NO: 91058 - protein, 520 aa, Streptococcus agalactiae 2603V/R
MTDISILNDIQKIIVLDYGSQYNQLIARRIREFGVFSELKSHKITADEIRDINPIGIVLSGGPNSVYADGAFGIDEEIFELGIPILGICYGMQLITHKLGGKVLPAGEAGHREYGQSALRLRSESALFAGTPQEQLVLMSHGDAVTEIPEGFHLVGDSVDCPFAAMENTEKQFYGIQFHPEVRHSVYGNDILKNFAVNICGARGDWSMDNFIDMEIAKIRETVGDRKVLLGLSGGVDSSVVGVLLQRAIGDQLTCIFVDHGLLRKNEGDQVMDMLGGKFGLNIIRVDASKRFLDLLSGVEDPERKRKIIGNEFVYVFDDEASKLKGVDFLAQGTLYTDIIESGTETAQTIKSHHNVGGLPEDMQFELIEPLNTLFKDEVRALGTALGMPDEVVWRQPFPGPGLAIRVMGEITEEKLETVRESDAILREEIAKAGLDRDVWQYFTVNTGVRSVGVMGDGRTYDYTIAIRAITSIDGMTADFAQLPWDVLKKISTRIVNEVDHVNRIVYDITSKPPATVEWE

SEQ ID NO: 91059 - protein, 423 aa, Halobacterium sp. NRC-1
MHTHHMDGARCKRMHPVSKRQHAPDSETDGVYAERGSRSDCMKLHEYQAKEVFADAGIPTPESALATSVDEAVEVADALDYPVAVKAQVHVGGRGKAGGIKLAENTAEAREAAESILGMDLKGYTVDRVLVEEAVDFTNELYVGVTMDRSEGAPVVMVSERGGVDIESVAEEAPEDIVREHVDPSFGLQAYQARNAVYDAGIEQDVAGDVAKIVQGVYDLWADSDATEVEINPVMVTSERDVVAADAVMKLDEDALFRQPAFADMEEDAAEDDLEAKANEYGFDYVRLDGNTGIIGNGAGLVMTTLDLVDYYGGQPANFLDIGGGAKADRVANALDMVFSDENVDSVVFNIFGGITRGDEVAKGINSALEQFDEIPTPVVVRLAGTNAAEGREILNDDLVTVEETLEGAVQRAVEYADEEDIQ

SEQ ID NO: 91060 - protein, 224 aa, Idiomarina baltica OS145
MAKVLLITGASSGIGEATAKEAVKQGYKVVATARSEDKLQALANDLGAEHVLPIAADVTDYQQLERVVQQTVDQFGQLDAVFANAGKGLNAAGTENGDPNEWREMIDLNINALLYTAKLTLPHLKKSTGHFIMTGSAAGRTAIKGSVYGASKWFVHGFAQNLAEEMREWSGRCTVIAPGMVNTPFFDEPKPDKLDPQDVADAVLHALNAHPRNCVREVFLMPGY

SEQ ID NO: 91061 - protein, 290 aa, Arabidopsis thaliana
MIQTGEEDEEKATSLEVEFASGNGVDDEEELRLQWATVERLPTFKRVTTALLARDEVSGKGRVIDVTRLEGAERRLLIEMLVKQIEDDNLRLLRKIRKRIDNNICFVNCMCMLATIEPSCNCRVGIELPTVEVRFNNLSVEAECQVIHGKPIPTLWNTIKGLLSEFICSKKETKIGILKGVSGIVRPGRVQKRCWFSCRMTLLLGPPGCGKTTLLQALSGKFSDSVKVGGEVCYNGCSLSEFIPEKTSSYISQNDLHIPELSVRETLDFSACCQGIGSRMGEDQISESLN

SEQ ID NO: 91062 - protein, 184 aa, Magnaporthe grisea 70-15
MAFRAFRPAAAMAARTTARRGFHTTRPAFVKAGDPLPDAECLVEGSPGNKVNIAKEFSLNNGLIIGVPAAFSGACSTSHIPSYMKHPKIKDVGQVFVVSVNDAFVMKAWAEQMDPAGDSGFRFLGDPQGVFTKTLDLDFDGTAIFGNDRSKRYALVIENGRVKSAHVEPDNTGTNVSMADKVLG

SEQ ID NO: 91063 - protein, 418 aa, Physcomitrella patens subsp. patens
MAGAMAARSSRRFMSTASKSWFGHVQPAPKDPILGVTEAFLADSHPDKMNVGVGAYRTDEGKPLVLECVRKAEEKIAGSNFMEYLPMGGDISFNNHSMKLAYGEDAGVLADKRVAAVQALSGTGACRLFADFQKRFMPESQVFIPVPTWSNHHNIWRDANVPQNTFRYYDAATKGLDFKGLMEDVKKAPNGSVFLLHACAHNPTGVDPSPENWKEISAFFKEKGHFALFDMAYQGFASGDTERDAQAIRIFLNDGHQIACAQSFAKNMGLYGQRVGCLSVVCDDPQQAVAVKSQLQLIARPMYSNPPLHGALLVSTILEDPELKSLWYKEVKGMADRIIGMRETLRTNLEKAGSQHSWKHITDQIGMFCFSGLKPEQVDRLTKDFHIYLTRNGRISMAGITTSNVEYLANAIHEVSKN

SEQ ID NO: 91064 - protein, 267 aa, Kluyveromyces lactis NRRL Y-1140
MTKFVGCIDLHDGQVKQIVGGTLTDSSKDKVTTNFVSKLPPSHYAKLYHENQVEGCHVIKLGPNNDEAALEALNECPNFLQVGGGITLDNCGYWLKYASKIIVTSFLFDKSTYQFQREKLVKLAEICGKDRLVVDLSCKRVTKPDQEPKWVVAMNKWQTLTDLELNERTFADLCQYTDEFLVHAADVEGLCNGIDEELVAHLYKWTADIPKVKIVYAGGAKSVDDLRLVEKLSHGKIDLTFGSALDIFGGSLVKFEDCVQWNHEKHA

SEQ ID NO: 91065 - protein, 233 aa, Xanthomonas campestris pv. campestris str. ATCC 33913
MGLLHFPELPMQPTAIAPSILSADFARLGEEVDNVLKAGADWVHFDVMDNHYVPNLTIGPMVCQALRKHGITAPIDVHLMVEPVDRLVPDFADAGATTISFHPEASRHVHRTIQLIRSHGCQAGLVLNPATPVDILDWVLPELDLVLVMSVNPGFGGQAFIPSALDKLRAIRSKIDALGKPIRLEIDGGVKADNIGAIAAAGADTFVAGSAIFNAPDYSQIIAQMRAAVDAAR

SEQ ID NO: 91066 - protein, 326 aa, Bacillus licheniformis ATCC 14580
MSYLIKISQFAGKTFAIWVILFAILGFAFPSQFTWIVPYITILLGVIMFGMGLTLSADDFKELLRRPLHVLIGVLIQYTVMPLLAFGLAYGLALPPEIAVGVILVGCCPGGTASNVMTFLAKGNIALSVAITTLSTLLAPFLTPFLILFFAKEWLPVSPGSLFVSILQAVLLPIIAGLIVQFFFKKQVKKAVQVLPLVSVLGIVAIVSAVVGGNRENIIQSGLLIFAVVVLHNGLGLFLGFVLAKCFKMDYASQKAVSIEVGMQNSGLGAALATAHFSPLSAVPSAVFSVWHNLSGSWLATYWAKKTNKQKNDNHSPAPQMINKKL

SEQ ID NO: 91067 - protein, 426 aa, Bacillus licheniformis ATCC 14580
MAEIKVPELAESISEGTIAQWLKQPGDYVEQGEFLLELETDKVNVELTAEQSGVLQEVLKDSGDTVQVGEIIGTISEGEGEGGKSTAPQADAQESAGASEEKAASSEKTAEPREGASDEADTAKTRTIASPAARKLAREKGIDLSEIPTGDPLGRVRKQDVESYQKNEQPPKAQPEPKRATQAPAAKQTEDAGKPVERQRMSRRRQTIAKRLVEVQHTAAMLTTFNEVDMTAVMNLRKRRKDQFLEQHDVKLGFMSFFTKAVVAALKKYPLLNAEIQGDELVIKKFYDIGIAVAAPDGLVVPVVRDADRKTFADIERDIGELAKKARNNKLSLNELQGGSFTITNGGTFGSLLSTPILNSPQVGILGMHKIQLRPVAIDEERFENRPMMYIALSYDHRIVDGKEAVGFLVTIKNLLEDPEQLLLEG

SEQ ID NO: 91068 - protein, 485 aa, Rhodospirillum rubrum ATCC 11170
MARKMLQFTRLDQRTPDKRSAGTRRVDFDEIYGRFTPDAAGDQASRCEQCGIPFCQIHCPLQNNIPDWLMLTAAGRLEEAYALSSATNSMPEICGRICPQDRLCEGSCVLEQSRHGAVTIGAVEKFITDTAWERGWVKPILPLREREQSVGIIGGGPAGMAAAEQLRAQGYQVTLYDRYDRIGGLLVYGIPGFKLEKSVVERRVDLLARSGVIFKTNFEVGRDASLPELRKTHDAVLIATGVYKARGLSIPGAGLRGVTKALDYLIASNRTGLGDRVPAFEDGTLDAKDKAVVVIGGGDTAMDCLRTAIRQGARSVKCLYRRDRANMPGSQREVINAVEEGVDFVWLTAPEAVLGDERATGVRAHRMHLGVADATGRQSPQPIAGSEFTLEADLVIEALGFEPEDLPAVFGEPRLPITRWGTIQIDPVSKMSGLDGVFAAGDIVRGASLVVWAVRDGRDAAEGIRRYLVAKAAAAPAKAAPLVNA

SEQ ID NO: 91069 - protein, 230 aa, Xanthomonas campestris pv. vesicatoria str. 85-10
MPASSLQQILDAIHAAAAAHARADVRLLAVSKTKPADAVAALAAQGQRAFGENYVQEADAKIAQLRALGLEWHLIGHLQSNKAELASQCFDWVQTVDRAKLIPLLARHRPADRAPLNVLIQVNIDDEDSKHGCAPEAIDSLAEAIALQPRLQLRGLMAIPAPFPDQARRQAAFMRMQALFEQLQARHRQVDTLSMGMSSDFAEAIAAGATMVRVGTALFGARDQAPAASA

SEQ ID NO: 91070 - protein, 284 aa, Xanthomonas campestris pv. vesicatoria str. 85-10
MNTPASSSPSSSAATSIAFVGGGNMARSLIAGLIRQGTPAASIRVAEPVAELRDALARDFGVQVVEDARAAVDAATTWVLAVKPQVLPMVCAQLADLAQAQQPLLVSIAAGITATQLQRWSGGDIAVVRAMPNTPALLGAGVTGLYANARVSAAQRQQATQLLDSAGVTVWIDNEAQMDAVTAVSGSGPAYVFLLAEAMEAAAQAQGLPAATARTLVLQTLLGAARMLTESGEPPEVLRRRVTSPNGTTHAAIETFQAGGFEALTAQAIAAATERGRSLSAAND

SEQ ID NO: 91071 - protein, 357 aa, Vitis vinifera
MKGPLDRTKVMVRHLPPMISEAAFLEQIDTVFKERYTLVKFCPGKNSQQRQSYSRAYLDFKRPEDVIEFAEFFDGHVFVNEKGTQFKTIVEYAPSQRIPKHWPKKDGREGTIFKDPEYLESLELLAKPFENLPSAEIQLERREAERAGAVKDTPIVMPLMDFVRQKRAAKGVSHPSGSSSGNPSLGSSKWGSEKRRLSTTMYVLRDAAKNTSAKDKSTFILVPKRADQLLSDKSVNLAAGEESGVSGAVDAGKKKVLLLKGKEREISHHLQQQNVTSPVKNILGANAPKQNQRREGSGRIIRSILLNKDARQSQSSMFQSEQQSQASNLEKEKRPPRPPQLYTQPEMQRKVRDAAAV

SEQ ID NO: 91072 - protein, 353 aa, Vitis vinifera
  misc_feature (67)..(67): Xaa can be any naturally occurring amino acid
  misc_feature (257)..(257): Xaa can be any naturally occurring amino acid
MADQENSVRITRAAKKRAAAAMAASDSLQLPPNKKRVVLGELPNLSNVAATPAAVPASGAQKQKFRXKKKEKVKAAVVAPDVGAKSDDPQMCGPYATDIYEYLHSMEMEPKRRPLHDYIEKVQKDVSHNMRGILVDWLVEVAEEYKLASDTLYLTISYIDRFLSSKALNRQRLQLLGVSSMLIAAKYEEISPPHVEDFCYITDNTYTKEEVVKMEADILKSLNFEMGNPTIKTFLRRFTRIAQENYKTPNLQLEFLXYYLAELSLLDYGCVKFLPSMCSSLQHHSGYKPSELKECVLIIHDLQLSRRGGSLVAVREKYKQHKGTLGRIEFFAMDKWFLCQFFSSNAGRHLSGT

SEQ ID NO: 91073 - protein, 347 aa, Vitis vinifera
MKGPLDRTKVMVRHLPPMILEAAFLEQINTVFKGRYTLVKFRPGKNSQQRQSYSRAYLDFKRPEDVIEFAEFFDGHVFVNEKGTQFKTIVEYAPSQRIPKHWPKKDSREGTIFKDPEYLEFLELLAKPFENLPSAEIQLERREAERAGHSYSYASNGFCPSEKSFQGCIPSQWVIIWKSKSGLIKTGLSTTMYVLRDAAKNTSAKDKSTFSLVPKRDDQLLSDKSVNLAAGEESGVSGAVDAGKKKVLLLKGKEREISHHLQQQNVTSPVKNILGANSPKQNQRREGSGRIIRSILLNKDARQSQSSMFQSGQQSQASNLEKEKRPPRPPQLYTQPAMQRKVRDAAV

SEQ ID NO: 91074 - protein, 150 aa, Zea mays
IITEWNKGELDSYLIEITRDILKFKDTDGSPLVEHIKDTAGQKGTGKWTVVSALDNGMPVTLIGEAVFARCLSAIKNERVRASKILSGPNGKFTGDKKQFIHDVSKALYASKIISYAQGFMLMREAAKENRWHLNNAGIALMWRGGCIIR

SEQ ID NO: 91075 - protein, 409 aa, Rhizobium leguminosarum bv. viciae 3841
MGEFIIKMPDVGEGVAEAEIVEWHVKTGDPVREDMVIAAVMTDKATVEIPSPVNGTVTWLAGEVGDRIAVKAPLVRIETAGDVDEVQPVGISQTPIAETPKAEIAKPAPAAPTPAPAPAEKPLAAPSVRLFARESGVDLRQVQATGPAGRILREDIEQFLGHGTAPATAKNGFARKTATEEIKLTGLRRRIAEKMVLSTSRIPHITYVEEVDMTALEELRATMNGDRRADHPKLTVLPFLMRALVKAISEQPDVNATFDDDAGIITRYSAVHIGIATQTPAGLTVPVVRHAEARGIWDCAAEMNRLAEAARSGTATRDELSGSTITISSLGALGGIVSTPIINRPEVAIIGVNKIATRPVWDGAQFVPRKMMNLSSSFDHRIIDGWDAANFVQRIRTLIETPALIFIEG

SEQ ID NO: 91076 - protein, 316 aa, Physcomitrella patens subsp. patens
MKRSASWAHFVELSQAEARHLEMEVPDQYVCDMSSLFLGQRFASGNHSRLYQGVYKDQDVAVKLLRLDSCEDAATAARLERQFMQEVHCLSQFHHPNIVEFVAASWKPPVCCVIMEYVPGGSLRAFLHKYESESLPLKTILSMALDVALGMEYLHSQGVVHRDLKSENLVLTEELHLKLTDFGVGCLETECDLRSSDTGTYRWMAPEMISHKHYSKKVDVYSFGIVLWELVTRLVPYQDMTPVQVAYAVVNKNLRPTIPDDCPTELADLMEQCWKDNPERRPNFYQIVQILEDVEMSLPEDPQPQHHRYSSSALFG

SEQ ID NO: 91077 - protein, 833 aa, Salmonella typhimurium LT2
MPLIVEFTCELPNGVHARPASHVETLCNTFTSQIEWHNLRTDRKGSAKSALALIGTDTLAGDHCQLVISGADEQVACQRLSQWLRDEFPLCDAPLAEIKNSELEPLPASLTQLNPQIYRARSVCSGSAGGVLTPLSSLDLNALGELPTANDTETEQAALDNGLAMLIKHIEFRQLDSDGAASAILEAHRSLAGDASLRQHLLDGVLRGLSCAQAIVESANHFCNEFARASSSYLQERALDVRDVCFQLLQHIYGGQRFPAPGQLTRPSICMAEELTPSQFLELDKTFLKGLLLKSGGTTSHTVILARSFNIPTLVGVEIEALTPWRQQTVYIDGNAGAIVVAPDEPVTRYYQQEARVQDALREQQRIWLTQEARTADGIRMEVAANIAHSVEAQAAFSNGAEAVGLFRTEMLYMDRACAPDENELYNIFCQALESAKGRSIIVRTMDIGGDKPVDYLNIPAEANPFLGYRAVRIYEEYASLFTTQLRSILRASAHGNLKIMIPMISSMEEILWVKEKLAEAKQQLRNEHIPFDEKIPLGIMLEVPSVMFIIDQCCEEIDFFSIGSNDLTQYLLAVDRDNAKVTRHYNSLNPAFLRALDFAVQAVHRQGKWIGLCGELGAKGSVLPLLVGLGLDEISMGAPSIPAAKARMAQLDSRACRQLLNQAMACRTSLEVEHLLAQFRMSQQDAPLVTAQCITLDSDWRSKEEVIKGMTDNLLLAGRCRYPRKLEADLWAREAVFSTGLGFSFAIPHSKSEHIEQSTISVARLNAPVRWGDDEAQFIIMLTLNKHAAGDQHMRIFSRLARRIMHEEFRNTLVNAASADAIASLLQHELEL

SEQ ID NO: 91078 - protein, 465 aa, Rhizobium leguminosarum bv. viciae 3841
MKEIVCKLLVIGAGPGGYVCAIRAGQLGVDTVIVEAGKPGGTCLTVGCIPSKALIHAAEEFDATQKMLAGKNPMGIRVEGASIDLGRTIAWKDGIVGRLTSGVSGLLQKARVKIVHGRAHFRDGKTVEVETETGQQIIRAETVVIATGSDPVELSNLPFGGRVISSTEALSLTELPKKLVVVGGGYIGLELGTAFSKMGSDVTVVEATPQVLPQYDAELVRPVMRKLTEGSIRLLTGAKAIGLADNGEALIVEAADGRRESLPADRILVTVGRRPRTAGSGLEELDLDRAGPYLRIDDRCRTSMRGIYAIGDVTGEPMLAHRAMAQGEMVAEIIAGKKRAWDKRCIPAICFTDPEIVSAGLSPADAKAQGYEIRTGQFPFSANGRAMTMLSEEGFVRIVARADTNLVLGLQAVGAGVSELSAAFALAIEMGARLEDIAGTIHAHPTRSEAVMEAALKALGSALHI

SEQ ID NO: 91079 - protein, 303 aa, Bordetella parapertussis 12822
MSTPTYPTIEQTVGNTPLVRLQRIPGAAGQARGNVILAKLEGNNPAGSVKDRPALSMILRAEERGEIHPGDTLIEATSGNTGIALAMTAAMRGYRMVLIMPDNLSLERRAAMTAYGAELILTPAAKGGMEYARDLATAMQAEGKGKVLDQFGNPDNPRAHIEGTGPEIWNQTDGRVTHFVSAMGTTGTIMGVSTYLKSRNAAVQVVGAQPAEGSQIPGIRKWPEAYMPKIFDRSLVDAYESIAQAEAETMARRLAAEEGIFAGISSAGALVAALRVAERVENATIVFIVCDRGDRYLSTGVFN

SEQ ID NO: 91080 - protein, 409 aa, Yersinia pestis biovar Microtus str. 91001
MLNGRAVDTSRRPLRKIKLSLMGPAFIAAIAYIDPGNFATNIQAGATFGYTLLWVVVWANVMAMLVQLLSAKLGIATGKNLAEHIRDRFPRPVVWAYWVQAEIIVMATDLAEFIGAAIGFKLLFGVTLLQGAVLTGIATFLILMLQNRGQKPPELVIGGLLLFVAAAYIVELIFSQPDIAALGRGMLIPNLPDGNAVFLAAGVLGATIMPHVIYLHSALTQTGGEESKTERYASTKFDVAIAMTIAGFVNLAMMATAAAAFHFNGYENIAEIEEAYITLQPLLGNAAATVFGLSLIAAGLSSTVVGTLAGQVVMQGFVRFYIPMWVRRIVTMLPSFIVILAGMDATQILVMSQVLLSFGIALALVPLLVFTGNKELMGELVDTKTTQILGKLVVLIVVGLNAYLLISLL

SEQ ID NO: 91081 - protein, 322 aa, Desulfococcus oleovorans Hxd3
MAKMKEIKAKNMNVEKFIADKVKDIQQAVGDGMAINALSGGVDSSVVTVLGHRALGKNLKTYFIDNGIMREGEPARVVATFKKMGIPVEVIDASRAFFAALKGVTDPEEKREAITQTFYKKIFGKLVVKSKATYLLQGTILTDVDETVAGIKRQHNVFAQLGIDPQKAFGYKILEPLIELRKDGVRKVGRGLGLPEAVFERMPFPGPALAARVIGEAKPDRIALARKATAIMEKTFKDVDAFQYMAILHEDRVTGMRDNKRVFGNQIEIRCWDSVDARKARPTRLSFDLLESVAKKITKTIPEVVSVTYNITSKPTSTMEAV

SEQ ID NO: 91082 - protein, 380 aa, Physcomitrella patens subsp. patens
MYTPIVNKRKIPEHVATTHIIPASQPAATESHRTPRSNRSEIKPQAMLEHELDHDSNNKDGDGAEALQYLFSIDPDAGDYCQPCSYPRHASPAAAPPHVPDSIPHNTLSSSCSYGIQALINNVHRGYINDDDDAPMMSPVPEDLSQQQESETLRQWKRKKELELQEKQRETQIKQDRILEHAAIERENFYKEREVQIEEKKRLNREKETKYRADAEMQQKLVEDNLWAAVAALIDLNGDQTDGMMTANGSGKQISKSQISTPKRVEQRRLKEYAVKPTKKTTDLSRMREVVPVLPLHAIKHICYASFAMTILYCHTSTPYDITKMIIDSSLQCGCFFSQYYADKVCCLLKILLKLQQRPLVRSSPHFAGKSPLEMERNMQ

SEQ ID NO: 91083 - protein, 527 aa, Arabidopsis thaliana
MIAIIVEFQNFFIFILLCLFSLLCHSLFFKKPKDSRSFVLPSSPPSLPIIGHLHLLLSVLTHKSLQKLSSKYGPLLLIRIFYVPIILVSSSSMAYEIFKAHDVNVSSRGIIALDESLMFGASGILNAPYGDYWKFMKKLMATKLLRPQVLERSRGVRVEELHRFYRSILDKATKNESVEIGKEAMKLMNNTLCKLIMGRSFSEDNGESNRVRGLVDETYALSEKIFLAAILRRPLAKLRISLFKKEIMGVSNKFDELLERILQERKENLEEKNNEGMDMMDVLLEAYGDENAEYKITWKHIKAFFVEFFIGGTDTSVQTTQWAMAEMINNANVLERLREEIVSVVGETRLIQETDLPNLPYLQAVVKEVLRLHPPSPVLIRKFQEKCEVKGFYIPEKTTLIVNVYAIMRDSDSWEDPEKFKPERFLTSSRSGEEDEKELKFLPFGSGRRGCPGANLGSIFVGTAIGVMVQCFDWKIKEDKVNMEETFEGMTLKMVHPLTCTPFFEPNLYLLLLISKFPCLILSFGAC

SEQ ID NO: 91084 - protein, 399 aa, Arabidopsis thaliana
MASSTATMLKASPVKSDWVKGQSLLLRQPSSVSAIRSHVAPSALTVRAASAYADELVKTAKTIASPGHGIMAMDESNATCGKRLASIGLENTEANRQAYRTLLVSAPGLGQYISGAILFEETLYQSTTDGKKMVDVLVEQNIVPGIKVDKGLVPLVGSYDESWCQGLDGLASRTAAYYQQGARFAKWRTVVSIPNGPSALAVKEAAWGLARYAAISQDSGLVPIVEPEIMLDGEHGIDRTYDVAEKVWAEVFFYLAQNNVMFEGILLKPSMVTPGAEATDRATPEQVASYTLKLLRNRIPPAVPGIMFLSGGQSELEATLNLNAMNQAPNPWHVSFSYARALQNTCLKTWGGKEENVKAAQDILLARAKANSLAQLGKYTGEGESEEAKEGMFVKGYTY

SEQ ID NO: 91085 - protein, 287 aa, Triticum aestivum
MVVGSFITRALILVLGYAYPAYDCYKTVELNRPEIEQLRFWCQYWILLAMLTVFERVGDNFISWLPMYSEAKLAFIVYLWYPKTQGTSYVYESFFKPYIAKHESEIDRNLLELRTRASDIAVTYFHKVADYSQSRFHEILQYIASQSQGSRSQAQQQQQRPPPPRTRMANPAPPPVPAPTAPPMPPQAAQVPPTPPRMQVQDKGPVPVAPPGAVPPVQQQTPSCPGPVAGNSPPKSEDMLVDQSGPSTSNVPPRPTMPEDEETLIQEAIRLTRGRLRRRMGGSGPPV

SEQ ID NO: 91086 - protein, 414 aa, Xanthomonas campestris pv. vesicatoria str. 85-10
MNMPAIPPSAAPDWDRVRLDFPLLMRQVHGKPLIYFDNANTGQKPLQVIAATDEFYRRQNANVSRAVHALGSEATDAFEGARSKLARFLNVRADELVLCSGTTFAINLVAYSWALPRLGAGDVILISRMEHHANIVPWQLVAQRTGATIRVAEITPDGALDLDALRKAMTPDVKLLAITHVSNVLGTVNPVREICREARKRGIVTMVDGSQAAPHRRIDVASIGCDFYAITGHKMCGPTGTGALWARREHLQAMPPFLGGGEMIKEVSFENTVFNDAPHKFEAGTPNIAGFVGLGAAVDYLESLGLAHVEAREAELLAHFTEELQRIDGLRIFGTTPDKAAVVSFLIEGAHSHDLATLLDLEGVAVRSGQHCAHPLLQYYGVAATCRASLAFYNTHDEIERFVAALMKVRRLLG

SEQ ID NO: 91087 - protein, 190 aa, Heliobacillus mobilis
MTTKTSCRWFRQARLSIRSLRRWTEMRHTLAVLVENRPGVLVHISGLIARRAFNIESITAGYTEEADITRITIVVEGDNRSLEQVVNQLSKLVDVIKIVELTSEPSIERELALIKVKANPETRSDIVDIVEIFRAKIVDVNRETMVIELTGEETKIDALCEVLKDHGIVEMVRTGKVALSRRPGAAKETE

SEQ ID NO: 91088 - protein, 142 aa, Populus trichocarpa
MTEEIFGPLLPIITLNNIHDSIEFISSRPKPLAIYAFTRDETFKKQILSKTSSGSVTFNDTLLQFVCDSLPFGGVGQSGFGRYHGKYSFDTFSHEKAILQRRFFPELEPRYPPWNNLKFQFIKLLYAFNYIGLLLLLLGLKK

SEQ ID NO: 91089 - protein, 328 aa, Triticum aestivum
  misc_feature (123)..(123): Xaa can be any naturally occurring amino acid
MAEHLASIFGTEKDRVNCPFYFKIGACRHGDRCSRLHNRPTTSPTIVLANMYQRPDMITPGVDAQGVAIAPEKMQEHFEDFYEDIYEELSKFGEVETLNVCDNLADHMIGNVYVQFREEEQAXVAAHNALQGRFYSGRPIIVEYSPVTDFREATCRQFEENSCNRGGYCNFMHVKQIGRELRRKLYGGRSRRSHGRSRSPSPQHRRDNRDRGGDFRRDGRDEYRGGGGGGGGGYRGGDGGDGGGYRGGGGGGGYRGGDGGGYRGGGGGGYRGGGRGGGGGRHDRYDDGPRRRYGGSPPRRGRSPPARENSEERRAKIEQWNREREEKK

SEQ ID NO: 91090 - protein, 485 aa, Burkholderia xenovorans LB400
MRIDHLINGKSGAAKDYFETVNPATQEVLAEVARGGAEEVDAAVRAAKDAFPAWAARPAAERAKLVRKLGELIAKNVPEISETETKDTGQTISQTRKQLVPRAADNFSYFAEMCTRVDGHTYPTDTHLNYTLFHPVGVCALISPWNVPFMTATWKVAPCLAFGNTAVLKMSELSPLTAAMLGNLALEAGIPAGVLNVVHGFGKETGEPLVAHPDVHAVSFTGSTATGNRIVQTAGLKKFSMELGGKSPFVIFDDADFERALDAAVFMIFSNNGERCTAGSRILVQRGIYARFAERFIERAKRLSVGDPLSDSTIVGPMISQGHLAKVRSYIELGPKEGATLACGGLDLPELPDALRKGNFVQPTVFVDVDNRMRIAQEEIFGPVACLIPFDDEADAIELANDISYGLSSYIWTENTGRALRVAAAVAAGMCFVNSQNVRDLRQPFGGTKASGVGREGGTWSYEVFLEPKNVCVSLGSHHIPRWGV

SEQ ID NO: 91091 - protein, 131 aa, Rickettsia sibirica 246
MAYSKKVIDHYENPRNVGSLDKENKNVGTGLVGAPACGDVMKLQIAVDDDGIITDAKFKTFGCGSAIASSSLVTEWVKGRSVDDAETIKNTEIAKELSLPPVKLHCSLLAEDAIKAAIADYKQKKESKKDS

SEQ ID NO: 91092 - protein, 361 aa, Bordetella parapertussis 12822
MDDSLQDKLRPLRDRIDAIDAQILDLLSQRARTAQEVGSVKHAAHADGPVLRPEREAEVIRRLQHSNPGPFPKAAVAAVWTEIMSACRGLERGMTVAYLGPQGSFSEQAALEHFGHSVQQLPCPSFDEVFRAVEAGQADVGMVPVENSTEGAVNRSLDLLLNTPLTILGERSLVIRHCLMSQSGTMDGIKTISAHPQALAQCQGWLTRHYPDLNRVAAASNSEAARVAAEDPTVAAIAGEVAAPAWNLRVVAAGIQDDPQNRTRFLAVGHIEPLSSGKDKTSLILAVPNRAGAVYDMLAPMAANGVSMTRFESRPARTGQWEYYFYVDVLGHRDDANVARALAALQAQVAFFKVLGSYPAQ

SEQ ID NO: 91093 - protein, 410 aa, Rickettsia sibirica 246
MNPQLNNLTLPIYMDYQATTPIDPRVMEAMLPYFTTKFGNPHSRSHSFGWEAENAVEEARSMVAKLIGADTKEIIFTSGATESNNLAIKGIAKFYSNKKNHIITVVSEHKCVLDACRHLEQEGIKITYLPIKPNGIIDLETLKNAITDQTMLVSVMMVNNEIGVVQPLKEIGKICREKGVFFHSDIAQGFGKIPIDVNAFNIDLASISGHKIYGPKGIGALYVRKKPRVRVTPLINGGGQERGMRSGTLPTPLIVGLGMAAEIAYSEMEKDTKHVNYLFDRFLNNIHKRISEVYLNGDKNQRYKGNLNLSFAGVEGESMILAIKDLAVSSGSACTSASLEPSYVLRSMGIGEELAHTAIRFGIGRFTTEQEVDYAVNLICSKIDKLRELSPLWEMMQEGIDLKKIKWAVH

SEQ ID NO: 91094 - protein, 422 aa, Solanum lycopersicum
MAAEQSKKWILMVTAQTPTNIAVIKYWGKRDENLILAINDSISVTLDPAHLCTTTTVAVSPSFQQDRMWLNKKEISLDGARYQNCLREIRARANDYEDEKKGIKISKNDWQNLHVHIDSYNNFPTAAGLASSAAGFACLVFSLAKLMNVQEDNGRLSAIARQGSGSACRSLFGGFVKWVMGKEEDGSDSIAVPLADEKHWDELVIIIAVVSSRQKETSSTSGMRETVVTSALIDHRAKEVVPKRIVQMEEAIQNRDFPTFAQLTCSDSNQFHAVCMDTSPPIFYMNDTSHRVISCVEKWNRAEGTPQVAYTFDAGPNAVLIARNRKAATLMLQRLLFHFPPNSDTDLDSYVIGDKSILKDAGIKDLNDIEALPPPPEIKDKVPAQKCKGEISYFICTRPGRGPVLLPDESQALLCLETGLPK

SEQ ID NO: 91095 - protein, 419 aa, Candida glabrata CBS 138
MKFEQFIVAIISVISFVSGFPFRRQIAPPLFTNTTIPHNNGTNGTGGGGGQEGGGGQGGGGGSGGGSGGGSGGGSGGGSGGGSGGGSGGGSGGGSGGGSGGGSGGGSGGGSGGGLITSPGSSYCYPSNGHYPGDTITTGRKIGIFYTGGYLANIQHSDVTVERLFNITNTELNITQLYSVAAAVNKTLGNGEYKGVLIVGNNNSLTGLGYFSSILFNTNKTIVISSNSTLGLPIANQSLSTNRGPILTHNDSAVYSGGLPPYKVPIGVLDTNGTAHYFYRGGLPKFFDRGSGLRLNYTNFTDPGAYNKTRTIPTIRIVNQTNVTDDFIRNVAPNLQGLVVNITGTPFTTTGLQSLRYPVMFVKDQQQLAFVSKWNVPTGIIPGGYLSPAQAQLFLYVAALNNATSPAAWSQWFGNPDII

SEQ ID NO: 91096 - protein, 456 aa, Desulfitobacterium hafniense DCB-2
MPDIKEILVKQKAFFQTGKTKELQFRVDMLNKLRSAIKIHEEEIMAALKADLNKAPFEAYATEVGMVLEELNYTLKHISSWVKPKRVRTPLVHFPSASYLYTEPYGSVLIMSPWNYPFQLALAPLVGAISAGNCAVLKPSEYSANTSAMIERIVKEIFDESFVAVVRGGREANKTLLNEKFDYIFFTGSVGVGKTVMESAARHLTPVTLELGGKSPCIIDDTADLELAAKRIVWGKFLNAGQTCVAPDYLLVHRTVKEKLIQEIKKSITAFYGHDPLGNEDYPKIINQKHFERLLGLLKSGRVVEGGRSDEKTRRIAPTILDDVTWESPVMQEEIFGPLLPVLEFESFDAALAMVNQHPKPLALYLFTRSKDHEAQAISKTSFGGGCINDTIIHLANPNLRFGGVGESGMGQYHGKGSYDTFSHTKSIMKKSNKLDIPLRYPPFRNHLSLLKKLMK

SEQ ID NO: 91097 - protein, 506 aa, Staphylococcus aureus subsp. aureus MRSA252
MQNFKELGISDNTVQSLESMGFKEPTPIQKDSIPYALQGIDILGQAQTGTGKTGAFGIPLIEKVVGKQGVQSLILAPTRELAMQVAEQLREFSRGQGVQVVTVFGGMPIERQIKALKKGPQIVVGTPGRVIDHLNRRTLKTDGIHTLILDEADEMMNMGFIDDMRFIMDKIPAVQRQTMLFSATMPKAIQALVQQFMKSPKIIKTMNNEMSDPQIEEFYTIVKELEKFDTFTNFLDVHQPELAIVFGRTKRRVDELTSALISKGYKAEGLHGDITQAKRLEVLKKFKNDQINILVATDVAARGLDISGVSHVYNFDIPQDTESYTHRIGRTGRAGKEGIAVTFVNPIEMDYIRQIEDANGRKMSALRPPHRKEVLQAREDDIKEKVENWMSKESESRLKRISTELLNEYNDVDLVAALLQELIEANDEVEVQLTFEKPLSRKGRNGKPSGSRNRNSKRGNPKFDSKSKRSKGYSSKKKSTKKFDRKEKSSGGSRPMKGRTFADHQK

SEQ ID NO: 91098 - protein, 374 aa, Methanothermobacter thermautotrophicus str. Delta H
MIMRKFASRVKDIQLSEIRKIFEVADEDTINLGIGEPDFSVPDHVREAVKDAVDEGLTHYTSNMGMEELREAIADKLKSENRVHAEPESIIVTVGASEAIFMCTQALLDIGDHALIPDPGFLSYDACVRLSGAVSIPVPLSMDEGFSMSPERVESLITQDTRVIIMNSPSNPTGSVMGKDDVKGIAEIAEDNDLIIISDEIYEKIIYDGKHYSPAQFTDNALIVNGFSKTYAMTGLRIGYVAGCEDIIEELLKVHQYNTACAPSISQYAALAAIRGPQNCVKDMVDEFRRRRDLMFRSLTDMGLECVLPGGAFYMFPYAGDSEEFTKLSLEAGVAVVPGSAFGNEGKGYIRMSYATSYELIEEAMERLKTVCGV

SEQ ID NO: 91099 - protein, 308 aa, Chlamydomonas incerta
MAKEEKNFMVDFLAGGLSAAVSKTAAAPIERVKLLIQNQDEMIKQGRLASPYKGIGECFVRTVREEGFGSLWRGNTANVIRYFPTQALNFAFKDKFKRMFGFNKDKEYWMWFAGNMASGGAAGAVSLSFVYSLDYARTRLANDAKSAKKGGGDRQFNGLVDVYRKTIASDGIAGLYRGFNISCVGIVVYRGLYFGMYDSLKPVVLVGNLANNFLAAFLLGWGITIGAGLASYPIDTIRRRMMMTSGSAVKYNSSFHCFQEIVKNEGMKSLFKGAGANILRAVAGAGVLAGYDQLQVILLGKKYGSGEA

SEQ ID NO: 91100 - protein, 301 aa, Zea mays
NLLTHSAIASANPRKGGNPSQLIPNPKPPIHPSPPHPLRAAMACSFAAATVVSSAPTPAARPLAVAPQSVSVSRSAAAAAARPLRLVASRSARATRLVARAGGVDDLPLVGNKAPDFEAEAVFDQEFINVKLSDYIGKKYVVLFFYPLDFTFVCPTEITAFSDRYEEFEKLNTEVLGVSIDSVFSHLAWVQTDRKSGGLGDLKYPLISDVTKSISKAFGVLIPDQGIALRGLFIIDKEGVIQHSTINNLAIGRSVDETMRTLQALQYVQENPDEVCPAGWKPGERSMKPDPKGSKEYFAAV

SEQ ID NO: 91101 - protein, 672 aa, Coprinopsis cinerea okayama7#130
MTEDEEDWEDYVKGGYHPVKIGDEFSDGRYVVVRKLGWGHFSTVWLARDTKMNRHVALKIVKSAPRYTETALDEIKLLQRLITSSTPPVAPTPENPNPPPSPSHTHPGKSHVIQFLDHFRHKGPNGTHVCMVFEVLGENLLGLIKRHQSKGVPMHLVKQIAKQILLGLDYMHRCCGVIHTDLKPENVLICIDDVENVILAELEASSAAASTPPTRLVGVPPSKGRGGNQTPRSESVFITGSQPLPSPSSSFGTSPMLDKWAFGMSRIEGDDNSNGIVEKKGLSTVKRAVSTDLVAEVNNVSLETQASYVGRMPGAPGPSLLTDTKPVPIPGAPSPEPPADGAPRSVMSVDQRSDSSSAIDLSEKITVKIADLGNATWVEHHFTDDIQTRQYRCPEVILGAKWGTSADIWSVACVLFELITGGDYLFDPASGSRYSKDDDHIAQIMELLGELPRSIAFSGKYSSEFFNRKGELRHINKLRYWPLDSVLHDKYLFPKHEADALAAFLLPMLRLHPDRRAKASELIHHNWLEGTVVQGEIDVIKRAEAEEAARKKAKADQQRQASQKHKRDDSKLVQAGGMQLLDEDEADAMKPIEAGAVVADGEAEGEQKDLKPVQQLQLQHQPPVLNPPPIPHGASGLTRTAPANVAKQVSPPPAANNRQPSAGKKTSKSGRS

SEQ ID NO: 91102 - protein, 594 aa, Populus trichocarpa
MGTLTYNFLVETFSRSFKRLIIWCILLYMIQCSSATSNKTGNHFYKWKVEYMYWSPDGIENVVMGINGQFPGPTIRARAGDIVHVQLTNKLHTEGVVIHWHGIRQKGTPWADGTASISQCVINPGETFDYRFTVDRAGTYFYHGHYGMQRSAGLYGSMIVDVAEGEKEPFHYDGEFDLLLSDWWHKSVHHQEVGLSSRPMRWINEPQALLINGRGQYGCSLAAHHGNSSFSQCNITGHEQWAPYILHVDPNKTYRIRIASTTALASLNLAIGNHKMMVVEADGNYLQPFETNDLDIYSGESYSVLLKTSQDSSQNYWISFGVRGREPHTPQALTILNYKTNSASKLPLSPPPVTPRWDDYAHSKAFSNKIKALDHKSIPKPSPTYHRRIVLLNTQNKMNGYTKWSINNVSLSIPATPYLGSIRFGLRDAFDQTKPPEDFPGHYDVMKPPVNPNTTTGSGVYMLGYYSTVDVILQNANALTENVSEIHPWHLHGHDFWVLGYGEGKFTKSDEKKFNLKNPPYRNTAVIFPYGWTALRFVADNPGVWAFHCHIEPHLHLGMGVVFAEGVQHVAKIPKEALSCGLTGKRFMTGSHLG

SEQ ID NO: 91103 - protein, 418 aa, Salmonella typhimurium
MTLLALGINHKTAPVSLRERVTFSPDTLDQALDSLLAQPMVQGGVVLSTCNRTELYLSVEEQDNLQEALIRWLCDYHNLNEDDLRNSLYWHQDNDAVSHLMRVASGLDSLVLGEPQILGQVKKAFADSQKGHLNASALRRMFQKSFSVAKRVRTETDIGASAVSVAFAACTLARQIFESLSTVTVLLVGAGETIELVARHLREHKVQKMIIANRTRERAQALADEVGAEVISLSDIDARLQDADIIISSTASPLPIIGKGMVERALKSRRNQPMLLVDIAVPRDVEPEVGKLANAYLYSVDDLQSIISHNLAQRQAAAVEAETIVEQEASEFMAWLRAQGASETIREYRSQSEQIRDELTTKALSALQQGGDAQAILQDLAWKLTNRLIHAPTKSLQQAARDGDDERLNILRDSLGLE

SEQ ID NO: 91104 - protein, 479 aa, Cryptococcus neoformans var. neoformans B-3501A
MASRNPVVTRRAATRSRNDENAAPQQSVRTKPSISHLGPASKTAAVNVSVAAGKKPVAVKVGAKRTALGGVVVNGKEETEAGKKPLKASGKTVTEARQPLASRQNNAQPTRPIAAIPHRSKATPANVYAPVEAPAKLTVEEDMQMEIDARRSQPVSNAADFATVDEELLDDESEEDDMEEEDEEDWLRMSEEEMVKAQEQLDVVQATFKDDVDMFDTTMVAEYADEIFEHMERLEESVMPNPRYMDFQTEIEWTMRTTLIDWLLQVHLRYHMLPETLWIAVNIVDRFLSTRVVSLVKLQLVGVTAMFIAAKYEEILAPSVEEFVYMTENGYTKDEILKGERIILQTLDFTISSYCSPYSWVRRISKADDYDVQTRTLSKFLMEVTLLDHRFLRCKPSMIAAIGMYLARKMLGGDWNDAFIYYSNFTESQLITGASLLCERLIEPDFESVYVYKKYANKKFLRASTFARDWALTNAANSS

SEQ ID NO: 91105 - protein, 322 aa, Heliobacillus mobilis
MRFLVTGGAGYIGSHTVLALQAAGHDVVILDNLTTGHAYLVPDGVPFYQGDVGDSSLLEKIFHDYPIDGVLHFAAKSLVGESMQDPGKYFLANTSQSAVLLSAMAKHKIPYFVLSSTAAVYGEPQDVPIPESHPIRPTNPYGLSKHLIEQMLPWFEKVHRMKWMALRYFNVAGADPQGRSGESHDPETHLIPNILKVAQGHRDFVSVFGNDYPTEDGTCIRDYIHVSDLADAHVLAIEALFSGKPSGVCNLGNGQGFSVLSVIESARRVTGHPIPVRIEPRRPGDPAVLVASNAKAVAELGWKPKFTDLSTIVETAWLWQHR

SEQ ID NO: 91106 - protein, 310 aa, Alteromonadales bacterium TW-7
MNTIYFMGECMVELRAMSAATLHQSFAGDVYNSAVYLKRCFPEVSTSVITALGQDNLSKKMRERFESEQLDTQYVFSHESKVPGMYYIETDEHGERSFIYWRSDSAAKKTVEFLNAECVDQLCQGDMFFFSGISLAIIDKTSREQFWKVLEQLKSAGVKIVFDPNYRARLWDSVEDTKAQYHLAFNLADVTLPGVEDLTTLYDVHSVEAVIEYLKPYQINEIVVKNGPESVITQQNNTLQSHTIIPVTTVVDTTSAGDAFNGVYLGARLSGKSIAAAVQLGAKAAGAVIQQPGAIAPKDVFQHVMVEAGI

SEQ ID NO: 91107 - protein, 445 aa, Populus trichocarpa
MTITIVSVKARQIFDSRGNPTVEADVTTSDGVLSRAAVPSGASTGVYEALELRDGGSDYLGKGVSKAVGNVNTIIGPALIGKDPTEQVAIDNLMVQQLDGTVNEWGWCKQKLGANAILAVSLAVCKAGAHAKGIPLYKHIANLAGNKNLVLPVPAFNVINGGSHAGNKLAMQEFMILPTGASSFKEAMKMGAEVYHHLKSVIKKKYGQDATNVGDEGGFAPNIQDNQEGLELLKTAIAKAGYTGKVVIGMDVAASEFYGADKTYDLNFKEENNDGSKKITGDALKDLYKSFVSEYPIVSIEDPFDQDDWEHYAKLTAEIGEKVQIVGDDLLVTNPKRVEKAIKEKACNALLLKVNQIGSVTESIEAVKMSKQAGWGVMASHRSGETEDTFIADLSVGLATGQIKTGAPCRSERLAKYNQILRIEEELGAEAVYAGANFRRPVEPY

SEQ ID NO: 91108 - protein, 254 aa, Streptococcus agalactiae 2603V/R
MDAKFDFAKQLVYKAGQFIKSEMQNTFDVEEKSRFDDLVTSLDKKTQKLLIQEIIQHYPDDNILAEEDDVRSPIAQGNVWVLDPIDGTVNFIVQKDNFAVMLAYYEEGVGQFGIIYDVMADILYSGGGHFDVYANDKKIVPFQECPLERCLLGVNSAMYAENDCGIAHLASETLGVRIYGGAGISMAKVMQGKLLAYFSYIQPWDYAAAKIMGETLGFTLLTLDGEEPNYSTRQKVMFLPKSKLNLIQSYLTKK

SEQ ID NO: 91109 - protein, 329 aa, Mesorhizobium loti MAFF303099
MARIVRFHQHGGPEVLGIEDIDLPPPAPGEVQIRVKALGLNRAEALLRAGSYIETPPLPSGLGLEAAGVVETVGEGVKDFVPGDAVSVIPPQSMVCWPAYGEVVAYPAGLIVKHPSSLDWQTAAAVWMQYLTAYGALIDIARLSSGDAVVITAASSSVGLAAIQIANKIGATAIAVTRTSVKKQALLDAGAAHVVVLAEEDLAARLSEIAGPQAVRVVLDAIGGPIFEPLTAAMSKGGILIEYGGLSVEPTPFPLAAVLGKTLTLRGYLVHEITGNPEKLEAAKAFILEGLETGTLRPIIDRTFALDQIVEAHRYLESNEQFGKIVVTV

SEQ ID NO: 91110 - protein, 475 aa, Oryza sativa Japonica Group
MATTPAPVSLSAAASTVPARLLVGRGAAAAPVARRRARMVVVRAKIREIFMPALSSTMTEGKIVSWSAAEGDRVAKGDAVVVVESDKADMDVETFHDGIVAAVLVPAGESAPVGAPIALLAESEDDLQAALAKAQELSKAHPQQAPPPSDAAAPPPPPPPPAAAPAAPAPVAAGTKGIATPQAKKLAKQHRVDLAKVAGTGPFGRITPADVEAAAGIEPKPKVVPAASAAPVPLSAPAIGAVPQAAELPPVPGATVVPFTGMQAAVSKNMVESLAVPAFRVGYPIVTDKLDELYEKVKSKGVTMTVLLAKAAAMALAQHPVVNASCRDGKSFTYNTNINIAVAVAIDGGLITPVLEDADKLDIYLLSQKWKELVKKARAKQLQPNEYSSGTFTLSNLGMFGVDRFDAILPPGQGGIMAVGASKPTVVADKDGFFSVKSKMLVNVTADHRIVYGADLAAFLQTFAKIIEDPESLTL

SEQ ID NO: 91111 - protein, 495 aa, Arabidopsis thaliana
MCFNNIETGDEVETERQVFGSSEEDEFRVEDTARNTNNVQISQQQQQPLAHVVKWERYLPVRSLKVLLVENDDSTRHIVTALLKNCSYEVTAVPDVLEAWRILEDEKSCIDLVLTEVDMPVHSGTGLLSKIMSHKTLKNIPVIMMSSHDSMVLVFKCLSNGAVDFLVKPIRKNELKNLWQHVWRRCHSSSGSGSESGIHDKKSVKPESTQGSENDASISDEHRNESGSSGGLSNQDGGSDNGSGTQSSWTKRASDTKSTSPSNQFPDAPNKKGTYENGCAHVNRLKEAEDQKEQIGTGSQTGMSMSKKAEEPGDLEKNAKYSVQALERNNDDTLNRSSGNSQVESKAPSSNREDLQSLEQTLKKTREDRDYKVGDRSVLRHSNLSAFSKYNNGATSAKKAPEENVESCSPHDSPIAKLLGSSSSSDNPLKQQSSGSDRWAQREAALMKFRLKRKERCFEKKVRYHSRKKLAEQRPHVKGQFIRKRDDHKSGSEDN

SEQ ID NO: 91112 - protein, 282 aa, Synechococcus sp. CC9311
MSSYSVIGCGYVGSFVAASMKNQGHYVVGTTRTSQRFAELRNVVNEPISLDLAQQDCDFSFLEDQHGLLISVAPTQNGDGYQGVFSNGIRNLARALRCRQSTHQLHVTYISSAGVYGDQQGELVTEDSPVDCLNPVNAMLVEAENVLLTIDRPDTSICVLRLGGIYGPGRDMVSMIKQAAGESIPKNGNDIPAWSGIFDITNGVSFAFNNQLVGIYNLVDDMQLSRRQLSNEICDIDGLPPVIWANENAPGARSMNAKVTNDKIKTKGFRLSSPSMLMPTLV

SEQ ID NO: 91113 - protein, 672 aa, Methanothermobacter thermautotrophicus str. Delta H
MRQYMRTFLLVAVIFVFGFSIRMLNAGYDDPLYTDDDGLQYFQESDSYYNYRLTENLAIRGIPGDAVIGGKIWDLHSYYPPGVPLDYPAGILLLAVILHAITGVIAPVSLRAVCLIMPPLLAPLAGVICFFTVKRFQGDIPAFIAGLLLVSAPFYLVKTVYGLYDTDMLILTLSMAVLFLFIEADAREVNRVPLSAIGGFILFLFSITWSGWQVMFYVTLVTFIILILTSGSRKPLRNILGNIPTGLHGSVYPFNLFNHLELIKLIMTPLHIHDLVDKSIWYPWPDSYTTVAELQPAYMDKVLGHISPALTVLGAAGIPAYYMLYRRKGSVGLPVIFISVWIATGALMLLEGIRFVMILIAPLSVSAGIFTGILLDCSRKFRFRWIKGVLFILIIFTVSAQLAISGNMVADLKPGYNDYFEESAHWIAENTPSDAVIITEWSYGHFYASEADRPVVYDGRLAYIETLPARGVWYGSSMDPEIPTTARDYWINLSLSSENRTLSLNILRMLANSGDDAYILLKNQTGSEVQAYRIMNEILGLNRESAMDVLMHRYGFSESEALRILNMTHPMTSRKIVVVVPEKMIGLIASKGDSGDMPAGTYSLIRLKDDVIEEEIINSSGNVTVLETTDGSYRINRKYRKSLLLELIMGVNDENFSLVYRNKQIKVYIINS

SEQ ID NO: 91114 - protein, 402 aa, Physcomitrella patens subsp. patens
MSIKDIDSKEYKGKTVFVRADLNVPLNDQLEITDDTRIRASLPTIQYLTKAGAKVVLASHLGRPKKGPEERFSLKPVAGRLTELLGQTVELAPDCIGDEVKSKIAGLKEGDVLLLENVRFYKEEEKNDIEFSKKLSENIDFFVLDAFGTAHRAHASTAGIADYVTSRLAGLLLEKELEYLSGVVQKPTKPFVAIVGGSKISSKITVIESLMNVCDKVILGGGMIFTFFRAEGKSVGSSLVEEDKIELAKNLAELAKKKGVELILPVDVIAADKFAPDANVQTCSASSIPDGWMGLDIGPDAIKQFQEALSDAKTVLWNGPMGVFEFEQFAKGTFAVAETMAELTSKGAITVVGGGDSVAAVEKAGLADKMSHVSTGGGASLELLEGKVLPGVAALDDVRIHA

SEQ ID NO: 91115 - protein, 539 aa, Candida glabrata CBS 138
MSRYQNSPAVTAANTAMAVNNLTNGGYPAMNANAPYNGTPSNRSSSNMTSRDDSTIVGLHYKIGKKIGEGSFGVLFEGTNMINGMPVAIKFEPRKTEAPQLKDEYRTYKIMAGTPNVPQAYYFGQEGLHNILVIDLLGPSLEDLFDWCGRKFSVKTVVQVAVQMITLIEDLHAHDLIYRDIKPDNFLIGRPGQPDENKIHLIDFGMAKQYRDPKTKQHIPYRERKSLSGTARYMSINTHLGREQSRRDDMEALGHVFFYFLRGQLPWQGLKAPNNKQKYEKIGEKKRTTNVYDLSNGYPVQFGRYLEIVRSLSFEETPDYQGYRKLLLSVLDDMNDSADGTYDWMKLNGGRGWDLTINKKPNLHGYGHPNPPNDKRRHKNKMTNPLQQLAGQQQGQYPDQTHHNQIQSHQAGIGGNADNANQMQNKRNLDPTSYEAYQQQLQHKYNQQTQRQQRQQPPAMQGQRVQDNGGLRNYNNAQAQDLQGNRYRQQQEPMVQPPNNPAQATPNNRQQFQQHTEQVEQDYTTTSSEKGFFQKLGCC

SEQ ID NO: 91116 - protein, 465 aa, Synechococcus sp. CC9311
MEAAVFPRTQLRFRNDALLRNLGVEPDRVSDQDFESAYGRFEERVPLLALRYHGYQFGTYNPQLGDGRGFLYGQLRDRTGQLQDLGSKGSGTTPWSRGGDGRLTLKGGVREVIASEALHRLGVTTSRTLSLIETGEELWRGDEPSPTRSAVMVRMARTHLRFGSCERLLYLRDPQGLERLLRHVVAVYYPDVAATHPAPDGDRLALEHQLLAFYGELVDRVARLAAEWMTAGFVHGVLNTDNMSLAGESFDYGPFAFLDRWDPSFTAAYFDQTSLYSYGRQPAICRKNLQLLQNPLAMLLPRPPMEQSLERYTSSYQNHYRYCLLRRMGLTPNPDVKSDEHLVSATLELIASWPVGYGDFFAGLSSVVQSAGLPQEPEGLPVVLNNLPAPPREVWQNWRDAWWWQTQAIEPSGASELEASVSEGLRRWNLSQTPTRPLIESLWEAIDQGDDWQPLGGWLASVMTV

SEQ ID NO: 91117 - protein, 346 aa, Synechococcus sp. CC9311
MSQVSLRPILVTGAAGFIGAALCERLLQRGDRVIGIDNLNDYYDPALKQARLARIETLAVSTAGAWSFHRLALEDGDALLKLFAAEQPRVVVNLAAQAGVRYSLENPAAYIQSNLVGFGHILEGCRHHGVDNLVYASSSSVYGGNRNLPFHEQQAVNHPVSLYAASKKANELMAHTYSHLYGLPATGLRFFTVYGPWGRPDMAPMLFARAILAGEPIKVFNHGKMQRDFTYIDDIVEGVLRCCDQPATSNLDFDPMQPDPATAAAPHRVFNIGNSQPTELLRFIEVMEQALGREAIKDFQPMQPGDVVATAANTEALETWVGFKPSTPIEEGIQRFADWYRKFYQP

SEQ ID NO: 91118 - protein, 228 aa, Erythrobacter sp. SD-21
MASDLPEKVTLMRDGSEIAGHSFDCIVAAVKPQMFDDVMPSYSDNLADDGYIISIAAGYSAARLSQLMGGKPVVRVMPNLPAAVGRGVSGIVAGPHATDAHMTHAVEFMERAGKVVTVDSEEKLDRVTAVAGSGPGYVFEIARAYAEAAMAQGFSEEEAREMVLGTIGGAIAMASEPGAPSLEELRNSVTSKGGTTAAGLNALNGDNGLTDRMHATLQACYDRAVELR

SEQ ID NO: 91119 - protein, 678 aa, Physcomitrella patens subsp. patens
VSVPETSKWNMERPHLTGRRLCQVQSFIISTFAECNIYMPIKTCSSSEDESMSLSQILHGQELLIVEELLAAMVGIGGDYICVQKNQEHCYCFVFHVDPKLNHSLHELADRILPICENYMVVSQFAEERSHYDHGLTNHAFAAGLRAILQDYHAMVAQLEHQFRLSRLSLPGLWFFVQPMMGAMQCLSSVSQAAAMQSARGAVLLNLLHNQGIALAGDVAVRTLLQKLTHAASFPYFRILERWVYEGVIDDPFGEFLIEENKCLEKESLSQDYYATFWLKRYSLRKDIPEFLSSHAEIILTTGKYLNAIRECGQCLQGPSLEDLRVANFTSTRPYLERVNVAHRYASAELLNLIEGQFDLAGRLRSVKHYFFVDKGDFLVIFMDSAKDELAKRPAALSRERLQSLLELAIKTSVAASDPYHDDLTCIIVTTTTMLIAQSETCNTGGVATGGLTGIDFFVLDYKVRWPTSLVLSRRALTKYQFIFRHLFHCKHVWRQLCASWQIHQIATRAYNITGTSLCRSYVVCQRMLHFIQSFEHYMTFEVLETNWDRLHSSLSGLNSVDEVMQQHESFLDSCLRQCMFFWPMIFEKVDHLQSLCLQYATATLRFLPMLFTKDTYTDESSCVVDPQQSMLDEDPSSERQCKGRLRKQYKLDNRRARQAADDKTFKNCIGYVDCWDW

SEQ ID NO: 91120 - protein, 302 aa, Glycine max
MSMAKKPVKYSLVDAFTESVFKGNPAAVCFLEEKRDKKWLQGVAAEFNLSVTCYLTRITESHGTTSYPRFDLRWFTPVSEINLCGHATLAAAHTIFSSGLVDTDVVEFVAISGILTAKKIPAINITSASDLQKGEAQDGFYIELDFPVDPVTEFSFDESTSLLSEALNGASIIDVKRTQIGDDLLVELTSVKAVSELQPKLDAIVRCPGRGVIVSAIAPPGSGFDFYSRFFCPKLGINEDPVCGSAHCALASYWSNKLGKFDLNAYQASSRGGVLNIHLDEKIQRVLLRGKAVTVMEGCVLV

SEQ ID NO: 91121 - protein, 272 aa, Xylella fastidiosa Temecula1
MAGTSAVITIPSDLHESVIAIATDSGRAIMKIYQDHFKVQIKADMSPLTQADLISHQIIVHGLKQLTPSLPVLSEESTGITWEERRHWKSYWLVDPLDGTREFVKRNGEFCINIALIHEGIPVYGMILAPVEGTIWHAMHGGQAFRRDGHRDTTLHVRAPAGTALQVAASRSHIDVHTSALLAQMKEITLVSQGSALKFCRLAEGTLDVYPRLGATYEWDTAAGQCLLLAAGGTLLNIETGKPFRYNKRETLLNGGFIALGDATLPWRDWLP

SEQ ID NO: 91122 - protein, 569 aa, Oryza sativa Indica Group
MAMQVGESVAPLSPQTIGNAFVQQYYNVLHSSPGQVCKFYHDSSTLGRPDSNGTMTSVTTLTAINDEFLSTDFSSCLIKLENVDAQLSLNGGVHILVTGSIGHNGTMRHRFSQSFFLAPQESGGYFVLNDMLRYDSLQETLLTETNDSPQERLLTEINDSLPNHVDDNTHSVTFTSEPETSGNVNETADLELPSAENVNDNVENLPANDSSPEENVLVEACTEVVSSCAENIPAAAPAPAPRASTQKDVTKQSYASVVKVTKEGTPTPPVAKPKPKPKPKPTAKVTDNVEKAVSSPVKPTNAADTTSPNDKNVLVEQGYSVYVKHLPYECTAKDVEEKFRKFGAIRPGGIQVRHRQPDGFCFGFVEFESRQSMLAAIEASPVSIGSKASIVEEKRTTTRVVNGVTHIENNGNAWGGRFQQDNRGGGYRGDNFRGREAGFVNNGNYRDGDNLRNRFRNQNEYSGRGRGPQGNGYHQNGNGGGYHQNGNGYHQNGDGYHQNGNRYNQNGNRYHQNGDEYYQNGNGNGHRQNGSGYYHQNGNGYRQDRIFHNGNGNGRPARFNGPRQTPVQA

SEQ ID NO: 91123 - protein, 321 aa, Alteromonadales bacterium TW-7
MKRLNTVLKEDGVRTDLILLIRTILATSKEIAFRVGQGELAGVLGSTMNENIQGEVQKKLDIIANQLLKDILLDDSSVRTVASEEEDHAVGGHPEGTFIVAFDPLDGSSNIDVNGQIGTIFTIYLARDDVPFDSDEQFNQPGVSQVCAGYVLYGPSSLLVMTTGGPTRCYTLDSTHGGYLLTNPQLQIPSQSREFAVNMANYRYWDEPTQVYFDKLLYTSESFEKSSIRWNAAMVGDVHRILCRGGLFLYPQDKRVGNDNGKIRLLYEANPLAMLVENAGGKATSRGARILDITPDDLHQRVPVTLGSIEPVDYFNNSAPS

SEQ ID NO: 91124 - protein, 387 aa, Methanosarcina thermophila
MATTRDYYEILGLSRDATPEDIKKSYRKLALKYHPDRNKEPGAEEKFKEISEAYAVLSDPEKRAQYDRFGHAGINGQYTAEDIFRGADFSGFGDIFEMFFGGSRRGPRGPRRGSDLQYDLYITFEEAAFGVRKDIDVPRTERCSNCSGTGARPGTSPKRCPTCGGTGQIRTTRTGLGMQFVSTTTCSTCRGKGQVIESPCPVCSGTGRVRNTRKITVNVPAGADSGMSLRLSGEGDAGDPGAPPGDLYVVLHVMEHKIFKRVDYDVISEVPISFAQAALGTDIMVDTLYGKVKMNIPAGTPTHSVFKIKEKGIQHLHGNRRGDQLVRVVIKTPTNLSHEQKRNFFASLKALSSGKNPGGEKGRYDKFTEKSKKSKGFFEKVKDAFES

SEQ ID NO: 91125 - protein, 358 aa, Cryptococcus neoformans var. neoformans B-3501A
MGGCMSSPTTGDPVAEARSKEIDRALKEDEKRMAKEVKLLLLGAGASGKSTILKQMRLIHDKPFESNEVEDYRKLTFSNIVGGMRAIIDVMDELGLAVQPENRRYISLVDAEPPINTNEPYPIKYLTALKSLWADQNVQECYKRGNEFALAENMPYFYADLDRLFAQDFKPSSDDILRVRSKTTGITETRFPIHDVVFRLFDVGGQRSERRKWASCFEDVTAILFLVALSDYNSCLIEDRESNGMQEALMLFDSICNSQWFTKSSIILFLNKADLLQAKIQDPSQQIQEYFPEFEGEPYSFQDAVDFFKIKFRSLNRTSKKEIYCHVTTAVDRQNVKVVMTACQDTILKNALRDMAIL

SEQ ID NO: 91126 - protein, 465 aa, Canavalia lineata
MASSVLSGANQSSPSSTVLNTHLKGKPRLGDNALRFSGNKGGSNAFSSRSRGRISMAVADNVSRFEGIPMAPPDPILGVSEAFRADNSDVKLNLGVGAYRTEELQPYVLNVVKKAENLMLERGQNKEYVPIEGLAAFNKATAELLLGADNPAIKQQRVATVQGLSGTGSLRLGAAVIERYFPGAKVLISSPTWGNHKNIFNDARVPWSEYRYYDPKTVGLDFEGMIEDIKSAPEGTFVLLHGCAHNPTGIDPTPEQWEKIADVIEEKNHRPFFDVAYQGFASGSLDEDAASVRLLVARGIELFIADSYPKDVGLYAQRIGAINVISSSPESAARDTSQLKRIARPMYSNPPVHGARIVADLVSKPQLFDEWKAEMEMMAGRIKNVRQLLYDPISSKDKSGKDWSFILKQIGMFSFTGLNKEQSDNMTNKWHVLMTKDGRISPAGLSLAKCEYLADAIIDSYHNVS

SEQ ID NO: 91127 - protein, 550 aa, Cryptococcus neoformans var. neoformans JEC21
MEGFDLPMSFGKKSKAGNSNLKAKVENTKRADIPTPVKEEKPEEEVPGPSISTSGRKTEAEEEDDEEIGPIPPSATGKRKAEENDASDDEQEAEEEVDRLPISHEIILKDHTKVVSALAVDPSGARIATGSHDYDTKLWDFGGMDHRLKPFKSFEANGNYYVHDLSYSPDGQQLLVISGTVHPKVFNRNGEDEMEFNKGDVYLRDMKNTNGHTAEINAGAWHPTDKSIFLTCSNDSTLRIWDTSNKRKQKQVIVVKSKERGARTKVTACAWSPDGKWIAGVCLDGTLHIWDTSSNFARPKYSCENAHPKNTETTGVAFSRDGLRVATRGGDDTVKLWDIRSIRNPLAVAKNLDNLYPETNIIFSPDDTQILTGTAAPKGQKGGLVFLNSKDLKEERRIAIGDGSVVRVLWHSRINQIFATLSTGGVHVLYSPNSSIHGALLPLAKLPKTAPRDPSFSTVDLKPVIYTPDALPMYQEQGHRESLHQKEKKAKKMKPMEPVSGVGRAGRLGASETQSFVHSMYPETLKFEDPREALLKYASKEEQEKKKQEM

SEQ ID NO: 91128 - protein, 175 aa, Triticum aestivum
MAPTVMASSATSVAPFQGLKSTAGLPVSRRSNGASLGSVSNGGRIRCMQLWPIEGIKKCDTLSYLPPLSTEALLKQVDYLIRSKWVPCLEFSKVGFIFREHNASPGYYDGRYWTMWKLPMFGCTDATQVINDVDEVKKEYPDAYVRIIGFDNMRHVQCVRFIAFKPPGCDESGKA

SEQ ID NO: 91129 - protein, 201 aa, Rickettsia sibirica 246
MSYVPIVIEPTSRGERAYDIYSRLLKERIIFVCSTVEDHMANLIVAQLLFLEAENPKKDIYMYINSPGGVVTAGLAIYDTMQYIKPKVATLCIGQACSMGSLLLCGGEKGMRYSLPHSRIMIHQPSGGYKGQATDIEIHAQETLKIKRLLNELYSKHTEQELKHIEKSMERDNFMSPEEAKKFGLVDNIMSSRDAMALLAK

SEQ ID NO: 91130 - protein, 731 aa, Oryza sativa Japonica Group
MNSQKKRSPKIEPFRHRVDADPKSFDKSWKKLEDAIREIYNHNASGLSFEELYRTAYNLVLHKHGLKLYDKLTENLKGHLKEMCRSIEDAQGSLFLEELQRRWADHNKALQMIRDILMYMDRTFIATNKKTPVFDLGLELWRDIVVRTPKIHGRLLDTLLELIHRERMGEMINRGLMRSTTKMLMDLGSSVYHDDFEKPFLEVSASFYSGESQQFIECCDCGEYLKKAERRLAEELERVSQYMDAKTADKITSVVDTEMLANHMQRLILMENSGLVNMLVDDKHEDLSRMYNLFKRVPDGHSTIRSVMASHVKESGKALVSDPEKIKDPVEFVQRLLNEKDKYDEIISISFSNDKAFQNALNSSFENFINLNNRSPEFISLFVDDKLRKGVKGANEEDVETVLDKVMMLFRYLQEKDVFEKYYKQHLAKRLLSGKTTSDEAERSMLVKLKTECGYQFTSKLEGMFNDLKTSHDTMQSFYANLSGDTDSPTISVQILTTGSWPTQPCTPCKLPPEIVDISEKFRAFYLGTHNGRRLTWQTNMGNADIKATFGGRRHELNVSTYQMCVLMLFNSADGLTYGDIEQATGIPHADLKRCLQSLACVKGKNVLRKEPMSKDISEDDTFYYNDKFTSKLVKVKIGTVVAQKETEPEKLETRQRVEEDRKPQIEAAIVRIMKSRRVLDHNSIITEVTKQLQSRFLPNPVVIKKRIESLIEREFLERDKVDRKMYRYLA

SEQ ID NO: 91131 - protein, 310 aa, Streptomyces coelicolor A3(2)
MTGWSTGDIPDLDGRVAVVTGANGGLGYVIARELARKGATVVLACRSEERGSAAVRRLMGEVPAAAVEPARLDLGDLASVREFAYGLPYERVDLLVNNAGVMALPHGTTVDGFETQFGVNHLGHFALTGLLLPSLLAAPGARIVTVSSVLHALARVDPRDLNSVRRYGRWTAYARSKSANLLFTHELARRLAGREGASDVRAVAAHPGYAETGLHGAGPRAEGRRLAERLARLGSRVVAQSPEAGALPVLYAATAPGVPSDSFTGPSFAMWRGTPAPSWRASWTIDDAMGERLWAASERLTGVIYEALLP

SEQ ID NO: 91132 - protein, 436 aa, Mesorhizobium loti MAFF303099
MHVSQSSPYQANADSTASEQALLERRARLLGPTYRAFYRNPIHLVRGSGVWLYDATGRKFLDAYNNVASVGHCHPRVVEALSGQAATLNTHTRYLSEIILDYAEKLLGTVPSHLGHAMFTCTGSEANDLAIRIAQHSSGGTGVIITDFAYHGATIATAQLSPAAVGAKGVPVHHRTVAAPDTFRDHGRAAKDFAKNVAAAIEDMRAQNIRPAALLLDSAFSSDGIFFPDAAVMREAGDHVRKAGGIVIADEVQSGFGRLGQGMWGFANYGLEPDIVTMGKPIGDGHPMGAVLVRPRLVSSFGSNTGYFNTFGGNPVAAAVGIAVLDVIEGEGLIENARNVGAYTADLLRALQGRHGMVGDVRHNGLYFGVELTADGGEALAASKTSSVVEAMREDGVLISSCGPRGNVLKIRPPLPFARDNAEQLAETLDRALSNW

SEQ ID NO: 91133 - protein, 149 aa, Zea mays
MEDMPKIRKPNAQWDPTAAKIFNDICVEQVLAKNRPQGCLNIKGYANLVTKFNEQTGRNYTRVQMKNRWDALKSEFIAWKTLLLSASGLGRDPRTGSIVASNEWCEEKIKAMPQAKKFRLAPLENEEDLEIMFSSASCTNVYVMAPRCK

SEQ ID NO: 91134 - protein, 909 aa, Streptomyces coelicolor A3(2)
MSENKDPQVANAAKFVYDFTEGNKDLKDLLGGKGANLAEMTNLGLPVPPGFTITTEACKTYLDSGEEPAALRDEVSAHLDALEATMGKKLGQADDPLLVSVRSGAKFSMPGMMDTVLNIGLSDKSVQGLAKQAGDDRFAWDSYRRLIQMFGKTVLGVDGDLFEEALEAAKTAKKVAVDTELEAADLKKLVTKFKKIVKTEAGRDFPQDPREQMDLAIKAVFESWNGERAKLYRRQERIPHDLGTAVNVCSMVFGNLGPDSGTGVAFTRDPASGHQGVYGDYLQNAQGEDVVAGIRNTVALADLEQIDKKSYDQLMQIMETLENHYLDLCDIEFTIERGQLWMLQTRVGKRTAGAAFRIATQLVDQGLIDEAEALQRVNGAQLAQLMFPRFDDEAKVEKVGRGIAASPGAAVGKAVFDSYTAVKWSRSGEKVILVRRETNPDDLDGMIAAEGILTSRGGKTSHAAVVARGMGKTCVCGAEELEVDTKRRRMTVPGGHVVEEGDVISIDGSSGKVYLGEVPVVPSPVVEYFEGRMHAGAEDADELVEAVHRIMAFADRKRRLRVRANADNAEDALRARRFGAQGIGLCRTEHMFLGDRRELVERLILADTEAVREESLKELLPLQKQDFVQLFESMDGLPVTVRLLDPPLHEFLPDITELSVRVALAESRQEPHENELRLLQAVHRLHEQNPMLGLRGVRLGLVIPGLFTMQVRAIAEAAAERKAAKGDPRAEIMIPLVGTVQELEIVREEADQVIAEVEAATGAKLKLSIGTMIELPRAALTAGQIAEAAEFFSFGTNDLTQTVWGFSRDDVEASFFTAYLEKGIFGVSPFETIDKDGVGSLVAAAAKAGRATRPDLKLGVCGEHGGDPESVHFFHEVGLDYVSCSPFRIPVARLEAGRAASRSKGSDHR

SEQ ID NO: 91135 - protein, 863 aa, Arabidopsis thaliana
MSRTRTAASEAHDSMESEERVDLDGDNDPEEILEEEVEYEEVEEEEEIEEIEEEIEEEVEVEEEEEEEDAVATEEEEEKKRHVELLALPPHGSEVYLGGIPTDATEGDLKGFCGSIGEVTEVRIMREKDSGDGKGYAFVTFRSKDLAAEAIDTLNNTDFRGKRIKCSTTQAKHRLFLGNVPRNWMESDIKKAANRIGPGVQIVELPKEPQNMGRNRGFAFIEYYNHACAEYSKQKMSNPSFKLDDNAPTVSWAESRSGGGGDSSASQVKALYIKNLPRDITQERLKALFEHHGKILKVVIPPAKPGKEDSRYGFVHYAERTSVMRALKNTERYEIDGHMLDCTLAKPQADQKTNTNTVQNVQKSQLQPNYPPLLSYGMAPSPFGALGGFGASAYSQPLMHAGGHAAGGMSMMPIMLPDGRIGYVLQQPGLAAMPQPPPRHSPPYRGGSGSSSSSGSKRSSDNERLKYDYNTGKANAITTMRNQGFTKEDRMNQLPEDLILRILSFLPTELVIATSVLSKQWRSLWKLVPNLEFDSDDYEINPVDIGLWIGIAFARHLRELVLYVAPKQTFTFPSSLCICNTLETLKLILGIHVDIPCPVLLKSLRTLHLDSVSYKDEESIRNLLSSCPILENLVVYEYWYNVVNFDIEVPSLKRLEICDVLHKKEFRRYTINVPCLKYLRIEGLNKDFELCLNAPELVEAYFTKGSLIIADKFLGSLKSAKRLSLDILALKMHTRREEWWNLLTVMLDSSPKLQVLKLIDHTQDVSKDNVVSEKWNEPKYVPECLLSHLETFVWIRYDWEREEEKEVATYILRNARWLKKGTISTNPIESKDLEKLEERRKMLNELDSVVRASNSCNLVFEFE

SEQ ID NO: 91136 - protein, 332 aa, Bacillus anthracis str. A2012
  misc_feature (328)..(328): Xaa can be any naturally occurring amino acid
MNPLIFKENRPFDLIAVGRLCVDLNANETQRPMEETRTFTKYVGGSPANIAIGAARLGLQTGFIGKVSDDQMGRFITGYLKDNKINTDQIPIDCTGAVTGLAFTEIKSPEDCSILMYRDNVADLNLDPTEVSEDYIKQSKALLISGTALAKSPSREAVFLALEYARKHDVVVFFDVDYRPYTWQSEAETAVYYNLAAEKSDVIIGTREEFDMMEKLLNYEKSNDQVTAERWFSHHAKIVVIKHGGDGSIAYTRDGQSHRGGIFKTKVLKTFGAGDSYASAFIYGLMQGLEIPQAMRLGGASASIVISKHSCSDAMPTRAEISAFMETXEELV

SEQ ID NO: 91137 - protein, 489 aa, Bacillus anthracis str. A2012
MNMTVQTAQIVKNYIGGEWVESISTKMEAVYNPATGEVIAQVPLSTKVDVEQAVLAANEAFKSWSKTAVPRRARILFKYQQLLVDNWEELAKLITIENGKSYNEAYGEVLRGIECVEFAAGAPTLMMGKQLPDIATGIESGMYRYPIGVIGGITPFNFPMMVPCWMFPLAIACGNTFVLKPSERTPLLAARLAELAEEAGLPKGVLNIVNGAHDVVNGLLEHKLVKAISFVGSQPVAEYVYKKGTENLKRVQALAGAKNHSIVLNDANLELATKQIISAAFGSAGERCMAASVVTVEEEIADQLVERLVAEANKIVIGNGLDEDVFLGPVIRDNHKERTIGYIDSGVEQGATLVRDGREDTAVKGAGYFVGPTIFDHVTKEMKIWQDEIFAPVLSIVRVKSLDEAIEIANESRFANGACIYTDSGASVRQFRETIESGMLGVNVGVPAPMAFFPFSGWKDSFYGDLHANGTDGVEFYTRKKMLTSRWEK

SEQ ID NO: 91138 - protein, 517 aa, Rhodospirillum rubrum ATCC 11170
MAISKTLVDELEKRRAIALEGGGADKAAARHAKGRLTARERLMALYSPGTFQEFGLHALHNTRHFGMENKPIPADGVIVGTGFVDGRPVAGFSQDFTVAGGSLGEIHARKICHTLDHAVKAGIPVVGFQDSGGARIQEGVGALSAYGQVFYRNVQLSGVVPQIAVIAGPCAGGAAYSPALMDFVIMTRENAQMFICGPEVIRAVTGQSTTVDEIGSAQVHASVSGNIHFIAESDDHAVAIAHRLLSFLPSNNMSDPPHTIEPDLSIDDDPGFDDLLPADSKTPFDVREVILRLSDGGDFMEVMADFAANIVIGFGRIGGVVVGYVANQPLVKAGTLDIDASDKAARFVRFCNIFNIPLVTLVDVPGFLPGVMEERRGIIRHGAKMLFAYASATVPKITVILRKAYGGAYLAMCSQDMGADRVLAWPSAEIAVMGAEGAVSILYNKELAQAEDRQARARELADDYRAEFASPYLSAGMLFVSDIIQPRQTRSAVALTLRGLLSKRETRPPKKHGNIPL

SEQ ID NO: 91139 - protein, 162 aa, Oryza sativa Japonica Group
MEAAVPSRVALSASRLSNHHHHAVGGERYAIYRGRCPNPAIPMALAAAAAPGKGGGVLDRPIEKVTPGRQSEFDVRKSRKMTPPYRVLLHNDNYNRREYVVQVLMKVIPGMTVDNAVNIMQEAHVNGLSVVIICSQSEAEEHCTSLRGNGLRSSIEPASGGC

SEQ ID NO: 91140 - protein, 510 aa, Rhodospirillum rubrum ATCC 11170
MHEIIRQLDAKRAAARLGGGQRRIDSQHKKGKLIARERIDLLLDSGSFEEWDMFVEHRCHDFGMADSKIPGDGVVTGHGTVNGRLVFVFSQDFTVLGGSLSETHAAKICKIMDQALKVGAPVIGLNDSGGARIQEGVASLAGYAEVFQRNVLSSGVIPQISLIMGPCAGGAVYSPAMTDFIFMVEDSAYMFVTGPEVVKTVTHEQVTAEELGGAISHTTKSGVADLSFENDVEALLQLRRFIDFLPSSNREKPPVRPTDDPWDRYDFSLDTLIPDNPNKPYDMKELITKVVDEGDFFEIAPKYAGNIITGFGRLEGSTVGFVANQPMVLAGCLDIASACKAARFVRFCDAFNIPIVTFVDVPGFLPGTSQEYGGIIKHGAKLLYAFAEATVPKVTLITRKAYGGAYDVMSSKHLRGDINYAWPTAEIAVMGPKGAVEIIFRQDMDDPAKIADRTEEYRELFANPFVAGSRGFIDEVIMPHGTRKRISRALAMLRNKTLENPWRKHGNIPL

SEQ ID NO: 91141 - protein, 645 aa, Rhodospirillum rubrum ATCC 11170
MTSRPITPLLDTIRGPSDTRGLSVAQLEQLAREVRAEMIDAVSVTGGHLGSGLGVVELTVALHHVFDTPDDRIIWDVGHQCYPHKILTGRRDRIRTLRQGGGLSGFTLREESPYDPFGAGHSSTSISAGLGMAIGSALAGDARDVVAVIGDGSMSAGMAYEAMNNAGAAKSRLIVILNDNDMSIAPPVGAMSAYLSRLLSSKSWLSIRTLAKEIVARLPDALERTAKRAEEYARGMVTGGGTLFEELGFYYVGPIDGHRMDHLVPVLRNVREAGRDGPVLIHVVTQKGKGYAPAENAPDKYHGVSRFNVVTGVQEKAKPQAPSYTAVFGKQLVAAAAKDHRIVGVTAAMPGGTGLDKLATAYPQRCFDVGIAEQHAVTFAAGLACEGLKPFVALYSSFLQRGYDQVVHDVVLQKLPVRFAIDRAGFVGADGATHGGVFDMAFLGCLPNLVVMCAADEAELARMVVTAAGHDSGPIALRYPRGEGVGVEIPEDPQPLAIGKGRIVREGKGVALLSIGTRLQSCLEACEILAARGLTPTVADARFLKPFDEELVADLAARHEVLIVVEEGAIGGFGAHVATWLTNQGLLDGGLKLRALHIPDRFFEHDAPEVQCAKAGIDAQAITTAVLDALKLETSATIDAGALKA

SEQ ID NO: 91142 - protein, 412 aa, Physcomitrella patens subsp. patens
MCMFVLLMLLLLLLVGFNWESWKSSCWYDVMGETAEDLAAAGITDVWFPPSSHSVSPQGYMPGRLYDLNDCKYGNEEKLRETIEKFHRVGVRCIADIVVNHRCGEEQDERGEWVIFEGGTPDDALDWGPWAIVGDDYPYGNGTGAPDTGDDFEAAPDIDHTNDIVQSDLIVWMNWMKFKIGFDGWRFDFAKGYGGYFVGRYIRKTEPQFAVGEFWTSLNYGHDGLEYNQDSHRQQLVDWIHATKERSTAFDFTTKGILQEAVKGQLWRLRDPNSKPPGLIGYWPSKAVTFLDNHDTGSTQGHWPFPGEHIMQGYAYILTHPGNPCIFYDHFYDWGLKEEIKTLIDVRKRNDINAKSKVHICCAEHDLYVAKIDDRVILKMGPRYDIGDLAPNCDEYKIAAVGKDYCVWEKCT

SEQ ID NO: 91143 - protein, 295 aa, Glycine max
  misc_feature (61)..(61): Xaa can be any naturally occurring amino acid
MGGGGAMRSAAAKIAGIGISKAALRPSALPTEQAVHNASRPTSVVGVKGAKSTEVASLPLXSPWDDWDLADDGDLVVPRMVFGSVPTFAEAKEATAELKDAIDQVYLSPESSQYSSRGGQVSALSPTGGQVSALSPTLYEPVNRSCVVDAISDSSAPKHAIQAFHLLSTSRDGVSSQNYSIRNREIFKCLLNEVLGSFIELIDSIHLFLVSTRLLWLHLLVTQMYGMQSWKILPSVVSSNHNSQWLILEQQEILRNWISSQVVLLKQLNPLKNWECQLSLTREMGFSISWIFYRM

SEQ ID NO: 91144 - protein, 473 aa, Synechococcus sp. RS9917
MAKTAQDVLRQIKDDGIELIDLKFTDLHGKWQHLTVCADMVDDQAFSEGLAFDGSSIRGWKAINASDMAMVPDPNTAWIDPFYRHKTLSLICSIQDPRTGEPYDRCPRALAQKALAYLAGTGLADTAFFGPEPEFFLFDDVRYSSSEGGCFYSVDTIEAPWNSGRLEEGGNLAYKIQLKEGYFPVAPNDTAQDIRSEMLLMMGQLGIPIEKHHHEVAGAGQHELGMKFAELIQAADNVMTYKYVVRNVAKKYGKTATFMPKPVFNDNGSGMHVHQSLWKGGQPLFFGEGTYANLSQTARWYIGGILRHAPSFLAFTNPTTNSYKRLVPGFEAPVNLVYSEGNRSAAVRIPLTGPNPKAKRLEFRSGDALANPYLAFTAMMMAGIDGIKNQIDPGDGTDVDLFELPADELAQIATVPASLNGALEALNADKHYLMEGGVFSEDFINNWIDIKYEEVQQLRQRPHPHEFVMYYDA

SEQ ID NO: 91145 - protein, 397 aa, Synechococcus sp. RS9917
MQALATSLSQRPVDSSHRQALAPIATPDRLLLGPGPSNAHPTVLQALSRTPIGHLDPLYVELMSEVQELLRYAWQTDNRLTLPMSGTGSAAMEATLANTVEPGDTVLVAVKGYFGHRLADMAGRYRADVRVIERPWGEAFSLEELEAALIEHRPAILAMVHAETSTGICQPMEGVGDLCRKHDCLLLLDTVTSLGGVPLFLDAWKVDLAYSCSQKGLSCPPGLGPFTMGPRAEAKLASRSSKVPNWYLDVSLLNQYWGSDRVYHHTAPVNMNFGMREALRLLAEEGLEQAWARHRRNAEALWAGLERLGLVLHAPEALRLPTLTTVRIPEGVDGKAFSQHLLNTHGIEVGGGLGTLAGKIWRIGLMGYNSNPENVDRLLNLFETELPRFKSVAAAVV

SEQ ID NO: 91146 - protein, 531 aa, Nocardia farcinica IFM 10152
MTITQDVGNRAAHQALTAELRERLAAAALGGPEKARERHVARGKLLPRQRVDQLLDPGSPFLELSPLAATGMYGDECPGAGIITGIGRVSGRECVIVANDATVKGGTYYPMTVKKHLRAQEVALQNNLPCIYLVDSGGAFLPRQDEVFPDREHFGRIFYNQATMSAAGIAQIAAVLGSCTAGGAYVPAMSDEAVIVRNQGTIFLGGPPLVKAATGEVVTAEELGGGELHSRTSGVTDHLAEDDQDALRIVRRIVATLGPRPQAPWEVLPTIEPAAPTEELYDVVPVDLRTPYDVREVIERLVDGAPGGESGFHEFKAEYGKTLVTGFARIHGHPVGIVANNGVLFAESAMKGAHFIELCDKRSIPLLFLQNITGFMVGRDYEAGGIAKHGAKMVTAVACARVPKLTVVIGGSYGAGNYSMCGRAYSPRFLWMWPNARISVMGGEQAASVLATVRGDQLDSSGNPWSAEDEEKFKAPIREQYEHQGNPYYSTARLWDDGVIDPADTRTVLGLALSVCGQAPLEPVSYGVFRM

SEQ ID NO: 91147 - protein, 302 aa, Oryza sativa Japonica Group
MSQLEVVEMEDKKQQQQQQREEAEAEAPVVPSSLRAAATCRSLSSLSSSLRWDHRGDDDEEEAELRWAAIERLPTLDRMRTSVLSSEAVDVRRLGAAQRRVLVERLVADIQRDNLRLLRKQRRRMERVGVRQPTVEVRWRNVRVEADCQVVSGKPLPTLLNTVLATARGLSRRPHARIPILNDVTGILKPSRLTLLLGPPGCGKTTLLLALAGKLDKNLKVTGEVEYNGANLNTFVPEKTSAYISQYDLHVPEMTVRETLDFSARFQGVGTRAEIMKEVIRREKEAGITPDPDIDTYMKVFL

SEQ ID NO: 91148 - protein, 655 aa, Aspergillus oryzae
MLAEKETHLMDIPSSPLGTSEGSLYEDSTPPTTPASSPLFGASRGDELASSSFPSSSATYNLSSEQRVHDIPGVATLWRSSEGQFKNVCVVGAGYVGGPTAAVLALHNPSIAVEVVDRDPRRIQRWKSRHPPVHEPGLDNVVRVARDGAEFVTASASIAAILGDAKRKPNLFFTCDSASSISRADMVFVAVNTPTKTFGLGAGKATDMTAVDEAVRQIALHAKPGAVIVEKSTVPCGTAQRIRQMFSTLRPEVPFEVLSNPEFLSEGSAIDDLVKPDRVLIGSSGTPAGRRVAAMLTSLYSTWVPASRILEINSWSSELSKLVANAMLAQRISSINSISAICEKTGAEVHQVAKAVGMDTRIGHQFLKAGLGFGGSCFRKDIASLTYLAESLGLDDVAEYWNQVNVMNVMQRNRFARKVIDRFEGNLHGRKIACLGFAFKKDTGDTRESLAADVVRLLMEERPMEIAIYDPYCQEEDILRELEVVLGTHTEKNSVVKVLADPYLACSQAHAVLVLTDCDQFRNVPTNPRGRSLLAYQSSIARADQEVYDSLAEVIMTPVKPEEETWTFNGISYRLVPQEDCAADCASCRSTSSRPATAEPLEWARIAYNLKEPKWVLDGRCFLDVREMEKLGIHLDTVGRRPGAIQSSDTTSVGI

SEQ ID NO: 91149 - protein, 335 aa, Yersinia pseudotuberculosis IP 32953
MNQFYKRHFLRLLDFTPAEIIALLDLATELKKDKKSGCEQQKLVGKNIALIFEKDSTRTRCSFEVAAYDQGARVTYLGPGGSQIGHKESIKDTARVLGRMYDGIQYRGYGQRVVETLAEFAGVPVWNGLTNEFHPTQLLADLLTMREHLPNKSLNKMTLAYLGDTRNNMGNSLLEAAALVGMDLRLVAPKACWPEEAFVISCQALAQKTGGKITLTEDIAEGVNGADFLYTDVWVSMGEPKEVWQERITLLKPYQVNMRVLTLTGNPQVKFLHCLPAFHDDQTTIGKQMAEQYDLPGGMEVTEEVFESAHSIVFDQAENRLHTIKAVMVATMSKI

SEQ ID NO: 91150 - protein, 235 aa, Chrysanthemum x morifolium
MATPSSATSLNVENIVFPSSVKPPGDTNTLFLGGAGVRGMEIQGNFVKFTGIGVYLEDKAIPLLAGKWKGKTAEELVNSVEFFRDIVTGPFKKFTQVTMILPLTGKQYSEKVSEMCVGVWKAHGTYTDADGATIDKFLEVFKDENFPPGASILFTTSPDGSLTISFSKDGMIPEAANIVLENEKLAQAVIESVIGKNGVSPATKQSLASRLADLMNHFDEKATTDAEPNLSKNGL

SEQ ID NO: 91151 - protein, 351 aa, Mesorhizobium loti MAFF303099
MTAKTFELGPGYTISRVIRGGWQLAGGHGAIDRSQAVTDLIATFDAGIWTYDCADIYTGVEELIGAARLRLASERGLDVAAKMKVHTKLVPDLERLATISRDYIRGIVEQSLRRLKTERLDLVQFHWWDYDQPRYVEAMGWLDELRREGKVRNLGTTNFDTPRLAEILAAGIPLVSQQLQYSVLDQRPAHSLAELAAKNGVSFLCYGSVAGGFLSDKWLGVAEPATPLENRSLVKYKLIIDDFGGWDLFQQLLQALKAVGDRHGVDIATIASAWVLKQPRVAAVIVGARNQAHALANARIMDVALDADDRAKIAAVIAQSQGPLGDVYTLERDRHGRHGSIMHYNLNAGRT

SEQ ID NO: 91152 - protein, 502 aa, Arabidopsis thaliana
MAISFLCVFLITFVSLIFFAKKIKRSKWNLPPSPPKFPVIGNLHQIGELPHRSLQHLAERYGPVMLLHFGFVPITVVSSREAAEEVLRTHDLDCCSRPKLVGTRLLSRDFKDIGFTPYGNEWKARRKFALRELFCLKKVQSFRHIREEECNFLVKQLSESAVDRSPVDLSKSLFWLTASILFRVALGQNFHESDFIDKEKIEELVFEAETALASFTCSDFFPVAGLGWLVDWFSGQHKRLNDVFYKLDALFQHVIDDHLNPGRSKEHEDIIDSMLDVIHKQGEDSSLELTIDHIKGFLANIFLAGIDTGAITMIWAVTELVKNPKLIKKVQGDIREQLGSNKERITEEDIEKVPYLKMVIKETFRLHPAAPLILPRETMAHIKVQGYDIPPKRRILVNVSAIGRDPKLWTNPKEFDPERFMDSFVDYRGQHYELLPFGSGRRICPGMPMGIAAVELGLLNLLYFFDWKLPDGMTHKDIDTEEAGTLTIVKKVPLKLVPVRVQ

SEQ ID NO: 91153 - protein, 446 aa, Bacillus licheniformis ATCC 14580
MSFLIKPDLHASYPVVQYAKGSWIVDHSGKRYLDGCSGAVTCNLGHGVQEVIEPLKEQLDAVSFVYRSQFTSEPAEQLAELLAEWLPGDLNWSFFVNSGSEAVETAMKIAVQYWQEKGQNDKTIFLSRWNSYHGITNGALSLSGFYERRYRFTHMLHKYPAASAPNCYRCRLSHPECQEACVKEIELAVKRIGKQFIAGFVAEPVIGAAGAAITAPAGYYKKVKEICEDNEILFIADEVMSGIGRTGRMLAIEHWGVTPDIAVLGKGLSAGYSPIAAAVMSDGMMETVKNGSGAIMSGHTYSANPFSARAALAVLRYILKHDLVKQAEIKGEKLKRMLKEVMKQSSIIGDVRGKGLLLGIEFVADQKSKKTFPSSMPVSALVISEAKKRGLLLYPSQAGIDGGGGDAVIIAPPLTISDKEMEELIEIFKHAVYEIEKQAEKVMRER

SEQ ID NO: 91154 - protein, 399 aa, Bordetella parapertussis 12822
MRFADRMARIAPSPSSMAGQRMRELRAAGRNVIGLTAGEPDFATPDNIQQAALRAMRNGQTKYTDVGGVPELKAAVAEKFRRENSLAYRQDQIIVSSGAKQVIFNALLCLVQRGDEVVIPAPYWVSYPDMVRFAGGTPVAVACAQQHRFKLQPDELERAITPRTRCLILNSPNNPSGAAYDETELKALAQVLLRHPDICVITDDIYEHLLYDGRRFATIAAVEPALADRVLTVNGVSKSYAMTGWRIGYAGGPAALIANMVKLQSQSTSCPSAVSQAAAIEALTGPQDIIASSRKLFQARRDLLVRRINAIPGLHCDTPDGAFYVFASCAGLAGKRTPQGRTIDNDTDLALHLLDAEGVVVIQGDAYGMPGFFRLSIAASETLIEEAQRRIAAACAALH

SEQ ID NO: 91155 - protein, 384 aa, Synechococcus sp. CC9311
MQDKLTLMIPGPTPVPETVLKAMGRHPIGHRSGEFQAVVERTTAQLRWLHQTNNDVLVITGSGTAAMEAGIINTLSRGDRVICGDNGKFGERWVKVARAYGLEVEVIKADWGHPLDPENFRTALEADSDKTIRAVILTHSETSTGVINDLETISRHVQAHGTALTIADCVTSLGATNVPMDDWNLDVVASGSQKGYMMPPGLSFVAMSERAWKAYERSDLPKFYLDLGPYRKTAAKNSNPFTPAVNLYFALDAALEMMQAEGLEAIFARHARHRDAAIAAMKAIGLALFAAEGHGSPAITAVAPAGMDAELLRKTIKDRFDILLAGGQDHLKGKVFRIGHLGFVCDRDVLTAVAAIESVLHSLGFHKGQMGAGLSAASAALSNN

SEQ ID NO: 91156 - protein, 678 aa, Oryza sativa Japonica Group
MQAFVFIFAVLALLAGDVEGRQGCYPFSCGHLQNISHPFRRRGDPQRCGVPSYELDCRDSKATIRINTGTYYVTSINYTTSVFWVVDASLKDTNSSCPLPRSDQLPFVSGGIQGSHGGWDLALDPGPGATWVSFVNCSQAVRNNSVYVPVDCLSTSSSFVYVFGSWIMPPSVFPIIGNLETSCRYLAMIPLGGWDSPLPHNASFSDIVRSMRNGFAVHFPIIHRWSRIGHIKDCLMGSIRGFHEEPLSNQTIKDQIVDILFIDFSFWSCIIGGVGMKDYFDMPQYMMGMLRGKIEFYGGFIVQFALFVFKWIAVLCRFVIAPLTLLTFLAFKYWKTRIKIDAVEKFLQMQLMLGPTRYAYTDIIAMTSHFRDKLGQGGYGSVFKGVILPGDVHVAIKMLSNYNCNGEEFISEVSTIGSIHHVNVVRLVGYCAEEMRSALVYEYMPHGSLDRFIFSPDKSLSWDKLNEIALGIARGINYLHQGCDMQILHFDIKPHNILLDSNFVPKVADFGLAKLYPRDNSFMPVSAARGTVGYIAPEMISRSFGIISSKSDVYSFGMLLLEMAGGRRNSKQNMSSSSQSYYPSWVYNQLVQQKMGEIANAFNMHELEKKLCVVGLHCIQMKSHDRPTMSEVIEMLEGDVGGLQLPSRPFFCDDEPLPLLVDSCRFSSELTEISEEDE

SEQ ID NO: 91157 - protein, 151 aa, Bacillus licheniformis ATCC 14580
MTNNKEERLKQLTRMQYEVTQKNGTEPPFQNEYWDLHEDGIYVDIVSGKPLFSSLDKFDAHCGWPSFTKPVDAGEIEEKLDTSHGMIRTEVRSKSADSHLGHVFPDGPGPDGLRYCINSAALRFVPKDDLEKEGYGEYVKLFERKKSGEES

SEQ ID NO: 91158 - protein, 583 aa, Solanum lycopersicum
MSKQTYKVGFFFRRQFTMAAAEAPADIKSLFKRYSDDSGVMSVQNLHSFLIEIQKEKNVSLENAEAIINNHGGDSKQKGLQLDGFFKFLFSDVNPPLDPKLGIHHDMTAPLSHYYIYTGHNSYLTGNQLSSDCSDVPIIQALQRSVRVIELDIWPNSDKDDIEVLHGRTLTAPVTLIKCLRSIKEHAFCASEYPLVITLEDHLTPDLQEKVAEMITQTFGEMLFSPSESLKELPSPESLRKRVMISTKPPKEYLKSKEVKEKDDTKKEAELFIVSTSSRNPLIDLPHNVFQQDDVDEEEDEDDEEDSKSDKKAASEYKRLIAIHAGKGKGGLSDWLRVDLNKVRRLSLSEPELEKAVDTHAKEIIRFTQHNLLRIYPKGIRVDSSNYDPFVGWMHGAQMVAFNMQQGYGRSLWLMHGMFRANGGCGYVKKPDLLLKAGPDNEVFDPTANLPVKTTLKVTVYMGDGWDKDFDQTDFDTYSPPDFYAKLGIAGVPADEVKKRTETIDDNWIPSWNEQFEFPLTVPELALLRIKVLDYNLSDKDEFAGQTCLPVAELRQGIRAVPLYDRKGEKYSSVKLLMHFEFK

SEQ ID NO: 91159 - protein, 341 aa, Synechococcus sp. CC9311
MTLRVAINGFGRIGRNVLRGWISRGADTGLEIVGMNSTSDPKTSAHLLTYDSILGRLDPSVDIKTTDDSMFINGKEIKFFADRNPLNCPWKEWGVDLVIESTGVFNTDEKASMHIQAGAKKVILTAPGKGAGVGTFVVGVNDDQYRHEDWDILSNASCTTNCLAPIVKVLDQNFGMEWGLMTTIHSYTGDQRILDNNHRDLRRARAAALNMVPTTTGAAKAVALVYPEVKGKLTGFAMRVPTPNVSAVDLTFGTSKGPSVEEVKAAMKSASENGMKGIIKYTDLPLVSTDYAGTNESTIFDADLTYAMGDKAVKILAWYDNEWGYSQRVVDLAEVVAKGWK

SEQ ID NO: 91160 - protein, 574 aa, Solanum lycopersicum
MGSSYNYYRMFGCFNRKFKIREREPPPDVRNAFFRYTGKANQMNADQLFRYLVEVQGEEECTIKDAEQIIQNVASRRHHLIRRLNHSLELDDFFFYLFQDDLNGAIKSQVHHDMTAPLQHYFIYTGHNSYLTGNQLSSDCSEIPIVKALERGVRGIELDLWPNSGKDNIHVLHGRFPSSCHYHTWKTHLTPDLQAKVAEVMVIQIFGEMLYYPQSECLDEFPSPEELKNRIILSTKPPKEYLESKNQRDTSPVGKDSFREDLLKKEKSEIGAEDHDTDERSDSDQDDEDGDTSTSNDQQSSQPEAPKYKSLIAVHAGKAKHGLKRALREESNKVSRLSLSEQEVVRAAEYYGTDLVRFTQKNILRVYPKGTRVTSSNFKPMTGWMHGAQMVAFNMQGYGKSLWMMHGMFRSNGSCGYVKKPQFLMDKGPNNEVFDPKVKLPVKQTLQVLQVRVYMGDGWRLDFSHTHFDAYSPPDFYTKVIGVPADSRKKKTRILEDDWCPVWDEEFNFPLTVPELALLRIEVREYDMSEKDDFGGQTCLPVSELRTGIRSVPLYDKKGHKMKSVRLLMRFQFL

SEQ ID NO: 91161 - protein, 274 aa, Heliobacillus mobilis
MNVSLLENRRIGFIGGGAMAEALLSGLVRLVPPQAITVSDPNPSRLAYLQSEMAVQTTSDNSVVCEQSDIVVLAVKPQVLPAVLTPLKTAICSKHLVISIAAGITLAQLESWLSPEVPLIRVMPNTPALIGKGASALAGGRAVSEQDVQTAKALLEAVGIAEVLPETYLNAVTGFSGSGPAYVYLFIEALIDAGVKEGLTRDLARKLAIQTVIGSAQLLIETGNHPAIERDKVTSPGGTTIAGVQALEDGGFRSAVFAAVHAGTKRARELSGSQ

SEQ ID NO: 91162 - protein, 210 aa, Alteromonadales bacterium TW-7
MTRTTIIAIAGASASGKSLFSQTIYNELVNELEPGAIAIIEEDAYYKDQSHLPMAHRTQTNYDHPDAFEHELMLEHLTQLRSGNSVEVPTYDYAQHTRSDKTRRVAAAKILIVEGILLLSDKALNKEFDIKVFIDTPLDICLMRRMQRDMEQRGRTLQSVVEQYQATVRPMFYQFIEPSKHNADLVVTRGGMNRVAIDIIKSKIKYLLQE

SEQ ID NO: 91163 - protein, 200 aa, Triticum aestivum
  misc_feature (178)..(178): Xaa can be any naturally occurring amino acid
RLKQGKLQEIPYGAEDESDDDEKPAALVKKTPVIESDSSESDSDDSSDEDVPAKTPAAAAKKVDSSDSSESESESEDEEKSKKAAQATKIAPAAAKRKEEPSDSSDSDESDEEPPQKKLKDAAKVTPKSAKKDSTSDDDSSDESSDDEPKKKVTTASKSQKEEPKTPASNKGQATGSXTLWMGNLSFNIEYDQVKQFFAQ

SEQ ID NO: 91164 - protein, 357 aa, Streptococcus thermophilus
MISCGFTRLDLFTSTCFCLSWCVAAGFIGSNLVKRIYQEAPSATVIGIDNMNAYYDVALKEFSLNELAKYPTFTFVKGNIADTELITELFEKYKPSVVVNLAAQADVRYSITNPDAYVESNLVSFFNILEACRHCESLEHLVYASSSSVYGSNKKVPYSTDDKVDNPVSLYAATKKSNELMAHAYSKLYNIPSTGLRFFTVYGPAGRPDMTYFGFTNKLVKGETIKIFNYGNCKRDFTYVDDIVESVVRVMKKALDKKNGEDGLLIPPYAVYNIGNQNPENLLDFVQILSEELVIAKVLPEDYDFKAHKELVPMQPGDVPVTYADTSALERDFGYKPSTSLRIGLRNFAEWYAEFYK

SEQ ID NO: 91165 - protein, 416 aa, Streptococcus thermophilus
MREFKDLKIAVAGTGYVGLSIATLLSQHHKVTAVDIIPEKVELINNKKSPIQDEYIEKYLAEKELDLTATLDAKEAYSDADFVVIAAPTNYDSKKNFFDTSAVEAVIKLVIEYNPEAVMVIKSTIPVGYTASVREKFHCDNIIFSPEFLRESKALYDNLYPSRIIVGTDVDNARLVKAAHTFAELLQEGAIKENIDTLFMGFTEAEAVKLFANTYLALRVSYFNELDTYAEMKGLNTQQIINGVCLDPRIDTHYNNPSFGYGGYCLPKDTKQLLANYADVPENLIEAIVESNRTRKDFIADRVLEIAGAYEANDSWDESKEKEVVVGVYRLTMKSNSDNFRQSSIQGVMKRIKAKGATVIIYEPTLKDGEKFFGSVVVNDLDEFKKKSQAIIANRYNKCLDDVKEKVYTRDIFQRD

SEQ ID NO: 91166 - protein, 426 aa, Geobacillus kaustophilus HTA426
MRKDWQTNRRNMELINKYTCKNGVRIVLEQIPTVRSVAIGIWIGTGSRNETEQTNGISHFLEHMFFKGTTTRTARDIAEAFDSIGGQVNAFTSKEYTCYYAKVLDEHAPLALEMLADMFFHSTFVEDELQKERNVVLEEIKMYEDTPDDIVHDLLGKACYAGHPLGYPILGTEETLRTFTGDTLRQYMADYYTPDRVVISVAGNVDERFIDEVERYFGSFAAESKPPSSGTPAFVPQKIARKKDTEQAHVCIGFNGLPIGHPDAYPLLILNNILGGSMSSRLFQEVREQRGLAYSVFSYHSAYQDSGLLAIYAGTGSSQLDVLFETIQHTIRQLKEDGVTEKELHNSKEQMKGSLMLGLESTNSRMSRNGKNELLLGRHRSLDEIIEEIESVTVEKVNELARTVFTDDYALALISPDGVLPRPLRS

SEQ ID NO: 91167 - protein, 512 aa, Zea mays
MAGKGGSSNGGGGGRESKKPALLLGRYEVGKLLGQGNFAKVYHARSVRTGEEVAIKVMEKEKILKSGLMAHIKREIAVLRRVRHPHIVQLYEVMATKLRIYFVMEYVRGGELFARVARGRLREDDARRYFQQLVSSVAFCHARGVYHRDIKPENLLLDDAGELKVTDFGLSAVAEQMRHDGLFHTFCGTPAYVAPEVLSRRGYDAAKADLWSCGVVLFVLAAGYLPFRDRNLVAMYRKIHRGEFRCPRWFSPGLTRLLRRVLDTSPPRRATAAEIMGDEWFKVGFRRFSFRVEDDRSFTRFDLDDDASTSPPEPDTPRADAAAAGREKPRRVAAGLTSCASAPSLLQLEARGGSSSSSSSSSSSRRRSSLNAFDIISFSRGFDLSGLFEGGGAPEQPPHPAAARFVSAAPAERVLAALEAAASAAGMAVRGRDDSSVSIEGTREGEHGALAVAAEIYELTPELLVVEVRRTSGGAADYEEFFRARLRPSLRDLVCDEDEPTLLQSDERSRSL

SEQ ID NO: 91168 - protein, 332 aa, Bacillus cereus ATCC 14579
MLMTRPNLKGRSFLAEKDFTQEELLYFLDLAAELKEKKKNGIPHHYLEGKNVALLFEKTSTRTRCAFTVACTDLGANPEYLGKGDIQLGKKESVEDTAKVLGRMFDGIEFRGFNHETVESLAQNSGVPVWNGLTDMWHPTQTLADLLTIREHIGKLKNVKLVYVGDGRNNVANSLLVGGAIVGMDVRICTPESLWPAQEVIDLAKKYNEQVMITSNVEEAVANADVIYTDVWVSMGEEEKFAERVELLKPYQVNMKMIKATGNENVIFLHCLPAFHDVETMYGEEVYEKYGLKEMEVTDEVFRSKHSKVFDQAENRMHTIKAVMAATLGNME

SEQ ID NO: 91169 - protein, 314 aa, Oryza sativa Indica Group
MGSGSLLKVLAKNFDVLAGPLVALAYPLYASVKAIETKSPVDDQQWLTYWVMYSLITLFELTFASIIQWLPFWPSMKLIFICWLVLPYFNGAAFVYQNYVRPMFVKHQMVNIWYVPQKKGLFGKSDDFLTALDKFIEENGPEALKKLTNKAGKSSKQSGKSWKDSKSSKESKDSKSSKESKEPKPSKDSKQLKPPKVSKESKPLKDSKEDKKAVKEDKKAAAKDSKEQKKALKDSKELKKALKDSKEQGLQKDSDELKPKSNKRVTFAEVEPEKELKASNSDWHPTSEYHSVYPEHNSWSSSFMIFEDENSYWN

SEQ ID NO: 91170 - protein, 488 aa, Triticum aestivum
  misc_feature (244)..(244): Xaa can be any naturally occurring amino acid
  misc_feature (285)..(285): Xaa can be any naturally occurring amino acid
WRRSRRPTGRARPGWRPWRYRWRPGTARESDWLDDDGRPRRSGTVWTASAHIITAVIGSGVLSLAWAIAQLGWVAGPAIMLLFALVIYYTSTLLAECYRSGDPETGKRNYTYMDAVRSYLPGTKVKLCGVIQYANLVGVAIGYTIAASISMRAIGRADCFHYHDVRGRSGKDECKSSSNPYMIVFGVVQILFSQIPDFDQIWWLSIVAAVMSFTYSTIGLGLGIAQTVANGGIQGSLTGLSVGXGVTSMQKVWRSLQAFGNIAFAYSYSIILIEIQDTVKAPPPXSEAKVMQKATGISVATTTVFYMLCGCMGYAAFGDAAPDNLLTGFGFYEPFWLLDVANAAIVLHLVGAYQVFCQPLFAFVEKWAAARWPDSAFIARELRVGPFAISVFRLTWRTAFVCLTTVVSMLLPFFGDVVGLLGAVAFWPLTVYFPVEMYIVQRGVRRGSTRWVCLKMLSAACLVVSVAAAAGSIADVIGELKEYRPFSG

SEQ ID NO: 91171 - protein, 383 aa, Oryza sativa Indica Group
MVVMLLADICLSKPAGHMIAYTSSILFVLQQSIPDIYLFIRCPGHGNSSCTEQFAKSDEMIRAIAFRESSGRYDSSEKCMFCRLINNLDNAHEQIDTAIATALSESKPVYISVGCNLAGLSHPTFSREPVPLFISPRLSTKANLEYAVEAAADFLHKASILCEWVQHMDLPGPRWKKGKDGKDFSALAAANPMSVIVAELKASFISSKPVAVLSGPGGGAILGVEPEQAVILNRAAFGHAVEIAAAQKHWFQLSPEEVFYLCHVLNCIRVESHDKKQMSDKQLWNHFRSMSESFPEMYKAYSHLRLKNWVESRNQNYQKDSKQLKPPKVGIESKVIELERRYEGSKGFKRTKEGTERLENTEKRKKDSKILKSARKTQKSRVH

SEQ ID NO: 91172 - protein, 481 aa, Mesorhizobium loti MAFF303099
MDIGLLIDGDKRDASGAAAYERLDPFTGKLATRAAAASVADANAAVEAAAAAFATWSKTGPGERRALLSRAADVMASKVGEFTKLMMEETGATAPWAGFNVMLAANMLREAAAMTTQISGEIIPSDKPGTLAMAIRQPAGVCLGIAPWNAPVILGTRAIAMPIASGNTVVLKASEMCPGTHRLIGQVLVEAGLPKGVINVVTNDPKDAAAIVEALVAHPSVKRVNFTGSTKVGRIIAELAGRHLKPALLELGGKAPLLVLDDAAIDAAVNAATFGAFMHQGQICMSTERLIVDERIADEFVSKLAARASQLPAGDPRGHVVLGSLISSQAADKMEELIADAVAKGAKLVAGGKRTGTVVEATLLDHVTPAMRVYAEESFGPVKPVIRVKDEDEAVRVANDTEYGLSSAVFSRDIKRAMAVAARIEAGICHINGPTVGDEAQMPFGGVKGSGYGRFGGKASIAEFTDLRWVTIEDPGQHYPF

SEQ ID NO: 91173 - protein, 448 aa, Yarrowia lipolytica CLIB122
MSVFQTDVHATLPRTIGGKGTELTIEEDGQTRTVLDACGGAAVAALGHGNERMIAKIQQAAGLPYILSHGLGSKHADDLAKYLVEQSPEGSFSSAVFLNSGSEANEAALKLSKQYFVEKNEPKRVNYISRHFSYHGSTLGVLSLGGFQSRRKPYADVLNTSNFHKVSTCFYYRGAKPGQTEEEYTQQLLDELDAKFQHLGPETVISFTCETVIGATLGCVPPTKGYIKGCRDICHKYGALFVLDEVMSGMGRCGTYHAWQHEMDEGPDLQPVAKVLGGGYVPLAAVLISPKVYNVFKSGSGHVVGHQTYQDHIFATSVGLELQKIIKEDQLVERSRFLGLKLEKMLKKALANNPNVGDIRGRGLFWDVEFVQDKETKKAFPRAVGFSTKVYKAGMKRGVHFLKGVGTVDSFEGDHIILSPPYTVSEEELTKIVDVLKASVEEAQGESL

SEQ ID NO: 91174 - protein, 443 aa, Geobacter metallireducens GS-15
MSMDRIDLSRYLTAVETMTPIRFHGKVTQVVGLVIEGYCPDAAVGTLCHVHPHDGDPIPAEVVGFRDNKTLLMPLGELRGVGLGSLISVKRKKSSLGVGPGLLGRVIDGLGEPIDDKGPLATREEYPIYANPVNPMKRRPIREPLDLGIRAINGLLTCGKGQRVGIMAGSGVGKSTLLGMIARYTEADVNVIALIGERGRELREFIEKDLQEEGLKKSVVVVATSDQPPLVRMRGAYIATTIAEYFQAQGKKVLLMMDSATRFAMAMREVGLAIGEPPTTKGYTPSVFAALPKLLERTGNFMDGSITGLYTVLVEGDDFNEPVSDAMRSILDGHIVLNRELAARAIYPPIDVLASASRVMMDVTERGQQQFASRFKELLAAHKQAEDLINIGAYKPGSNPTIDYAISKMEGMVGYIRQGIHDGVTMEQSVTALGDIFDEGMAL

SEQ ID NO: 91175 - protein, 649 aa, Oryza sativa
MQLLQQRSQAARGHLQVCNVAVPSRPPAFKAPKRSKVEIIKEKSDYLRHPLMEELVNDKSFITEDAVQLMKFHGSYMQDHREKRSFGEGKFYQFMMRTRQPSGLVTNQLYLVMDELADKYGNGTLRLTTRQAYQLHGVLKHDLKTVFSTVIKNMGSTLAACGDGNRNVMGPAAPYKNKPEYMLAQQYANDIADLLAPQSGAYYDVWLDGEKFVSVYKENPKVTADRAFNGFGTNFNNSPEAIYGAQFLPRKFKVAVTVPGDNSVDILTNDIGMVVMCDANGELQGFNLLVGGGIGRTHRNEDTFPRLADALGYVDKDDIFHAIKAIVATQRDYGRRDDRKQARMKYLVDEWGIDKFRSVVEQYLGKKFEAFRPLPAWKFEDYLGWHEQGDGKLFYGVYVQNGRLKGDAKKALRNVIERYELPVTLSANQNIILRDVEPAWKDDIQATLEAAGLVDAVDLTGIERLSMACPALPLCGLAITEAERGLPDVNKRVLSLLKRVGLGDEAITMRMTGCPNGCARPYMAEIGFVGDGPNSYQLWLGGSPNQTRLAKVYQERVKLRDLEAVLEPLLVAFRARRSPGGAFGDFVARVGFVSLRGYADGYVPADKLDKLPTVSIDEDTFKALEAVAAAEGKSIAHVASEKLQKLGGH

SEQ ID NO: 91176 - protein, 750 aa, Halobacterium sp. NRC-1
MGLDDDALDYHASDPPGKVEISTTKPTNTQRDLSLAYSPGVAAPCRAIADDPTEAFTHTTKGNMVGVVSNGSAVLGLGDIGAQAAKPVMEGKGVLFKRFADIDVFDIELDQATADELVATVSAMEPTFGGINLEDIKAPECFEVERRLGDAMDVPVFHDDQHGTAIISGAALLNAAEIAGKDLSDLDVVFSGAGASAIATAKFYVSLGVDREHITMCDSSGVITEDRDVNEFKAAFAQPADSGGDLADAMAGADVFVGLSVGGIVNQAMVRSMADDPIVFAMANPDPEIDYESAKAAREDTVIMATGRSDYPNQVNNVLGFPFIFRGALDVRATDINEEMKVAAATALADLAKQDVPDEVVKAYGDQPLQFGSEYIIPKPLDPRVLFEVAPAVADAAMETGVARTELDLVDYREELEARLGKSREMMRIVINKAKSEQQRIALGEGGDEKMIRAAHQMHEAGIADPVLLGDRDTIQGTVDALSLDFDPDVVDPDEGDHSAYADTLYDLRKRKGITRNEAESLVARDPNYLGSTMVEAGDADAFLTGLTHHYPSALKPPLQVVGTAPDTDYVAGVYMLTFQNRVVFCADATVNQDPDADVLAEVAQHTADLARRFNVDPRVAVLSYSNFGSVDNEGTRKPRRAAQQLREDDDIDFPVDGEMQADTAVVEDILQGSYEFSDLDTAANVLIFPNLEAGNIGYKLLQRLGGADAIGPMLVGMNKPVHVLQRGDEVKDIVNLAAVAAADAQQRED

SEQ ID NO: 91177 - protein, 659 aa, Thermoplasma volcanium GSS1
MEISKVTVIGSGIMGHGIAETIALAGYDVNLEDISDDVLAKAKAEIDASLDRLVKSGKLSDKTKVLGRIHYFTSIPESVKDADLVIEAVPEILDIKRQVFAQLDQSTKEDAILATNTSNIRLTEIAEGVKKKGKVVGMHFFNPPVVLKLVEVIRSDYTEDEVFEAVYDFSKKIGKIPIKVYKDTPGFVVNRINAPESLYFCLVLDKGIAKPEEVDRFARSQGLPMGPYELMDYVGIDTVYHSLEYYAKELSPDYAKCQVYNKLYNEKKLGLKTGEGFYKWVNGKAQIPDAQPTKNVELMDIFALEINEAVKIIEEKIVSPEDIEIGVKLGMNRPFGPITVAKGLTNAEIKSKLESLYNKFGVSVFQPAKSISEGRLKSLISEKFEPPVRGQQTEQEKPSIVESSDPVILERNGKIAVLRLNNTKNNLINSAVLDALEQQINDLWHDREINVVVITGNGSVFSAGAQLDSFFSSTFDFLEFSRKGERIFKLLSEMPKITIAEMKGYVLGGGLELSLACDIRVATEDVQIGFPEVTLGLIPGWGGSQKLSKLIGESRASYYVLTAERFDGKRAYEIGLVSRLYKPQEIDAETLKFAKDISERVAPISAALAKRLLLRSANTSLDDGLEMESMAMGTLYGTEDLKEGISAFLSKRKPNYQGK

SEQ ID NO: 91178 - protein, 440 aa, Arabidopsis thaliana
MAEDMAADEVTAPPRKVLIISAGASHSVALLSGDIVCSWGRGEDGQLGHGDAEDRPSPTQLSALDGHQIVSVTCGADHTVAYSQSGMEVYSWGWGDFGRLGHGNSSDLFTPLPIKALHGIRIKQIACGDSHCLAVTMEGEVQSWGRNQNGQLGLGDTEDSLVPQKIQAFEGIPIKMVAAGAEHTAAVTEDGDLYGWGWGRYGNLGLGDRTDRLVPERVTSTGGEKMSMVACGWRHTISVSYSGALYTYGWSKYGQLGHGDLEDHLIPHKLEALSNSFISQISGGWRHTMALTSDGKLYGWGWNKFGQVGVGNNLDQCSPVQVRFPDDQKVVQVSCGWRHTLAVTERNNVFAWGRGTNGQLGIGESVDRNFPKIIEALSVDGASGQHIESSNIDPSSGKSWVSPAERYAVVPDETGLTDGSSKGNGGDISVPQTDVKRVRI

SEQ ID NO: 91179 - protein, 440 aa, Candida albicans SC5314 [sequence omitted]

SEQ ID NO: 91180 - protein, 475 aa, Staphylococcus aureus subsp. aureus MRSA252
MRDYTKQYINGEWVESNSNETIEVINPATEEVIGKVAKGNKADVDKAVEAADNVYLEFRHTSVKERQALLDKIVKEYENRKDDIVQAITDELGAPLSLSERVHYQMGLNHFVAARDALDNYEFEERRGDDLVVKEAIGVSGLITPWNFPTNQTSLKLAAAFAAGSPVVLKPSEETPFAAVILAEIFDKVGVPKGVFNLVNGDGAGVGNPLSEHPKVRMMSFTGSGPTGSKIMEKAAKDFKKVSLELGGKSPYIVLDDVDIKEAAKATTGKVVNNTGQVCTAGTRVLVPNKIKDAFLAELKEQFSQVRVGNPREDGTQVGPIISKKQFDQVQNYINKGIEEGAELFYGGPGKPEGLEKGYFARPTIFINVDNQMTIAQEEIFGPVMSVITYNDLDEAIQIANDTKYGLAGYVIGKDKETLHKVARSIEAGTVEINEAGRKPDLPFGGYKQSGLGREWGDYGIEEFLEVKSIAGYFK

SEQ ID NO: 91181 - protein, 163 aa, Zea mays
FKYEENPKKAVQCLTNMVTDALIHAEECLQYMSALKDPAIFRFCAIPQIMAIGTCALCYNNVHVFRGVVKMRRGLTARIIDETNSMTDVYTAFYEFSSLIESKIDDSDPNAALTQRRVDSIKQTCKSSGLVKQRGYHLEKSPYRPMLIMIVLLLVAILFGVMF

SEQ ID NO: 91182 - protein, 422 aa, Bacillus licheniformis ATCC 14580
MKPLLKENSLIQVKDILKAHQNVKDVVIHTPLQKNERLSERYDCNVYLKREDLQVVRSFKLRGAYYKMKQLSKETTKNGVVCASAGNHAQGVAFSCKHLGIHGKIFMPSTTPRQKISQVELFGKEYVEIILTGDTFDDAYQSAVACCEEEKRAFIHPFDDPAVMAGQGTVAVEILNDIETEPHYLFASVGGGGLLSGVGTYMKNVSPDTKLIAVEPKGAPALFESNKKGEVVILEKIDKFVDGAAVQKIGEETFKTLETVVDDILLVPEGKVCTAILELYNQCAIVAEPAGALPIAALDLYRDEIKGKNVVCIVSGGNNDIGRMQEIKDRSMMYEGLQHYFIVNFPQRAGALREFLDEVLGPTDDITRFEYTKKNNKSSGPALVGIELKQREDYEPLIARMDRKGFRYVEVNKDEGLFHLLI

SEQ ID NO: 91183 - protein, 576 aa, Xanthomonas campestris pv. vesicatoria str. 85-10
MSLRLRGHGAARGNALGRARVRQSHTLEVAEQRVPANQVETQLQRLHAAIASARVEMQQLRDRLHGALAREVGEFLELHALLLDDPELLQGLDELIRTHRYSADYALRVQRDRLAAVFDGMEDAYLKSRMDDLDHVIGRIHAFLHKRAPDLKGVAGEILVCDNVAPSELAQLQAQGVVGIVTTAGSTLSHSAILARSLHLPLVVGVSDALQRIEDGDVLIVDAGSGQVIVDPKPEHLRDYRERLRALAKEQRELGRLRSKPTRTRDNVDITLLANAESLEDVANAHALGASGLGLYRTEFLFLQRNELPDEDEQFHTYRDTVLGMSGHPVTIRTLDLGADKADRTGLTLSDEDNPALGLRGVRLSLARPAVAQAQLRAILRASGYGPVRILVPMVSGREEILQLRKQLKKLTAQLRAEGHEIAEHIPLGAMIEVPAAALALDCFIDDIDFLSIGTNDLVQYLLAVDRNNEALGELYSPLHPAVLRLIAQVIATGRTYGKPVAVCGEIAGDPRFVPMLLALGLTEFSLHPATLLEVRRAVRDTHLGELRVHGEKLLRARDRKGIEKWLAGHAQGLLR

SEQ ID NO: 91184 - protein, 570 aa, Arabidopsis thaliana
MASLSGLYSSSPSLKPAKNHSFKALPAQSRDSFSFPHTSKPTNLPLTLSSARSVARDISHADSKKELLKDPDALWKRYLDWFYQQKELGLYLDISRVGFTDEFVAEMEPRFQAAFKAMEDLEKGSIANPDEGRMVGHYWLRNSKLAPKPTLKTLIENTLDSICAFSDDIISGKIKPPSSPEGRFTQILSVGIGGSALGPQFVAEALAPDNPPLKIRFIDNTDPAGIDHQIAQLGPELASTLVVVISKSGGTPETRNGLLEVQKAFREAGLNFAKQGVAITQENSLLDNTARIEGWLARFPMYDWVGGRTSIMSAVGLLPAALQGINVREMLTGAALMDEATRTTSIKNNPAALLAMCWYWASNGVGSKDMVVLPYKDSLLLFSRYLQQLVMESLGKEFDLDGNTVNQGLTVYGNKGSTDQHAYIQQLRDGVHNFFATFIEVLRDRPPGHDWELEPGVTCGDYLFGMLQGTRSALYANGRESISVTIQEVTPTSVGAIIALYERAVGLYASIVNINAYHQPGVEAGKKAAAEVLALQKRVLSVLNEATCKDPVEPLTLEEIADRCHAPEEK

SEQ ID NO: 91185 - protein, 838 aa, Arabidopsis thaliana
MAAVIRKLLPFPSPNPKRDNRESDDDDETSSGYRIEYSFASEYKGPLIANVPRALPVEVDQIPTALPVSFSSLRSGISYPVAPLVMTKDTKRPPDSGIEKKNGFVDSAAGSSVVLIGRDVVSGSSSSSSSKRLDVPEEVKSPADFRLSPSSPLSASAREEDHLDDDRVSDVGPRAVRFVEPFQSSECDESSYVSDGESIAATHRAERKGKRGSCYRCQLGNRFTEKEVCIVCDAKYCFNCVRRAMGAMPEGRKCQACIGYRIDESKRASLGKCSRMLKRHLTDSELRQVMNAEITCKANQLPSRLIIVNDKPLSEDELYTLQTCPNPPKKLKPGHYWYDKVAGYWGKIGEKPSQIISPNNSIGGYISEKVSNGDTEIYINGREITKPELTMLKWAGVQCEGKPHFWVDSDGSYREEGQKHPIGNIWSKKRAKIACAVFSLPVPPASSAVEPYDVPLYEQKMLNKLLLIGSEKGGATTIYKQARSLYNVSFSLEDRERIKFIIQTNLYTYLAMVLEAHERFEKEMSNDQSSDWVLKEKEDGNLKIFPPSSRENAQTVADLWRVPAIQATYKRLRDTLPRNAVYFLERILEISRSEYDPSDMDILQAEGLSSMEGLSCVDFSFPSTSQEESLESDYQHDTDMKYQLIRLNPRSLGENWKLLEMFEDADLVIFCVSLTDYAENIEDGEGNIVNKMLATKQLFENMVTHPSLANKRFLLVLTKFDLLEEKIEEVPLRTCEWFEDFNPLISQNQTSRHNPPMAQRAFHYIGYKFKRLYDSILEPVNMRGRSFKPKLFVCQVSLESDTVDNALRYAREILKWHVEETSMFQEMSTTSIEASSSS

SEQ ID NO: 91186 - protein, 462 aa, Xanthomonas campestris pv. vesicatoria str. 85-10
MPLPTDSVAETAAPAAPALRHALKPRQLMMMGLGTAIGAGLFLGSGVGIHAAGPAVLISYLIAGALVIIVMNALGEMAAAKPASGAFSVYAADAMGPTAGATVGWLWWFQVVVVIAAEAVGAAGLLATVWPALPVPLLALLFMATFTAINLLGVRNFGEFEFWFAILKVLAIVVFLLIGVALLAGWLPGVASPGLSNFTQNGGFAPKGLAGIGSALLVVVFAFGGTEIVAVAAAETADPGRSLARTIRTVAWRILVFYIGSISVIVAVVPWTSAALSSPFAAVLDVARIPGAATAITLVAVVALLSALNANLYGASRMIFSLAQRGEAPRLLARTSGEQVPLVAVIASVLFGFAAAALELLYPNKVLPMLLNIVGATCLLVWTISLVSQLILRARADRAGLALPFRMRGYPFLTVLALVILGVIFVLLASSADTRAQFLSMVALTAVIAAVSEVARRLRARM

SEQ ID NO: 91187 - protein, 417 aa, Geobacillus kaustophilus HTA426
MKLIVQKFGGTSVRDERGRNLARRHIERALEDGYKVVAVVSAMGRCGDPYATDTLLSLIGGVHHHVTKREQDMLMACGEIISSVVFSNLLNEHGIKATAFTGAQAGFCTNSDHTNAKILEMRCDRLLEALRQYDVVVVAGFQGMAENGDITTLGRGGSDTSAAALGAALNAEWVDIFTDVDGVMTADPRIVESARPLDVVTYTEICNMAYQGAKVIHPRAVEIAMQAKVPLRIRSTYSDAPGTLVTSSVRGRKGSDVKERLVTGITYVADVTQIKVLAKEGHYELQSDVFQAMAHEGISVDFINISPYGVVYTVSGDMTEKAVAALRRIGYEPAVTPRCAKVSVVGAGIAGVPGVTAKIVTALSEQGIQILQSADSHTTIWVLVKQDDMEKAVNALHDAFCLSEADAGEDEAIWSEE

SEQ ID NO: 91188 - protein, 369 aa, Chlamydomonas incerta
QKSAFTGSAVSSKSGVRAKAARAVVDVRAEKKIRVAINGFGRIGRNFLRCWHGRQNTLLDVVAINDSGGVKQASHLLKYDSTLGTFAADVKIVDDSHISVDGKQIKIVSSRDPLQLPWKEMDIDLVIEGTGVFIDKVGAGKHIQAGAHKVLITAPAKDKDIPTFVVGVNDADYKHEYPIISNASCTTNCLAPFVKVLEQKFGIVKGTMTTTHSYTGDQRLLDASHRDLRRARAAALNIVPTTTGAAKAVALVLPSLKGKLNGIALRVPTPTVSVVDLVVQVEKKTFAEEVNAAFREAANGPMKGVLHVEDAPLVSIDFKCTDQSTSIDASLTMVMGDDMVKVVAWYDNEWGYSQRVVDLAEITAKKWVA

SEQ ID NO: 91189 - protein, 434 aa, Heliobacillus mobilis
MEGFCVSVIAEVYAREILDSRGNPTVEVEVVLEDGTVGRAAVPSGASTGAYEAVELRDGDKERYLGKGVLNAVDNVNTEIAPEIIGWDVTRQMEIDSALIELDGTPNKGRLGANAILGVSMACAKAAAQYQGLPLFQYLGGVFARELPVPMMNILNGGKHADNNVDIQEFMVMPVGAQSFSEGLRMGVEVFHSLKKVLQSKGLNTAVGDEGGFAPNLKSNEEALKVILEAVQAAGYKAGEDILLAVDAAASEMYKDGKYHLEGEGKVMTSAEMVDFWEDLVNRYPIISIEDGLNEDDWDGWKLLTDRLGKRAQLVGDDLFVTNTEKLSKGIETGVGNSILIKVNQIGTITETLAAIEMARRAGYTAVISHRSGETEDATIADLAVAVNAGQIKTGAPSRTDRVAKYNQLLRIEEELDEQATYRGKKTFFNLERR

SEQ ID NO: 91190 - protein, 482 aa, Aspergillus oryzae
MSRANGFSTASSAPTFRPSARVRDLSKYTGYRHCAVLHRDTRFLPRKAVGGKGIYIFLEDGTKFLDSTGGAAVSCLGHGHEKVKQAIIDQTNTISYCHTAFFGTGVSEELAQFLVDSTGGKLSKVYMISSGSEAVEAALKLARQYFLELPTPQPQRTRFIARKPSYHGITLGALAAGGHVLRRQPFEPLLPQNISHVSPCYPYRGKENGETDADYVARLAAELDAEFQRVGPENVCAFVAEPVVGAALGAVPAVPGYFKAMKAVCERYGALLILDEVMSGMGRCGTLHAWEQEDVIPDLQTIGKGLGGGYAPVSGLLIGEKIVQTLDKGTGVFRHGQTYQGHPISCAAALAVQKVIQEENLLENIRNMGIYLETQLKGRLGDHPYVGDIRGKGLFWGIEFVKDKSTKEPFSPEMGVAAHIQETGLDPTYGISLYAAAGCVDGTRGDHVLLAPPYIVTKDEIDLIVETTARVLEHVFTKVVKV

SEQ ID NO: 91191 - protein, 427 aa, Trichoderma atroviride
MAFLGGYEKKHKVTIVGSGNWGSTIAKIVAENTRANKDVFEEDVQMWVFEEDVTIAKDSKHYDESIGDAPQKLTHVINKYHENVKYLPGITLPSNIIANPSLVDAVQDSSILIFNLPHQFIRNVCNQIRGKILPFARGISCIKGVNVSDDGVSLFSEWIGDGLSIYVGALSGANIASEIAAEKWSETTIAYDPPPMDNSRAPTPRSQSPGLTMTVTEPPADMQHRDARGRKSKTKLTPVPAEYPPLDHACFHSLFHRPYFHVEMVSDVAGVSLGGALKNIVALAAGFVDGRGWGDNAKAAVMRIGLMEMVKFGKEFFGETVHTATFTESSAGVADLITSCSGGRNFRCARKAVEKGITVDEVEKQDLNGQKLQGTSTAFEVNSFLTARGLEKDYPLLTAVNAILLGKASVDDIPSLVSDTERKQPLP

SEQ ID NO: 91192 - protein, 226 aa, Physcomitrella patens subsp. patens
MDGEFWTARMSTSKRHHTFQSPQSLIDRQINLDDVDGDEELRAEFSCPFCYEEFDISALCSHLEDEHCFESRAAMCPVCAAKISKDMVGHISSQHIHLSKISFLCDIEAAFIRRRRFRRAGVPSSSTFSFLGKELCDAHLQALLGGTSRSSGISNAADPLLSSLVYNVPIPETEDPPKPTAVTEEQPTNSVENLLTAEEREEKLKHANMRAEFVQQLVLSTLLGDN

SEQ ID NO: 91193 - protein, 272 aa, Idiomarina baltica OS145
MIEQLVTLGPAGTFSERAAQHFQQQLGDSVPIVFKSTLADVLHSVNDTQLAVVPIENLIDGFVSPVVDYFAHHPLYIHAEYRLPIQYHLLANSEKPEQVWAQFVAAGQCHHALNTLSLPIVHTASNTASLNELIAADKPSAAIVPSHIPCPEQLHCIQRTIADSHKNQTRFVLLSAHAEPLLALQDRRWKSSVMLIDDNDHPGLLVDSLKAFAEQGINLTSIVSRPTGDGFGQYHFFIDFDGHEQDPSVQKALKKLAELNQIRWLGSYPAFN

SEQ ID NO: 91194 - protein, 158 aa, Brassica oleracea
MVKSEKKATVERKKRKASRPAANISDLRASVEKKKGFAELRDDLFREAAKLVAEDPSQRIAILIKPPASESNVAMQSFGYPSAEGVVRQFLKDSAPHVDDEDWSKYYWWEDEKLLNSKDPVEIMAAMEEMKKLQKQLEHFVPRETGQGSGTQDDGSKP

SEQ ID NO: 91195 - protein, 629 aa, Oryza sativa Japonica Group
MLLKLCLRLLPLLLVLVAASHGASNDTYDTSMCLQETTTCGDVSIRYPFYFSDKTGYINGSSNSYCGYPGLAIDCDDGKPILQLNGAEKYKVNYINVGSITNVSLVDKEVVDDSSGCPRVDHNVTFAQGSWLFFPAGMSLDYLVFFLGCSFPNLFLPPENIDPITCSFIGLIGPSYVLPKDQVPPGNWSQFCKTFEVPVVKYQQMDPKGDAWRKGGYGQVLRQGFLLSVNDSRRPPNCTQCEESKGRVFKLKGENETFLKKYRHRRISKGTPRIESFLQRNGTLHPKRYTYTEVKRMTKSFAEKLGHGGFGAVYRGNLSDGRQVAVKMLKDSKGDGEEFINEVASISRTSHVNVVTLLGFCLHRSKRALIYEYMPNGSLERYAFRNNSKGELSLTWEKLFDVAVGIARGLEYLHRGCSTRIVHFDIKPHNILLDQEFCPKISDFGMAKLCANKESIVSIAGARGTIGYIAPEVYSKQFGAISSKSDVYSYGMMILEMVGARERNIEANSESSSHYFPQWIYEHLDEYCISSSEIDGETTELVRKMVVVALWCIQVVPTNRPTMTRVVEMLEGSTSGLELPPKVLLSCSNFYKMLYKLETATKIPICAAMQNYGYLNFKLDIAVSESELT

SEQ ID NO: 91196 - protein, 329 aa, Bacteroides thetaiotaomicron VPI-5482
MDKIIGLGNALIDVLATLKDDTLLDELELPKGSMQLIDDAKLQQINTKFSQMKTHLATGGSAGNAILGLACLGAGTGFIGKVGNDHYGDFFRKNLQKNNIEDNLLTSEQLPSGVASTFISQDGERTFGTYLGAAASLKAEDLTLEMFKGYAYLFIEGYLVQDHEMILHAIELAKEAGLQICLDMASYNIVENDLEFFSLLINKYVDIVFANEEEAKAFTGEEPEEALRVIAKKCSIAIVKVGANGSYIRKGTEEIKVSAIPVEKVLDTTGAGDYFAAGFLYGLTCGYSLEKCAKIGSILSGNVIQVIGTTISPERWDEIKLNINKVLAE

SEQ ID NO: 91197 - protein, 602 aa, Physcomitrella patens subsp. patens
MLKNGAPIELFRFVFLLLAVHFRVSGALYVDKAALLAFKARVDDPRGVFSNWNDSDTTPCNWNGIVCSNVTHFVTFIDLPFLNLSGTIAPQLGGLKYLERLSLDHNDFMGKIPKSLSNLTNLRILNLRHNSLSGDIPLALGTLIDLQVLDLAENKLEGPIPESFSNLTSLSYFNLSNNQLIGRVPQGALLNFNLSSYSGNANLCVDDGVGLPACSLSPVLSPSVSPGMFLSWMFAFHTYFSSTSCSCRWGCFSDLTRNDSFSDISLLLWVSGGKIVMFQGVQSVPSSKEMLEALRKIRKNHIIGEGGYGIVYKLEIPGYPPLAVKKLKICLESERSFENELDTLGTLKHRNLVKLKGFCSGPNVKLLFYDYLPGGNLDQLLYGDKEENVIIDWPIRYRVALGVARGLAYLHHGCDPRIIHGDVSSTNILLDTDFESYLSDFGLAKLLTMNDSHVTVTVGGTFGYVAPEFAKSGRATEKVDVYSYGVILLELLSGRRAVDEDMSDDYTNLAGWVRELNSTGKSMEVVDKNLRDTVPSVELELLLEIACHCISLKPQDRPTMHKVVETLELLTETGMSPAGTSMRTSIETLEGSVLEAVKVSLL

SEQ ID NO: 91198 - protein, 428 aa, Neisseria meningitidis FAM18
MSAIVDIFAREILDSRGNPTVECDVLLESGVMGRAAVPSGASTGQKEALELRDGDKSRYSGKGVLKAVEHVNNQIAQALIGIDASEQSYIDQIMIELDGTENKGNLGANATLAVSMAVARAAAEDAGLPLYRYLGGAGPMSLPVPMMNVINGGEHANNSLNIQEFMIMPVGAKSFREALRCGAEIFHALKKLCDSKGFPTTVGDEGGFAPNLNSHKEALQLMVEATEAAGYKAGEDVLFALDCASSEFYKDGKYHLEAEGRSYTNAEFAEYLESLVNEFPIISIEDGMDENDWEGWKLLTEKLGGKVQLVGDDLFVTNPKILAEGIEKGVANALLVKVNQIGTLSETLKAVDLAKRNRYASVMSHRSGETEDSTIADLAVATNCMQIKTGSLSRSDRMAKYNQLLRIEEELAEAADYPGKAAFYQLGK

SEQ ID NO: 91199 - protein, 388 aa, Glycine max
MAMASAKLNTLSSQWIAHNSFSPRRGSSSRRVSLPIRASSYQHELVQTAKSIASPGRGILAIDESNATCGKRLASIGLDNTEVNRQAYRQLLLTTPGLGEYISGAILFEETLYQSTTDGNKFVDCLRDQNIVPGIKVDKGLVPLPGSNNESWCQGLDGLASRSAEYYKQGARFAKWRTVVSIPCGPSALAVKEAAWGLARYAAISQDNGLVPIVEPEILLDGDHPIERTLEVAEKVWSEVFFYLAENNVLFEGILLKPSMVTPGAEHKEKASPETIAKYTLTMLRRRVPPAVPGIMFLSGGQSEVEATLNLNAMNQSPNPWHVSFSYARALQNTVLKTWQGHPENVEAAQKSLLVRAKANSLAQLGRYSAEGESEEAKKGMFVKGYTY

SEQ ID NO: 91200 - protein, 460 aa, Xanthomonas campestris pv. vesicatoria str. 85-10
MTDTPRRDDAATLQRFGYAQELKRQLTLKDLLIYGLVCMVPTAPFSIFGGVFDISAGMVPLTYLVGFVAMLFTALSYQQMSQAFPVAGSVYAYVGRGLSSGMGFLAGWAILLDYLLVPTLLYVVGANAMQTVLPAIPQPAWIGFFVVLNTVVNLRGIETTARANRFFLLAQLLVLAVFVVLATLAIQRGVNGAHWSWRPLYNPQAFSPQLIFSALSVAVVSFLGFDAISTMSEEARGGNRVVGRATLLALLIVAGLFILQTWLAALLQPTLQRYPSAQASNDAFFEIGRLIAGPWLQIVIALTVAISAAIANSLVAQAATSRLLFAMARDRQLPGFLRYIHPRTGVPQRAILLVAGLSLVLGEVFVGQIALLSSLCNVGALTAFVLLHIAVLWHFRTHGRRVLHGVVPLIGIVILAYVLLNADLHAQLGGAAWMAVGLTVLAFLKLSGRSTELRASDALE

SEQ ID NO: 91201 - protein, 278 aa, Chlamydomonas incerta
MAETLTLRATLKGHTNWVTAIATPLDPSSNTLLSASRDKSVLVWELERSESNYGYARKALRGHSHFVQDVVISSDGQFCLTGSWDGTLRLWDLNTGTTTRRFVGHTKDVLSVAFSVDNRQIVSGSRDKTIKLWNTLGECKYTIGEPEGHTEWVSCVRFSPMTTNPIIVSGGWDKMVKVWNLTNCKLKNNLVGHHGYVNTVTVSPDGSLCASGGKDGIAMLWDLAEGKRLYSLDAGDVIHCLCFSPNRYWLCAATQSSIKIWDLESKSVVDDLRPEFNI

SEQ ID NO: 91202 - protein, 140 aa, Arabidopsis thaliana
  misc_feature (91)..(91): Xaa can be any naturally occurring amino acid
  misc_feature (111)..(111): Xaa can be any naturally occurring amino acid
MASSMLSSATMVASPAQATMVAPFNGLKSSAAFPATRKANNDITSITSNGGRVNCMQVWPPIGKKKFETLSYLPDLTDSELAKEVDYLIRXNKWIPCVEFEFGARICVPVXTVTHPDTMMDGTGQCGSFPCSVAPTPLKC

SEQ ID NO: 91203 - protein, 444 aa, Aspergillus oryzae
MGSALARPQPRPEGGKSQTGASSTRMGSRRKLLSSMILHRRSSPRAPLATSRRRPLRRPPPTETCPSPRERNGAPGSSQHSIIKLLGQGTFGKVVEAFDKHRKTRVAVKIIRSIQKYRDASRIELRVLSTLASNDRQNRNKCIHLRDCFDYRNHICIVTDLLGQSVFDFLKGNGFVPFPSSQIQNFARQLFTSVAFLHDLNLIHTDLKPENILLVSNAYQTFTYNRTIPSSSHAISRSARQRRVLLDSEIRLIDFGSATFDDEYHSSVVSTRHYRAPEIILNLGWSFPCDIWSIGCILVEFFTGDALFQTHDNLEHLAMMEAVIGDRIDTRLVRQVMQGGRSGSQNQSAKYFIRNKLDYPNDETTRASRKYVRAMKQMTDFIPTTTKFHRLFLDLLQRIFVYDPKNRITAKDALKHPWFKESIVDDGTEALRIGEQLQRNTQRR

SEQ ID NO: 91204 - protein, 351 aa, Nocardia farcinica IFM 10152
MTTVEVPHGSRSAVLRVAAVIAETADSCSLVFDVPEDLTEKFAYRPGQFLTLRIPSDLTGSVARCYSLASSPYTDDKPKVTVKRTEGGYGSNWVCDNVKPGDQLEVLPPSGVFTPRDLDENLLLFGAGSGITPVMSILKSALARGTGKIVLVYANRDAETVIFADELRELAAKHPQRLTVIHWLEPLQGLPTADALASLTAPYASYEAFMCGPKPFMDLVHDALARLGVPRNRTHAEVFNSLAGDPFADQAPVEVSDEEAADAATVEVELDGEVHELSWPRKQTLVDIMLAKGIDVPYSCQEGECGSCACTVLEGEVAMENAEILDPEDIANGYILGCQARPVTDRLRIQF

SEQ ID NO: 91205 - protein, 192 aa, Geobacillus kaustophilus HTA426
MNLPNKITVARIMLIPFFLIVMLVPFGWGSIQIGGTELPVAHLAGALIFIIASATDWIDGYYARKYGLVTNLGKFLDPLADKLLVSAALIVLVELGAVPAWMVIVIISREFAVTGLRLVLAGEGEVVAANMLGKIKTWTQIVAISALLLHNFPFSLISFPFAELALWVAVIFTIWSGWDYFAKNRHAFSHSK

SEQ ID NO: 91206 - protein, 175 aa, Cryptococcus neoformans var. neoformans JEC21
MGAAESSMFNSLEKNSNFSGPELMRLKKRFMKLDKDGSGSIDKDEFLQIPQIANNPLAHRMIAIFDEDGSGTVDFQEFVGGLSAFSSKGGRDEKLRFAFKVYDMDRDGYISNGELYLVLKQMVGNNLKDQQLQQIVDKTIMEADKDGDGKLSFEEFTQMVASTDIVKQMTLEDLF

SEQ ID NO: 91207 - protein, 734 aa, Oryza sativa
MEEWHRFGRTGVYRTFMFSSPTILAVTPEACKQVLMDDEGFVTGWPKATVTLIGPKSFVNMSYDDHRRIRKLTAAPINGFDALTTYLSFIDQTVVASLRRWSSPESGQVEFLTELRRMTFKIIVQIFMSGADDATMEALERSYTDLNYGMRAMAINLPGFAYYRALRARRKLVSVLQGVLDGRRAAAAKGFKRSGAMDMMDRLIEAEDERGRRLADDEIVDVLIMYLNAGHESSGHITMWATVFLQENPDIFARAKAEQEEIMRSIPATQNGLTLRDFKKMHFLSQVVDETLRCVNISFVSFRQATRDIFVNGYLIPKGWKVQLWYRSVHMDDQVYPDPKMFNPSRWEGPPPKAGTFLPFGLGARLCPGNDLAKLEISVFLHHFLLGYKLKRANPKCRSRSEMDGVVAASADATRDEIKIMNVYIWDMDETLILLKSLLDGSYAGAFDGLKDHDKSVDIGKRWENLILELCDEHFFYEEIENYNEPFLSAVKEYDDGKDLTTYDFEADCFSSPYDDLNKRKLAYRHRAIGEKYTKGLEKILDHHMIKVWNDLYSATDKYTDGWLSSALMWHNQMLMWYNRVLMRLKLYKVGASVPCMRPSHKLLEEAMGKSTAESTAKHSSINCIVTSGSLIPSLAKCLLYRLDDVVAFENVYSSWEVGKLQCFKWIKERYDGPNVRFCAIGDGHEECTAAQIMKWPFVKIEFHPDAPHRFPGLNLPTIHRIMDTVYDSSSNDG

SEQ ID NO: 91208 - protein, 87 aa, Chlamydophila abortus S26/3
MSQKNKNSAFMNPVNITSDLAAIVGKGPMPRTEIVKKVWDYIKKRNLQDPKNKRNILPDEALAKVFGSKNPIDMFQMTKALSSHIVK

SEQ ID NO: 91209 - protein, 489 aa, Mycobacterium avium subsp. paratuberculosis K-10
MSSSVTPSRPTTGTAQIGVTGLAVMGSNIARNFARHGYTVALHNRSIAKTDALLKEHGDEGKFVRCETIAEFLDALEKPRRVLIMVKAGDPTDAVINELADAMEPGDIIIDGGNALYTDTIRREQAMRERGLHFVGAGISGGEEGALNGPSIMPGGPAESYRSLGPLLEEISAHVDGVPCCTHIGPDGAGHFVKMVHNGIEYSDMQLIGEAYQLLRDALGKTAEQIADVFDEWNSGDLDSFLVEITAQVLRQTDAKTGKPLVDLILDEAEQKGTGRWTVKSALDLGVPVTGIAEAVFARALSGSVAQRRATTGLASGRFGEKPSDAAQFTEDIRQALYASKIIAYAQGFNQIQAGSAEYGWDITPGDLATIWRGGCIIRAKFLNRIKDAFDENPDLPTLIVAPYFRSAIEAAIDGWRRVVVTATRLGIPIPGFSSALSYYDALRTERLPAALTQGLRDFFGAHTYGRIDEDPDKRFHTLWSADRREVPA

SEQ ID NO: 91210 - protein, 267 aa, Bacteroides thetaiotaomicron VPI-5482
MLDLKQLTVEVCRIATEAGHFLKEERKNFRRERVMEKHAHDYVSYVDKESEVRLVKALSALLPEAGFITEEGSATYQDEPYCWVIDPLDGTTNYIHDEAPYCVCIALRSRTELLLGVVYEVCRNECFYAWKGGKAFMNGEEIHVSDVRDIKNAFVFTELPYNYDQYKPTALHLIDNLYGAVGGIRMNGSAAAAICYIANGRFDAWAEAFIGKWDYSAAALIVLEAGGRVTNFYGDDHFIEGHHIIATNGYLHPLFLKLLAEVPPLDM

SEQ ID NO: 91211 - protein, 479 aa, Brassica napus
  misc_feature (379)..(379): Xaa can be any naturally occurring amino acid
  misc_feature (455)..(455): Xaa can be any naturally occurring amino acid
MRQLLKRVFFHRASSLIHHRHRPAVSFLRSDFSTSSSPPQIPPFGYEPRPYNGPSAEEVFEKRKKFLGPSLFHFYQKPLNIVEGKMQYLFDETGRRYLDAFAGIVTVSCGHCHPDILNAINEQSKLLQHATTIYLASPLLGDFPEAWAAKMPGNLKVVYFVNSGSEANELAMMMARLYTGSLEMISLRNAYHGGSSNTIGLTALNTWKYPLPQGEIHHVVNPDPYRGVFGSDGSMYAKDVQDHIDYGTSGKVAGFIAETIQGVGGAVELAPGYLKSVYDIVRKAGGVCIADEVQTGFGRTGSHYWGFQTQDVVPDIVTMAKGIGNGLPLGAVVTTPEIASVLATKIQFNTFGGNPVCSAGGHAVLKVIDKERRQTHCAXEVGSHLIQRLKDLQKRHDIIGDVRGRGLMVGIELVSDRKDKTPAKAETAVLFEQLRELGILVGKGGLHGDVFRIKXPPMCFTKDDADFLVDALDYSISRL

SEQ ID NO: 91212 - protein, 334 aa, Vibrio cholerae O1 biovar eltor str. N16961
MAFNLRNRNFLKLLDFTPKEIHFLLDLSAELKRAKYAGTEQKTLQGKNIALIFEKSSTRTRCAFEVAAFDQGAQVSYIGPSGSQIGHKESMKDTARVLGRMYDGIQYRGFGQEIVEVLGQYAGVPVWNGLTDEFHPTQILADLLTMQEYGRSKQLHEMKFAYLGDARNNMGNSLMVGAAKMGMDIRLVAPKAYWPNDALVATCQEIAKQTGAKITLTEEVQEGVKGCDFLYTDVWVSMGEAADAWDERVALMKPYQVNMDVIKATGNPQVKFMHCLPAFHDDQTKVGQEIAAKYGMQGLEVTEEVFESEYSIVFDEAENRLHTIKAVMVATLGQ

SEQ ID NO: 91213 - protein, 321 aa, Bacteroides thetaiotaomicron VPI-5482
MIIAFICIVLIFNTMETISIHRPKIVVIGSCNTDMVVKANRLPVPGETILGGTFYMNPGGKGANQAIAAARLGAEVTFISKIGYDLFGLQALEIYRSEKINTEYIFTDQKSPSGVALISVDSFGENSIIVAPGASRSLSIEDINKAEEKIKEADIILMQLEIPIDTVEYAATIACKYGKKVILNPAPASSLSNSFLMNVHTILPNRIEAEMLSGIKVMNIESAHRAAQAIGEKGIENVVITLGKDGAYVKEKDEYTMIPAKEVETIDTTGAGDVFCGAFSVCLSEGHSLAKSVKFANAAAAIAVTRIGAQSAIPYKREVVL

SEQ ID NO: 91214 - protein, 271 aa, Idiomarina baltica OS145
MLFKGIREDIKSVYSRDPAARNAFEILFNYPGLHAIWLHRFSHRLWMLKLYWLARFISNLGRWFTGVEIHPGAKIGRRFFIDHGMGVVIGETAEIGDDVTLYHGVTLGGTSWNKGKRHPTLKNGVVIGAGAKVLGPLTVGTEARIGSNAVVVRDVPEGATMVGIPARVAKSGQDKETNERRAKMAKAYGFDAYAIAADNPDPVATAIGRMLDHVHVLDQKVSDLCQAVNRLGGDVCGELPEVEMDDVAFLEEKQRAAQQREAQHESKHEAD

SEQ ID NO: 91215 - protein, 311 aa, Bacteroides thetaiotaomicron VPI-5482
MKVVVIGSSNIDMVAQVNHLPAPGETVGDASFMQSLGGKGANQAVAAARLGGSVTFITSLGNDMYAEILKKHFKKEGITTDYIIDDVNQPTGTALIFVADSGENCIAVAPGANYSLLPGSIIHFSKVIDEADIIVMQAEIPYETIKRIALLAKQKGKKVLFNPAPACLIDEELMKAIDILVVNELEAAFISGIEYTGNNLEEIALSLLQAGARNAVITLGSQGVYMKNDKEIIQLPGYKVNAIDTIAAGDTFCGALAVICAQREIDRDALSFANAAAAIAVTRSGAQPSIPTLDEVKHFMLEKELALSFNF

SEQ ID NO: 91216 - protein, 225 aa, Idiomarina baltica OS145
MNILQASEPVVSEKRINYQTATFITSAPNIRKLPEDSGIEIAFAGRSNAGKSSALNTLTRQRNLARTSKTPGRTQLINVFETATGQRLIDLPGYGFAKVPMEVKEQWQRSLSEYLEKRDSLKGLVVLMDIRHPFRETDQELIYWAVDCGIPVLALLTKADKLKQGARKSTLLKARQAAIAFNGDVQVEVFSSLKKFGIDQLENKLDQWFLGESPVDDNFVQSDDS

SEQ ID NO: 91217 - protein, 1205 aa, Streptococcus agalactiae
MLKKQFGNFGEKSRKVRVKMRKSGKHWVKSVMTQIGYVILSRFSGKEKSSKVQTTSEDLSRTKTSASILTAVAALGAVVGGTTDTTSVSAEETPTATELTGNEKTLATAETVVVAPEVKTVNSDSSSHSTSESQSMSTSTLQSTSASLSASESLMDSTSASLSESSSLSEYSSLSLSSSESVSASESVQSSEAATTARVQPRAMRVVSSASDMETLPAALISGEGDVTTVQGQDVTDKLQNLDIKLSGGVQAKAGVINMDKSESMHMSLKFTIDSVNRGDTFEIKLSDNIDTNGASNYSIVEPIKSPTGEVYATGIYDSQKKSIVYSFTDFAASKNNINGILDIPLWPDDTTVQNTKEDVLFSVKIKDQEATIKETVKYDPPVRIDFAGGVSVDSRITNIDDVGKKMTYISQINVDGKSLYNYNGLYTRIYNYSKESTADLKNSTIKIYKTTSDNIVESMVQDYSSMEDVTSKFANSYPEKGWYDIYWGQFIASNETYVIVVETPFTNAVTLNTTLSDYNENNGVEHNHTYSSESGYSDVNAQERKILSELVSSSESVSSSESVSNSESISTSESVSNSESISSSESVSSSESISTSESVSTSESISSSESVSSSESVSSSESISSSESVSNSESISSSESVSNSESISSSESVSSSESISNSESISSSESVSTSESISSSESVSNSESISSSESVSSSESISNSESISSSESVSTSESISNSESVSSSESVSTSESISSSESVSNSESISTSESVSTSESISSSESVSSSESISSSESVSNSESISNSESVSSSESVSNSESISSSESVSNSESISTSESVSTSESISSSESVSNSESISSSESVSNSESISSSESVSNSESISSSESVSNSESISSSESVSSSESVSSSESISTSESVSNSESISSSESVSNSESISSSESVSNSESISSSESVSNSESISSSESVSSSESISSSESVSSSESVSNSESISSSESVSNSESISSSESVSTSESISSSESVSNSESISSSESVSSSESVSSSESISTSESVSNSECISSSKSVSNSESISSSESVSNSESISSSESVSNSESISSSESVSSSESISSSESVSNSESILSSESVSSSESISSSESISSSESVSMSTTESLSESEVSGDSEISSSTESSSQSESMNHTEIKSDSESQHEVKHQVLPETGDNSASALGLLGAGLLLGATKSRKKKKD

SEQ ID NO: 91218 - protein, 616 aa, Desulfovibrio vulgaris subsp. vulgaris str. Hildenborough
MSHASLTARYRPQTFAEVAGQETVKAILSRAAQENRVAPAYLFSGTRGVGKTTIARIFAKALNCTTAPTGEPCNTCEQCRKVTQGMHVDVVEIDGASNRGIDDAKRLKEAIGYAPMEGRYKVFIIDEAHMLTREAFNALLKTLEEPPARVTFVLATTEPHKFPVTIVSRCQHFTFTRLSEAGLEAHLTKVLGREGVDYDPAAVRLIARRAAGSVRDSMSLLGQVLALGESRLTIDGARGVLGLAGQELFLRLMEALAAQDCLGVANVVRELLDRGVDMGFFLRELVATWRNLFMLRQAGEAALASLDLPEDEARQWLGWAKRFEPAHIHACWQMTLEGQRRVLTSLEPAMALELLLLNLAMLPRLMPVESLRPSGGGASAPSGSAAEGPASGGAATIPTPGTQGMQGTAPAAGMTPSPAAPATPAPSAAPSPRVPWDDAAPAPRQTGIPPRPAPRMPEASPTAGSPAAPAQGDDSDTAEHTPSGPRTWDGFLEFCQGRNGQGGRLATVLRQTTPEHDDGILRLATMSSVQYERLTDAATRTTLAGLVRDYFGDACRVEVNPPTRVRRTEAELRKEAEAHPAVQLLKEEMGACILKCTPLADLRRPEDTTEQGDNKP

SEQ ID NO: 91219 - protein, 349 aa, Bacillus cereus
MKALLWHNQRDVRVEEVPEPTVKPGAVKIKVKWCGICGTDLHEYLAGPIFIPTEEHPLTHVKAPVILGHEFSGEVVEIGEGVTSHKVGDRVVVEPIYSCGKCEACKHGHYNVCEQLVFHGLGGEGGGFSEYTVVPEDMVHHIPDEMTYEQGALVEPAAVAVHAVRQSKLKEGEAVAVFGCGPIGLLVIQAAKAAGATPVIAVELSKERQELAKLAGADYVLNPATQDVLAEIRNLTNGLGVNVSFEVTGVEVVLRQAIESTSFEGQTVIVSVWEKDATITPNNLVLKEKEVVGILGYRHIFPAVIKLISSGQIQAEKLITKKITVDQVVEEGFEALVKDKTQVKISCFT

SEQ ID NO: 91220 - protein, 301 aa, Robiginitalea biformata HTCC2501
MSEAATCEIDLPILRERDVRLWIRREDELFPGLSGNKYRKLKYNIREMQRGGHQTLLTFGGAFSNHIHAVAAAGRQFGFRAIGVIRGDELAVSPLNPTLADARDAGMHLHFVSRRDYARRQSPEYLQELLGQFGPAYLLPEGGTNPAAVRGCAEILGEADAGFDRVCCPVGTGGTLAGLAAAAVPGQQVRGYASLKASGLEASLRDWIPGKHWTLSGEFHFGGYARIDARLVRFINDFRTETGVPLDPVYTGKMLYGILEETRRGQFQPGTRILAIHTGGLQGIRGMNLKLGKKGLPLLQL

SEQ ID NO: 91221 - protein, 416 aa, Candida albicans SC5314
MSDLPLLGGSRNQGNFMHRAKKSVYNGTLSTLKSSPVNYLLIFVPLGIIAGELEWSATARFLLNFFAIVPLASVLAFATEEISEHVGQTVGGLLNATFGNAVELIVSIIALKDNQVRIVQASMLGSILSNLLLVLGCCFVAGGITRVQQTFNQTVAQTMSSLMALATASLLIPAAFHASLPTPKKGGGFPEPGSSDELILSFSRGVSVVLLIVYLFYLLFSLKTHKELFEEDQSADAILNERSQNSTLDVVTGPKTEEDGHLSMTAGLVVLLLTTILVSFCADYLVGSIDEIVESSGLSKTFIGLIVIPIVGNAAEHVTAIVVAMKDKMDLAIGVAIGSSLQIAIFVTPFMVLVGWAIDVPMSLYFSTFETAILFVSVFITNLVILDGESNWLEGAMLLSTYLIIALAFFYYPDVN

SEQ ID NO: 91222 - protein, 354 aa, Triticum aestivum
  misc_feature (155)..(155): Xaa can be any naturally occurring amino acid
  misc_feature (188)..(188): Xaa can be any naturally occurring amino acid
MADEEGCMYAVQLALSSVLPMTLKAAIELGLLETLVGAGEGTLSPEEVAAKLPAKANPEAAAMVDRMLRVLASHEIVSCVVEEGKDGSLSRRYGAAPVCKWLTPNEDGVSMAAWAIIAQDKIFMDTWCYLKDAVLEGGSPFKKALGMSWFDYAGXDMRFNHLYNEAMKHHSGIITKKLLELYTGFDGXGTLMGRRAAASGTTIHAITSKYPSIKGINYDLPHVISEAPPYPGVQVQHVGGDMFKQVPSGTDAILMKWILNCFSDQQCATLLKNCYDALPAHGKVINIECIMPVNPDPTPSARGLIQIDMSLLAYSNGGKERYQRELEKLAMGAGFASVKSTYIYANFWALEYTK

SEQ ID NO: 91223 - protein, 485 aa, Bacillus subtilis subsp. subtilis str. 168
MFQYEELNKQFIGGKWQEGSSPNVLENKNPYTQKTFTTFRKATADDVDEAYRAAALAKKKWDAVNPFEKRTILEKAVTYIEENEEAIIYLIMEELGGTRLKAAFEIGLVKNIIKEAATFPIRMEGKILPSTIDGKENRLYRVPAGVVGVISPFNFPFFLSMKSVAPALGAGNGVVLKPHEETPICGGTLIAKIFENAGIPAGLLNVVVTDIAEIGDSFVEHPVPRIISFTGSTKVGSYIGQLAMKHFKKPLLELGGNSAFIVLEDADIEYAVNAAVFSRFTHQGQICMSANRVLVHSSIYDKFLELYQAKVESLKVGDPMDPDTIIGPLINSRQTDGLMKTVEQAIEEGAVPVKLGGFNGTIVEPTILKDVKPFMSIAKEELFGPVVSFMKFDSEDEAVDIANETPFGLSGAVHTSNLERGVAFAKRIETGMIHVNDTTINDEPNVAFGGEKQSGLGRLNGEWSLEEFTTLKWISVQHEKRSFPY

SEQ ID NO: 91224 - protein, 136 aa, Zea mays
PFQILTLSIIRNRWSIHLTKHFALTISLTTFSRPVVVLAGFGNLPGDMAFWDYSEKKLVAKTKAECSVTSEWSPDGRHFMTATTAPRLQIDNCIKIFDHNGSLQFKKMFERLYQADWKPEAAERFTDIADLTTSLS

SEQ ID NO: 91225 - protein, 154 aa, Chlamydomonas incerta
MALQATSQLARQLISKTVGGAFATKAADVVPTFDWKKVPVPSATAKDIPVTVKGATPAGDLRATSGLGLGDGIKNHTDKWLDGDKKSPMEYINEVAPIKVKGLVVASYGSDDPALGCPVEYINLKGTSKENPAVCKYTGNRYYSDDWKGGAAHH

SEQ ID NO: 91226 - protein, 518 aa, Bacillus subtilis subsp. subtilis str. 168
MSILSVKDLSHGFGDRAIFNNVSFRLLKGEHVGLIGANGEGKSTFMNIITGKLEPDEGKVEWSKNVRVGYLDQHTVLEKGKSIRDVLKDAFHYLFAMEEEMNEIYNKMGEADPDELEKLLEEVGVIQDALTNNDFYVIDSKVEEIARGLGLSDIGLERDVTDLSGGQRTKVLLAKLLLEKPEILLLDEPTNYLDEQHIEWLKRYLQEYENAFILISHDIPFLNSVINLIYHVENQELTRYVGDYHQFMEVYEVKKQQLEAAYKKQQQEVAELKDFVARNKARVSTRNMAMSRQKKLDKMDMIELAAEKPKPEFHFKPARTSGKLIFETKDLVIGYDSPLSRPLNLRMERGQKIALYGANGIGKTTLLKSLLGEIQPLEGSVERGEHIYTGYFEQEVKETNNNTCIEEVWSEFPSYTQYEIRAAPAKCGLTTKHIESRVSVLSGGEKAKVRLCKLINSETNLLVLDEPTNHLDADAKEELKRALKEYKGSILLISHEPDFYMDIATETWNCESWTTKVL

SEQ ID NO: 91227 - protein, 357 aa, Bacillus subtilis
MTSYLSDYVQQIKPSGIRKFFDLAATMEGVISLGVGEPDFVTAWNVREASILSLEQGYTSYTANAGLYSLREEISRYLSNRFDLSYSPDNELIVTVGASQALDIAIRAIVNPGEEVIIPEPCFVAYDALVSLAGGIPVHVHTTADKGFKATAADFEAAVTEKTKAILICSPSNPTGSVYSKEELNEIAEFAKKHDVIVLADEIYAELTYDEEFTSIAALPGMKERTVVISGFSKAFAMTGWRLGFAAAPSLLRDAMLKIHQYAMMCAPAMAQFAALEGLKNGMEDVEKMKKSYRRRRNLFVESLNEIGLSCHHPGGRFLCFSIYQKHGNEFKNSLPEELLTQEKVAVVSWKCVWSER

SEQ ID NO: 91228 - protein, 213 aa, Pseudomonas putida GB-1
MSRNSYIQQSSDIQAAGGLVPMVIEQSARGERAYDIYSRLLKERVIFLVGPVEDYMANLVVAQMLFLEAENPDKDIHLYINSPGGSVTAGMSIYDTMQFIKPDVSTICIGQACSMGAFLLTAGAKGKRHCLPNSRVMIHQPLGGFQGQATDIQIHAQEILSIKARLNELLAYHTGQDLETIQRDTERDNFMSASRAAEYGLIDSVYDKRQLAS

SEQ ID NO: 91229 - protein, 340 aa, Bacillus cereus ATCC 14579
MTKIFILASTLSLSFFSGLNIGNTTTENFQPLTNAIVQNSDHFAEGNSKDNNIPPGNNGSQDDTGSGDNGSGGNGSGGNGSGGSGSGGNGSGGNGSGDNGSGGNGSGDNGSGGNGSGDNGSGGNGSGDNGSGGNGSGDNGSGGNGSGDNGSGGNGSGGSGSDGSGSGGNGSGGNGSGGNGSGDNGSGGNGSGGNGSGGNGSGGNDSGGNGSSGNGSGGNGSGGNGSGGNGSGGNGSGGNGSGGNGSGGNGSGGNGSQGGNRVKGDSSSQGGNGSQGGNRVKGDSNSQEGTGSQGGNVKDNTKKQGDKLPNTATHYPISILMGLSTFLIGMLLFIRRKNVK

SEQ ID NO: 91230 - protein, 188 aa, Bacteroides thetaiotaomicron VPI-5482
MEPILNSQLPEFSVQAFQNGAFKTVTNNDLKGKWAILFFYPADFTFVCPTELVDMADKYAQFQEMGVEIYSVSTDSHFVHKAWHDASESIRKIKYPMLADPTGALSRALGVYIEEEGMAYRGTFVVNPEGKIKVVELNDNNIGRDASELLRKVEAAQFVATHDGEVCPAKWKKGESTLKPSIDLVGKI

SEQ ID NO: 91231 - protein, 416 aa, Salmonella enterica subsp. enterica serovar Typhi str. CT18
MESKVVVPVEGKKITLQNGKLNVPENPIIPFIEGDGIGVDVTPAMLKVVDAAVEKAYKGERKISWMEIYTGEKSTQVYGQDVWLPAETLDLIRDYRVAIKGPLTTPVGGGIRSLNVALRQELDLYVCLRPVRYYQGTPSPVKHPELTDMVIFRENSEDIYAGIEWKADSADAEKVIKFLREEMGVKKIRFPEHCGIGIKPCSEEGTKRLVRAAIEYAITNDRDSVTLVHKGNIMKFTEGAFKDWGYQLARDEFGGELIDGGPWLKIKNPNTGKEIVVKDVIADAFLQQILLRPAEYDVIACMNLNGDYISDALAAQVGGIGIAPGANIGDECALFEATHGTAPKYAGQDKVNPGSIILSAEMMLRHMQWFEAADLIVKGMEGAIAAKTVTYDFERLMDGAKLLKCSEFGDAIIANM

SEQ ID NO: 91232 - protein, 360 aa, Thermotoga sp. RQ2
MERVGIVGLPNAGKSSFFNFLTDNSVPAESFPFCTIEPNVGIFVVPDERIELLAKNEGSKKVVHPFVEVVDIAGLVKGASKGEGLGNQFLDHISKVDVIAHVVRLFEDGRVSHPYQNVDPKRDIEIVETELILKDLETVQKRLEKRMKVARTGDKEAKREVELLQNLREFLSQGKKASKFPRHDRFEEEVIESLFLLTDKPQILVFNVDELDEEKRKLIEEIVKEKDEEYIIINVKLEEELKFLPEEEAEVFRREYNLFGDKRREFFEKVLKLLNLIRFLTATQNEARSWTIKKGSTAYEAAGLIHSDIQKGFIKAEVIPFERYVEFGSLKKAREAGAVETHGKDYIVREGDVIHFLFRA

SEQ ID NO: 91233 - protein, 178 aa, Zea mays
MALTRIGLAGLAVMGQNLALNIAEKGFPISVYNRTTSKVDETVQRAKVEGNLPVFGFHDPASFVSSIQKPRVVIMLVKAGAPVDQTIATLAAHLDQGDCIVDGGNEWYENTERREKAMEERGLLYLGMGVSGGEEGARNGPSLMPGGSFEAYKYIEDILLKVAAQVPDSGPCVTYIGK

SEQ ID NO: 91234 - protein, 97 aa, Synechococcus sp. CC9311
MTSFNVQLITPQGEVSFHCPDDEYILDAAEQAGIDMSYSCRAGACSSCVGRLIQGTLDQSDQSFLDEAQIKDKYALLCVAYATSDLVVKTDCEEELW

SEQ ID NO: 91235 - protein, 261 aa, Ostreococcus tauri
  misc_feature (88)..(94): Xaa can be any naturally occurring amino acid
MRYGGDETEASRGRRAAPTREREPTTPTRAARLRRETNDFGERSWKIYERSSNGRARRLTGGVFAGRRVASPSSVRRRGASYSRPCVXXXXXXXDNAEYRQRETFALRDHSQEDAREVQAGKFDLNYIGLDGNIGCMVNGAGLAMATMDIIQLYGGSPANFLDVGGNASEEQVVEAFKILTADPKVKAILVNIFGGIMKCDVIAAGIVAAAKQVDLRVPLIVRLEGTNVEAGNAILSSSDLTIITASDLDDAAQKACASLK

SEQ ID NO: 91236 - protein, 203 aa, Ostreococcus tauri
  misc_feature (202)..(203): Xaa can be any naturally occurring amino acid
MLRRARRATTRARALSLAGARRHLNVHEYQGAEIMMKNGVRVPIGVACATLDDVDAACDALRGREVVVKSQILAGGRGLGTFASGFAGGVHVVAKTEARATAEKMLGGTLVTKQSGPAGKPVNVLYVAEKLKLTREMYFALMLDRASAGPLVIASAEGGTSIEDLAATQPEKIIKMRLDIVKGMTRPQADELVEKLGVKKHXX

SEQ ID NO: 91237 - protein, 382 aa, Geobacillus kaustophilus HTA426
MAKRDYYEILGVSKNATKDEIKKAYRKLSKQYHPDVNKAPDAAEKFKEIKEAYEVLSDDEKRARYDRFGHADPNETFGGGGFQGGGFDFGGFSGFGGFEDIFETFFGAGPRRRASGPRKGADVEYMMTLTFEEAAFGKETEIEIPREETCDTCQGSGAKPGTSPTSCPHCHGSGQVTSEQATPFGRIVNRRTCPVCGGTGRYIPEKCPTCGGTGRVKRRKKIHVKIPAGVDDGQQLRVAGQGEPGVNGGPPGDLYIIFRVEPHEFFKRDGDDIYCEVPLSFAQAALGDEIEVPTLHGHVKLKIPAGTQTGTRFRLKGKGVPNVRGYGQGDQHVIVRVVTPTKLTEKQKQLLREFERLGGDTMHDGPHGRFFEKVKKAFKGEA

SEQ ID NO: 91238 - protein, 507 aa, Synechococcus sp. CC9311
MTATITNPLRVGLRQERVIAPQCLVIFGASGDLTHRKLVPALFELFQQRRLPSEFAILGCARRPWSDDEFRSKMAEAMGDKVRDHPEAWEQFAAGMFYEPVDLQKPEDVVKLGGRLQEIDRLRATRSNRTFYLSVSPKFYASGCRALADADLLKDPQRSRVVIEKPFGRDYGSAQSLNRVVQGCGQENQIFRIDHYLGKETVQNIMVMRFANAIFEPIWNRNYISSVQITASETVGVEERAGYYETSGALRDMVQNHLTQMLAITAMETPGRFDPEAIRSEKAKVLQAARLADELEPWNCCVRGQYGPGGSDGSPLSGYRQEPGVDPQSTTETYVSMKLFIDNWRWQGVPFYVRTGKRLAKRLSEVVLTFREAPVHLFDAAGGSPTANQLILRIQPDEGAEFKFEVKSPGSGMRSRPVEMEFSYDESFGEPSDEGYVRLLADAMLGDPTLFTRSDEVEAAWRLYTPLLELIEDSPWKLPIHPYESRTWGPAAADALLARDGLLWRRP

SEQ ID NO: 91239 - protein, 145 aa, Glycine max
  misc_feature (59)..(59): Xaa can be any naturally occurring amino acid
  misc_feature (67)..(67): Xaa can be any naturally occurring amino acid
  misc_feature (103)..(103): Xaa can be any naturally occurring amino acid
  misc_feature (123)..(123): Xaa can be any naturally occurring amino acid
ITLTHDDLKRLVDDMAVYSFKTGVVLGLGAGSNADLVVDNVGDLLALRPLCDIFGVATXKRTEEQAXSFRLHLSVLDYNPRLHLASHGCDNVQPDLKLYTRRXRALLREKIVEATYDKFVVIXGDTKLVDGLCGSGLAMPADGVQ

SEQ ID NO: 91240 - protein, 214 aa, Arabidopsis thaliana
MEAEVEEEEEDMFEDAVCTTQARVNTPLSVITEAFEDLADLVKPQRSDEIDEDELRLDDFCSACTHVSVLFNCLGFAFKFAEMEYIAKVKDLVEASKTFETLHNILDLDVEKETVKTPGSHSRNLRRVRQDDYSLKDAATTAYTEVCAPFHTWAVRTAVYAGMYTLPTRDQLLLRLNETDQSVEKNMRRYMEASRPIIEYIDKLYIERNIKLDW

SEQ ID NO: 91241 - protein, 337 aa, Triticum aestivum
MSTPSDPAASAQPPSTAATSSSGLTFKLHPLVIVNVSDHYTRVKAQASFPAEAPSPGKAQASCSAEGSPPPAEPPRVFGCVIGVQRGRTVEIFNSFELVLDPVTGTLERAFLEKKLELYKKVFPEFYVLGWYSTGSDVQDTDILIHKALMDINESPVYLLLNPAINHSQKDLPVTIYESELHVIDGGPQLIFVKSNYTIETVEAERISVDHVAHLKPSDGGSAATQLAAHLTGIHSAIKMLNSRVRVIQQYLGAMQKGDIPLDNSLLRQVSSLVRRLPAMESEKFQDDFLTEYNDTLLMTYLAMFTNCSSTMNELVEKFNTTYERSPARRGGRGAFM

SEQ ID NO: 91242 - protein, 470 aa, Desulfovibrio vulgaris subsp. vulgaris str. Hildenborough
MEYVCLGCGARHSIDELLYTCPSCGGVFLLEDLDFDHLADHRSGDDWRTLFDSRASTRCRSLRGIFRFYELMAPVLEEDDIIYLGEGNTPVVDASPALERSVGQRFAYKNDGQNPSASFKDRGMACAFSYLRALVRKHGWDEVLTICASTGDTSAAAALYASYVGSPIKSAVILPHGKVTPQQLSQPLGSGATVLEIPGVFDDCMKVVEHLAENYRVALLNSKNSWRILGQESYAFEVAQWYGWDMAGKCVFVPIGNAGNITAVMSGFLKMHRLGIIDALPRVFGVQSHHADPVYRYYSVEDPRQRHYEPVTVQPSVAQAAMIGNPVSFPRVRHLAERFEALGGPGAFQVVQVTEQAIMDSMIRANRHGHIACTQGGECLAGLLRAKELGLVDKDETAVLDATAHSLKFSGFQDMYFTNGFPPAYGVTPDATLGNAPSLVLHDEDKVALAEKYTVEAAQRIAAKLGLAGK

SEQ ID NO: 91243 - protein, 204 aa, Neisseria meningitidis FAM18
MSFDNYLVPTVIEQSGRGERAFDIYSRLLKERIVFLVGPVTDESANLVVAQLLFLESENPDKDIFFYINSPGGSVTAGMSIYDTMNFIKPDVSTLCLGQAASMGAFLLSAGEKGKRFALPNSRIMIHQPLISGGLGGQASDIEIHARELLKIKEKLNRLMAKHCGRDLADLERDTDRDNFMSAEEAKEYGLIDQILENRASLQF

SEQ ID NO: 91244 - protein, 480 aa, Thermoplasma volcanium GSS1
MEYHEVIEKLDFSKVTRFYWLLTLLATIGGFLFGYDTSNIGTALVFIPYPVQGFIEGYLVAGASLGAAVGALIAAGLTDRYGRKYLLIADAAIYAAGAILSAFTIDLAMLLLSRTLIGLAVGADSGIATAYISEYAPKDRRGSLGILQQWMITIGILGAYIVGMATLYAAPGLASVLDWRIMLGVAAIPALIGLGFRFMMPESPRWLMINGKYKEASEAFKKLGLNLSVDELKEVKFRQRAKITNGVKRAFLVVALFFVFQQITGINIPFYYGPIVIEKLHLFGSATQSLVFTQIYAVAAATILAVINVAATYIGFRYIDTVGRRKLALLGYSGMTFFGLLGGLLLYLKFDVGLLIAFAGFIIFFAFGVGGTGWMIQGEYFPTNMRGLYASLGAFVDWIANFAIIEIFPVLEALITIKNVMFVFGILSLIAVLIFYYIMPETKELSVEQISDLFENNGLSSLRKASMSYNKSSSGSSGKK

SEQ ID NO: 91245 - protein, 425 aa, Marinobacter sp. ELB17
MTNKELQALKERYVAAGAASPNEQFADHATNAELWDADGKRMIDFAGGIGVLNIGHRHPKVVEAIRAQLDKLMHTCQTVMPYEGYVRLAQKLSDVVPVRGHAKVMLANSGAEALENAVKIARAATGRTNVICFDGGYHGRTFMTMAMNGKAAPYQTDFGPMPGMVYRAPYPVPYHGVSEDEALRGLAMTMKADSPARNTAAIVIEPVLGEGGFYPAPTSFMKALRTICDDNGIVLIVDEVQSGFGRTGKMFAIEHTGVEPDMMTMAKSMADGMPISAIVGTDKIMDSCGPNSLGGTYAGSPTACAAALAVFEVFETEDILGKSQRLGEKLNQRFSQWQEQFAHVDNVRTLGAMAAFELVENKDTRKPMPELVAAITKLAKAKGLILLGCGLYGNTLRFLMPVTIEDEVLNEGLAILEQCLKEAGA

SEQ ID NO: 91246 - protein, 233 aa, Synechococcus sp. CC9311
MKPRDPAAVEALFNAVAPRYDRLNDLLSLGLHRQWKRQLLSWLSPQPDERWLDLCCGTGDLALALARKLRPDGSVLGLDAAEAPLTLAAERAGREPWLRVQWMQADALETGLPDQDFDGVVMAYGLRNLADPFLGFQEMARVLKPGGRAAVLDFNRLPEGSAAAAFQRIYLRRVVVPIAAGMGLADQYAYLETSVNQFLTGAEQESQAVAAGFTSAQHRRLVGGQMGVLLLIR

SEQ ID NO: 91247 - protein, 334 aa, Schizosaccharomyces pombe
SSTITCDGKSLNTLPTPKQEDVEFGVPLQPEDTQDLQRKLKPRHMQMIAIGGCVGTGLFVGSGNALADGGPASILIAFAVIGTYVLFTTSALAELSAIYPVSGSFYTYFSKFIDPAWGFAVGIQYWLSFAVTVPLELTVAPLIINFWNASGPVSIWISVFYVIIIAINIWGTEGYGEVEFFLSIMKVISVIGFVILSIIIAAGGVPTDDRGVIGVSYWKQPLVFNNGFKGLCAVSVIAIFSLSGTELVGLAASEAKNPQKTVPAAVKQIFWRIFLFYIVALFMLTLVVPSDLPGLRTSDNSNVLISPFVIAIQLANIRALPSIMNVVILLSTLS

SEQ ID NO: 91248 - protein, 472 aa, Lactococcus lactis subsp. lactis Il1403
MAQANFGVVGMAVMGKNLALNVESRGYTVAIYNRTTSKTEEVYKEHQDKNLVLTKTLEEFVGSLEKPRRIMLMVQAGAATDATIKSLLPLLDKGDILIDGGNTHFPDTMRRNAELADSGINFIGTGVSGGEKGALLGPSMMPGGQKEAYDLVAPIFEQIAAKAPQDGKPCVAYMGANGAGHYVKMVHNGIEYGDMQLIAESYDLLKRVLGLSNAEIQAIFEEWNEGELDSYLIEITKEVLKRKDDEGEGYIVDKILDKAGNKGTGKWTSESALDLGVPLPLITESVFARYISTYKDERVKASKVLSGPAVNFSGDKKEVIEKIRKALYFSKIMSYAQGFAQLRKASEEFDWDLPYGTIAQIWRAGCIIRAEFLQNITDAFDKDSELENLLLDDYFVDITKRYQEAVRDVVSLAVQAGIPIPTFTSAISYYDSYRSENLPANLIQAQRDYFGAHTYERTDKAGIFHYDWYTED

SEQ ID NO: 91249 - protein, 563 aa, Coccidioides immitis RS
MAGVTTTNGASRPSTPAFSSLSLTEYTANPTPPSEKCVHQPDWDIPDSLLLPNGYPDYLRLILTSRVYDVIKESPLTHAVNISNRLECRVSLKREDLLPVFSFKLRGAYNKMAHLSDERRWKGVIACSAGNHAQGVAFSARHLKIPATIVMPSCTPAIKHKNVSRLGGNVVLHGSDFDASKEEAHRLAKLHGLTNIPPFDDPYVIAGQGTCGMELLRQANVQNLEAVFCCVGGGGLIAGVGVYIKRIAPHVKVVGVETCDANAMAQSLETGKRVTLKDVGLFADGAAVKIVGEETFRLCREVVDEVIQVTTDETCAAIKDIFEDTRSVVEPAGALALAGLKKYVAKYPSSNPNRELIAVASGANMNFDRLRFVAERAALGEKKEALLSVTITEQPGSFAKLVEIIMPHDITEFSYRCATTSSADILMGISLSASTGMADLADLKLQIERDGMSVTEVTDDELAKTHIRYLVGGRSNVSDERVFMFEFPERPGALARFLTTLRPHQNITLFHYRNYGGDVANILAAVQCPPDEAQEVESFLRDLGYPFKDCTGSPVYQRFLRNH

SEQ ID NO: 91250 - protein, 154 aa, Oryza sativa
MAVEAPWLARKQDSESENEELDWGTMAQIPNLDNAPLNLAALREQSQKDLLNILKSIRGKKCVVIDPKLAGTLSLILQTSLLKEYGAELRLLSAEPLQTECAKILYLVRSELKFMKLIASQIKNDEPKGLQREFFLYFVPRRTVACEKDSIILE

SEQ ID NO: 91251 - protein, 199 aa, Zea mays
MASTRFPQIGKPAPEFGGQAVVDGQFKNINLSDYKNKYVVLFFYPLDFTFVCPTEIIAFSEAAEQFRAINTELIACSNDSHFSHLAWVNLPRKQGGLGKMEIPLLADKSGKIARDYGVYIEEEGISFRGLFIIDGNGVLRQITINDLPVGRSVEETLRLVQAFQFTDEHGEVCPANWKPGKKTIKPSVENSKDFFQDSA

SEQ ID NO: 91252 - protein, 193 aa, Streptococcus pyogenes M49 591
MGWWKESITIVKALDPAARNSLEVILTYPGIKALAAHRLSHFLWRHHFKLLARMHSQFWRFWTQIEIHPGAQIAPGVFIDHGAGLVIGETAIVEKGVMLYHGVTLGGTGKDCGKRHPTIRQGALISAHAQVIGPIDIGANAKVGAAAVVLSDVPEDVTVVGVPAKIVRVHGQKDNRQIQSLQKQREVSYQLSK

SEQ ID NO: 91253 - protein, 350 aa, Nicotiana tabacum
MSEGEKVLPTASADEKSGASENKKSSESSSTEAPSGEARTTSTAAAGAGLQNPFDFSAMSGLLNDPSIKELAEQIAKDPAFNQMAEQLQKTFQGAAVEESVPNFDSQQYYSTMQQVMQNPQFMTMAERLGNALMQDPSMSGMLESLSNPAQKEQIEERMARIKEDPSLKPILEEIESGGPAAMMRYWNDQETLKKIGEAMGFAAGGEGATSSAIPGTDETEEASEDESVVHQCASVGDAEGLKAALTAGADKDEEDSEGRTALHFACGYGEVKCAQILLEAGAKVDALDKNKNTALHYAAGYGRKECVALLLENGAAVTLQNMDGKTPIDVAKLNNQQEVLKLLEKDVFL

SEQ ID NO: 91254 - protein, 461 aa, Clostridium difficile 630
MKIVVVGGGPGGYVAAIKASMLGADVTVVEKRRVGGTCLNAGCIPTKALLASSGVLNTVKEAKDFGIEIDGTVKPNFTAIMERKNKVVNQLISGIEFLFEKRGVNLVNGFGKLIDKNTIEVTKDDGTVETIKADKIILANGSVPVVPRMFPYDGKVVITSDEVLGLEEIPESMLIVGGGVIGCEIGQFFRALGTEVTIVEMVDQILLNEDKDVAKQLLRQFKKDKIKVITGIGVQTCEVVDGKAVATLSNGKVIEAQYALVCVGRRPNLDNSGVEDIGIEMERGKVVVNEHLETNVEGIYAIGDIIDTPFLAHVASKEGIVAVENALGKTKVVDYRAIPRCVYTEPEVAGVGKTEKQLEAEGVEYNVGQFDFRGLGKAQAIGHFQGFVKVIADKETDKIIGAAVVGPHATDLLTELSLAVHLGLTVEQVGDAIHPHPSLSEGLMEALHDVHGECVHSVPKL

SEQ ID NO: 91255 - protein, 402 aa, Ostreococcus tauri
MVMSARVAPRAGAIGARRARCATRSTTTTRTTTRASVTAHGPTSCHGGAHLTSERKAELEAICAAIGRAGKGITACDEGPGTIGTRFENVGVTNTEENRRAYRQMLFETPGANEYLSAAILDPETLYQKSTTNGKLFPEVLSDLGIVPGVKPHLKVYALPGQSGATVMQGLDSLAMRLEEYKKAGCKFAKWRSPMDIDIANGQPSELTIETNMKDLARYALICQDVGLVPIVEPDISLKGDHDLETAVRVNLKVQSMLFKSMVDHGVYMEGALLKSNMVNPGKKCPINYTVDELAIANLQVFRRCFPTAMVSANFLSGGQSLEDACARLDAINKHKTAKDPWNLSFSWSAALQMPLFELCRGKTELPLKEMGELYIAELEKAGAAALGTYNRNGKEGDHSAK

SEQ ID NO: 91256 - protein, 376 aa, Arabidopsis thaliana
MSDETTSSPSPAPAKKKQNLGWMEWMRGWSSVFGEILFQRITASHLENPLPLPSVNDLTCVVTGSTSGIGRETARQLAEAGAHVVMAVRNTKAAQELILQWQNEWSGKGLPLNIEAMEIDLLSLDSVARFAEAFNARLGPLHVLINNAGMFAMGEAQKFSEEGYEQHMQVNHLAPALLSVLLLPSLIRGSPSRIINVNSVMHSVGFVDPDDMNVVSGRRKYSSLIGYSSSKLAQIMFSSILFKKLPLETGVSVVCLSPGVVLTNVARDLSRILQALYAVIPYFIFSPQEGCRSSLFSATDPQIPEYWETLKNDDWPVCPFISQDCRPANPSEEAHNTETAQRVWKKTLELVGLPLDAVEKLIEGENIQCRYGAQHE

SEQ ID NO: 91257 - protein, 300 aa, Oryza sativa Japonica Group
MVVPVFAAQCSECPDCLSDRSNLCSKLPNVAGLMPRDRTTRFSSVSTGEPIRHFLSVSSFAEYTVVDITHIVKLDVGFPPAMACLLSCGISTGVGAAWKVAAVEPGSSVAVFGLGAVGLAVAQGARMRGAKRIIGVDLNPDKFDVGKRLGMTDFINPNDTGGKTVSEVIKEMTGGGGADYCFECIGSTSVMAEAFQSTRNGWGKTILLGVSGNKAPISIPSHEILRGRSVIGSLFGGIKPKNDIPMLAQKYLDKELELEEFITHEMGFEEINRAFELLTQGKSIRCIIWMDGAKVIDNGE

SEQ ID NO: 91258 - protein, 468 aa, Glycine max
MEVLLPKLPSFKFPSATYCCSITSRSSSYVRFGFRRVSVCASTVNETVAEPTVGSSSLGHSTRPHFPILHQEVNGSKLVYLDNAATSQKPTTVLKALQNYYEAYNSNVHRGIHFLSAKATDEYESARRKVASFINATDSREIIFTKNASEAINLVAYSWGLSNLKPDDEIILTVAEHHSAIVPWQIVAQKTGAVLNFVDLNQDEIPDIDKLKEMLSRKTKIVVVHHVSNVLASVLPIRDIAQWAHDVGAKVLVDACQSVPHMMVDVQSLNADFLVASSHKMCGPTGIGFLYGKIDLLSSMPPFLGGGEMISDVYLDHSTYAEPPSRFEAGTPAIGEAIGLGAAIDYLSGIGMQTIHDYEVELGRYLYERLLSVPNIRIYGPAPSEKVERAALCSFNVENLHPTDLATLLDQQHGVAIRSGHHCAQPLHRYLGVSSSARASLYFYNTKEDVDNFIHALNDTVSFFNSLM

SEQ ID NO: 91259 - protein, 354 aa, Staphylococcus aureus subsp. aureus MRSA252
MLTVDQVKELIGEIKDPIIDVPLKETEGIVEVSIKEEKEHVSVKVAMAQLGGAPQLDLQMAVVNVLKENGAKTVGIRFETLPEEKVNQFKPKEENKPKTIEGLLSQNNPVEFIAIASGKGGVGKSTVAVNLAVALAREGKKVGLVDADIYGFSVPDMMGIDEKPGINGKEVIPVERHGVKVISMAFFVEENAPVIWRGPMLGKMLTNFFTEVRWGDIEYLILDLPPGTGDVALDVHTMLPSSKEIIVTTPHPTAAFVAARAGAMAKHTDHSILGVIENMSYFESKETGNKEYVFGKGGGTKLADELNTQLLGELPLEQPSWNPKDFAPSIYQSDDRLGKIYSSIAQKVIAATNK

SEQ ID NO: 91260 - protein, 390 aa, Desulfovibrio vulgaris subsp. vulgaris str. Hildenborough
MNISDRLTRIKPSATLAVNAKALELKARGVKVVSLAVGEPDFGTPAHICEAAKRAIDEGFTRYTPVPGIIELREAVAGYFGRCYGVEAPAEATIVTNGGKQALYNLFQALLNPGDEVLVPAPYWVSYPALVQLAEGVPVFVPSPAERGFKITPAELDAHRTPRTRVLLLNSPSNPTGACYTREEMDALMQWAVDHDIFVIADEIYDRLVYGDMQPVSVSGWWQRFPDRVAVVNGLAKTFAMTGWRVGYVLAHPDLVKAVAKIQGQSTSNICSIAQKAALAALTGPYDAVEEMRCAFVRRRDLAYDIISGWKDVVCPRPDGAFYLFADIHRHYNASMPDSAAVCTRLLEEAQVALVPGSAFGDDKCIRFSYAVADDVLEDALSRVAKVLFG

SEQ ID NO: 91261 - protein, 63 aa, Sinorhizobium meliloti
TRVRPAVAQDGGDITFRGFKDGTVFLNMKGACSGCPSSTATLRHGVQNLLRHFVPEVEAVESV

SEQ ID NO: 91262 - protein, 201 aa, Chlamydomonas incerta
MALRSITRGVSARTACRAATAARRAAVTVRAAHNPAAITKKVYFDINIGANSAGRVVIGLYGNDVPQTVENFRALCTGEKGFGYKGSPFHRVIKQFMIQGGDFTAGNGTGGKSIYGARFNDENFKYKHTGPGVLSMANAGPNTNGSQFFICTVATPWLDGRHVVFGEVVEGQDVVDKVENFPTGRGDRPVEPITVAACGEL

SEQ ID NO: 91263 - protein, 246 aa, Helicobacter pylori J99
MKKENRLKQEKIINMFDDIASSYDQANRLMSFGLDVKWRQRACEHAFLFLENKKALRLVDVACGTGDMLVAWQKSALNCGIEFKECLGIDPSNNMLELAIKKCEELENKASFIQAQAKDLKGVENNSVDILSIAYGLRNIVERQEALKEFFRVLKTRGVLVILEFLKKDNPTWLDKISGFYTNKVLPLVGGAISKNYGAYSYLPQSIEGFLSLEGLKNELKNAGFEILRTEDSIAQISTTMLVKKS

SEQ ID NO: 91264 - protein, 478 aa, Bacillus subtilis subsp. subtilis str. 168
MASEKDAGKQSAVKLVPLLITVAVGLIIWFIPAPSGLEPKAWHLFAIFVATIIGFISKPLPMGAIAIFALAVTALTGTLSIEDTLSGFGNKTIWLIVIAFFISRGFIKTGLGARISYVFVQKFGKKTLGLSYSLLFSDLILSPAIPSNTARAGGIIFPIIRSLSETFGSSPANGTERKIGAFLLKTGFQGNLITSAMFLTAMAANPLIAKLAHDVAGVDLTWTSWAIAAIVPGLVSLIITPLVIYKLYPPEIKETPDAAKIATEKLKEMGPFKKSELSMVIVFLLVLVLWIFGGSFNIDATTTALIGLAVLLLSQVLTWDDIKKEQGAWDTLTWFAALVMLANFLNELGMVSWFSNAMKSSVSGFSWIVAFIILIVVYYYSHYFFASATAHISAMYSAFLAVVVAAGAPPLLAALSLAFISNLFGSTTHYGSGAAPVFFGAGYIPQGKWWSIGFILSIVHIIVWLVIGGLWWKVLGIW

SEQ ID NO: 91265 - protein, 367 aa, Shewanella sp. MR-4
MALHSIEEIIEDIRQGKMVILMDDEDRENEGDLIMAAELVTPEAINFMAKYGRGLICQTMTKARCQQLNLPLMVTNNNAQFSTNFTVSIEAAEGVTTGISAHDRAVTVKAAVAKDAKASDLVQPGHIFPLMAQDGGVLTRAGHTEAGCDLARLAGLEPSGVIVEILNEDGTMARRPDLEIFSELHGIKIGTIAALIEYRNTKETTVVREAKCKLPTRFGEFDMVTFRDTIDNQLHFALVKGEVKPDCLVRVHLQNTFNDLLHSERDQQRSWPLEKAMERISAEGGVLVLLGNQEHPCEILSKVKAFEAEDQGQAPASAKWQGTSRRVGVGSQILASLGVTKMRLLSSPKRYHSLSGFGLEVTEYVAE

SEQ ID NO: 91266 - protein, 185 aa, Lactococcus lactis subsp. lactis Il1403
MLEKRSTDNSVSNKNMELKDYIATIENYPKEGVVFRDISPLMADGNAYNYAATEIVQYARDKEIDMVVGPEARGFIIGCPVAFALGVGFAPVRKPGKLPREVIEATYEKEYGTDTLTMHSDSIKPGQRVLIVDDLLATGGTIAATIELVEKMGGIVVGCAFLIELDELKGREKIGDYDYKVLMHY

SEQ ID NO: 91267 - protein, 545 aa, Pseudomonas putida GB-1
MSELIRVPDIGSGEGEIIELFVKVGDRIEADQSLLTLESDKASMEIPAPKAGVIKELKVKLGDRLKEGDELLVLEAEGAAAAAPEAPAAAAAPAAAPAPAAEAAPAPAAAPAAASVQDIHVPDIGSSGKAKIIEVLVKVGDTVEADQSLITLESDKASMEIPSPAAGVVEEVLCKLEDEVGTGDLIFKLKVAGAAPAAAPAPAAAAAPAKAEAAPAAAPAAAAPAAAPAPAATAPAAGSNAKVHAGPAVRQLAREFGVDLGAVAATGPHGRILKEDVQVYVKAMMQKAKEAPAAAGATGGAGIPPIPAVDFSKFGEVEEVALTRLMQVGAANLHRSWLNVPHVTQFDSADITELEAFRVAQKAVAEKAGVKLTVLPLLLKACAFLLKELPDFNSSLAPSGKAIIRKKYVNIGFAVDTPDGLLVPVIKNVDQKSLLQLAAEAAALAEKARTKKLSADEMQGACFTISSLGHIGGTGFTPIVNAPEVAILGVSKATMQPVWDGKAFQPKLMLPLSLSYDHRVINGAAAARFTKRLGDVLGDIRTMLL

SEQ ID NO: 91268 - protein, 340 aa, Oenococcus oeni PSU-1
MIKQTRKIAILGAGSWGTALASTFSMNGNQVILWGKNQSDIDDINQNHQNRRFLQEAFLDKNLKATTDLKDAVKDAEIVLFVVPTSAVRQVAGKLASILPSLKNEIIFGHAIKGIEVDSNKRVSQMISEEIPSIKEDDLFFISGPSHAESVVKRAITLVAVASSNQARAAIIQAALSNSFFRVYTNSDLCGSEYAAALKNVLAIAGGIIKGLKMTDNTQAALVTRGLSEMRRLGVALGGKSETFNGLAGLGDLIVTAMSTNSRNFRAGLGLASGKDLKQVQKEMGMVIEGVKTAKAVDQLSRKNNISMPISESVYKILYENAKIDDVVADLMNRPLISEE

SEQ ID NO: 91269 - protein, 291 aa, Oenococcus oeni PSU-1
MVQKVKKAVIPAAGLGTRFLPATKALAKEMLPIVDTPTIQFIVEEAIQSGIEDIVIVDGKSKRSIEDHFDSNTELEDNLSAKGKDKLLKLVQDTTDLNIYFIRQSHPHGLGDAVLKAKSFISNEPFVVMLGDDLMTDRVPLTKQLVDRYNETEQSTLAVMPVPHEETSKYGVIDPSKEVKPGLFEVKNFVEKPRPQDAPSDLAIIGRYLFTPTIFSELENTMPGKGNEIQLTDAIESLNHKEHVYAHQFDGKRYDIGSKIGFLETNIEFGLKHPDTGDELRKYIKELAKTL

SEQ ID NO: 91270 - protein, 143 aa, Oryza sativa Indica Group
WTEFTPQVAEPTFASAIQIGDPVSVDRAVVALKATDGIVEEATEEELMNAMSFADRTGMFACPHTGVALAALFKLRDQRIIGPNDRTVVVSTAHGLKFSQSKIDYHDSKIEDMACKYANPPVSVKADFGAVMDVLKKRLKGKL

SEQ ID NO: 91271 - protein, 198 aa, Oenococcus oeni PSU-1
MWPGVIEQTANGRESYDLPSRLLKDRIILVQGEVEDQMATSIVAQLLFLDAQDPNKDIYMYINSPGGSVTAGMAIVDTMNFIRSDVQTIVMGMAASMATIIASSGTKGKRFMLPNAEYLIHQPMGGAGAGTQQTDMSIIADQLLKTRKRLNNILKENSGKPIEKIEKDTERDHWMDSKETLDYGLIDKILINKEKNKS

SEQ ID NO: 91272 - protein, 471 aa, Rhizobium etli
  misc_feature (204)..(204): Xaa can be any naturally occurring amino acid
  misc_feature (453)..(453): Xaa can be any naturally occurring amino acid
MRVRDEEMGKVTGFLEIDRQVAKYQPASDRIRHFREFTIPMSDPEVQKQAARCMDCGIPYCHGPTGCPVHNQIPDWNDLVYNNNWEAAIQNLHSTNNFPEFTGRVCPAPCEEACTLNLEDAPVAIKTVEQAIADKAYELGFIRPQPATVHTGKKVAVIGSGPAGMAAAQHSAAPATKCMSMNVRQPGGCCLRLPIQMEKLLIPXGEMKGRGVHLPLGRSISVLKSRLSSCLPIMTPSFTAAVPRRRVRPAFRVLTLPACMMPCPIWSSRTAASGARTLTASAGRRIQFLLAPNMSSLSAAAIRRRTVSARRSARVPSKSPSSTSGRSRRRRKTSSPSGPSGRRRCARPPRRPRVPSASSRWRRSNSSAKTACYRRQVLRGRRAPAAGRRHGHSRRSRLHRHRFPRPVHNKRAEGIEGKLTLNTDKRGSTNVVANDRDYETSVDKLWTAGDVRXGSHWWSGRSEKPTGGARH

SEQ ID NO: 91273 - protein, 402 aa, Pseudomonas fluorescens PfO-1
MAEQGSPRRFARIDRLPPYVFNITAELKMAARRRGEDIIDLSMGNPDGATPPHIVEKLVQVAQREDTHGYSTSKGIPRLRRAISNWYKERYEVEIDPESEAIVTIGSKEGLAHLMLATLDQGDTVLVPNPSYPIHIYGAVIAGAQVRSVPLVPGVDFFAELERAIRGSIPKPKMMILGFPSNPTAQCVELDFFERVIALAKQYDVLVVHDLAYADIVYDGWKAPSIMQVPGAKDMAVEFFTLSKSYNMAGWRIGFMVGNPELVSALARIKSYHDYGTFTPLQVAAIAALEGDQQCVRDIAEQYRQRRNVLVKGLHELGWMVENPKASMYVWAKIPEAYAHLGSLEFAKKLLAEAKVCVSPGVGFGEYGDDHVRFALIENQDRIRQAVRGIRGMFRADALGTK

SEQ ID NO: 91274 - protein, 357 aa, Trichoderma atroviride
MAEFVRAQIFGTTFEITSRYSDLQPVGMGAFGLVCSARDQLTNQNVAVKKLMKPFSTPVLAKRTYRELKLFKHLRHENVISLSDIFISPLEDIYFVTELLGTDLHRLLTSRPLEKQFIQYFLYQIMRGLKYVHSAGVVHRDLKPSNILVNENCDLKICDFGLARIQDPQMTAYVSTRYYRAPEIMLTWQKYDVEVDIWSAGCIFAEMLEGKPLFPGKDHVNQFSIITELLGTPPDDVINTIASENTLRFVKSLPKRERQPLRNKFKNADDSAIDLLERMLVFDPKKRITATEALAHDYLAPYHDPTDEPVAEEKFDWSFNDADLPVDTWKIMMYSEILDYHNVEGVPQMEDQQFPPQ

SEQ ID NO: 91275 - protein, 341 aa, Securigera parviflora
RNKEYLPIVGLADFNKLSAKLIFGADSPAIQENRVVTVQCLSGTGSLRVGGEFLGKHYHQRIIYLPQPTWGNHPKIFNLAGLSVKTYRYYAPATRGLDFQGLLEDLGSAPSGSIVLLHACAHNPTGVDPTLEQWEQIRKLIRSKPLLPFFDSAYQGFASGSLDADAQSVRSFVADGGELLMAQSYAKNMGLYGERVGALSIVCKSADVASLAESQLKLVIRPMYSNPPLHGASIVATILKDRNLYNEWTIELKAMADRIISMRQQLFDALRAKGTPGDWSHIIKQIGMFTFTGLNPEQVSFMTKEYHIYLTSDGRISMAGLSSKTVSHLADAIHAAVTRGH

SEQ ID NO: 91276 - protein, 122 aa, Populus trichocarpa
MASKLAQLQSKAAQASQLVAKHGGSYYRQLLEQNKQYIQDPPTAEKCNLLSKQLLYTRLASIPGRYEAFWKELDSAKQLWKNRKELKVEDAGIAALFGLECFAWFCAGEIVGRGFTFTGYYV

SEQ ID NO: 91277 - protein, 195 aa, Mycobacterium avium subsp. paratuberculosis K-10
MPLLTIGDQFPAYELTALIAGDLSKVDAKQPGDYFTTVTSEDHAGKWRVVFFWPKDFTFVCPTEIATFGKLNDEFEDRDAQVLGVSIDSEFVHFNWRAQHEDLKNLPFPMLSDIKRELSLATGVLNADGVADRATFIVDPNNEIQFVSVTAGSVGRNVEEVLRVLDALQSDELCACNWRKGDPTLNATELLKASA

SEQ ID NO: 91278 - protein, 1456 aa, Yarrowia lipolytica CLIB122
MKHGKQKLANNNTDHDSLSSLDRALATRRDMFGRTLLHNACICGDAQAVEQLLANPHVDVTAVEYESGSSALHLALAAGSLHCAQLLIKHSRELLRLKDRDGCPAFETALYYHKWHTTDPGLPSEYFSFGSNTNHTLGFPDSDDRQTPETVKVLRPATTDIRSSLAPVRVVDCAIGGYHTAILTSDETANLYVCGVSSRGRLGLGPHVSTQFTPTLVASLASEKIVSVGVGKDHTACVTAKGVVYTWGCNRDSQLGYPTGGATGEEQLQISPRRVGGPTLKKAHITHVTCSNVHTVCWRENTSDMYVWGANNGQMGGMAPGQDCAIPTMVALVPGKISAVCASDYYTACIIDESYIQVYMNGGHFRVFLPAPGGTAREESQSGFDVFKPRLLVNRPQQLYASAGGPTICVSSLGHVYELPLQRFLNVKPALVARQMPVTALWVPRRDYMVATHAAVGDDGSVIICTSSGSAWKRERKENRLGGGTLKEYKFSRIPKVTNAYRVACDPLFRSFAALRYATQVDAIDVDMESLEFDVAERHAINRKMAYFTLDGDKESSEEFEDSPNLGALNWLVEAFEGVVSGTAQRTGLEEEAEMMGLNRFEETVMYKAVEMNKSDPHRGYDCELVCENSTVKLPCHSYMLRSSNLKAAVAKNSPLKCSLLTLVILHHYLYNDNVLSVWTLSGGCSIPREYVEAKAELLALAKEFELSSLVCKLSFGETADQLPVDMAKLFSSDTGDVAIEVDGGQILHAHRFILTQQSEFFQSCLSERWSDDTKVVVDLCHLPAASVRLCLRFMYTHNLDSLFDQVSSKVSSKDFIATVSQLLSTADELLLTPLKEFCELILSELVTVKNAASLLFLASAYNCDKLMTFMFSYICVNMECLLEGGFLGAILADGELFGAIDHHYRVMTGREIVLKEVPESSAVVGVTQLGEGISEDAAEQEEVEEEVKPKTLALASRPSGWVESFLSDFDGHNELLCRVAPGSVQAPDAAAALTPHRQSFAALHRNSKSEETRPSISPMSSPDLRGHNQTDDVFEFELDECPAEQRKRHDSRHDDRRCSHSEWREVKTGSSVRTAQFSSSPFGKSPMAGSPLSVSPNHASGDRRRSSFATAASGVPLTPGEIRFNLKQQIEKDSDAVYWPTLGGLGSPGGAGSVGAAGATPGSHPRGSPGPSATPSGSSTPWGKGAGVSNATPGSAGSASTWGNSSANGASAPSASATSAGSALSDLFSVTPPSSKLSQKERRRLLKQQQEETLMRAQEKEKQAAEGPWKVKKKAPVGVSPFESTSSPASSKTPSKTPSRAPPRAPSRAGLPGPNVGVGISTVGNSSATATSSFASDFYAASQPVTALSLAEIRERQERSTQKAKNVKTIEEIQQEEMFQKWWDAEVARNKGEESRGPEGGPRGTPSKSSRRPNKKKNNNKGPANGSSNGGGGGSGSQDDNGKRHRPRPREQIKA

SEQ ID NO: 91279 - protein, 302 aa, Salmonella enterica subsp. enterica serovar Typhi str. CT18
MAALNSKVKKAVIPVAGLGTRMLPATKAIPKEMLPLVDKPLIQYVVNECIAAGITEIVLVTHSSKNSIENHFDTSFELEAMLEKRVKRQLLEEVQSICPPHVTIMQVRQGLAKGLGHAVLCAHPVVGNEPVAVILPDVILDEYESDLSQDNLAEMIRRFDETGNSQIMVEPVEDVTAYGVVDCKGVELAPGESVPMVGVVEKPKADVAPSNLAIVGRYVLSADIWALLAKTPPGAGDEIQLTDAIDMLIEKETVEAYHMKGKSHDCGNKLGYMQAFVEYGIRHNSLGAEFKAWLEEEMGIKK

SEQ ID NO: 91280 - protein, 517 aa, Sorghum bicolor
MAMTAIASPSSRTLIPPRHHGAAPSPSTSGDSSLRLLRAHPRHGRRSRGVSVSTPAARSRPFVFSSRAVSDSKSSQTCLDPDASTSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPNWFQGTADAVRQYLWLFEEHNVMEFLILAGDHLYRMDYEKFIQAHRETDADITVAALPMDEARATAFGLMKIDEEGRIIEFAEKPKGEQLKAMMVDTTILGLDDVRAKEMPYIASMGIYVFSKDVMLQLLREQFPGANDFGSEVIPGATTIGKRVQAYLYDGYWEDIGTITAFYNANLGITKKPVPDFSFYDRSAPIYTQPRHLPPSKVLDADVTDSVIGEGCVIKNCKIHHSVVGLRSCISEGAIIEDTLLMGADYYETEADKKLLAENGGIPIGIGKNSHIRRAIIDKNARIGDNVKILNADNVQEAARETDGYFIKGGIVTVIKDALLPSGTVI

SEQ ID NO: 91281 - protein, 272 aa, Geobacillus kaustophilus HTA426
MNIGVIGTGNMGTILIEAFLDSGAVKADQLVITNRTLAKAFAIQRAHPGIAVVADAAEVIKQSSLVFLCVKPLDIHPLLQQLAPHWTNEHYLVSITSPISVEQLEAAVPCQIVRAIPSIANRALSGSILVTFGSRCSAACRQTIDDLLRRIASPVYIDEAITRVASDISSCGPAFFSYLLQRFIDAAAAKTAITKEQATMLATDMIIGLGELLKRNLYTLPTLQEKVCVKGGITGEGIAVLEQRMNGVFEEVLAKTHEKFKEDVEKVKQQFP

SEQ ID NO: 91282 - protein, 339 aa, Buchnera aphidicola str. Bp (Baizongia pistaciae)
MNALYKKNFLKLSDFTSLDIRNIINIACILKYQKKNKNEFPYLKNKNIVLIFEKQSTRTRCAFEIASFDQGAQVTYLGPGSTHLGYKESIQDTARVLSSIYDGIQYRGHNHETIKNLAKYSNVPVWNGLTEKFHPTQILADLLTIYETLPEKSFCNIKCAYVGDARNNISNTLLEASSLLGLNLCLVAPKCFWPNYDFFLKCQLKAKKNHGNIICTEDIQKGVRGADFIYTDVWVSMGEPKKTWHNRIKLLKKYQVNLKMLLLTQNKKIKVLHCLPSFHDKNTIVGEEIINKHNLDNGIEITNQVFNSQSDVIFRQSENRLHTIKALLLSTLLKEFPYI

SEQ ID NO: 91283 - protein, 488 aa, Robiginitalea biformata HTCC2501
MGKITGFMEYERKVDPYAPVEERLKNYKEFTKPLSEKAMKEQGARCMDCGIPFCHSGCPLGNLIPDFNDAVYRGKWDKAAEILHATNNFPEFTGRLCPAPCEEACVLGINEDPVSIENIEKHIAETAFAKGWVIATPPETRTGKKVAVVGSGPAGLAAAQQLNRAGHLVTVFERDEKPGGLLRYGIPDFKMEKHVIDRRLEILEEEGIEFRCGVHVGKDVAATDLQSDYDAILLCGGATVRRPLPIPGADLDGVVQAMDFLGQNNRRVDGIPFKGKELSAKGKNVIVIGGGDTGSDCIGTSFRQGAKSVSNFEILGKPPAGRPEDQPWPFWPMRLRTSSSHKEGAERYFSISTKEFKGDGDGKLTGLVTVEVEWEKVPGQRPKLVELKGTEKEWPCDLALLALGFTGSEMSIADQLGLELDPRTNIKASVSDYQTNVPGVFAAGDQRRGQSLIVWAISEGRQAAHHVDSYLMGSSELPLKGEGDLPRI

SEQ ID NO: 91284 - protein, 615 aa, Thermotoga sp. RQ2
MAVQKLPEKDFFAPLKAWKFLVRKPVTIEVPNKIRREASERYRGFHVNDWGKCIGCGTCAKICPTDAITMVEVPDLTQEDGKLPQRPVIDYGRCSFCALCVDICTTGSLKMTREYIHISEDPEDFIFMPTDKGLNAKKGLYEFGKAPLGWVRDENSELLDLERIEMPVEPPEVRIKSFIEIVKGYSREQAMQEAARCVECGVCTYTCPEHMDIPQYIKSVYEDNLEEGLRWLYRTNPLSMVCGRVCTHRCETACSVGVRGEPVAIQWLKRYIVDSIPLERYGEILDIKPERKGKSVGIIGSGPAGLAAAYFLATMGYDVTIYESESKPGGVMRYGIPKYRLPDEALDKDIAFIEALGVKILLNTRVVQDVSFEDVRKRHDVVFLATGFGLGRSTGVPGTDHPDVKQALPLLKMIRDYLRGDGPKPPVPERLVVIGGGNVAMDISRSMARLQFMEYGRVNVQVLSLEGCFEDMPADMEEIEEALEEGIVINPGWGPMEVVIENDRIKGVKFKKCVSVFDGEGRFNPQFDEKEQIFVEADMVVEAIGQAPDYSYLPEEIRSKLEFFRGRIKTNEYNQTSVEWLFAGGDIVHGPDIIHGIADGYAAAKGIDMYLRKEK

SEQ ID NO: 91285 - protein, 336 aa, Vibrio cholerae O1 biovar eltor str. N16961
MQKMRTLGEFIVEKQHDFPHASGELSSLLASIRLAAKIVNREINKAGLADIIGASGNDNIQGEEQQKLDLYANEKFKAALEARDQVCGVASEEEDEAVAFSKELNKNAKYVVLMDPLDGSSNIDVNVSVGTIFSIYRRVSPVGTPPTQEDFLQPGNKQVAAGYVIYGSSTMLVYTTGNGVNGFTYDPSLGTFYLSHENMRIPENGKIYSINEGNYIRFPTGVKKYIKFCQENVPEEGRPYTSRYIGSLVADFHRNLLKGGIYLYPSTQSHPNGKLRLLYECNPMAFLIEQAGGLASDGARRIMDIKPTELHQRVPFFVGSKNMVHKVETFLETYPD

SEQ ID NO: 91286 - protein, 442 aa, Yarrowia lipolytica CLIB122
MGCTSSKEVKPGPSGPSATAGKAKPANTASNSTANTNSAATANANATSTANNTTTTPNSAPKARAGANDATNDTANTPDEEKEVKTLLLGSGESGKSTIIKQMKIIHQNGYTDSELYLFKSTIYKNLLDCGRALLAAVDKFGLQEELAAEVGHSNKTEAMEANDFDFVEDKVNEAEHPVYTGGRGGVEQFQIILDTPNPNDNNTSLSPELVDALDALWKTAVVQEKLLKGLRNQFYLMDSGPYFFHNLQRLGGAQYIPTQDDILRARIKTTGIYETKFRLGSHLIHMYDVGGQRSERKKWIHCFENVTLIIFCVALSEYDQVLLEEKKENRMNESLVLFDSIINSRWFVRTSVVLFLNKIDVFTEKLPLSPLENQFPDYMGGNDINKGAKYILWRFTQMNRAGLNIYPHLTQATDTSNIRLVFAAIKETILQNALQDAGILT

SEQ ID NO: 91287 - protein, 454 aa, Robiginitalea biformata HTCC2501
MRKAGQYFYICPGRHHCGNGWLHRRGFRKSRVPAPIADHSKSRIMLMKELLERYENKPPEIVFQWKDPETEAEGWAVINSLRGGAAGGGTRMREGLDQNEVLSLAKTMEVKFTVSGPPIGGAKSGINFNPDDPRKKGVLERWYRAVSPLLKNYYGTGGDLNVDEIHEVIPITEDAGVWHPQEGVFNGHFRPTEADKINRIGQLRMGVIKVLETDTYSPDTSRKYTVADMITGFGVAEAVRHFYDIHGESVVGKRAVVQGFGNVGGAAAFYLSKMGARVVGIIDRAGGVIKEEGFSFEEIRALFGKKKGNALVAEDLIPSAEMDRRIWSLPCEIFAPCAASRLVTREQISTLIDSGLEVISCGANVPFADREIFFGPIMEFTDQRVSLIPDFVSNCGMARVFAYFMEGRVSMEDADIFNDTSGTIRNAILNIFNQNPTRRNFSRTAFEIALKQLV

SEQ ID NO: 91288 - protein, 311 aa, Magnaporthe grisea 70-15
MASQKFDPDSDIPSLSGKVILVTGGNIGLGQESILQLAKHDPKRIYLAARSEEKARKAMEAIEQKIGAAKSSVITFLPLDLGSFDSVRKAADTVKSQTDELHILLNNAGIMMTPAAKTKDGYEEQFGVNHMGHALLTRLLLPLLEKTAKSGADVRIVNLSSSGEMLAATDCFKDMSRYKTTMEDVQTVKRYGAAKLANVYHAQMLAQKYPSIKAVSLHPGVVKTNLMSRMKESWPILGPIVSSIISNVFCTSVADGVRNQLWAAVSNDVVSGEFYHPVGLLGKGSPATKKVKEAENLWEWTEKELDAYLNK

SEQ ID NO: 91289 - protein, 110 aa, Clostridium perfringens
TNIKVGAQNMHFEEKGAFTGEIAPRMLEAMNIDYVIIGHSERREYFNETDETCNKKVKAAFAHNLTPILCCGETLEQRENGTTNDVIKAQITADLEGLTKEQAEKVVIAY

SEQ ID NO: 91290 - protein, 249 aa, Bacillus subtilis subsp. subtilis str. 168
MIVTNDQELEGLKKIGRIVALAREEMKRKAEPGMSTKDLDLIGKAVLDEHGAVSAPEKEYDFPGVTCISVNDEVAHGIPSTSKILKAGDLVNIDISAEFGGFYSDTGISFVLGEGEERLHKLCQCAENAFQKGLQQAKAGKRQNQIGRAVYHEARSQGFTVIKTLTGHGIGRSLHEAPNHIMNYYDPFDNALFKNGTVIALEPFISTKAETIVEAGDGWTFKTPDKSMVAQVEHTIVITKDEPIILTKL

SEQ ID NO: 91291 - protein, 449 aa, Pseudomonas putida GB-1
MANPPSSAPAQLRRVLGLPALVFFGLVYMVPLTIFTTYGIVTELTGGRTAGAYLVTLVAMLFTAASYSFMVKRFPVAGSAYSYTNMAFGPNIGFLAGWSLLLDYLFLPMINYLLIGLFLNIAFPAVPTWAFVLACIALVTVLNVVGINSVAKTSNLIVGAQIVFIGVFVALSCQTLAGQPLDLLSPLLGDGSKPGFGHLMAGAAVLCLSFLGFDAVSTLAEECRDARRDVPRAIILTTLFAGLLFTVLAYVSQLVLPGSSFANADAAANEVMFKAGGQFLTNFFTAAYVAGSLGSALASQAAVSRILFTMGRDNVLPRRSFGYLSPRFGTPVFAIALVSAFSLLALVIDLSTLASLISFGALVAFSAVNLAVVKTHLMDDTSQRNAKNLLRYGVVPLVGLGLTLWLWTSLSALTLVIGLCWFALGLVYLAVLTAGFRRPVHLVDFTEAA

SEQ ID NO: 91292 - protein, 188 aa, Triticum aestivum
PSTPPASSPRSNDRNIVSTVNLDCKLDLKAIALQARNAEYNPKRFAAVIMRIREPKTTALIFASGKMVCTGAKSEQQSKLAARKYARIIQKLGFPAKFKDFKIQNIVASCDVKFPIRLEGLAYSHGAFSSYEPELFPGLIYRMRQPKIVLLIFVSGKIVLTGAKVREETYSAFENIYPVLTEFRKVQQ

SEQ ID NO: 91293 - protein, 433 aa, Lactococcus lactis subsp. lactis Il1403 [sequence omitted]

SEQ ID NO: 91294 - protein, 590 aa, Aspergillus nidulans FGSC A4
MTQILSKSSGGVLQIPASATQKNAPAPKKAPKPVAPRLKLLVRRLPPGLTQEEFETALGAEWKLGAGRVSWAQYKPGKVSKDHGNHSPAKPSRPSRAYLYVVSSEHIAPLSDKVRSTSFLDARNTANDPVLLGPPNLEFAPYAKIPGSRVRKDARLGTIDQDPEFIQFLESLTQPITKPTLAETSAEGEDKKETVTTTPLVQYIKEKKANKAKEAASKSSRQRSEREAKSEKVQSKKLLQRPDKEVSPANAEKTEKKSRSDKSTKEAVKAASKQAANVASRQAAKASAAQNASKDMAAAASERKRERGNVAAVGKILQRDLGLAPSNNRRRGGRGTSGENEPKTDSAAASETSKKEISTRSPKGSPAQDTSSKTKRSNTPQPSETPQSQRSDTSTPAQATSTPRGPRSGRGKQSSAATPTTPTSTATQAFLKHANPSQGVTEPLLEAAFLPFGKVVKVEIDKKKGFGYVDFAEPEGLQKAISASPVTVAQSQVVVLERKANPGAEKGRGKGRGEPKPPNPSASGEANSNSGRNGKSGEGTGGGGSGGGNSSSGRGRRGRGKGGSKANGGGGSGTTSANAPAPENKNSETK

SEQ ID NO: 91295 - protein, 233 aa, Bacillus subtilis
MQDSKEQRVHGVFEKIYKNYDQMNSVISFQQHKKWRNKTMRIMDVKEGAKALDVCCGTADWTIALAKAAGKSGEIKGLDFSENMLSVGQQKVKDGGFSQIELLHGNAMELPFDDDTFDYVTIGFGLRNVPDYLTVLKEMRRVVKPGGLVVCLETSQPEMFGFRQAYFMYFKYIMPFFGKMFAKSYKEYSWLQESAREFPGMKELAGLFEEAGLKNVKYHSFTGGVAATHIGWK

SEQ ID NO: 91296 - protein, 463 aa, Glycine max
MASSFLSAASHAVSPSCSLSTTHKGKPMLGGNTLRFHKGPNSFSSSRSRGRISMAVAVNVSRFEGIPMAPPDPILGVSEAFKADNSDVKLNLGVGAYRTEELQPYVLNVVKKAENLMLERGDNKEYLPIEGLAAFNKATAELLLGADNPAIKQQRVATVQGLSGTGSLRLGAALIERYFPGAKVLISAPTWGNHKNIFNDASVPWSEYRYYDPKTVGLDFEGMIEDIKSAPEGSFILLHGCAHNPTGIDPTPEQWEKIADLIEEKNHIPFFDVAYQGFASGSLDEDAASVRLFVARGIEVLVAQSYSKNLGLYAQRIGAINVISSSPESAARETSQLKRIARPMYSNPPVHGARIVADVVGNPVLFNEWKAEMEMMAGRIKNVRQQLYDSITSKDKSGKDWSFILKQIGMFSFTGLNKNQSDNMTNKWHVYMTKDGRISSAGLSLAKCEYLADAIIDSYHNVS

SEQ ID NO: 91297 - protein, 399 aa, Pseudomonas putida GB-1
MSGNRGVVYLGAGKVEVQKIDYPKMQDPRGKKIEHGVILKVVSTNICGSDQHMVRGRTTAQVGLVLGHEITGEIVEKGSDVERMQIGDLVSVPFNVACGRCRSCKEMHTGVCLTVNPARAGGAYGYVDMGDWTGGQAEYVLVPYADFNLLKLPERDKAMEKIRDLTCLSDILPTGYHGAVTAGVGPGSTVYVAGAGPVGLAAAASARLLGAACVIVGDLNPARLAHAKSQGFEVVDLSKDTPLHEQIVDILGEPEVDCAVDAVGFEARGHGHEGAKHEAPATVLNSLMQVTRVAGSIGIPGLYVTEDPGAVDAAAKIGALSIRFGLGWAKSHSFHTGQTPTMKYNRQLMQAIMWDRINIAEVVGVQVINLDQAPEGYGEFDAGVPKKFVIDPHKMWGAA

SEQ ID NO: 91298 - protein, 431 aa, Shewanella sp. MR-4
MAKIINVIGREIMDSRGNPTVEAEVHLEGGFIGMAAAPSGASTGSREALELRDGDKSRYLGKGVLTAVANVNGPIRAALIGKDATAQAELDQIMIDLDGTENKDKLGANAILAVSLAAAKAAAAFKGMPLYAHIAELNGTPGQYAMPVPMMNILNGGEHADNNVDIQEFMVQPVGAKNFREALRMGAEIFHTLKKVLHGKGLSTSVGDEGGFAPNLSSNADALAVIKEAVELAGYKLGTDVTLALDCAASEFYKDGKYDLSGEGKVFDSNGFSDFLKSLTEQYPIVSIEDGLDESDWDGWAYQTKIMGDKIQLVGDDLFVTNTKILTRGIENGIANSILIKFNQIGSLTETLAAIRMAKAAGYTAVISHRSGETEDATIADLAVGTAAGQIKTGSLCRSDRVAKYNQLLRIEEQLGEKAPYRGLKEIKGQA

SEQ ID NO: 91299 - protein, 307 aa, Schizosaccharomyces pombe
MTETGRTSKYRVEIQQMMFILGEVQDPLPETTQLVEELIRGQVMEMLIQANELALRRGSRSITVEDLFFLIRHDRAKVNRLKTYLSWKEVRKKAKEQDANPRDTKDLFEEVDSKTRSMNAVAMPWEVKNMFTEPVPETEEFEEDNDTMEMAYATRQRLKMADERTKKMTREEYVHWSECRQASFTYRKGKRFREWCGMSILTDTRPDNDIVDILGFLTFEIVATLTEEALAVKDRMDRIQNSSGSGGSHAAHHPKNCSLFDGLTEGRTPLQVSHVLEAFRRLQIPDKTHTAMRSFHGGLVKSRVYLI

SEQ ID NO: 91300 - protein, 363 aa, Bacillus cereus ATCC 14579
MRRNTYDGRMKNMFNKIFLIVALIGVPLSVLGKTLHWPETIMFAVYCVTIIALAGFMGRATESLAIVSGPRIGGLLNATFGNAVELIISIFALQAGLIEVVLASLTGSVLGNLLLVGGSSFFVGGLKYKRQSFNVYDARHNSALLIFAVVVAFVIPEIFSMKMDAGKTYQLSIGVSIIMIIMYLAALLFKLVTHRGVYQHKSDEVAHEEEPEWSKGKALLILAIATLAVAYVSEALVHTFETVAKSFGWSELFIGVIIVAIVGNAAEHASAIIMAYKNKVNIAVEIAIGSTLQIAMFVAPVLVLLSMFFAQRMPLVFTIPELVSMITAVFLTIAISNDGDTNWFEGGTLLAAYVIMGIGFYLL

SEQ ID NO: 91301 - protein, 365 aa, Clostridium difficile 630
MKKTYLFSPGPVMVTDKVRNSLLHYDICHRGNEFMNLFKDTQQKINKLYNATSNYYSLIVSGSGTSVNECVLSSIFDKEDAVLLVSNGVFGERLEEILSTYNVKTYKPNFEWAEYPDLDILEKYIIENSDIKVIAMVFHETSSGMINPVPELGKLAKKYNKIFFVDAISASAGEYIDVEEFNIDIITGVGGKALGAFPGSAYLCAKESILQNIKENQCKNVYLNLYKHYKVAKSSSQTPNTPNVTLIFALNEALTEFLEDDSKIERYKECSAILRNGMEELGLTFLLPDKYMSNTVTSVFLPKEINVNEFILGLERESGYVVYPGKGKFLDANIFQVANMGEIYPEDCYKFLDILKSKLEIKKVI

SEQ ID NO: 91302 - protein, 347 aa, Magnaporthe grisea 70-15
MSDLPKTMKALQYSKPKEFAVVDVPLPELRDDDVLVKVKACGVCGTDLHIHEGEFIAKFPLIPGHETVGVVAAVGKDVKDFKVGDRVSADNAELCGHCFYCRRGESLLCENWAGHGTTLSGGFAEYCAYPQGKVFKFNNMTDVEATLIEPASCACHGLDKIKPRLGSSVLMFGAGPTGLMLAQLLRQNGCSQVTIAAPAGLKMDLARSLDAADTYVDLSREDSGPQLEQLKKDNPYGFDIVIEATGSVKILEDSINYCRRGGTLVVYGVYGDQDKVSWKPTKIFGDEIRIIGSFSEVFMFPQTIDYLDNGKVKTKGIVNKTFKLEQFGEALESIKNKSAIKAAIVFD

SEQ ID NO: 91303 - protein, 176 aa, Vibrio cholerae O1 biovar eltor str. N16961
MSLNNVPAGKSLPDDIYVVIEIPANADPIKYEVDKESGAVFVDRFMSAPMFYPCNYGYVNHTLSLDGDPVDVLVPTPYPLIPGSVIRCRPVGVLKMTDESGEDAKVVAVPHTKISKEYDHIQDVNDLPALLKAQITHFFERYKELESGKWVKVDGWEDAASARAEILSSYERAQNK

SEQ ID NO: 91304 - protein, 615 aa, Glycine max
MASLSGICSSSPTLKKFPNQSPSLTDPLRKDHVSFPARLADRTLSLAPLRAVAREVSDGALAAAVKKGLEKDPRALWRRYVGWLYQHKELGIYLDVSRVGFSDEFVKEMEPRFQAAFRAMEELEKGAIANPDESRMVGHYWLRDPKRAPNSFLKTQIENTLDAVCKFANDVVSGKIKPPSSPEGRFTQILSVGIGGSALGPQFVAEALAPDNPPLKIRFVDNTDPAGIDHQIAQLGPELASTLVIVISKSGGTPETRNGLLEVQKAFREAGLDFPKQGVAITQENSLLDNTARIEGWLARFPMFDWVGGRTSEMSAVGLLPAALQGIDIREMLAGASLMDEANRSTVLRNNPAALLALCWYWATDGVGSKDMVILPYKDSLLLFSRYLQQLVMESLGKEFDLDGNRVNQGISVYGNKGSTDQHAYIQQLREGVHNFFVTFIEVLRDRPPGHDWELEPGVTCGDYLFGMLQGTRSALYANNRESITVTVQEVTPRTVGALIALYERAVGIYASLVNINAYHQPGVEAGKKAAGEVLALQKRVLAVLNEASCKEPVEPLTLEEVADRCHAPEDIEMIYKIIAHMAANDRALIVEGSCGSPRSIKVFLGECNIDGLYA

SEQ ID NO: 91305 - protein, 565 aa, Shewanella oneidensis MR-1
MSEQKLALNEYLKTDSDYLRGTIKEGLDSSVTGSFSDGDQQLIKFHGFYQQDDRDLRNERKEQKLEPLYSFMLRARVPGGVCTPKQWLGVDEIASTLTSSNSIRLTTRQTFQYHGIPKRNLKTIIQGLDREALDSIAACGDVNRNVMCNPNPVESKLHAQAYEVAKKLSDHLLPHTRAYAEIWLDEEKLLTTEDETVEPVYGKTYLPRKFKMAVAVPPDNDVDVYTNDLGFIAVAENGELVGFNLTAGGGMGSTHGEVETFPRLADDFGFIKTEDVMKFAEAVMTVQRDWGNRTNRKRSRLKYTIVDHGYEKFKAEVEVRAGVKFEPKRDVVIGDRGDRYGWVEGVDGKWHLTLFIESGRIKDMPGKSLQTGMREIAKIHKGDFRMTSNQNMIIAGVAPEDKATIEGLARKRGLLGQVLTQTRGHSIACVALPTCPLAMAEAERYFPEFIDHIDALQAKNGISDQAIVVRMTGCPNGCARPFAAEIGLVGKAPGRYNLYLGANFEGTRLNKMYRENIQEAEILAELDALFARYAIERNAGETFGNFTVRVGVVKAVIDAAKDFHG

SEQ ID NO: 91306 - protein, 485 aa, Bacteroides thetaiotaomicron VPI-5482
MLLKQTKIVASISDRRCDVDFIKQLFEAGMNVVRMNTAHASREGFEALIANVRSVSNRIAILMDTKGPEVRTTANAEPIPYQIGDKVKIVGNPDQETTRECIAVSYPNFVNDLNIGGLVLIDDGDLELEVIDKTADYLLCEVKNDATLGSRKSVNVPGVRINLPSLTEKDRNNILYAIEKDIDFIAHSFVRNRQDVLDIREILDAHNSDIRIIAKIENQEGVDNIDEILEVADGVMVARGDLGIEVPQERIPGIQRVLIRKCILAKKPVIVATQMLHTMINNPRPTRAEVTDIANAIYYRTDALMLSGETAYGKYPVDAVKTMTKIAAQAEKDKLEENDIRIPLNENSNDVTAFLAKQAVKATSKLKIRAIITDSYSGRTARNLAAFRGKFPVLAICYKEKTMRHLALSYGVEAIYMPELANGQEYYFAALRRLLKEGRLQPTDMVGYLSSGKAGTQTSFLEINVVEDALKHAGETVLPNNNRYL

SEQ ID NO: 91307 - protein, 109 aa, Aspergillus oryzae
MPVTAIESYQQFQELITGDKPVLIDFWATWCGPCRAISPVFEEMSNAEGFDNVGFYKVDVDAQEQIAQEVGIRAMPTFMLFRNGAKVGDLVGANSQGLTELVKKATALP

SEQ ID NO: 91308 - protein, 517 aa, Sorghum bicolor
  misc_feature (86)..(206): Xaa can be any naturally occurring amino acid
MAMTAIASPSSRTLIPPRHHGAAPSPSTSGDSSLRLLRAHPRHGRRSRGVSVSTPAARSRPFVFSSRAVSDSKSSQTCLDPDASTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXILAGDHLYRMDYEKFIQAHRETDADITVAALPMDEARATAFGLMKIDEEGRIIEFAEKPKGEQLKAMMVDTTILGLDDVRAKEMPYIASMGIYVFSKDVMLQLLREQFPGANDFGSEVIPGATTIGKRVQAYLYDGYWEDIGTITAFYNANLGITKKPVPDFSFYDRSAPIYTQPRHLPPSKVLDADVTDSVIGEGCVIKNCKIHHSVVGLRSCISEGAIIEDTLLMGADYYETEADKKLLAENGGIPIGIGKNSHIRRAIIDKNARIGDNVKILNADNVQEAARETDGYFIKGGIVTVIKDALLPSGTVI

SEQ ID NO: 91309 - protein, 581 aa, Yarrowia lipolytica CLIB122
MPKSKKMLIAPTSAYLGRDRAVTPTADFDAASPPTPAPSPTPSYRVSQNGESRSTNTPGDGLRQLITTFDKVYSRLSHEHKQRFFDHILSKSHHQELSYLSEAVVPLLKRDPFRMLPYEISLRILSYVDDPKTLGKASQVSRLWHLILSDDQTWKTLCERHQYRRLSAAQRITYRQSSRLASIPNVPENMEVDSNVLESMYDPEPLRQVPLSYRSHFKHQYLVDAACNKGGRLAAKHVTSDQAVVTSLEMNGRYIVVALDNSRIYVFAEDGRLIHTLFGHVMGVWAITVLGDTLVSGGCDRDVRVWNLKTGECLQILRGHSSTVRCLKMVDERTAISGSRDNTLRVWDIRSGVCLRELIGHDLSVRCIEVVGDICVSGSYDFKAKVWRISTGECLHTLEGHYSQIYSLAFDGKRIATGSLDTSVRIWDAATGNLIFVLQGHTSLVGQLQMKDNTLVTGGSDGAIRVWDLEQGACTQRLAAHDGSVTSLQFSDNRIVSGGSDGRVRVWDMASGQYIRDLSQAFDSVWRVAFKEEKVVILASQRRQIHMELISFSPKGEDKEVDPLEDGVVVEDIVMEEDEFK

SEQ ID NO: 91310 - protein, 110 aa, Clostridium perfringens
TNIKVGAQNMHFEEKGAFTGETAPRMLEAMNIDYVIIGHSERREYFNETDETCNKKVKAAFAHNLTPILCCGETLEQRENGTTNDVIKAQITADLEGLTKEQAEKVVIAY

SEQ ID NO: 91311 - protein, 536 aa, Listeria monocytogenes str. 4b F2365
MTIVAMNDVVKSFTGDIILEKVSLQLEEGERVGLIGRNGEGKSTILKILKGTEGVDSGIVTSKKGAKIGLLEQLSTVDPNIIVEQYLRTSFGELEELEKELRALEGEMATNSSEKLMNRYGDKMALFGELGGYEMDANLNKVVNGLGIGSLLSQRWGDLSGGEKTKVALAHLLLQKTDLLLLDEPTNHLDLMAVEWLTAFLQHYSGTVLVVSHDRYFLDEVVEKMVELENRELIVYHTNFSGYLKEREERLLREFQDYKDQQKKIKKMQQAIKRLRQWAMQANPPNDAMFRRAKNMERALERMEKVKRPVLTQKQMQLQFDEAGRSGQEVVVMENLSKSFSEKAIVQDVSLQIRQGERVAIIGENGAGKSTLLKIMEGKVVPDVGMIKVGASVKIASLSQQMEELNEKLTVLDAFRDKVAVTEGEARQMLAGFMFYGEMVFRKVGNISGGERMRLRLAQFINMPVNTLILDEPTNHLDIASREILEEAIRAFSGTIITVSHDRYFIDQLCSKVIWLENKQLTVYEGNYSYATSKRR

SEQ ID NO: 91312 - protein, 466 aa, Saccharophagus degradans 2-40
MAEFQYDFLVIGAGPAGEAAAMAAAKSDLRVGVIESQGMLGGNCTHRGTIPSKSLRHTVKQVIQFGSQPIFRNIGGARPLTYPAVLDAASQVIPKQVELHTEFFARNRVRVHSGNARFLSNTQVEVMDSHGVRDVISAERVLIATGSRPYRPDDVDFTHPRVYDSDTILDMQHTPRTIIIFGAGVIGCEYASIFAGLGLKVDLINTRERLLEFLDDEISDALSYHLRDNGVMVRHSEECASVDATSKGVTLNLKSGKRIRADALLWCNGRTGNTDMLDLENAGLEANHRGQVKVDNNYCTEVDNIYAAGDVIGWPSLASASYDQGRAVVAAMLQKEMRFVEDAPTGIYTLPEISSVGKTEAELTSARIPYEVGRAFFKDTARGQISGEDVGMLKILFHIDTLEILGIHCFGAEAAEIIHIGQAIMNQPNGANTVKYFVNTTFNYPTMAEAYRVAALNGLNRVNRHS

SEQ ID NO: 91313 - protein, 533 aa, Neisseria meningitidis FAM18
MSIVEIKVPDIGGHENVDIIAVEVKAGDTIAVDDTLITLETDKATMDVPADAAGVVKEVKVKVGDKISEGGVILTVETGAAAAEAAPAAAEAQPAPAAAPVAAGGATVQVAVPDIGGHTDVDVIAVEIKVGDTVAEDDTLITLETDKATMDVPCTAAGVVKAVFLKVGDKVSEGSAIIEVETAGSAAAAPAPAAQAAAPAPAAAPVPAAAAAPAPSAPAAAKIDEAAFAKAHAGPSARKLARELGVDLGQVKGTGLKGRIMGDDIKAFVKSVMQGGAAKPAAASASLGGGLDLLPWPKVDFSKFGNVEVKELSRIKKISGQNLSRNWVVIPHVTVHEEADMTELEEFRKQLNKEWEREGVKLSPLAFIIKASVSALKAFPEFNASLDGDNLVLKNYFNIGFAADTPNGLVVPVIKDVDQKGLKQISQELTELSKKAREGKLKPQEMQGACFTISSLGGIGGTGFTPIVNAPEVAILGVCKSQIKPVWNGKEFAPRLMCPLSLSFDHRVIDGAAGMRFTVFLAKLLKDFRRITL

SEQ ID NO: 91314 - protein, 110 aa, Clostridium perfringens
TNIKVGAQNMHFEKKGAFTGEIAPRMLEAMNIDYVIIGHSERREYFNETDETCNKKVKAAFAHNLTPILCCGETLEQRENGTTNDVIKAQITADLEGLTKEQAEKVVIAY

SEQ ID NO: 91315 - protein, 595 aa, Neisseria meningitidis FAM18
MSLVELKVPDIGGHENVDIIAVEVNVGDTIAVDDTLITLETDKATMDVPAEVAGVVKEVKVKVGDKISEGGLIVVVEAEGAAASPKAEAPVAAPAQEAPKAAAPAPQAAQFGGSADAEYDVVVLGGGPGGYSAAFAAADEGLKVAIVERYKTLGGVCLNVGCIPSKALLHNAAVIDEVRHLAANGIKYPEPELDIDMLRAYKNGVVSRLTGGLAGMAKGRKVDVIQGDGQFLDSHHLEVSLTAGDAYELAAPTGEKKIVAFKNCIIAAGSRVTKLPFIPEDPRIIDSSGALALKEVPGKLLIIGGGIIGLEMGTVYSTLGSRLDVVEMMDGLMQGADRDLVKVWQKQNEYRFDNIMVNTKTVAVEPKEDGVYVTFEGANAPKEPQRYDAVLVAAGRAPNGKLISAEKAGVAVTDRGFIEVDKQMRTNVPHIYAIGDIVGQPMLAHKAVHEGHVAAENCAGHKAYFDARVIPGVAYTSPEVAWVGETELSAKASGRKITKANFPWAASGRAIANGCDNGFTKLIFDAETGRIIGGGIVGPNGGDMIGEVCLAIEMGCDAADIGKTIHPHPTLGESIGMAAEVALGTCTDLPPQKKK

SEQ ID NO: 91316 - protein, 357 aa, Geobacter metallireducens GS-15
MAKKLFIPGPVEVHPDILQAMATPMVGHRMAEYATLHGRVTTGLKKLLATEAKVFLSTSSAFGAMEGAVRNLVAGRCVNFCNGAFSDKWHDVTRRCGKEADAVKVEWGKPITAELVDEALATGKYDSLTLIHNETSTGVMSPLPEIAAVLRKYPDVVSIIDTVSSMSALPIPVDELGIDCCIFGVQKAFALPPGLAVFTASEKALARARTVEGRGYYFDFLEFEASDAKNNTPSTPCISLIYAMDKQLERMFAEGFEQRWARHRALADFVRGWVSDRGYGFFAEEAYRSMTLTCAVNSRGTDLASLKKMLGERGFAFDDGYGKIKGKTFRIPHMGDMQRSDLEEFLAVIDECLAVLG

SEQ ID NO: 91317 - protein, 357 aa, Xylella fastidiosa Dixon
MSKQILILPGDGIGHEIVAEAVKVLEHVNVRHTLNMRLSFDALGGAAYEKYGSPLADETLARAREADAVLLGAVGGPQWDTIDPALRPERGLLKIRAQLGLFANLRPALLYPQLADASTLKPEVVAGLDILIVRELTGGLYFGQPRGSRISKNGEREAFDTLPYCESEIRRILKVGFEMARLRGKKLCSVDKANVLASSQLWRTVAGEMAKDYPDVTLSHMYVDNAAMQLVRHPKQFDVIVTENMFGDILSDQASMLTGSIGMLPSASLDANNKGMYEPCHGSAPDIAGQGVANPLATILSVAMLLRYSMGYIKTADAIEYAVGVVLDSGLRTADIWSEGMTKVGTVAMGDAVVAAL

SEQ ID NO: 91318 - protein, 613 aa, Coccidioides immitis RS
MHELYSIKGHNSTPVRRRPSRAIGRTPKTGDHPRDLEPFFKLKGANGNNLLHSKCTTDGDNSSPGCYLSSFPASPNPAIRTSCPAHAQDIPLQFQPYTEDDDTQCTQFLHIADFGPSTSKLKDKSLLIGKCFVNGEWVDAKSGETFEVTDPSTGKLIGTCPEFTAEETQKAVDAASASFPSFRKTLARERARMLRRWYQLMMDNAEDLATLITWENGKPYADAKGEVVYAANFFEWFSEEAPRVYGDTIPSSVPGNRVMTLKEPIGVCGFITPWNFPAAMITRKIGPALAAGCTVVAKSPGETPFTANAIMELGRRAGIPKGVVNLVTALKNTQELGMCLTTHPDIRKVSFTGSTNVGKLLMKQSSSTVKKLSFELGGNAPFIVFDDCPDVDAAVAGAIASKFRSSGQTCVCANRIYVQKGIYDEFAAKFAEKVRGFKLGYGFDEGVTHGPVIHSRAVDKVTQHVRDAEAKGGKVILGGKPASELGPNFFHPTVVTGMTKDMLMASEETFGPVAGLFPFETEKDVVEWANKAEVGLAGYFYSKDIRRIYRVAEALEVGMIGVNTGIISDTASPFGGVKQSGFGREGSKYGIDEFLSVKTITFGGMGGELQGHL

SEQ ID NO: 91319 - protein, 521 aa, Oryza sativa
  misc_feature (357)..(357): Xaa can be any naturally occurring amino acid
MWGSFVIEQRTSDMEFFTEYGEASQYQIQEVVGKGSYGVVAAAVDTHTGERVAIKKINDVFEHVSDAIRILREIKVLRLLRHPDIVVIKHIMLPPTRREFRDIYVVFELMESDLHQVIEANHDLSPEHHRFFLYQLLCALKYIHSANVFHRDLKPKNILANSDCKLKICDFGLARVAFNDSPSTIFWTDYVATRWYRAPELCGSFFSKYTPAIDIWSIGCIFAEILTGRPLFPGRNVVHQLDLITDLLGTPSSETLSRIRNENARGYLTGMQRKHPIPFSHKFHNADPLALRLLERLLAFDPKDRPTAEEALADPYFRGISKLSREPSRLPVSKFEFEFERRKLTKDDVREMIYREXKQILEYHPQMLQEYIRGGEQISFLYPSGVDRFKRQFAHLEENYSRGERSTPLRRQHASLPRERVCSSVDSNNQDSDNEERRAISSIARTMISPPRSQEKGKNRASVYPNGIINLNSNPKIYLKSASISASTCIIRGNKGPKNGISEDMEEVVYELSDNVTRMLS

SEQ ID NO: 91320 - protein, 376 aa, Desulfovibrio vulgaris subsp. vulgaris str. Hildenborough
MSQRDYYEVLGVARDASEDDIKRAYRKLALQYHPDRNPDDPEAEQKFKEAAEAYDVLRDGEKRARYDRFGHAGVGNGGGFGQGFSSNEDIFAHFSDIFGDLFGFAGAAGGRSRGPRPQAGSDLRYNLTISFRQAAKGDEVTLRLPKSVPCDECGGSGAAPGTRPETCRHCGGAGQIRQSQGFFQIAMPCPVCRGEGTVITSPCPKCKGSGQTQQVKELSVRIPAGVDTGNRLRLRGEGEPGIHGGPAGDLYVVISVEDDKTFRRQGQDLVVTREISFVQASLGDRIDVPTLDDDITLDIPAGTQSGEVFRLVDKGLPYLGHGHTGDLLVEIRVVTPTRLTKKQEELLREFALLDEEKPLEKVKKMARKIGKAMGMD

SEQ ID NO: 91321 - protein, 868 aa, Coccidioides immitis RS
MNAMRSSHRIPPEQLQQKKPSQIKFIRAAQMSLFANISSWPPLGQVTFLKRNGNDISGDKARFTILLEASSSFPEQGWEVSIWHNVYGDWEELTLQKVTGQKVPVASGRKTGGDYHRHTFSGELGFPKEGKYASFTVKYRIGPDTEWQWVKELFGTKDGEIVFEPPQTWIDKYRDGHPTDQLNNFIETFNTELDVQRRASETPGAVLWSIAGKAPRATDGKSGRATLALGSPREFVRNFSLVRIWSPWLAPRHGMETYRLTEDAVLSSFLRKDGLSLVLLAVSGPANISTTLQSSESGVVISARNDEMKQVDVKVLAAVASSFRLAIAAVIYEARKLERLVAESLGKPTQTLTSDSFSKEPDDLSAQWLSSWYDGLAYCTWNSLGQSLTEEKILNALDTLKVNNINVVNLIIDDNWQSLDNKGKSQFQRGWTRFEANEEGFPKGLKHAINSVRAKHPNIKHIAVWHALMGYWGGISPNGELVRNYKTKVVKKVDRVAGGTMLAIDPDDIHRFYDDFYSFLLAAGVDSVKTDAQFFLDTLDNATDRARFTTAYQDAWSISLLSSHPWHIFCNAHNSLLTRHLNVIPDWDMFQTNHPYASFHGAARCISGGPIYITDEPGKHDFELINQMTALSIDGTSVILRPSVPGSTVDVYHNYNEGQLLKVGSYTGQARTGSGMLGLFNISCQDVSSLISILDFPGVNSGTETEYVVRAHSTGNVAIGPCDQSFLLSVGLEPRGWEILTAYPVHAFSLDRKCSGSELTRVAVLGLLDKMTGAAAIVGFDVAISHGGRLRFDITLKALGELGIYISDLGTRTVEDNFMVMISGRAVPVETIKVQGPNLLSVDILTAWREMRLERGWSNEVVVQVLMD

SEQ ID NO: 91322 - protein, 836 aa, Geobacter metallireducens GS-15
MKAVIMAGGFGTRIQPLTSSIPKPMIPLLNRPIMLHIVELLKKYEITDLVMLLYHQPAVIKNFFRDGTDFGVKITYVTPLQDMGTAGAVKCAEKFLDERFLVISGDLLTDFNLQKIIDSHEDNKALATITLTSVKDPLQFGVVITDKEKRITQFLEKPGWGEVISDTINTGIYVFEPEIFAHIPEEENYDFSQDLFPKLLEQQKPLFGYTAKGYWRDIGNTDSYREAHHDIFKGKVNVKIDEAKQDLVGKDLRLGSDVNLDEHVTLEGTVVVGDNSQVFESAHIKDTVIGRNCTIEPGVRLNRCVIWDNVYVKKGAKLNDGVLCSNVRVGHGVVMEEGVIVADDTSIGEEAYIKRDVKIWPRKVIEAGATVTGNLIWGEKWKKSLFEGAMVKGLTNMELTPEFVAKLGCAYGTMLPKGSHIISGRDSYRSCRMLKRSFIGGLLSAGINVRDLTMVPMPVLRYKLRTFGEVGGIYFRQAIDDPASTEIVFLDGDGLDFSSSMGKNVERIFFKENFRRAHHTEPGALSEIPQQVTDFYREGFLHTIGKSPLQKKQFKVVIDFNHSSASQLLPGILTQMGCEVISLNAYVDEERGIQAVAERQQSLAQLSKIVATLEASAGFWLDPGTEGVIVVDETGKVYEGAELLPLMVGLALRSGEKGLFAVPVSAPSAIERMVQERGSAVTRTKSADRAMIEATLSSEVVLAGTMDGRFAFPKFQSAFDGMFAIAKTIELVAKGGLSISRVAAEIPQRVFLQTRVPCVWDMKGGIMRKMSEDSLDKEASFIDGIKVHFGEDWALVLPDQYLPYVHIVAEARDAKTAQKLLDEYKKKVEGWKRELQ

SEQ ID NO: 91323 - protein, 159 aa, Shewanella sp. MR-4
MKIRIGHGFDVHKFGEARPLILCGVEVPYETGLVAHSDGDVVLHAISDAILGAMALGDIGKHFPDTDAAYKGADSRVLLRHCYALARAKGFELGNLDVTIIAQAPKMAPHIEDMRQVLAADLNADIADINVKATTTEKLGFTGRKEGIAVEAVVLLSRQ

SEQ ID NO: 91324 - protein, 449 aa, Sulfitobacter sp. EE-36
MDRPLPARVALVNQPLGLLRSLAMARRNVLSIIPEIAVKQPMVSGKMGKRWHMVMDPTAIREMLLDRVDDYPKSLVTKNLLRPAIGDSLFIAEGAHWRWQRRAVAPAFSHRNMLNLSPIMTAAAQRSADRIAAAGPRAINMLDEMVTSTFDVISDVTFSGGGGFDRDAVHRAIDDYIAEAGKLSLFDILGLPDWLPRPGRAMSGRALKDMKRIADGAIDARAERGPSDTPDLLDLLLDGTDPKTKRQMNTAELRDNLLTFIVAGHETTALTLSWALYLMGFDQAVQQKARAEAQTVLQGRAATGADVENLPYIRQIIDETLRLYPPAGVISRTAQRNDTLCGREVRPGDTVMVPIYALGRHQQLWDQPDVFDPDRFKDRKAIDRYAYLPFGDGPRICIGASFAQQEAVIILATLLSRFRFTPVAGKSPEPVMILTLRPEGGVWLTATPA

SEQ ID NO: 91325 - protein, 172 aa, Prochlorococcus marinus str. MIT 9215
MKFFKFLRYFLCITFSFLVFSSPVFAGANVAVKGEGDEVPSYVRSNITGFNFHGEDLHLSSIAGAVARDADFSDVDLHGTTLTLSDLKGSNLNGIDLTDTLSDRVNFQKTDLRNAVLINMIASGSSFAGAQIEGADFSYAILDSEDQRNLCEIADGINPTTGVSTRDSLECS

SEQ ID NO: 91326 - protein, 81 aa, Glycine max
  misc_feature (55)..(55): Xaa can be any naturally occurring amino acid
RARPAYCLKPAGSHGVWGLDNFNFWPLILGSSQLLDPKYMNPKPFHMEDFGENFXNEYSALVGFALSKKEKRGVFADHSPM

SEQ ID NO: 91327 - protein, 126 aa, Arabidopsis thaliana
MDKLILKGLKFYGFHGAIAEERTLGQMFLVDIDAWVSLKKAGESDNLEDTISYVDIFSLAKEIVEGSPRNLLETVAELIASKTLEKFHQINAVRVKLSKPNVALIKSTIDYLGVDIFRQRNTSSKN

SEQ ID NO: 91328 - protein, 474 aa, Zea mays
  misc_feature (325)..(325): Xaa can be any naturally occurring amino acid
MAWLPKKVCVVGAGVSGLVSARELRREGHDVTVMEQSGGVGGQWLYDPRTDASDPLGVAGAHSSVYASLRLNTPRESMGFSDYPFVYPAGNDDDGAGGDGRRYPGHAEFLRYIRRFCDAFGLMDAVRLNTKVLHVAPSAPRGHGDGSVTRWTVRCSSRHGDCDGEAVTTEETTFDAVVVAVGQFTQPRLPVINGMDKWSRRQLHSHSYRVPDSFQDEAVVVVGCHASGVDIALELRAVARDVHVSVKNLVHERRAFVDCFVRASQIERLCEDGQVTFADGSRVVADSIVYCTGYGYSFPFLDTGGLVTVDDGSRVGPLYEHTFPXALAPSLSFVGVPKRVVVPRFYETQARWVAEVLSGRRALPSSEEMMRAAEGYHHPAREMMVAGVPKHLAHDIFDDYDYCDEFGEKHCGFPRLERWKKELRWSSIARQRGEGEGEGEDSESFRDVYRDSDLVREGLQAQGWPWPAGSHQHK

SEQ ID NO: 91329 - protein, 496 aa, Pseudomonas putida GB-1
MPQLRDAVYWRGRSTDLVVEARAFIAGAYVGASEGETFAVCSPIDGRELAQVALCRGTDVERAVAAARGAFERGGWADLVPRQRKAVLLRWAALMREHAEELALLETLDTGKPIADTTAVDIPSSIYCLEWFAELVDKVTGEVPACDPQFLGTVTREPVGVVAAIVPWNYPLLMATWKFAPALAAGNSLILKPSEKSPLSALRIAGLARAAGIPEGVFNVVPGDGETGRLLSLHPQIDCLAFTGSGAVGRQISRNAADSNLKRVWLELGGKSANIVMADCPDLRRAAEAAAAAVFSNMGQVCSAGSRLLVQRPIAGAFIAELLEAARAYLPGDPLDPTSVTGSLIDEAQYQRVRQYIELGKREARLLLGGEDCAAVPGGHYLQPTIFATDATSRIAREEVFGPVLSVIEFDGLDDAIAVANASEYGLAAAFWSADLGAIRRASRRLRAGTVWVNCYDELLDMNFPFGGFKESGNGRDNSVHALDKYSELKSTIIRC

SEQ ID NO: 91330 - protein, 517 aa, Sorghum bicolor
  misc_feature (119)..(119): Xaa can be any naturally occurring amino acid
MAMTAIASPSSRTLIPPRHHGAAPSPSTSGDSSLRLLRAHPRHGRRSRGVSVSTPAARSRPFVFSSRAVSDSKSSQTCLDPDASTSVLGIILGGGAGTRLYPLTKKRAKPAVPLGANYXLIDIPVSNCLNSNISKIYVLTQFNSASLNRHLSRAYGSNIGGYKNEGFVEVLAAQQSPDNPNWFQGTADAVRQYLWLFEEHNVMEFLILAGDHLYRMDYEKFIQAHRETDADITVAALPMDEARATAFGLMKIDEEGRIIEFAEKPKGEQLKAMMVDTTILGLDDVRAKEMPYIASMGIYVFSKDVMLQLLREQFPGANDFGSEVIPGATTIGKRVQAYLYDGYWEDIGTITAFYNANLGITKKPVPDFSFYDRSAPIYTQPRHLPPSKVLDADVTDSVIGEGCVIKNCKIHHSVVGLRSCISEGAIIEDTLLMGADYYETEADKKLLAENGGIPIGIGKNSHIRRAIIDKNARIGDNVKILNADNVQEAARETDGYFIKGGIVTVIKDALLPSGTVI

SEQ ID NO: 91331 - protein, 389 aa, Chlamydophila abortus S26/3
MFEFRFPKIGESGSGGLVVRWLKQVGENIAKDEPVIEVSTDKIATELASPKAGKLMRCLVKEGDEVASGEIIALIDTECAVEEEVVVEEPSPHASCPQDSGKNAAWFSPAVLSLAHREGISIQQLQQISGTGNDGRVTRRDLENYILEMRQPSCPHIANANENRIPMSPLRRAIASSLSKSSDEVPHASLIVDIDVTDLMNLIAEEKDRFFATHGVKLTITSFIIQCLAKALEQFPLLNGSLDGDTIVVKKSINVGVAVNLNKEGVVVPVIHNCQDRGLVSIAKTLADLSARSRANKLDPSETQDGSVTVTNFGMTGALIGMPIIRYPEVAILGIGTIQKRVVVRDDDSLAIRKMVYVTLTFDHRVLDGIYGSEFLTSLKNRLESVTMS

SEQ ID NO: 91332 - protein, 574 aa, Shewanella oneidensis MR-1
MDADSINSFFLIGALLTAVSVLLSPMSSRLGIPILLIFLAVGILAGEDGPGGILFDDYSTAYLVSNFALAIILLDGGMRTRVASFRVALWPALSLATFGVAITTSITGVMAAWLFDLHWLQGLLVGAIVGSTDAAAVFSLLKGRSLNERVGATLEIESGSNDPMAVFLTVTLIAILANVGAELSASFMLISFIKQFGLGVLLGLGGGWLLWKLVNVSKLAEGLYSILVLSGGLMIYATSNKLGGSGILSIYLVGLFLGNKPTRGRHAILNVLDGMTWVSQIGMFLVLGLLLTPSDLLDIWLPGLALAFGMILFARPLAVWLSLLPFKSFGSRDRWFISWVGLRGAVPIILAVFPMMAGLPGAQLYFNLAFFVVIVSLLVQGASLTTAARLAKVELPPKPLPISRSGVEIYPKSEWEVFVYCLSESKWCIGEPLKRLAMPDGTRIAAVFRNNTLLHPSGSTCLEAGDILCVLGQEKSLEALSNLFSQAPETDEVSRFFGDFFIDTEVKLADLAPIYGLTLDDETGAMTVADLVALELGAHPVLGDQFLWQSLHWVVAGLYEGKVTNVGIRLPADA

SEQ ID NO: 91333 - protein, 309 aa, Bacillus cereus ATCC 14579
MQCIETNNLQQLLEQVKPYTKKGKLATYIPELGNANPDDLGIAIFHKETEYIHAGNSQTLFTLQSISKVITLALALLDRGEEYVFSKVGMEPTGDPFNSIIKLETTSPSKPLNPMINAGALAITSMLEGKDNEEKMERILHFVREITDNPTINYSSKVADSELETAYLNRSLCYYMKQNGIIDCDIEELMDLYTRQCAVEVNCIDLARIGLIFAMDGYDPYKKKQIIPKHITKICKTFMVTCGMYNESGEFAIRVGIPAKSGVAGGIFGCVKGDMGIGIFGPALDANGNSIAGFKILELLSAQEGWSIF

SEQ ID NO: 91334 - protein, 517 aa, Sorghum bicolor
  misc_feature (86)..(138): Xaa can be any naturally occurring amino acid
MAMTAIASPSSRTLIPPRHHGAAPSPSTSGDSSLRLLRAHPRHGRRSRGVSVSTPAARSRPFVFSSRAVSDSKSSQTCLDPDASTXXXXXXXXXXXXXXXXXXXXXXXXXXXXXXXXXXXXXXXXXXXXXXXXXXXXXLTQFNSASLNRHLSRAYGSNIGGYKNEGFVEVLAAQQSPDNPNWFQGTADAVRQYLWLFEEHNVMEFLILAGDHLYRMDYEKFIQAHRETDADITVAALPMDEARATAFGLMKIDEEGRIIEFAEKPKGEQLKAMMVDTTILGLDDVRAKEMPYIASMGIYVFSKDVMLQLLREQFPGANDFGSEVIPGATTIGKRVQAYLYDGYWEDIGTITAFYNANLGITKKPVPDFSFYDRSAPIYTQPRHLPPSKVLDADVTDSVIGEGCVIKNCKIHHSVVGLRSCISEGAIIEDTLLMGADYYETEADKKLLAENGGIPIGIGKNSHIRRAIIDKNARIGDNVKILNADNVQEAARETDGYFIKGGIVTVIKDALLPSGTVI

SEQ ID NO: 91335 - protein, 110 aa, Clostridium perfringens
TNIKLGAQNMHFEEKGAFTGEIAPRMLEAMNIDYVIIGHSERREYFNETDETCNKKVKAAFAHNLTPILCCGETLEQRENGTTNDVIKAQITADLEGLTKEQAEKVVIAY

SEQ ID NO: 91336 - protein, 213 aa, Zea mays
MRGPNTKAFQQGFVLKNMISSLQACCNISSSGSAGGATATMSLQQRKRAIKASVDIAMAASARGGGARWPQAVLAPSSSSSSSSPSARTPSPSSPGKKKKNTRGVCKKKVVRRSCLHHTRTRRRRDGSIAGTTSSSLARTTAAAGTTLGSCREIARRLVRKRTMVLRKMIPGGELLHDEISLLHEAVDYVTHLHAQVDALRRISNAVQRARLS

SEQ ID NO: 91337 - protein, 371 aa, Buchnera aphidicola str. Bp (Baizongia pistaciae)
MTLKNALLAFRNAINILDKNLINLLAKRKQLSLNIAHTKVKNNYPVRDIEREQMLLKNLTILGEKHFLNKKYIESLFSIILEDSVLTQKKWIKKYNLNKYKLEKISFLGSFGSYSHLAAQKYAKKHSKILTDKIYKNFSDVITSVEQQQSTYAILPIENQSSGLIIEVYKLLQKTPLFIIGNIYIHANHCLLAKKYTPILKIQKIYSHIQPFKQCSKFISLFPNWKLSNTTSTSEAIQHVAKENDNTIAALGNESYGELNKLEVIAKNISNKRNNITQFIILAQKKTYITNKKTHLKTIILISKKNENCEKIIRNILHKNKITLLKLKYYVTSKVLLEKIFFIEIENIYCIKHILKQFTIEIKCIKILGCF

SEQ ID NO: 91338 - protein, 517 aa, Sorghum bicolor
  misc_feature (86)..(126): Xaa can be any naturally occurring amino acid
MAMTAIASPSSRTLIPPRHHGAAPSPSTSGDSSLRLLRAHPRHGRRSRGVSVSTPAARSRPFVFSSRAVSDSKSSQTCLDPDASTXXXXXXXXXXXXXXXXXXXXXXXXXXXXXXXXXXXXXXXXXNCLNSNISKIYVLTQFNSASLNRHLSRAYGSNIGGYKNEGFVEVLAAQQSPDNPNWFQGTADAVRQYLWLFEEHNVMEFLILAGDHLYRMDYEKFIQAHRETDADITVAALPMDEARATAFGLMKIDEEGRIIEFAEKPKGEQLKAMMVDTTILGLDDVRAKEMPYIASMGIYVFSKDVMLQLLREQFPGANDFGSEVIPGATTIGKRVQAYLYDGYWEDIGTITAFYNANLGITKKPVPDFSFYDRSAPIYTQPRHLPPSKVLDADVTDSVIGEGCVIKNCKIHHSVVGLRSCISEGAIIEDTLLMGADYYETEADKKLLAENGGIPIGIGKNSHIRRAIIDKNARIGDNVKILNADNVQEAARETDGYFIKGGIVTVIKDALLPSGTVI

SEQ ID NO: 91339 - protein, 110 aa, Clostridium perfringens
TNIKVGAQNMHFEEKGAFTGEIAPRMLEAMNIDYVIIGHSERREYFNETDETCNKKVKAAFAHNLTPILCCGETLDQRENGTTNDVIKAQITADLEGLTKEQAEKVVIAY

SEQ ID NO: 91340 - protein, 307 aa, Geobacillus kaustophilus HTA426
MRVAKSIHELIGHTPVVEITRFPLPEGVRLFAKLEYFNPGGSIKDRLGQELLREAFASGKLKEGGTIIEPTAGNTGIGLALAAIGKNVNIIFCVPEKFSIEKQQLMKALGAQIVHTPTEEGMEGAIRKAEELARTIPGAYCPQQFQNPANPRTYYKTLGPELWDDLDGQIDIFVAGAGSGGTFMGTATFLKEKNPAIKTVIVEPEGSILGGGKPGPHRTEGIGMEFLPPFMDPDYFDAIYTIADDDAFRRVSELARQEGLLVGSSSGAAFHAALMEAEKAKPGTNIVVIFPDGSERYLSKHIYEGGR

SEQ ID NO: 91341 - protein, 460 aa, Vibrio cholerae O1 biovar eltor str. N16961
MNANSFAALNLKPELLANLETMGFATMTPIQAQSLPAILKGQDVIGQGKTGSGKTAAFGLGVLSNLNVKRFRVQALVLCPTRELADQVATDIRTLGRAIHNIKVLTLCGGMPMGPQIGSLEHGAHILVGTPGRILDHLSKDRIDLSELNTLVLDEADRMLEMGFQEALEAIIAAAPAERQTLLFSATYPASIEQIAQSVTRNALMIKVEATHDTSSIRQYFYKVEGSAARDEALETLLLHHQPTSSVVFCNTKREVQNVADALHQSGFSVIELHGDMEQRERDQALVQFANKSISILVATDVAARGLDVDNLDAVFNYDLSRDPEVHVHRIGRTGRAGSKGLAFSFFSDNESYRVAQIDEYMDIAIEPSTLPQPAAGARPYAANMVTIQIDGGKKDKVRPGDILGALTSDGELTAEHIGKINLFPMRAYVAVHKKIATKALNKIANGKMKGRQFRARLLK

SEQ ID NO: 91342 - protein, 441 aa, Gibberella zeae PH-1
MKSVVFKGVKQVALEDRPKPMIQDPTDIIVKVKYTAFELHVFRGHQPSGTGFIMGHEFTGVIDQVGSAVKSLEVGDAIVSPFTVSCGECFFCKRGYSSRCDKSLLFGTVLLDGAQAEYVRIPYAQSTVMKAPKEVEDLKLCLMADIFPTGCYAASNGLDSLDKERVQESIVVLIGCGPVGICALIAALEYKPKAILAVDGIESRLSLAKDLGAEPWNYLTQKQDLEKRVKDLSDGRGADVIIEVVGHSSALDMGFKLLRPWGIISSVGVHNGEIPWTGNEAYGKNLTIKMGRCPVRSIFENSLKLLAKKQHLLEFMTATVMPLSNAPEGYELFDSMKVQKVIFDAEKIRSAFLMIKPDVASSDATDIRFEMKRNGDSYILNGILSSGSDDLRCDVYIVVGKIDASNPNTHRRQFVFLVPVRFPGVAVHHILNVFSAGRTLS

SEQ ID NO: 91343 - protein, 110 aa, Clostridium perfringens
TNIKIGAQNMHFEEKGAFTGEIAPRMLEAMNIDYVIIGHSERREYFNETDETCNKKVKAAFAHNLTPILCCGETLEQRENGTTNDVIKAQITADLEGLTKEQAEKVVIAY

SEQ ID NO: 91344 - protein, 386 aa, Zea mays
MLSRLAAARRQLLLSPAVAYRSSSAAATASAVHERAAPASASVLPDTLERGSDAYQRNTAAVGGLLSDLRARVSQVLRGGGAEAVRRNAARGKLLPRDRIDRLLDPGASFLELSQVSLAAPARTLVFLALIWPHCEVNSIACSDVYDEALPSAGIITGIGPVHGRLCMFVANDPTTKGGTYYPLTVKKHLRAQEIASECKLPCIYLVDSGGANLPRQADVFPDRDNFGRIFYNQAKMSSDGIPQIAVVLGSCTAGGAYIPAMADESVIVKGNGTIFLAGPPLVKAATGEEISAEDLGGASVHCKVSGVSDHFAQGNYLGACFKFLFILLHDHFMFCSIFLLSVICLATPIMLIDVDEIHGLELGRIIVKNLHLADTRIKYSEFCLW

SEQ ID NO: 91345 - protein, 268 aa, Silicibacter sp. TM1040
MLDTHKAVRQIDPVWGRITEEAERAVAEQPLMGGLIHACILHHKTLDKALSYRIAAKLCSNEMSMVILREIVDGAYEAEPALVEAARADLMAVFERDPACHRLLQPILYFKGYQAIQAYRVGHWLWQQGDWDLAYFFQMRISEIFGVDIHPAAKIGKGIMIDHAHSIVIGETAVVGDNVSMLHSVTLGGTGKEEEDRHPKIEDGVLIGAGAKVLGNIRIGHCSRIAAGSVVLQEVPPCKTVAGVPAKIVGEAGCDQPSVSMNQVLAGK

SEQ ID NO: 91346 - protein, 201 aa, Geobacter metallireducens GS-15
MCMCTLVTKEAPDFAADAVLPDNTFATIKLSSFRGKYVILFFYPLDFTFVCPSEILAFNKKLDQFKAKNCEVIGVSVDSKFTHLAWKNTKVEDGGIGNIQYPLVSDLKKEIATQFGVLFENGGVALRGLFLIDTKGIVRHAVINDLPLGRSVDEALRMLDALQFVETHGDQVCPANWREGDEAMKPTAAGVADYLAKHAAG

SEQ ID NO: 91347 - protein, 301 aa, Zea mays
  misc_feature (289)..(289): Xaa can be any naturally occurring amino acid
MRLPSPAGLRSSSSPSPETPTESQFPTPTPLLLSIKGNFATKSRIPSRCSPPLDADTTATSPSPIPPCPGPRSRQRRDPERRAMANIDMAKILADLDRGAGDARLPKTKLVCTLGPASRSVPMLEKLLRAGMNVARFNFSHGTHQYHQETLDSLRQAMHNTGILCAVMLDTKGPEIRTGFLKDGKPIKLTKGQEITVTTDYDIKGDENMIAMSYKKLPVDVKPGNVILCADGTISLAVLSCDPDAGTVRCRCENTAMLGERKNCNLPGIVVDLPTLTEEDKEDILGWGXVPNDIDMIALSF

SEQ ID NO: 91348 - protein, 424 aa, Physcomitrella patens subsp. patens
LGVVAVAYLGADYLREILPGLHEILRPVIWGVFAVAIVCRALNYDYWTQELRSIGMFVGSLVFMVCCLFVEAAAMQYVTAVLGMDWHWNTAPLPDSGQWTVLFSNEKLPKVIVALLREPIIGLHHYLMLFLLLAFSVLYGCVKAPGMALGARYMFTMACGRLIRVSTFTATILPSARPWCAQARFTIANHPHPWAQKYYVPYSKDPRMVQQIISRDEAFASLENYPAEYVPNWGSLQFLVNILRPRDPAKTGQTGYDWFNTFKNSAAGGCNDLMFSGHVFVAVLTAMAWQEAYPGWTSTLIWLLVVHTAQREIRERHHYSVDVVTGVYFGIFLWNTTGWIWASRDQQKELKLKLLAAVEDDIQKAAKDGNLEKITYMLNKVSTANKDNEQKDKVSYWFTMLLGCFVLFMTLGLGLLTFTWTANG

SEQ ID NO: 91349 - protein, 119 aa, Chlamydia trachomatis
KVGSWIGAQYDQEIIFTRGTTSSLNLLAIAANDSWLAGGTVVISEAEHHANLVSWELACQRSGATIKKVRVDDEGMVDCSHLEQLLKQGVQLVSLAHVSNVSGAVLPLPEIAHLVHRYE

SEQ ID NO: 91350 - protein, 351 aa, Bacillus subtilis subsp. subtilis str. 168
MNRIFFILVAAGVPLSVIGSLMHWPSAVLFAVYCVTIIALASYMGRATESLSIIAGPRIGGLLNATFGNAVELIISLFALKEGLTGIVLASLTGSVLGNLLLVAGLSFFVGGLKYKRQEFNIHDARHNSGLLIFAIIVAFVIPEVFSVGMGNASKLNLSIGISIIMILLYVAALYFKLVTHRGVYQPNNAAQTEEEEEPEWSGKVATIVLFAATIVVAYISENLVHTFHSVAEQFGWSELFIGVIIVAIVGNAAEHASAIIMAFKNKMDIAVEIAVGSTLQIAMFVAPVLVICSIFFPTSMPLVFTLPELVAMVSAVLLMIAISNDGDSNWFEGATLLAAYVIMAIGFFLL

SEQ ID NO: 91351 - protein, 175 aa, Glycine max
  misc_feature (121)..(121): Xaa can be any naturally occurring amino acid
MESTFIMIKPDGVQRGLIGEIISRFEKKGFYLKALKLVNVERSFAEKHYADLASKPFFQGLVDYIISGPVVAMVWEGKSVVTTGRKIIGATNPLASEPGTIRGDFAVDIGRNVIHGSDSIXSANKEIALWFPEGPADWQSPHPPGSEKENWEVSPQPGRPKKSGPFWCLKGSKKN

SEQ ID NO: 91352 - protein, 360 aa, Glycine max
MANFTSSSSSSCSPLPLSLTMSHISPPSSSAAFDDSSEDACSICLEPFSTHDPATITSCKHEYHLHCILEWLQRSKECPICWQLLILKDPASQELLNAVEAEKRLSSRTVYSHAFMDSRSPLQRLNNDQHLVSAASRARYICRSKRQRSPGAGPSEVLVFNSSIHASGMQPTLTTSPTSGVPSAAHIQSPTSTFSCVGMVTTNTSSESDMPSKPRVIYSQPSPESARRLNTSEMFSFSESFKSKLSAASARCKESISKNTRGLKEKLIARNASVKELSKGVQCEMNAGIACVARMIERLDLTSKWSSSALIPVKGKSVQENGVLVGNVTSNASSLDSSLVAVGVETPPSCVQSGHDAART

SEQ ID NO: 91353 - protein, 111 aa, Zea mays
NPPKSFFRQMAAIAAQVTDWSKVVVAYEPVWAIGTGKTATPDQAQEVHQQLREWFSKNVSPQVAESVRIIYGGSVTGANSQELARKPDIDGFLVGGASLKPEFVQIAKARD

SEQ ID NO: 91354 - protein, 248 aa, Alkalilimnicola ehrlichei MLHE-1
MSENREGQRVPEVVFRTRKDGEWVDVDSRDLFNGRTVAVFSLPGAFTPTCSSTHLPRFNELAPVFFENGVDEIVCISVNDAFVMNEWARDQHAENITLIPDGNGEFTEGMGMLVDKTDLGFGKRSWRYSMLVKDGVIEKMFIEPQKPGDPFEVSDADTMLRYINPEAPHPEFVTLFAKAGCPHCARAKALLESHQMAYEEITLGEGVITRSVRAATGSGSVPQVFVDGRLIGSADALEAFLTQRRQAA

SEQ ID NO: 91355 - protein, 488 aa, Pseudomonas fluorescens PfO-1
MPSITVEPCTFALFGALGDLALRKLFPALYHLDGAGLLHEDTRIIALAREAGTEQQHLAFIAAELRRYVGKELDEAVAERFLARLTYLHVDFLKAEDYVALAELAGSTQRMIAYFATPAAVYGAICENLANVGLAENTRVVLEKPIGSDLESSRKVNDAVAQFFPENRTYRIDHYLGKETVQNLIALRFANSLFETQWNQNYISHVEITVAEKVGIEGRWGYFDKAGQLRDMIQNHLLQLLCLIAMDPPADLSADSIRDEKVKVLKALAPISPEGLTTQVVRGQYIAGHSEGKSVPGYLEEPNSNAQSDTETFVALRADIRNWRWAGVPFYLRTGKRMPQKLSQIVIHFKEPSHYIFAPEQRLQISNKLIIRLQPDEGISLRVMTKEQGLDKGMQLRSGPLQLNFSDTWRSARIPDAYERLLLEVMNGNQNLFVRKDEIEAAWKWCDQLIAGWKKSGDAPKPYAAGSWGPMSSIALITRDGRSWYGDI

SEQ ID NO: 91356 - protein, 316 aa, Magnaporthe grisea 70-15
MASRSLLSSTWRAATAAALRPTAAVRHSSSSSTSAIAYKALRRRQAPLPTSDSPPAWSSAQAAVSNILYETPTPSTAPPKRHILNCLVQNEPGVLSRVSGILAARGFNIDSLVVCSTEVADLSRMTIVLTGQDGVVEQARRQLEDLVPVWAVLDYTDSPLVQRELLLAKVNILGQEYFEELLDHHREITSADAEVLASSEGEQTLEQVAADFHPSRLAASEALRHKHEHLKSITYFTHQFGGKVLDISTNSCIVELSAKPSRIDSFLKLIGPFGILESARTGLMALPRSPLYGPNEEEALIKEADDIVDASQLPPG

SEQ ID NO: 91357 - protein, 175 aa, Zea mays
MEHKEAGCQAPEGPILCINNCGFFGSAATMNMCSKCHKEMITKQDQAKLAASSIDSIVNGSDAVMEPVVAGSNTVVAVAQVELQTMNVQQPADVAGPSEGVAAAISKGGKVGPNRCSACRKRVGLTGFNCRCGNLYCALHRYSDKHDCKFDYRAAARDAIAKANPVVKADKLDKI

SEQ ID NO: 91358 - protein, 413 aa, Bacillus cereus ATCC 14579
MNSSKVAIIGLGYVGLPLAVHFAERGHTVLGLDKDIRKIDSIIKGESYIPDVSSKELQSLLTKKKLTVNTPDQGIADFQNSDYVIVTVPTPINEQREPDLSALISASHYIQQNLQKGQTFIFESSTYPGTLEEVILPIISQNGKKVGEDFYIGYSPERIDPANSQYSVQAIPKVISGQTEKCKQKVQDLYSTIFDEVVPVSSPKVAEMCKLFENIQRLVNISLVNELNTLCESLGIDFYEAIEAASTKPFGFTPYWPGPGIGGHCIPVDPLYFQWRIKKNGAISQLIEAAHIINEEMPEKMVRKVKSVVQLPATVLIVGIAYKKDVNDLRESPALPIIQLLRNQGYEIEYHDPYISSAEIGDKVYQSVSLDEEKVKKADCILILTDHSNIDWKLFKGMDRVIDTRGIVKKVSK

SEQ ID NO: 91359 - protein, 480 aa, Pseudomonas putida GB-1
MKPARLRADLLAGLTTAFALVPECIAFALVAHLNPLMGLYGAFIICTLTALFGGRPGMISGAAGSMAVVIVALVVQHGVQYLLATVLLGGVVMILFGLLRLGKLVRLVPYPVMLGFVNGLAIVIAMAQLEHFKDGDHWLSGAPLYLMIGLVALTMVVVYLLPRLTRAVPPALVAILGVGLLVYLLGLPTRTLGDMAHIAGGLPGLALPDVPWNLHTLKVIAPYAVLMAMVGLLETLLTLNLTDEITESRGFPDRECVALGAANMVSGLCGGMGGCAMIGQTVINLSSNGRGRLSGVVAGVMILLFVLFLSPLIERIPLAALVGVMFVVAQQTFAWASLRVLHKVPVNDVLAIIAVTVVTVFTDLATAVLFGIIIAAVNFAWQHARELYADSHEDGEGGKHYQVHGTLFFASTTPFLNQFDPANDPGKVTLDCQHLSFVDYSAIAALKTLRERYAKAGKQLRVVHLSERCKTLLKRAGEQH

SEQ ID NO: 91360 - protein, 517 aa, Sorghum bicolor
  misc_feature (86)..(142): Xaa can be any naturally occurring amino acid
MAMTAIASPSSRTLIPPRHHGAAPSPSTSGDSSLRLLRAHPRHGRRSRGVSVSTPAARSRPFVFSSRAVSDSKSSQTCLDPDASTXXXXXXXXXXXXXXXXXXXXXXXXXXXXXXXXXXXXXXXXXXXXXXXXXXXXXXXXXNSASLNRHLSRAYGSNIGGYKNEGFVEVLAAQQSPDNPNWFQGTADAVRQYLWLFEEHNVMEFLILAGDHLYRMDYEKFIQAHRETDADITVAALPMDEARATAFGLMKIDEEGRIIEFAEKPKGEQLKAMMVDTTILGLDDVRAKEMPYIASMGIYVFSKDVMLQLLREQFPGANDFGSEVIPGATTIGKRVQAYLYDGYWEDIGTITAFYNANLGITKKPVPDFSFYDRSAPIYTQPRHLPPSKVLDADVTDSVIGEGCVIKNCKIHHSVVGLRSCISEGAIIEDTLLMGADYYETEADKKLLAENGGIPIGIGKNSHIRRAIIDKNARIGDNVKILNADNVQEAARETDGYFIKGGIVTVIKDALLPSGTVI

SEQ ID NO: 91361 - protein, 230 aa, Chlamydophila abortus S26/3
MLPSTHKPNLQEMFDSLALKYDKINSILSFGMHHVWNRTFSKMLGKSDHLIDLCSGTGKVAYRYIRDYPGATATLVDFSANMLHIAKQRYPTAPFTFIEGDIAQLPIREESQTLVSMAYGLRNLPTPKDTLENIHRILKHQGTLGILELTSPPHNHPLYQLHRLYLKFIIPWIGKLYSKNRQAYAYLAESIRQLPSDHYLEQLFSSAKFQVRKKRKLAFGAATIWILKKI

SEQ ID NO: 91362 - protein, 325 aa, Alkalilimnicola ehrlichei MLHE-1
MPHAIRIHETGGPDVLKWEPVEVGEPGPGEVRLRHTAVGLNYIDVYFRTGLYPPPGLPSGLGLEAAGVVEAVGDGVTEVAVGDRVVYASPPLGAYAEARLMPADRVVRLPDAIDDRTAAGMMLQGLTAWYLLHRTYPVKAGDTLLIHAAAGGVGLLVCQWAKHLGATVIGTVGSDEKAELARAHGCDHPIVYTRERFPDRVREITAGEGVPVVYDSIGKDTFEDSLDSLRPLGLMVSFGNASGPVPPLDLQLLSAKGSLFITRPTVMTYTARREDLLAGAQALFDVVQKGVLKVAVNQSWPLAQAAEAHKALEARQTTGSTVLTV

SEQ ID NO: 91363 - protein, 490 aa, Pseudomonas putida GB-1
MAGTSLPMPSMRPKCRRSGLLCSGFANGWLRGTDSTDPGQITNPGNDRNRIIRLRNTPPTRLDNKKLEQRPRVPMNQESISQSIAIVHPITLSHGRNAEVWDTDGKRYIDFVGGIGVLNLGHCNPAVVEAIQAQATRLTHYAFNAAPHGPYLALMEQLSQFVPVSYPLAGMLTNSGAEAAENALKVARGATGKRAIIAFDGGFHGRTLATLNLNGKVAPYKQRVGELPGPVYHLPYPSADTGVTCEQALKAMDRLFSVELAVEDVAAFIFEPVQGEGGFLALDPPFAQALRRFCDERGILIIIDEIQSGFGRTGQRFAFPRLGIEPDLLLLAKSIAGGMPLGAVVGRKELMASLPKGGLGGTYSGNPIACAAALASLAQMTDENVATWGERQEQAIVSRVERWKSSGLSPYIGRLTGVGAMRGIEFVNADGSPAPAPLAKVMEAARAKGLLLMPSGKARHIIRLLAPLTIEAEVLEEGLDILEQCLTELN

SEQ ID NO: 91364 - protein, 517 aa, Sorghum bicolor
  misc_feature (86)..(128): Xaa can be any naturally occurring amino acid
MAMTAIASPSSRTLIPPRHHGAAPSPSTSGDSSLRLLRAHPRHGRRSRGVSVSTPAARSRPFVFSSRAVSDSKSSQTCLDPDASTXXXXXXXXXXXXXXXXXXXXXXXXXXXXXXXXXXXXXXXXXXXLNSNISKIYVLTQFNSASLNRHLSRAYGSNIGGYKNEGFVEVLAAQQSPDNPNWFQGTADAVRQYLWLFEEHNVMEFLILAGDHLYRMDYEKFIQAHRETDADITVAALPMDEARATAFGLMKIDEEGRIIEFAEKPKGEQLKAMMVDTTILGLDDVRAKEMPYIASMGIYVFSKDVMLQLLREQFPGANDFGSEVIPGATTIGKRVQAYLYDGYWEDIGTITAFYNANLGITKKPVPDFSFYDRSAPIYTQPRHLPPSKVLDADVTDSVIGEGCVIKNCKIHHSVVGLRSCISEGAIIEDTLLMGADYYETEADKKLLAENGGIPIGIGKNSHIRRAIIDKNARIGDNVKILNADNVQEAARETDGYFIKGGIVTVIKDALLPSGTVI

SEQ ID NO: 91365 - protein, 460 aa, Pseudomonas putida GB-1
MASQDNKKQRSLQHGLTSRQVSMISIAGIIGAGLFIGSSNAIATAGPAILISYAMTGLLVLLVMRMLGEMAIANPNSGSFSTYASEAIGPWAGFTIGWLYWWFWVLIIPVEAIAGADILHAYFPGVPSWLFAFLIMLVLSGTNLVSVKNFGAFEYWFALVKVVAIIGFIGVCTLAVFGFWPLAEVSGVSRLWDNGGFMPNGFGTVLGGVLITIFSFFGAEIVTIAADETANPKDKIRRATNLVVYRIAIFYLASIFLVVSLVAWNDPALKAVGSFQRVLEVLNVPGAKLLVDLVVLVAVTSCMNSGLYTASRMLYSLGARGQALSVTKRISGSGVPTVAVIFSTLAGFAGCLVNYVFPGKVFGFLLSTTGAIALLVYLVIAVSQLRMRARAEREGRPLELKMWLFPWLTWLVIGTIVMVLGYMLFSDAYRYETLMTAGVTAFILLVSLTQRRANVVAQTA

SEQ ID NO: 91366 - protein, 517 aa, Sorghum bicolor
  misc_feature (86)..(117): Xaa can be any naturally occurring amino acid
MAMTAIASPSSRTLIPPRHHGAAPSPSTSGDSSLRLLRAHPRHGRRSRGVSVSTPAARSRPFVFSSRAVSDSKSSQTCLDPDASTXXXXXXXXXXXXXXXXXXXXXXXXXXXXXXXXYRLIDIPVSNCLNSNISKIYVLTQFNSASLNRHLSRAYGSNIGGYKNEGFVEVLAAQQSPDNPNWFQGTADAVRQYLWLFEEHNVMEFLILAGDHLYRMDYEKFIQAHRETDADITVAALPMDEARATAFGLMKIDEEGRIIEFAEKPKGEQLKAMMVDTTILGLDDVRAKEMPYIASMGIYVFSKDVMLQLLREQFPGANDFGSEVIPGATTIGKRVQAYLYDGYWEDIGTITAFYNANLGITKKPVPDFSFYDRSAPIYTQPRHLPPSKVLDADVTDSVIGEGCVIKNCKIHHSVVGLRSCISEGAIIEDTLLMGADYYETEADKKLLAENGGIPIGIGKNSHIRRAIIDKNARIGDNVKILNADNVQEAARETDGYFIKGGIVTVIKDALLPSGTVI

SEQ ID NO: 91367 - protein, 211 aa, Geobacillus kaustophilus HTA426
MGKKPVVIGVAGGSGSGKTSVARAIYDHFGDRSILVLEQDFYYKDQSHLPFEERLKTNYDHPLAFDNDLLIEHIHKLLRYEPIDKPVYDYTLHTRSSDVIRVEPKDVIIVEGILVLEDERLRNLMDIKVYVDTDPDIRIIRRLIRDIKERGRTFDSVIEQYLSVVRPMHNQFVEPTKRYADVIIPEGGQNVVAIDLMVAKIRTVLEQKAVL

SEQ ID NO: 91368 - protein, 45 aa, Glycine max
METSRRFGDRTVNKFEKTIKKRGFVQDTTTRKGKDYPVGPSAARF

SEQ ID NO: 91369 - protein, 517 aa, Sorghum bicolor
  misc_feature (86)..(123): Xaa can be any naturally occurring amino acid
MAMTAIASPSSRTLIPPRHHGAAPSPSTSGDSSLRLLRAHPRHGRRSRGVSVSTPAARSRPFVFSSRAVSDSKSSQTCLDPDASTXXXXXXXXXXXXXXXXXXXXXXXXXXXXXXXXXXXXXXPVSNCLNSNISKIYVLTQFNSASLNRHLSRAYGSNIGGYKNEGFVEVLAAQQSPDNPNWFQGTADAVRQYLWLFEEHNVMEFLILAGDHLYRMDYEKFIQAHRETDADITVAALPMDEARATAFGLMKIDEEGRIIEFAEKPKGEQLKAMMVDTTILGLDDVRAKEMPYIASMGIYVFSKDVMLQLLREQFPGANDFGSEVIPGATTIGKRVQAYLYDGYWEDIGTITAFYNANLGITKKPVPDFSFYDRSAPIYTQPRHLPPSKVLDADVTDSVIGEGCVIKNCKIHHSVVGLRSCISEGAIIEDTLLMGADYYETEADKKLLAENGGIPIGIGKNSHIRRAIIDKNARIGDNVKILNADNVQEAARETDGYFIKGGIVTVIKDALLPSGTVI

SEQ ID NO: 91370 - protein, 463 aa, Haloarcula marismortui ATCC 43049
MVPTMADLQLTDDVPPVADDGVWLACIECGETFAPFDEIRYTCDHCDGLLEVRYDDLPTFDEFEGSGVWRYNAALPFEEGITLPEGDTPLHEMPRLKDDIGVDALRVKHEGMNPTGSFKDRGMTVGVRVAQEVGVDRLACASTGNTSAALAAYGARGGMETLVLLPAGKVAAGKIAQASLHRARILEVDGNFDQCLDIVQDLAARGEAYLLNSLNPFRLEGQKTIGLEIMEEFYADNGEYPDRIVLPVGNAGNTAALYKCFRELVKAGAITEEQVPKLTGVQAEGAAPMVEAIENGYEDTRRWDDVETRATAIRIGNPVNAPKALPGIRETGGTAVAVSDEEITEAQRDIAGEGVGVEPASAASVAGLRKLRREGEVDSDESVVCLTTGHLLKDPEAAAEAGNEPEPVANSTEAVLDLIEEPSSVTETIRRQASKAADAPLVPALVASGLGVAYLYRKLRSKK

SEQ ID NO: 91371 - protein, 882 aa, Methanosarcina barkeri str. Fusaro
MSKFVYFFGKDVTDGKASMRDLLGGKGAGLAEMANLGIPVPPGFTITTEVCVLYLKGKKYSEEVLKQVEEAIDKLETLNNKKLGDPEDPLLVSVRSGARVSMPGMMDTVLNLGLTDKSVLGLANKVNDERFAYDCYRRFISMFGDVVLGIDFDKFESLIEDKKKELKVESDTDLDAKALKDLAERFKGVIKLEKGFEFPQDPKVQLQMAIDAVFDSWNNPRAITYRKLNEIDDSWGTAVNVQTMVYGNRGNTSGTGVAFTRNPSTGERKFFGEYLINAQGEDVVAGIRTPDFIDTLGNKIPEAYNQLVDICRKLEAHFKDMQDIEFTIQEGKLYMLQTRTGKRTAAAAVKLATDMVAEGLIDKETAVTRVKAEHIDLLLHPRIDPNAKLEVVAKGLPASPGAAVGKVVFTAEVAEEMAEKGEKTILVRTETSPEDIGGMAAAQGVITVRGGMTSHAAVVGRGMGKPCVVGCGDISIDTKSNLFMVNGYTVKEHDYVTIDGSTGSVIIGKVELIDAEINEDLKKILQWADEIRTLGVRTNADNPADAGLARELGAEGIGLCRTEHMFLGEERIPVVREMIMAEDEKSRRKALKKLLPMQKEDFLGIFRSMEGLPVTIRLLDPPLHEFLPDKEELDAKLRELEASGDSSGKINEVKKVIQRVVSLKEINPMLGHRGCRLGITYPEIYDMQVRAIMEAACELTNEGMKITPEIMIPLVGLVKELAITREEVCKMAEAVMAEKGVKIDYKVGTMIELPRAAIVADQIAQEADFFSFGTNDLTQTTFGFSRDDVSKFVPIYQKAGIIEHDPFAVLDQEGVGEIMKIGISKGRSVKPDLKMGICGEHGGEPRSIHFAYDIGLNYVSCSPYRVPIARLVAAQSTIESRK

SEQ ID NO: 91372 - protein, 218 aa, Buchnera aphidicola str. Bp (Baizongia pistaciae)
MKTNELKRLVARKVVDYINPGSVIGIGTGSTVSYFIEVLSTIKNLISGAVSSSNFSTACLKRIGIPIYDLSKINSLVLYIDSADEINPQLQMIKGGGAALTREKIIAATAEKFICIADESKQVEILGKVPLPIEIIPMARSYISNEIIKIGGMPKYRKNVITDNGNVIIDVFNLVITDPVCLENKINSFPGVVSVGLFATRKADIALIGTSSGVQVIY

SEQ ID NO: 91373 - protein, 181 aa, Agaricus bisporus
MFTANQSKRRIETDVMKMLMSDYEVNLVNDNMQEFYVRFYGPAETPFAGGVWKIHVELPDQYPFKSPSIGFMNKIFHPNIDELSGSVCLDVINQTWSAMFDMINIFEVFLPQLLRYPNPNDPLNGEAAALMMRHPKEYDAKVKEYVQRFATREALDGDDNKDNKDEDEEMSDIGSISEDDN

SEQ ID NO: 91374 - protein, 516 aa, Ostreococcus tauri
MFAATKPQVALRARARKSDVRARSGGRKAMVTRAAGYDYDLLIIGAGVGGHGAAMHAVSRGLKTAIMEGDVIGGTCVNRGCVPSKALLAASGRVREMRNAEHLKALGITVQPGAVTYDRQGIADHAENLAATIRGNLERSLTGLGVDIITGAAKIEDNHTVSYGAPGTVTGGKVTAKNIIIATGSTPFVPPGIEVDHKTVFTSDAGLKLDWVPEWVAIIGSGYIGLEFSDVYTALGSDVTFIEAMPNIMPGFDKEIAKMAERVLISPRNIDYVTNVLATKVTPGIPGKKPVTIELTDFKTKEVVDTMEVDAVLVATGRSPYTQGLNTEAIGVELQRGFIPVNAKMQVLDKDGKVVEGMWCIGDANGKMMLAHAASAQGISAIENMCGNENELNHLSVPAACFTHPEVSFVGLTEEQAREKGEKEGFEVAVRKTAFKGNSKALAEKEGDGMAKLIYNPKTGEILGMWIFGLHAADLIHEASNAISMGSKLDDLKFTVHAHPTLSEVVESLLRGSDGH

SEQ ID NO: 91375 - protein, 301 aa, Xanthomonas campestris pv. campestris str. 8004
MKLTIPTWLTLLRIVMIPVLVVVFYLPYKWTNFASAGVFALAAITDWLDGWVARRYHQYSAFGAFLDPVADKLMVAVALFLIVQGHPTPWMAFWAAVIVGREIAVSALREWMAEIGQRAKVRVAMIGKVKTTAQMVALLCLLYSVTPGQMPTHEIWLGNLIFQAGYWTLAIAALLTLWSGFQYLQAAWPSLRADEKAFFGLNFGLKNAGCWCMSVAFAGMKKGAEAPLFNDLQMPVEVCRSIFGAGNETRTRDLNLGKVALYQLSYSRVEQYSTACHRFALALSPRWRQGKHTRCGGLGRN

SEQ ID NO: 91376 - protein, 196 aa, Salmonella enterica subsp. enterica serovar Typhi str. CT18
MQLKRVAEAKLPTPLGDFLMVGFEELATGHDHAALVFGDISGKTPVLARVHSECLTGDALFSLRCDCGFQLEAALTHIAEEGRGILIYHRQEGRNIGLLNKIRAYALQDQGYDTVEANHQLGFAADERDFTLCADMFKLLGVDEVRLLTNNPKKVEILTEAGINIVERVPLIVGRNPNNEHYLDTKAAKMGHLLSK

SEQ ID NO: 91377 - protein, 298 aa, Haloarcula marismortui ATCC 43049
MDILDVDDLTTDELVTVLDRAAAIKADHGEGSTSDLLDQQTLGMIFEKPSTRTRVSFETGMTQLGGHAVFLGPDDIHLGHGEPVKDTARALGRYVDFIMARVFDHADAEELAEYADVPVINGLTDDAHPCQTLADLLTIRAQFGDFEDVSVAWVGDGNNVCQSFVIGAAMVGLDLTVATPEGYGISDDVADRAAGFGNAPETTHDPEAAVAGADVVYSDVWVSMGQEDKRDQKLADFEGFQITPDLLGDRPFMHCLPAHRGEEVTDAAIESENAVVWNQAENRLHAQKGLLVWLSEQA

SEQ ID NO: 91378 - protein, 396 aa, Silicibacter sp. TM1040
MGWKTLDDMDLQGKSVLTRVDINVPMEDGKVTDDTRIRRLVPTISDLLSKGAKPVLLAHFGRPKGKVVPEMSLQPLVPALEAAFGAPVMFVADCRGPAAKGAVDALAPGQILLLENTRFYPGEEQNDADLAKEMAALGDIYCNDAFSAAHRAHASTEALARLLPACAGRLMEAELKALEGSLATPERPVTAVVGGAKVSTKLDLLGNLVAKVDTLVIGGGMANTFLAAQGIDVGKSLCEHDMTGTAKDIMARAEAAGCTILLPSDVVVAREFKAGADNETVPADACPADAMILDAGPASVAAISTVFAESKTLIWNGPLGAFEIAPFDIATNTAAQKAAELTKAGQLISVAGGGDTVAALNQAGAAEAFSYISTAGGAFLEWMEGKVLPGVAALQT

SEQ ID NO: 91379 - protein, 616 aa, Debaryomyces hansenii CBS767
MIAIDLKFEEWQWQYQISTTFFVFGILPTLYYIYAKYITSRPNKYNKLEEPLKIEIPIPDEAKAHWKGKRLYPPNLSIRIPNEPNKIQSYCPATSQYLGTFTATTKEEMNQQIVKAKAAQKVWAKSTFSLRRQLLKTLSRFIIDHQEDIARVACRDSGKTKLDALMGEIMVTLEKLNWIIANGEKALRPSQRPGPSNLLIGLMKNGEVRYEPLGVVAALISWNYPFHNLMGPVIASLFTGNAIVIKCSEQVLWSSTWFVDLVKTVLKLLNINEDLIQLCCCYPEDADYLTSHPGLSHITFIGSKNVAHKVVESAAKELTPCVVELGGKDSLIVLDDVVDLKALSSVIMRGTFQSVGQNCIGIERVICLPKAYETLVEILSERIGHLRLGSDIDQLDEIDLGAMISDNRFQHLEDLISDAVSKGARLIHGGKPYQHPNYPQGHYFEPTLLADVDKSMKIFQEEVFGPILTMIKATDADEAVAISNATEFGLGNSIFGKNFHQCNEIANSLESGNVAINDFATYYVAQLPFGGIKKSGYGKFGGEEGLTGLCVAKSIVMDKPILRMLGIATSIPPEIDYPINSDKKAWGFVSALNTAGYDNRLWEIIKAFKKLAKGGA

SEQ ID NO: 91380 - protein, 305 aa, Neisseria meningitidis FAM18
MGKNIKHLMKWAKRNGIEAWRIYDRDIPQFPFAADVYGDRIHLQEYDTGWLMRPEEYEAWLAEVLEAVAFVTGFEPEQIRLKRRERQKGLQQYEKTGKAGDDFVITENGRKFWVNLDKYLDTGLFLDHRNTRKKVGETAAGKRFLNLFSYTGSFTVYAATGGAASSETVDLSNTYLDWARRNFELNGIDTERHKIVRADVFQYLQTAYGEGRRFDLIVMDPPSFSNSKKMSDILDIQRDHKKLIDGAVKLLASDGILYFSNNLRSFVLDDLVSEQYAVKDISKQSVPEDFRNKKIHRCWEIRHKS

SEQ ID NO: 91381 - protein, 324 aa, Physcomitrella patens subsp. patens
MGRRQGMQIGVVGFFMLGLASLLLVVSQEFPVESSSSTVTPAFIWSDLRCLFAQDRRVNYEFQTSETLVDTIFHDFGRCAATEDEVQEEAKPEMIIMFIGKELRSEDISRSASSSVLKTLQKSITGVKYSMSIPYVTSASDKASISESFLSNIRNKFDTTPKIGVVAVSGSCATGDHAVKRLADVADIQGYIFGRKTSRAQGETDVMVICYSPTLHWSTDGVSNSEGIVLEEVLSTVKSSGTSNVAIYFSEPSVSSVKHHGILERHLLEGSGTGSTDCDALCRSRAVILEGIFVAFTLITILVSGICCMKAVKSPARFETAKES

SEQ ID NO: 91382 - protein, 286 aa, Haloarcula marismortui ATCC 43049
MTVVIKVGGARAVDPAGALADVASLVADGEQVVVVHGGSTKVDETLERLGVEPEYVETPSGVVGRFTDETTMEVFEMAFGHLNTQLVAGLQSEGVDAVGLTGVDGKLLYGPRKSAVRVVEDGKKKIRRGDHSGTIKQVNGDLLETLLGDGYTPVAGPPMAGDDDGEVIPVNTDADRSAAAIAGELDAQLVLLTDVEGVYADPDDPSTLIESVETASDWDALEDAAEGFMGRKIMAAEEALDGGASEVVVADANAESPILSALDGGGTHVHASALEQDTDQTATEEQ

SEQ ID NO: 91383 - protein, 496 aa, Magnetospirillum magnetotacticum MS-1
MPLTPELDPFKLAKALSGKHLIGGKFVPAKGGKTFPVDNPATGEEIGTAAFGTKADVDAAVANAKAAQKEWAKQSARARGKLVAECGRVLSAHVEELGRLVALETGKALRTESRVEAGVLADMFVFFGGLGSELKGETIPFNPDMLTVTVREPVGVVGCIIPWNVPLLLMAMKAAAALVAGNAVVVKSAEEAPLTVLRVAEIMNTVLPPGLFNMLSGFGPECGAPLVEHPDVKKVTFTGSVETGRIVYKAAAEKLIPVTLELGGKSPMIVCADADMDQAVAGALAGMRFTRQGQSCTASSRLFVHESIHDEFVARVKAKVDAMVMGDPLDEKTDIGTIVSDGQLERVKSYIKLGEETKGATKHVCSAMPTDPKLAKGRFVQPVIFTGMKNSDRLCQEEIFGPVCAVIKWTDYEDVLAQANDSEYGLAASIWTRDFKVAMDATRRLEAGFVQVNQNLVVQPMLSYGGVKTSGIGKEASLESMLEHFTHKKTIIFNMK

SEQ ID NO: 91384 - protein, 462 aa, Neisseria meningitidis FAM18
MSIKFADLNLDKNILSAVSSEGYESPTPIQAQAIPFALEGRDIMASAQTGSGKTAAFLLPTLQRLTKRSEKPGKGPRALVLTPTRELAAQVEKNALAYAKNMRWFRTVSIVGGASFGYQTRALSKPVDLIVATPGRLMDLMQSGKVDFERLEVLILDEADRMLDMGFIDDIETIVEATPTDRQTLLFSATWDGAVGKLARKLTKDPEIIEVERVDDQGKIEEQLLYCDDMRHKNRLLDHILRDANIDQCVIFTSTKAMTEVIADELYEKGFAANCLHGDMPQGWRNRTLMDLRKGRCKILVATDVAARGIDVPTITHVINYDLPKQAEDYVHRIGRTGRAGRTGIAITFAEVNEYVKVHKIEKYINRKLPELTIEGMEPTRKRKSAGGKPKGKGGWGDRKSGGRRGDHKPGKEGFGGKTRGEGFKKEGFKKDGFKKTGEGFKGKRKAGDSFAGRGERRYKDR

SEQ ID NO: 91385 - protein, 220 aa, Bradyrhizobium sp. BTAi1
MTTSHDTDERLIEKGRKLFAQAWRFTHASPSIASLPPMSGQIEIAFAGRSNVGKSSLINALTGQNALARTSHTPGRTQELIFFEGPDYAPLRLVDMPGYGYAAAAKTKVASWTKLIHQFLLGRASLARVYVLIDARHGLKEVDQEIFKTLDRSAVSYQLVLTKADQVKPPELAARIAETEAALAKHPAAFPQVLATSSRSGTGMPELRAAMARLLEERGA

SEQ ID NO: 91386 - protein, 298 aa, Bradyrhizobium sp. BTAi1
MTDATTISPLDQARILSEALPHMQEYDDETIVIKYGGHAMGDEDTAKAFARDIVLLEQTAINPVVVHGGGPQIATMLKRLGIVSEFAAGLRITDAATIEIVEMVLAGSINKQLVGYINEAGGKAVGLCGKDGNMVRAVKATRTMVDPDSHIEKVVDLGFVGEPDKVDLTLLNQLIGYELIPILAPLATSKEGQTFNVNADTFAGAVAGALKAKRLLLLTDVPGVLDKSKKLIPELSVKDARKLIADGTISGGMIPKVETCIYALEQGVQGVVILDGKVQHAVLLELFTNQGTGTLIHK

SEQ ID NO: 91387 - protein, 398 aa, Neisseria meningitidis FAM18
MQNYLTPNFAFAPMIPERASGSRVWDTKGREYIDFSGGIAVNALGHCHPALVDALNAQMHKLWHISNIYTTRPAQELAQKLVANSFADKVFFCNSGAEANEAALKLARKYARDRFGGGKSEIVACINSFHGRTLFTVSVGGQPKYSKDYAPLPQGITHVPFNDIAALEAAVGEQTCAVIIEPIQGESGILPATAEYLQTARRLCDRHNALLILDEVQTGMGHTGRLFAYEHYGIVPDILSSAKALGCGFPIGAMLATEKIAAAFQPGTHGSTFGGNPMACAVGSRAFDIINTPETLNHVREQGQKLQTALLDLGRKTGLFSQVRGMGLLLGCVLDEAYRGRASEITAAALKHGVMILVAGADVLRFAPSLLLNDEDMAEGLRRLEHALTEFAATSDNP

SEQ ID NO: 91388 - protein, 412 aa, Lactococcus lactis subsp. lactis Il1403
MKIEMKNGKLVVPDYPAIGYIRGDGVGEDIFPQAQKVFDAAVLKIYGQKKKIEWQKLLAGGEAFETCGEYLPKETLAHINENLIAIKGPLMTPVGESFRSINVTLRQKMDLYACVRPVEYFKGIKSPVKAPEKVDMTIFRENTEDIYAGIEFASETNESHNLLKFLEKELNVHSIRFPKTSALGIKPVSPEGSKRLVNAAFEYALKMNKKRVTFVHKGNIMKFTEGGFRNWAYEVAREYPTFTKLEYDEIKNERGSLQAENEKKAALKSGKIYVDDVIADNFLQQIILNPENFEVIATLNLNGDYISDALAAQVGGIGIAPGANINYKSGHAIFEATHGTAPDIAGKNIANPSSLILSGVMMFEYLGWQEVAELIKIALSFSFRNGNLTADLGGKLSTSKFSDVLIDFIKTY

SEQ ID NO: 91389 - protein, 199 aa, Lactococcus lactis subsp. lactis Il1403
MGYLVPTVIEQSSRGERAYDIYSRLLKDRIIMLTGPVEDGMANSIIAQLLFLDAQDNTKDIYLYVNTPGGSVSAGLAIVDTMNFIKSDVQTIVMGMAASMGTIIASSGTKGKRFMLPNAEYLIHQPMGGTGQGTQQTDMAIVAEQLLKTRKRLEQILADNSNRSLEQIHKDAERDHWMDAKETLEYGFIDEIMENNSLK

SEQ ID NO: 91390 - protein, 427 aa, Shewanella sp. MR-4
MELYNLKHPSQKVSFKEAVQLGLGKDRGLFFPTQIPVLHDIEALLAMPFVERSKKVLGAWLASELGQGAVDKLVERAFNFDLPLVAVDEQRSCLELFHGPTLAFKDFGARFMAQCINAFAQDSRLTILTATSGDTGAAVADAFYGLDKVNVVVLYPKGKISELQEKMFTTLGKNIHTVAVASDFDACQHLVKQAFEDSDVRDGLHLNSANSINISRLLAQICYYFEAVAQSKQRHEADPVIAVPSGNFGNLTAGLFAKAMGLPVKRFIAATNANDTVPRYLESGDWQPNPTQATMSNAMDVSEPSNWPRVEAICEKLGWPLSDLVGIRLSEAQTSEALAELQAKGYVSEPHAAIAAKALSLNLVPDEVGIFLGTAHPAKFKDVVDRELNLDLPLPAELKAVEHKPILSAELAADFAQLKSHLFAVLS

SEQ ID NO: 91391 - protein, 481 aa, Glycine max
MGNILNLNNSKTRRNDSHGVLQGESCKRQRLSPNSCEDNPRLIPSLPDEISIQILARVPRIYYLNLKLVCRAWKETFVSSELFCVRKELGSMEEWLYILTKVNDDKLLWYALDPLSRRWQKLPPMPKVGFEDETKKGLISFPLRMWSMMGSSIRIVDVIMSWLGRRDALDWMPFCGCSIGAVDGCIYALGGFSRASAMKYVWQYDPIKNSWAEASPMSVGRAYCKTGILNNKLYVVGGVTRGRGGLSPLQSAEVYDPHTGMWSLLPSMPFARAQVLPTAFLADLLKPIATGMASYKGRLFVPQSLYCWPFFVDVGGEVYDPNLNSWLEMPIGMGEGWPARQAGTKLSVTVDDDLYALDPSNSLDSAKIKVYDYEGDTWKVAAGDVPIHDFTESESPYLLAGLLGKLHVITKDANHNITVLQADMQNEHAESAFSQSILSSPDNSISEDAESSAETQGEFWKVLATRSGRSAELVNCQSLKI

SEQ ID NO: 91392 - protein, 357 aa, Marinobacter sp. ELB17
MFEKTAAPAQGNASNVPARHDVAVLGGGSFGTAMVKVLAENGHRVHFWMRDQAQADSIRETGRNERYMPGIALAGDIEPTTDLPGAVASAEIVFVAIPSKAFRDVIHQHAGRFRDGQIVVSLTKGIEAQGFKLMSEILQDEIPQCRIGVLSGPNLAAEIVNRDLTATVIASEDPEVRACVQNLLGCEYFRVYANVDMYGVELAGALKNIYAIVAGLGSALEMGENAKAMLITRGMAEMSRFAVSLGANPMTFLGLAGVGDLIVTCTSAKSRNFRIGYAIGKGKPLDEAAAELGQVAEGIYTLKLVREKSEAMGIQMPLVHGLHEILYGNASVKAVISGLMTAAQNSDVEFILPRTIV

SEQ ID NO: 91393 - protein, 292 aa, Alkalilimnicola ehrlichei MLHE-1
MTEQRIKKAVFPVAGLGTRFLPATKASPKEMLPVVDRPLIQYAVDEACAAGAETLIFITGRTKRAIEDHFDKAYELEAELEQKQKHEMLELVRSTVPDGVHCIYIRQGEALGLGHAVHCARAVIGDEPFSVLLADDLIDGNGREVLCQMAEQYAEHRSSVLGVERIPNEETHKYGVVSAESLGERVYDVNGIVEKPSPAEAPSDLAVVGRYILTPAIFDELARTPPDAKGEIQLTDAIATLLRRERVLAYEFSGRRYDCGSKLGYLEATLDYGLKHPELGPAFRDYVARQFR

SEQ ID NO: 91394 - protein, 509 aa, Mycobacterium avium 104
MTLPTADELRARAADALRSLGAHVELGAPDAHGLPASTPITGEVLFTVAPTTPDQAEHAITQAAQAFSEWRRTPAPVRGALVARLGELLRAHRDELAALVTLEVGKITSEAAGEVQEMIDICQFAVGLSRQLYGRTIASERPGHRLSETWHPLGVVGVITAFNFPVAVWAWNAALALVCGDTVVWKPSELTPLTALATQALIARAAADVGAPPGVSAVVLGDRELGELLVDDERVALVSATGSVRMGRAVGPRVAARFGRVLLELGGNNAAVVTPSADLDLAVRAVVFAAAGTAGQRCTTLRRLIVHHSVADEVVARVVSALRRLPIGDPFEPGTLVGPLIHETAYRDMVGALESARADGGEVIDGDRRHPFAVEHPSSYYVAPAVVRMPAQTPIVATETFAPILYVLTYDRLDDAIALNNAVPQGLSSAIFTTDLREAERFLDESDCGIANVNIGTSGAEIGGAFGGEKQTGGGRESGSDSWKAYMRQSTNTVNYSGALPLAQGVEFG

SEQ ID NO: 91395 - protein, 527 aa, Mycobacterium avium 104
MNQPFGWDFPYAWPRKPVLADNVVCTSQPLAAQAGLRMLAEGGSAVDAAIATAITLTIVEPVSNGMGSDAFAIVWDGEKVHGLNASGRSPAAWTPEYFGGNAVPVLGWNSVTVPGAVSAWTELHARFGKLPFERLFAPAISYGRNGFPVSPVVAEQWVAQVPLFAGQPGFAEAFAPEGRAPRPGERFRLPAHADTLEAIAASRGEAFYRGALAARVAEHAAANGGAMTADDLAAHRADWVETITGDYRGYTVHEIPPNGHGIVALIALGILERFDMASLPVDSADSVHLQIEAVKLAFADAQAYLADIEHMPLRPEHLLDTEYLERRAALIDPARAKPVSAGAPAGGTVYLTAADAAGMMVSMIQSNYMGFGSGVVVPGTGISLQNRGANFTAGLGHPNSVGPNKRPYHTIIPGFVTKGGAPVMSFGVMGGMMQPQGHVQVMVRIADHGQNPQAACDGPRFRWVQGTQVSCENGFPAATLDELRRRGHDLVAVDDYNQFGSCQAIWRMDTGYVAASDPRRDGQAAAF

SEQ ID NO: 91396 - protein, 446 aa, Malus x domestica
MAIDIEQRQQPSPGLSKIAVSDTHGEDSPYFAGWKAYDENPYHESSNPSGVIQMGLAENQVSFDLLEKHLEENSEASNWGSKGSKGASGFRENALFQDYHGLLSFRKAMANFMEQIRGGRAKFDPVRVVLTAGATAANELLTFIIADPGDALLVPTPYYPGFDRDLRWRTGVNIVPIHCESSNNFQITPQALEAAYKEAEAKNMRVRGVLITNPSNPLGATIQRAVLEEILDFVTQKNIHLVSDEIYSGSAFSSSEFISVAEIIEDRQYKDAERVHIVYSLSKDLGLPGFRVGTVYSYNDKVVTTARRMSSFTLISSQTQHLLASMLSDKEFTGNYIKTNRKRLRTRYDMIIEGLKKSGIECLKGNAGLFCWMNLSPFLDEPTRECELTLWDSMLHEVKLNISPGSSCHCSEPGWFRVCFANMSEQTLGIALTRIHNFMEKRERAC

SEQ ID NO: 91397 - protein, 85 aa, Glycine max
  misc_feature (51)..(51): Xaa can be any naturally occurring amino acid
MFGGGMGSPILRDLTRIAETADTSSQDGLTYLLADTIQSLVRHLRYCIAGXTFMNLKRSKEDGEKYYNRVSNEERNTPDEETLVN

SEQ ID NO: 91398 - protein, 333 aa, Pseudomonas fluorescens PfO-1
MTLRIAINGFGRIGRNVLRALYTQGYRQDLQIVAINDLGDSAINAHLLKYDTVHGTFDAEVAHDNESLTVNGDRISVSAIRNPADLPWAAEKIDVVFECTGLFTDRAKAAAHITAGARKVIISAPAKGADATVVYGVNHDILRQSHQIISNASCTTNCLAPVAQVLHRELGIESGLMTTIHAYTNDQNLTDVYHTDPYRARSATQNMIPSKTGAAEAVGLVLPELAGKLTGMAVRVPVINVSLVDLTVQLKREASADEVNALMKAASQHSKILGFNTLPLVSSDFNHNPLSSIFDANHTKASGKLLKVLAWYDNEWGFSNRMLDNCLALCNAE

SEQ ID NO: 91399 - protein, 530 aa, Glycine max
MAEIEGSPGSSMHGVTGREQTFVASVASPIVPTDTTAKFALPVDSEHKAKVFKLFSLANPHMRTFHLSWISFFTCFVSTFAAAPLVPIIRDNLNLTKSDIGNAGVASVSGSIFSRLAMGAVCDMLGPRYGCAFLIMLSAPTVFCMSFVKDAAGYIAVRFLIGFSLATFVSCQYWMSTMFNSKIIGLANGTAAGWGNMGGGATQLIMPLVYELIRRAGATPFTAWRIAFFVPGFMHVIMGILVLTLGQDLPDGNLGALRKKGDVAKDKFSKVLWYAITNYRTWIFALLYGYSMGVELTTDNVIAEYFYDRFNLKLHTAGIIAASFGMANLVARPFGGYASDVAARLFGMRGRLWTLWILQTLGGVFCIWLGRANSLPIAVLAMILFSIGAQAACGATFGIIPFISRRSLGIISGLTGAGGNFGSGLTQLVFFSTSKFSTATGLSLMGVMIVACTLPVSVVHFPQWGSMFLPPSKDVSKSTEEFYYTSEWNEEEKQKGLHQQSLKFAENSRSERGKRVASAPTPPNATPTHV

SEQ ID NO: 91400 - protein, 400 aa, Arxula adeninivorans
  misc_feature (380)..(380): Xaa can be any naturally occurring amino acid
MADFIRTQIFGTCFEITSRYVDLNPVGMGAFGLVCSARDQLTNQNVAIKKIMKPFSTPVLAKRTYRELKLLKHLRHENLITLSDIFISPLEDIYFVTELLGTDLHRLLTSRPLEHQFIQYFLYQILRGLKYVHSAGVVHRDLKPSNILINENCDLKICDFGLARIQDPQMTGYVSTRYYRAPEIMLTWQKYDVEVDIWSAGCIFAEMLRGKPLFPGKDHVHQFSIITELLGNPPDDVIETIGSENTLNFVKSLPKRERIPLSQKFPNADPDAVDLLEKMLVFDPRKRINAADALAHPYLAPYHEPSDEPVASEKFDWSFNDADLPVDTWKVMMYSEILDFHNVDSSAVEQQQQQPQPPQPQLQQQQQPPQQPQQPQQPQXAQQPVQPVQGDYVPQVAPRS

SEQ ID NO: 91401 - protein, 186 aa, Pseudomonas putida GB-1
MNIPNLLTVLRVLLIPIFILLFYVPYQWSYMAASSVFAVAAATDWLDGYLARRLQQSTPFGAFLDPVADKLMVAVALVLLVQTHANFWLTLPAAVIIGREIVVSALREWMAELGARAHVAVSNLGKWKTAAQMLALVILLANPPAVTFWVILGYGLLLVAAGLTLWSMVHYLLAAWPHLREGSEQK

SEQ ID NO: 91402 - protein, 431 aa, Buchnera aphidicola str. Bp (Baizongia pistaciae) [sequence omitted]

SEQ ID NO: 91403 - protein, 167 aa, Vibrio cholerae O1 biovar eltor str. N16961
MAKEQQVQANDLQEKLIAVNRVSKTVKGGRIMSFTALTVVGDGNGRVGFGYGKAREVPAAIQKAMEKARRSMVTIALNEGTLHHPVKGRHSGSKVYMQPAAEGTGVIAGGAMRAVLEVAGVHNVLSKAYGSTNPINIVRATIDALVDVKSPEMVAAKRGLTVEAISE

SEQ ID NO: 91404 - protein, 517 aa, Sorghum bicolor
  misc_feature (390)..(398): Xaa can be any naturally occurring amino acid
MAMTAIASPSSRTLIPPRHHGAAPSPSTSGDSSLRLLRAHPRHGRRSRGVSVSTPAARSRPFVFSSRAVSDSKSSQTCLDPDASTSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPNWFQGTADAVRQYLWLFEEHNVMEFLILAGDHLYRMDYEKFIQAHRETDADITVAALPMDEARATAFGLMKIDEEGRIIEFAEKPKGEQLKAMMVDTTILGLDDVRAKEMPYIASMGIYVFSKDVMLQLLREQFPGANDFGSEVIPGATTIGKRVQAYLYDGYWEDIGTITAFYNANLGITKKPVPDFSFYDRSAPIYTQPRHLPPSKVXXXXXXXXXIGEGCVIKNCKIHHSVVGLRSCISEGAIIEDTLLMGADYYETEADKKLLAENGGIPIGIGKNSHIRRAIIDKNARIGDNVKILNADNVQEAARETDGYFIKGGIVTVIKDALLPSGTVI

SEQ ID NO: 91405 - protein, 1124 aa, Ostreococcus tauri
MSDDALTSLARADGRADALDALRALVEAERATASSDAVDDDAVFSVVTTRARACEGVLTRGVGTWYETLRERDRRALVDAWFDVRGEMIQGKASSSGAALTGTFRTVSAIARRDGGGRDVAKAYAVESLATAVARGAIEGVMAFEEDARRRGWTRTRRAASETVEAMIGAFERLDARTFEIPMFRTTTSYEEECARRVLAGGTEAPGSAAAAACRMCRRGGAGALARATLRAFVPCVRSLSVDEVRSIVDADDIPVTLRWGTTMMNEMGDAHAATRWIAHLFAACDGRQGEDSCTWRTLDVILRVLLRDRYWSCEAMRFHLSETLLLRKGVPRNALPALLRLTILRPIKRGCDASRVKTACTQNILALLETWSSEDFVRAGSVGAQRHLTWSAALLLAATPSDEWNAMRGNPTQLILKGVSTRLDAVAPRARRHASLIAHELSLKMDASNPLRLLDGDDAQSSDDESEWMRDMTRIVHNDVIVEEESGDGDATDEQFLGVDVPAKVEIKSIDPDEVVDMWSVRRDDSDESDLSDNDEDDDLIPYDMDSDDEPSLRSGDPASLTERRIASLPKPQTLRECVDALRHAKTGTSTQQTDIDLADRAEGAVHAVSDLVAKEPHELASCAADLAVAILHAHPPTPDSDPLDRARRQGLASLFTVTPGLAGPPTIEHALSESCDASQVVDTLSAIEVAAANLATPRTTELLDDASNAPVRDRLGVERRFAPKSLEARGKSRSSASTRSHLIGDSFVAPLLRSAALRLERQVTSGRVLDGLDAMVCGQILQTIGQCARHARNAVDAPLIGRAVLEFALAPPLAQADHPHLRRSVLIAGGLVASSLPEVALGISYAEASDLARALERFAEHATSRSRSDVDADVRASAAFALDACARARVAALDAIENLPERDSTREITLNGNRREKMSSDRRNRLFRVRKTIHKMLAARGYLVSARELERDADSFAEEFGEEPKRDSLTILAPRKDDPSENIFVFFPDEEKVGVKTIKDLAKRMKEENVFRAIIVVQASLTPFAKQSLLECQTQKFYIEQFQETELLVNIVDHVLVPEHILLSDEQKRTLLERYKVKDTQLPRIQMHDPIARYYGMRRGQVVRIIRPSETAGRYVTYRLCV

SEQ ID NO: 91406 - protein, 236 aa, Buchnera aphidicola str. Bp (Baizongia pistaciae)
MILSYIFIMYLVDTIDYQKICCIIKTFEDNILFQKNYHSTWFLKSIANIQKEKYNYGLEVAFVGYSNSGKSSIINALTNQKKLAKISRTPGRTRLINIFSVTSEIRLVDFPGYGYAQVSRSISKKWKEMIFQYLNIQKCLQGLVIITDIRCPIKEIDELVINLAVSLNIPILLLLNKMDKVTRSIQKSKLFSTREKMLNFSNNINVELFSSFKKIGIHKLQFVLNNWFSSDKKLCQ

SEQ ID NO: 91407 - protein, 517 aa, Sorghum bicolor
  misc_feature (383)..(389): Xaa can be any naturally occurring amino acid
MAMTAIASPSSRTLIPPRHHGAAPSPSTSGDSSLRLLRAHPRHGRRSRGVSVSTPAARSRPFVFSSRAVSDSKSSQTCLDPDASTSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPNWFQGTADAVRQYLWLFEEHNVMEFLILAGDHLYRMDYEKFIQAHRETDADITVAALPMDEARATAFGLMKIDEEGRIIEFAEKPKGEQLKAMMVDTTILGLDDVRAKEMPYIASMGIYVFSKDVMLQLLREQFPGANDFGSEVIPGATTIGKRVQAYLYDGYWEDIGTITAFYNANLGITKKPVPDFSFYDRSAPIYTQPRXXXXXXXLDADVTDSVIGEGCVIKNCKIHHSVVGLRSCISEGAIIEDTLLMGADYYETEADKKLLAENGGIPIGIGKNSHIRRAIIDKNARIGDNVKILNADNVQEAARETDGYFIKGGIVTVIKDALLPSGTVI

SEQ ID NO: 91408 - protein, 462 aa, Fusobacterium nucleatum subsp. nucleatum ATCC 25586
MNKGTITQIISAVVDIAFKDELPAIYNALKVKLEDKELVLEVEQHLGNNVVRTVAMDSTDGLKRGMEVIDTGKPITIPVGKAVLGRILNVLGEPVDNQGPLNAETFLPIHREAPEFDDLETETEIFETGIKVIDLLAPYIKGGKIGLFGGAGVGKTVLIMELINNIAKGHGGISVFAGVGERTREGRDLYGEMTESGVITKTALVYGQMNEPPGARLRVALTGLTVAENFRDKDGQDVLLFIDNIFRFTQAGSEVSALLGRIPSAVGYQPNLATEMGALQERITSTKSGSITSVQAVYVPADDLTDPAPATTFSHLDATTVLSRNIASLGIYPAVDPLDSTSKALSEDVVGKEHYEVARKVQEVLQRYKELQDIIAILGMDELSDEDKLTVSRARKIERFFSQPFSVAEQFTGMEGKYVPVKETIRGFREILEGKHDDIPEQAFLYVGTIEEAVAKSKDLAK

SEQ ID NO: 91409 - protein, 368 aa, Xylella fastidiosa Dixon
MSKRDYYQVLGVPRTASEDDLKKAYRRCAMKYHPDRNPGDAAAEAAFKECKEAYEVLADTKKRKLYDTHGHAAFEHGVGGGNAPDMNDIFGDIFGNIFGGARASRRGADVGYMVELDLEEAVAGVERQIQIPTLVECTHCNGSGSEDGHVETCGTCRGSGQVRIQRGIFAMQQTCPHCGGRGVIIRNPCKVCNGAGRVEDHKTLSVKIPAGVDNGDRIRLSGEGEQGPDGVPPGDLYVEVRVREHPIFQRDGDDLHCEVPVRISQAALGDIVRVATLDGEAEIRIPAETQSGKLFRLRGKGVRSVRSRTEGDLYCRIVVETPVNLTAEQRKLLEQFEMTFAGEDARKHSPKSATFLDGVKSFWDRMTS

SEQ ID NO: 91410 - protein, 154 aa, Geobacter metallireducens GS-15
MKLKILWVGKTQEEWLRRGIDEYTGRIRRYTPLEIAEAREEKGAAAEAMRTRECERLEKLVPKNARLVLLDERGDQLTSPELAAFMGKCRDSAVPEMVFAIGGAYGFADSFRARADRVLALSRLTFTHQMVRVILLEQIYRAHTILNGEPYHHS

SEQ ID NO: 91411 - protein, 120 aa, Glycine max
  misc_feature (74)..(74): Xaa can be any naturally occurring amino acid
  misc_feature (93)..(93): Xaa can be any naturally occurring amino acid
MKEATASGGGATATANDPRQPATARPYAPPKLSSQDLPVDYAGFLAVVFGVVGVMLHYKVCSWIAIIFCAQSLXANMKNFENDLKQLSMAFMXCCHGFGDELFRASPRRHKTLICTPCAI

SEQ ID NO: 91412 - protein, 512 aa, Geobacter metallireducens GS-15
MTRPLMLMILDGWGINPSAEHNAVAQARTPNLDTLLATYPTTEIQTSGMAVGLPDGQMGNSEVGHLNIGAGRVVYQDLTRITKAIQDGDFFTNPVLLECIAKTKAAGGRLHLAGLLSDGGVHSHNTHLYALLELARRQGLTDVFIHAILDGRDTPPKSGADYLAQLEAEIARIGVGAIATVMGRYWAMDRDNRWERVERAYNAMVQGEGVQRASSAEAIEASYAADVTDEFVEPSVMVRDGAPVGQLRDGDGFIFLNFRSDRAREITRALALPDCEGFARQARPNLASYVCMTEYDATFGLPIAFGPEELKNILGDVLAHAGIRQLRIAETEKYAHVTFFFNGGVEEPFPLEERCLIPSPKDVATYDQKPEMSAYPVTDELLKRIDSDAYDVVIVNFANADMVGHTGILEAAARAVEAVDSCVGRIVAKVREKGGAVIITADHGNAEKMVDETGGPHTAHTSEPVHLVLVDDSRKGIRLRAGTLADIAPTMLEILGLSQPAEITGKSLIAQS

SEQ ID NO: 91413 - protein, 472 aa, Candidatus Kuenenia stuttgartiensis
MRYDYHIIVIGAGSGGLVVASGAASLGARVALIEAEKMGGDCLNAGCVPSKTFLKSAHIAKAIRDASMYGLTADLKKVDITTVMDRVNKVIREIEPHDSRERYEGLGVDVILGFGELQDRHTVKIGNETITGKYIVIATGSEPAVPPIHGLNEVNYQTNRTIFHLKELPGHLIVLGSGPIGIELGQGFRHLGSQVTIINRSPGLFKKDDPEVGPLMEKQLKDDGIELLLGIAYREVRQDSDVISVEIEHEGKGRIITGDQLLVATGRLPATKNLGLDKVGVRVDEKGYIVTDKKQKTSVKNIYACGDVTGHYQFTHMAGYQAGIIIRNIIFKLCAKVDYSAVPWTTYTKPEVAHVGYTEPMASKAGTYKSSLKVDLSAIDRAKAEDDRVGFLKLNLGKKGRIIGATLVGEKAGEMIPAITIAIKQKLTAGIFMNMIFSYPTESEILKSASLEAAKQSLKPWMKKVIRAVLLR

SEQ ID NO: 91414 - protein, 325 aa, Bacillus subtilis subsp. subtilis str. 168
MTENFWRELPRPFFVLAPMEDVTDVVFRHVVSEAGRPDVFFTEFTNSESYCHPDGKDSVRGRLTFTEDEQPIVAHIWGDKPENFRKMSIGMAELGFKGLDINMGCPVPNVAGNGKGSGLICRPAVAAELIQAAKAGGLPVSVKTRLGYTDVDEWREWLTHILKQDIANLSIHLRTRAEMSKVDAHWELIPEIKKLRDEVAPDTLLTINGDIPDRQTGLKLAEQYGVDGIMIGRGIFTNPFAFEKEPKEHSSKELLDLLRLHLDLHDEYSKEEARPYKPLPRFFKIYLRGFRGASELRNQCMNTKSTDEVRALLDDFERKYLDGIE

SEQ ID NO: 91415 - protein, 464 aa, Silicibacter sp. TM1040
MAAASYDVIVIGAGPGGYVAAIRASQLGLKTCVVEREHLGGICLNWGCIPTKALLRSSEVFHLMERAKDFGLKAENIGYDLGAVVKRSRGVAKQLSSGVKGLLKKHKIDVIMGEATLPAKGKVAVKTDKGSEELTGKNIILATGARARELPGLEADGDLVWTYKHALDPKRMPKKLLVIGSGAIGIEFASFYNTLGADTTVVEVMERVLPVEDEEISKFAKKAFEKQGMKIMQKAMVKQLDRASGKVTAHIEVGGKVEKHEFDTVISAVGIVGNVEGLGLEGLGVKIDRTHVITDEYCRTGVDGLYAIGDIAGAPWLAHKASHEGVMVAELIAGKHAHPVKPESIAGCTYCHPQVASVGYTEAKAKELGYKVKVGRFPFIGNGKAIALGEPEGLIKTVFDEKTGELLGAHMIGAEVTELIQGYVVGRQLETTEEDLMNTVFPHPTLSEMMHESVLDAFDRVIHI

SEQ ID NO: 91416 - protein, 470 aa, Arabidopsis thaliana
MINDKEDDSVDLDESNRFTNEDLEALQSLQNGFQKTDLMMQSANGLGLQAAMGRDYCKVSINFPKDTVPKWLVIILVLVSSKYGLPYYYVLDYVQQQKDPKSGELEGLSYEFDLCEAVATWEQVRNSSTILTKEYIDALPNGWEDYAWRRINKGIQLQQLNTCLVDCSQSQYTNNRCQNKSLCIEKLSLVLPETPPYFPRQFGRCAVIGNSGDLLKTKFGKEIDTYDTVLRENGAPIQNYKEYVGEKSTFRLLNRGSAKALDKVVELDEKKQEVLLVKTTIHDIMNKMIREVPIKNPVYLMLGASFGSAAKGTGLKALEFALSTCDSVDMYGFTVDPGYKEWTRYFSESRQGHTPLHGRAYYQMMECLGLIKIHSPMRADPNRVVKWVPSRSTIRSARIAAEKLLRRVGAGSADPLASCSIVKKRNKNKRPMVSHLRKPVSDHQKFVRSTSMYPVEHSPGHGQLCITPAD

SEQ ID NO: 91417 - protein, 404 aa, Neisseria meningitidis FAM18
MTVKTPVYLDYAATTPVDKRVAEKMIPYLTETFGNPASNSHAFGWEAEEAVEKARADIAALINADPKEIVFTSGATESDNLAIKGAANFYKTKGKHLITVKTEHKAVLDTMRELERQGFEVTYLGVQENGLIDLEELKAAIRDDTILISVMWANNEIGVVQDIPAIGEICRERKIVFHVDAAQACGKVPVDVEAAKIDLLSMSAHKVYGPKGIGALYVRRKPRVRLEAQMHGGGHERGFRSGTLPTHQIVGMGEAFRIAKEELEQDMAHYRKLRDIFLKGIEGIEEVYINGDLEHRAPNNLNVSFNFVEGESLIMAVKELAVSSGSACTSASLEPSYVLRALGRNDELAHSSLRITFGRMTTEEEVQFAAELIKSKIGKLRELSPLWEMFKDGIDLNSIEWAAH

SEQ ID NO: 91418 - protein, 310 aa, Streptomyces avermitilis MA-4680
MPASYAYLGPEGTFTEVALRTLPEAATRELVPMVSVPAALDAVRNGEAEAAFVPIENSVEGGITTTLDELVAGEPLMIYREVLLSITFALLVRPDTKLSEIKTVTAHPAAQPQVRNWMKANLPDVVWESAASNADGARLVQEGRYDAAFAGEFAAAKYGLVPLETGIHDAENAQTRFVLVGRPARPAAPTGADKTSIVLWQRDDHPGGLRDLLGEFAVRGVNLMLLQSRPTGAGIGNYCFCIDAEGHISDRRVAETLMGLKRICLQVRFLGSYPRAGVRAEDVPTALPGTSDDEFVKASDWVARCQDGRF

SEQ ID NO: 91419 - protein, 398 aa, Bacillus subtilis subsp. subtilis str. 168
MAVKVVMPKLGMAMKQGEVSIWNKKVGDPVEKGESIASIQSEKIEMEIEAPEKGTLIDIKVKEGEEVPPGTAICYIGDANESVQEEAGAPVAEDNMPQAVQPVKQENKPAASKKDRMKISPVARKIAEKAGLDLKQLKGTGPGGRIVKDDVTKALAEQKKDQAKPVSEQKAQEIPVTGMRKVIAARMQESLANSAQLTITMKADITKLATLQKQLSPTAEERYGTKLTITHFVSRAAVLALQAHPVLNSFYQNERIITHPHVHLGMAVALENGLVVPVIRHAEKLSLIELAQSISENAKKAREGRAGSEELQGSTFSITNLGAFGVEHFTPILNPPETGILGIGASYDTPVYQGEEIVRSTILPLSLTFDHRACDGAPAAAFLKAMKTYLEEPAALIL

SEQ ID NO: 91420 - protein, 458 aa, Bacillus subtilis subsp. subtilis str. 168
MTLAIIGGGPAGYAAAVSAAQQGRNVLLIDKGKLGGTCLNEGCIPTKSLLESANVLDKIKHADSFGIELPAGAISVDWSKMQSRKQQVVSQLVQGVQYLMKKNQIQVVKGTASFLSERKLLIEGENGKEIREADQVLIASGSEPIELPFAPFDGEWILDSKDALSLSEIPSSLVIVGGGVIGCEYAGLFARLGSQVTIIETADRLIPAEDEDIARLFQEKLEEDGVEVHTSSRLGRVDQTAKTAIWKSGQREFKTKADYVLVAIGRKPRLDGLQLEQAGVDFSPKGIPVNGHMQTNVPHIYACGDAIGGIQLAHAAFHEGIIAASHASGRDVKINEKHVPRCIYTSPEIACIGMTERQARSIYGDVKIGEFSFSANGKALIKQQAEGKVKIMAEPEFGEIVGVSMIGPDVTELIGQAAAIMNGEMTADMAEHFIAAHPTLSETLHEALLSTIGLAVHA

SEQ ID NO: 91421 - protein, 171 aa, Oryza sativa Japonica Group
MLRAGGRRLLAPGLRRVLGGGAAAPVAVGGAKAYHERVVDHYENPRNVGSFENDDPSVGTGLVGAPACGDVMKLQIRVDESSGKIVDACFKTFGCGSAIASSSVATEWVKGKQMEEVVTIKNTEIAKHLSLPPVKLHCSMLAEDAIKAAVKDYEAKKAKLAQKGEEKAAEA

SEQ ID NO: 91422 - protein, 113 aa, Pisum sativum
MAEEGQVIGVHTVDAWKEQLEKGKASKKLIVVDFTASWCGPCRFIAPILAEIAKKLTHVTFLKVDVDELKTVSEEWGIEAMPTFLFLKDGELVDKVVGAKKEELQLKIDKHAA

SEQ ID NO: 91423 - protein, 451 aa, Mycobacterium avium 104
MTTSTVVPRVSGGEEEHGHLEEFRTDPIGLMQRVRDECGDVGWFQLVDKHVILLSGAQANEFFFRSADEDLDQAEAYPFMTPIFGKGVVFDASPERRKEMLHNSALRGEQMKGHASTIEGEVKKMIADWGDEGEIELLDFFAELTIYTSTACLIGLKFREQLDHRFAEYYHDLERGTDPLCYVDPYLPIESFKRRDEARVKLVALVQEIMDQRLANPPKDKADRDMLDVLVSIKDEDGKPRFSADEITGMFISLMFAGHHTSSGTSAWTLIELIRHPDVYAEVLAELEELYADGQEVSFHALRSIPKLDNVVKETLRLHPPLIILMRVAKGEFEVEGFPIHEGDYVAASPAISNRIPEDFPDPDAFKPDRYNKPEQADIVNRWTWIPFGAGRHRCVGAAFAQMQIKAIFSVLLREYDFEMAQPADSYRNDHSKMVVQLARPAKVRYRKRNA

SEQ ID NO: 91424 - protein, 300 aa, Prochlorococcus marinus str. MIT 9215
MTEIINSISDFEKYLKNTKKVVEEALDVSLGPENPEILRESMRYSLLAGGKRIRPILCLASCSLAGGEPSLAVPTAVAIEMIHTMSLIHDDLPAMDNDDLRRGRPTNHKVYGDAIAILAGDALLTRAFEMVSLRSPGVDPTRLLNVIGELSLVAGAPGLVGGQVVDLECEGKEVDLETLEYIHLHKTGALLKACVRTGAMIAGANEKLLQALTTYAEGIGLAFQIIDDILDLTSSSEKLGKTAGKDLLADKTTYPKLLGMEESKKRAFDLVEKAKKAIEPWGSDAKYLISLADFITNRDR

SEQ ID NO: 91425 - protein, 149 aa, Zea mays
  misc_feature (93)..(93): Xaa can be any naturally occurring amino acid
YNIHARAQLSNTSIIMDASAYIKQLQQKVVRLNQEIACAQDALRHKSSSYPTVTVETLGVQGFLVNVFSDKSCPGLLVSVPGAFDELGLSVLXATASCAADSFRLEAVGGENVVDNVDEHVVKQAVLQAVRSCPESGCGGEHDDEESLG

SEQ ID NO: 91426 - protein, 507 aa, Prochlorococcus marinus str. MIT 9215
MPSTLSNPLRLGLRQERVISPQCLVIFGASGDLTHRKLIPALFELFLQRRIPSEFGIVGCARRPWTDDEFREKMKVKLSNQISGKEREWEKFSNYLFYEPVDLQQSNDVVRLSKRLNGIDKTQATHGNRTFYLSVSPNFYASGCKALKAAGLLDDFKKSRLVIEKPFGRDYSSAKKLNKIVQSCAEESQIYRIDHYLGKETVQNILVLRFANTIFEPIWNRNYISSVQITSSETVGVEDRAGYYESSGALRDMLQNHMTQMLAVTAMEPPGKFEPEAIRNEKAKVLQASKLADENEPWNCCIRGQYGEGGNISNRLKGYRQEEGVNCNSTTETYIATKVFVDNWRWQGVPFYLRTGKRLPKRLGEIVLTFKDVPVHLFESTIINPAPNQLILRIQPNEGATFKFEVKSPGSGMKSRPVEMEFSYDESFGEPSDEGYVRLLADAMLSDPTLFTRSDEVEAAWKLYTPLIELMDNSPWKLPIYNYESMTWGPPESDQLLSKDNIFWRRP

SEQ ID NO: 91427 - protein, 517 aa, Sorghum bicolor
  misc_feature (86)..(210): Xaa can be any naturally occurring amino acid
MAMTAIASPSSRTLIPPRHHGAAPSPSTSGDSSLRLLRAHPRHGRRSRGVSVSTPAARSRPFVFSSRAVSDSKSSQTCLDPDASTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDHLYRMDYEKFIQAHRETDADITVAALPMDEARATAFGLMKIDEEGRIIEFAEKPKGEQLKAMMVDTTILGLDDVRAKEMPYIASMGIYVFSKDVMLQLLREQFPGANDFGSEVIPGATTIGKRVQAYLYDGYWEDIGTITAFYNANLGITKKPVPDFSFYDRSAPIYTQPRHLPPSKVLDADVTDSVIGEGCVIKNCKIHHSVVGLRSCISEGAIIEDTLLMGADYYETEADKKLLAENGGIPIGIGKNSHIRRAIIDKNARIGDNVKILNADNVQEAARETDGYFIKGGIVTVIKDALLPSGTVI

SEQ ID NO: 91428 - protein, 405 aa, Oryza sativa
MASPMLSAATVPLQVSLGGGLSEFSGLRSSSSLPLRRNATSDDFMNAVSFRTHAVGTSGGARRAPTEAKLKVAINGFGRIGRNFLRCWHGRGDSSPLDVIAINDTGGVKQASHLLKYDSTLGIFDADVKPVGDNAISVDGKVIKVVSDRNPSNLPWGELGIDLVIEGTGVFVDRDGAGKHIQAGAKKVLITAPGKGDIPTYVVGVNADQYSPDEPIISNASCTTNCLAPFVKILDQKFGIIKGTMTTTHSYTGDQRVFDGSHRDLRRARAAALNIVPTSTGAAKAVALVLPNLKGKLNGIALRVPTPNVSVVDLVVQVSKKTLAEEVNQAFRDSAANELKGILEVFNVPLVSFDFRCSDVSCTINASLSMVMGDDMVKVIAWYDNEWGYSQRVVDLADIVANQWK

SEQ ID NO: 91429 - protein, 535 aa, Pseudomonas putida GB-1
MATLHTQINPRSAEFAGNSAAMLEQVQALRGLLAQVAQGGGPKAQERHTSRGKLLPRERIDRLLDPGSPFLEIGQLAAHEVYGEDVPAAGVIAGIGRVEGVECMIVANDATVKGGSYYPLTVKKHLRAQTIALQNRLPCIYLVDSGGANLPRQDEVFPDREHFGRIFFNQANMSAQGIPQIAVVMGSCTAGGAYVPAMADEAIMVRQQATIFLAGPPLVKAATGEVVSAEDLGGADVHCRTSGVADHYADNDEHALAIARRSVANLNWHKLGKLQRLAPVAPLYAADELYGVVPADAKQPFDVREVIARLVDGSVFDEFKALFGTTLVCGFAHLHGYPVAILANNGILFAEAAQKGAHFIELACQRGIPLLFLQNITGFMVGKKYEEGGIAKHGAKLVTAVACAQVPKFTVIIGGSFGAGNYGMCGRAYDPRFLWMWPNARIGVMGAEQAAGVLAQVKREQSERSGQPFSAEDEARLKQPILDQYEHQGHPYYSSARLWDDGVIDPAQTRDVLGLALSAALNAPIEQSRFGIFRM

SEQ ID NO: 91430 - protein, 93 aa, Brassica napus
SIVVRLTRSVNFDSLFPPSTKSVSTMTTSKRLADRKIEKFDKNITKRGFVPETTTKKGKDYPVGPILLGFFVFVVIGSSLFQIIRTATSGGMA

SEQ ID NO: 91431 - protein, 398 aa, Chlamydophila abortus S26/3
MRRNTNFSNLEANYLFSGIRQKIQAFRKQHPEASIIDLSIGDTSYPLHTSVIHTFTQSVEKLGNPKTYRGYGPELGLPALREKLSEVFYHGQVSPEEIFISEGAKMDIFRIFSLFGPGKTIAVQDPSYPVYIDTALLTGSRKIIKLPCTKETHFFPEIPQDEAIDIFCICSPNNPTGTVLNREQLKELVDYANAQGSIILFDAAYSAFISDPTLPTSIFDIPGARSCAIEVNSFSKSLGFAGVRLGWNVVPKDLQYNDGLPVIRDWERLLFTTFNGVCLPVQESAIAGVSLFPNLEAISHYRYNSSLLREALQKADFSVYGGEQAPYLWVEVPGHIPDEDVFDFFLHHYHIAITPGKGFGSCGKGYVRFSSLGKTEDIVAACQRLTLTSVYDTMVLSL

SEQ ID NO: 91432 - protein, 136 aa, Glycine max
  misc_feature (38)..(38): Xaa can be any naturally occurring amino acid
MGTIFGGFTTPSIPRACLVQKRFFGFSFPVLGFPPMGXVGRVSCSLGEKPFFVKESSSTILGMGAFFMVGARAATMLGPAMALVDERFSPEGTGVPFGLRNNLLGWILFGVFGLIWAFYFVYPSFFEGDEESGLSL

SEQ ID NO: 91433 - protein, 516 aa, Clostridium difficile 630
MLVVENVSHGFGARTILENVSFRLRKGEHIALVGANGEGKSSFLNIITKKLMPDAGNIKWSSRATVGYLDQHTVLSKGKTIREVLREAFKHMFDLEQEMIAMYDKMGEASDDEMSKLLEETAEIQTILENSGFYMIDAKIQEVANGLGLGEIGLDKDVTDLSGGQRTKVLLTKLLLENPTILILDEPTNYLDEEHITWLTKYLQEYENSFVLVSHDIEFINNTCNVIYHMENGELNRYKGNYDEFVRLNDIKKRQEEQAYDKQVEERKRLEDFVARNKARVATRGMANSRQKQLDKMEILERPKEKIKPTFAFKDARAASKIIFETENLVLGYDEALTKPLNFHLERGKKIALKGMNGIGKSTLLKTLLGIIKPFEGNVKLGDYLEVGYFEQESSRENSNTPMDEVWSEFPGLTNFEVRQALAKCGLTNEHITSQMRVLSGGEAAKVRLCKVMLKNINFLVLDEPTNHLDVEAKDELKKAIKEFKGTVLLVCHEPEFYSEIVDDVWNIEDFTTKIV

SEQ ID NO: 91434 - protein, 310 aa, Bartonella henselae str. Houston-1
MKLFCGNSNPRLAKEVTNYLSIPLGKATVKRFADQEIFVELHENVRGQDVFVLQSTSYPANDHLMELLIMIDALRRSSARRITAVIPYFGYARQDRKPGPRTPISAKLVANLITEAGAHRVLTLDLHAGQIQGFFDIPTDNLYAVPVIARDVKMHYSLENVIVVSPDVGGVVRARSLAKRLNSLLAIVDKRRERPGESEVMNIIGDVSGKNCLLLDDIVDSGGTLCNAASTLLKHGANSVTAYITHGVLSGNAIERITNSEMKELVITNSIMPTEEIEKAHNIRVLPITDLIGEAIARTAAEQSVSSLFG

SEQ ID NO: 91435 - protein, 535 aa, Shewanella oneidensis MR-1
MSFSALGLSAPLQKAVSEQGYDTPSPIQAQAIPAVLTGKDVMAAAQTGTGKTAGFTLPLLELLAKGHKAKSGQTRALVLTPTRELAAQVGESVETYGKYLPLRSAVVFGGVPINPQINKLRHGVDVLVATPGRLLDLVQQNAVKFNQLEILVLDEADRMLDMGFIRDIKKILALLPAKRQNLMFSATFSDEIRELAKGLVNHPVEISVTPRNAAATTVKQWICPVDKTQKSALLIQLIKQENWQQVLVFSRTKHGANRLAKSLIQAEISAAAIHGNKSQGARTKALADFKSGEVRVLVATDIAARGLDIDQLPQVVNFDLPNVPEDYVHRIGRTGRAGATGQAVSLVSSEEIKLLKDIERLINRVLERQEVEGFSPVHALPETTLNPQGKDTKVKAVANHRKHRSAGKPAPRSGSGRDTQGNRENSQRQNSASSRNSNEHNNTEAAVARSPKPKSKHPQRDGGTANSATAGNNAKAKPHSGAQQRSHAERSEKSNNDGRRQEQPKGRNPQSAKPASNQPKQHSHRADNRPNSVKP

SEQ ID NO: 91436 - protein, 761 aa, Ostreococcus tauri
  misc_feature (1)..(1): Xaa can be any naturally occurring amino acid
XASGDGRRRLLRGGFGQTLDTIFGSGILAMCAGGSDGSELWWSTGGQFARLHAYDMFIQGQREIARPRLNEDAAGVGIRCLTGSSAGAPTLNAPIVTMSSSTSNDSVLLWAGLRNGVVMAWDCDLGKLLSTDIVLASRDKAVTAIAPIDATRAWVGCEDGTIVEVHAPATKPDSSWSYSGKCFKTRDVFPADAHERPSFGEPRENSKGVRCMIHNANEGSDGFMFIACERDLFLEIWDIADATCVRVEALDDLGAVVSLMQHPTVRDLIVSVHETGAVQLWGGDKCAVKTGDRVMTITPGFKQVEKWSLAPFSKYFGKTVIGAVPVENVLVIGHASGKLTIWSLPGAQELHDTTLHSETLASSPASASVTVRWGKRVAHESGLVHLTKIDGGGSLGVVTVGRFGSIMYWPLAQLESGLGKGRKPRPMLGTPSKMNEDRLKPKTPESGTLSDTARIAYEHIKLVQKIGEGSFGRVYKAKWNHIDVAVKFIGPSDIDVTASGLGRSLEELEKEVSIMTKLRHPNIVLLLGVVMSPRPAIVQEFCVRGSLYTVLQRHAKSGAPELTWRLRLQMALGAAAGMLYLHECTPTVLHRDLKSANLMVDRYYRVKVGDFNLSRAEIVASSESAEFSGNLHSPSWMAPEVLCDSQYSKASDVYSFAVVMWEIQSLQTPWKDLHIYQIVTAVPDGERLDPTATHGVVFHEAKAYQDLMMQAWQQDPAVRPCFEQLVEEVTTLLSAEIARDPQLKKDAKIQFFQRERFHQTA

SEQ ID NO: 91437 - protein, 321 aa, Methanosarcina barkeri str. Fusaro
MTLVDEIKKRSVHVDAAIDELLPVAHPEELYKASRYLVDAGGKRLRPAVLILAAEATGSDLKSVLPAAVAVELVHNFTLIHDDIMDKDDIRRGMPAVHTIWGDAGAILAGDTLYSKAFEILSKVQNEPARILKCMDVISKTCTEICEGQWLDMDFEKREKVSKAEYIEMVEKKTSVLYAAAAKIGALLGGASDEIAAALSEYGRFIGIGFQMYDDVLDMVTPEEVLGKVRGSDLMEGKHTLIVIDAFEKGVKLDIFGKGEATQEETDEAVRILTECGSIDYVKDLAISYINEGKAKLDVLRDCPEKELLLQIADYMISRNY

SEQ ID NO: 91438 - protein, 182 aa, Ostreococcus tauri
MASVVKKGIDKALTRARSRARRPGMEPSAPETPVEVLDEYTSCANMTFEQRMYGFAFCAAFGLACSALSSVFWTVPRKFAILYSMGNILSLASTGFLTGFGRQLKNMFHGTRFVATCVYLGSLIMTLIAAVEIQSFPLTILFLSIQWCALMWYCLSYIPGGRAMLKGCVKACCGGASEGDFF

SEQ ID NO: 91439 - protein, 374 aa, Xylella fastidiosa Dixon
MTKPVNTTADKVALSDTALADIRTKIDKIDRDIQTLIAERACYAQQVGQAKSKLAAAMDYYRPEREAQVLRMVVERNEGPLSDEVLVRLFREIMSACLAQQEPLKIGYLGPEGTFSQQAVLKHFGHYVLGEPMASIEEVFQEVEAGHTDFGVVPVENSGHGTIQVTLDLFLNSKLKICGEIELRVHQYLMSRSGRLEDIHRIYAHPQSFAQTACWLRANLPHAEKIPVSSNAEGARRASNANDAASIGSESAARVYALSKVFIHSIEDEQDNTTRFLVIGRRIFAPSGCDRTSILVFIRDNPGALFEVLGSFARHGINMNRIESRPSHQVRWEYVFFIDLLGHVEDEPMKQALAELEQHAVKVKILGAYPIALL

SEQ ID NO: 91440 - protein, 548 aa, Neisseria meningitidis FAM18
MKHFHDLPAWPKLWNHFDDSKTLHMREMFEQDPQRAERYWLQVGGLTLDYSKNRINDETMSLLFELAREAGVPERMRQMFHGEKINTTENRAVLHVALRNRTNSPIVVDGEDVMPKVNRVLQRMGEFAHEVRSGSWLGYTNQVITDVVNIGIGGSDLGPLMMCTALKPFGHPRLNMHFVSNVDGSQLRDVLSKVHPETTLFIIASKTFTTQETLTNALTAREWFLNHAGDESAVAKHFVAVSTNQKAVAEFGIDTANMFEFWDWVGGRYSLWSAIGLPIMLYLGEENFIEMLNGAHLMDQHFINTPLERNLPAILALIGIWYINYYGGGSHVIAPYDQHLHRLPKFIQQLDMESNGKQVTLDGKAVGHETSPIIWGETGINGQHAFFQLLHQGTHITPIDLIASLEKRSNLPGHHEILLANVFAQAEAFMRGKTPDEVRAELKAQGMDEARIEELVPHKTFSGNRPTNLILMDKVNPRNMGSLIAMYEHKTFVQGIIWGINSFDQWGVELGKQLAKTILGELTGETGPQKHDSSTERLIRLYLQTNRK

SEQ ID NO: 91441 - protein, 344 aa, Oryza sativa Japonica Group
MNPGRPAPASFRDRTNEFRAAVESAARYASSSAAAAPSSSSGGGVGGPLDVSRGAASAHSEFNRRASKIGLGIHQTSQKLARLAKLAKRTSVFDDPTVEIQELTAVIKKDITALNSAVVDLQVLCNSQNESGNLSKDTTNHSTTVVDNLKNRLMSATKEFKEVLTMRTENLKVHENRRQMFSSSAANNASNPFVRQRPLVTRDGPESSVPPAPWASDSATTPLFQRKKTNGDHGASSSSSQPFMQQQLVQQDSYMQSRAEALQNVESTIHELSNIFTQLATMVSQQGELAIRIDENMDDTLANVEGAQGQLLKYLNSISSNRWLMMKIFFVLMVFLMIFIFFVA

SEQ ID NO: 91442 - protein, 499 aa, Silicibacter sp. TM1040
MQELTHYVNGEKVAGTSGRFADVLNPATGEVQAKVPLATKAEMDAIIAKAAEAQVEWAATNPQKRARVMMKFGQLINEHMDTLAELVAREHGKTLPDARGDVQRGLEVVEVCMGTPSLLKGEFTDSGGPGIDLYSMRQPLGVVAGITPFNFPAMIPLWKMAPALSCGNAMILKPSERVPSTSLYLAELLKEAGLPDGVLQVVNGDKEAVDAILDNETIQAVGFVGSTPIAQYIYGRAATNGKRAQCFGGAKNHMLIMPDADLDKAADALVGAGFGAAGERCMAISVAVPVGKETADGLIERLVPRIEKLKVGPYTAGEDIDYGPVITPQAKARIEGLIDSGVEQGATLVTDGRGLTLQGYENGYFVGPTLFDNVTAEMDIYKEEIFGPVLSTVRMDNYEDALNLVKDNAYGNGTAIYTADGDTARDFANRVNVGMVGINFPIPVPLSYHTFGGWKKSAFGDLNQYGPDAFRFYTRTKTVTQRWFSGIKEGGEFNFKAMD

SEQ ID NO: 91443 - protein, 584 aa, Streptomyces avermitilis MA-4680
MSLEGARERWVRTGGIELCVAELGDETQPTVVLVHGYPDSKEVWSEVAGRLSERFHVVLYDVRGHGRSTAPQPLRGGFTLEKLTDDFLAVADAVSPDRPVHLVGHDWGSVQSWEFVTVKRTEGRIASFTSMSGPSLDHFGHWIKRRVKRPTPRRVGQLLGQGAKSWYVYLLHTPVLPELAWRGPLGRRWPKILQRVEKVPADGYPTPSLPSDAAHGAWLYRDNVRARLSRPRTDAYAHAPVQLVTPLGDAFLSEKLYDELELWAPQLVRRTLPAKHWIPRTRPDQLASWITEFVIASEGGRPAPVASGPYADRFGGQLVLVTGAGSGIGRATAYAFAEAGARVVAVDRNAEGAARTAEMSRLIGAPDAWAETVDVSDEQAMEKLAEKVATEYGVVDVLVNNAGIGLSGSFFDTTAEDWRKVLDVNLWGVIHGCRLFGKQMAERGQGGHIVNTASAAAYQPSKALPAYSTSKAAVLMLSECLRAELAGQGIGVSAICPGFVHTNITSTARFAGVAAEEEKRRQKRAARLYRLRGYPPEKVADAVLRAVVRNQAVVPVTPEARGAHLMSRFAPRALRAIARLEPPL

SEQ ID NO: 91444 - protein, 449 aa, Saccharophagus degradans 2-40
MTFDYDFFVIGAGSGGVRASRIAAGLGAKVAVAEDTFMGGTCVNVGCVPKKLFVYASEFAEHFEAAKGFGWQQVDGSFDWPTLRDNKTKEIERLNGIYERMLGGANVEVIHGRATLLGNNKVGIGDKVVTAKHILIATGGTPKWPTFEGAEHCITSDQIFYLETLPKRVLVQGGGYIAVEFAGILNGLGCATELAYRGPLFLRGFDSEVREFVATQMAEKGVQLSFNTDIESIAKNDDGSLTVRLNNGEVREVDAVLSAIGREPRINGLGLENTQVKTAKNGFIEVDNNFLTADPSIYAVGDVVGRMPLTPVALAEGMALARYLFDNKPIELNYSNIPTAVFCQPNIATVGLTQQQAEEQFGEVLVFKSDFKALKHTLSGLAERTLMKLIVDKTTDKVVGCHMVGPDAAEIMQGIAVAIVAGATKQDFDNTIGIHPSAAEEFVTMRSPV

SEQ ID NO: 91445 - protein, 144 aa, Silicibacter sp. TM1040
MLVKSILKSKDIAEVVTITPEATIEAAAQLLSEHGIGTVVVSPDKSKPVGILSERDIVRQLAKVGSVCLNHKVEDYMTRDVVTCTQDSVAEQALSTMTEGRFRHMPVVEDGALVGIISLGDVVKAQLNEVAMEKTALEGMIMGH

SEQ ID NO: 91446 - protein, 62 aa, Methanosarcina barkeri str. Fusaro
MIPVRCFSCGKVISNYWDEYKRRVSDGENAAAVLDDLGITRYCCRRMLLSHVELVDVLSPYQ

SEQ ID NO: 91447 - protein, 481 aa, Neisseria meningitidis FAM18
MSTQTNFDLVLFGATGDLAMRKLLPCLYQAHVAGLLHPEGRILGVSRSELDTEGFLAKVETSSKIHVKENFSDEAWASFVERLAYLKVDVTQPDDFAALGDLVKARKETDNVVIYLSTAPKFFAQTCENLAKIGLNADNVRVVLEKPLGTDLASSQQINTDVARYFKEGQIYRIDHYLGKESLQNLLALRFANVMFEPLWNNKYIESVQLTIAEQLGVEERGEFYDITGALRDMVQNHLMQMLCMTAMEAPASLDADAVRDEKVKVIKSLKPLTVESVNENVVRGQYTAARGMNGYLEEINVPQDSFTETYVAIKAEIENERWKGVPFYLRTGKRMAGKVAEIVLNFKDLNSHIFEGSRTAPNRLVIELQPYESVRLYTQMKTPGAGNKVETVPLATDLGKALESRRAEAYERLLLDVINGKLALFNRRDELEAAWEYVMPILENWTNNTTPPHGYGAHSWGPEAARELLARDGHKWHEEQ

SEQ ID NO: 91448 - protein, 439 aa, Bradyrhizobium sp. BTAi1
MRIAMIGTGYVGLVSGACFADFGHQVTCVDKDESKIAALHRGEIPIFEPGLDALVAANVKAKRLDFTTDLKQPVADADAVFIAVGTPSRRGDGHADLTYVYAAAREIAACLTGFTVVVTKSTVPVGTGDEVERIIRETNPSADVVVASNPEFLREGAAIRDFKWPDRIVVGTADERGRKVLGDIYRPLSLNQAPIMYTARRTAELIKYAANAFLATKITFINEVADLAEKVGADVQEVARGIGLDNRIGAKFLHAGPGFGGSCFPKDTRALIKIAQDNDTQLRIVESVLAVNDNRKRAMARKVAHAVGGNLRGKTIAVLGLTFKPETDDMREAPSIPLVTGLLDMGAKVRAHDPVGIEQAKKELPEIAYYDDPYDCATGADAIVLVTEWVQYRAMDLDRLKEVMAHPVVVDLRNVYRPDEMAAHGFIYESVGRPSAKGA

SEQ ID NO: 91449 - protein, 330 aa, Prochlorococcus marinus str. MIT 9215
MTSFITAVQNKESNFNLTNSRLRLVSGTTNPKLAEEIASYLGIKNVPLISKRFADGELYVQIQQSIRGCDVFLIQPTCAPVNDSLMELMIMVDACKRASARQITAVIPYFGYARADRKTSGRESITAKLTANLLEKSGVDRVLAMDLHSAQIQGYFDIPCDHIYGSPVLIDYLESLNLEEIVVVSPDVGGVARARAFAKLMKDAPLAIIDKRRSAHNIAESLTVIGEVKGKTAILIDDMIDTGGTICSGAHLLKKEGANRIFACASHAVFSPPSYERLSIKDLFEQVIVTNSIPVIKDDFPQLKVLSVANMLGEAIWRIHEESSVSSMFR

SEQ ID NO: 91450 - protein, 124 aa, Glycine max
  misc_feature (61)..(61): Xaa can be any naturally occurring amino acid
FAVPGALTPTCSQKHVPGFVEKSGELRAKGIDTIACISVNDAFVMKAWKEDLKVNEEVLLXSDGNGTFTKAIGVELDLSDKPVGLGVRSRRYALLAEDGVVKLFNLEEGGAFTFSGAQDILDVL

SEQ ID NO: 91451 - protein, 323 aa, Glycine max
  misc_feature (274)..(274): Xaa can be any naturally occurring amino acid
  misc_feature (310)..(310): Xaa can be any naturally occurring amino acid
MAMHGTSCLVPSVLELAKQPIIEVPERYVHANQDPHILSNTISLPQVPIIDLHQLLSEDPSELEKLDHACKEWGFFQLINHGVDPPVVENMKIGVQEFFNLPMEEKQKFWQTPEDMQGFGQLFVVSEEQKLEWADMFYAHTFPLHSRNPHLIPKIPQPFRENLENYCLELRKMCITIIGLMKKALKIKTNELSELFEDPSQGIRMNYYPPCPQPERVIGINPHSDSGALTILLQVNEVEGLQIRKDGKWIPVKPLSNAFVINVGDMLEILTNGXYRSIEHRGIVNSEKERISIAMFHRPQMSRVIGPAPXLVTPERPALFKKI

SEQ ID NO: 91452 - protein, 380 aa, Lactococcus lactis subsp. lactis Il1403
MAIEMLGLILAGGQGTRLGKLTKDVAKPAVPFGGRYRIIDFALSNCANSNVKNVGVITQYQPLTLNAHIGNGAPWGLNGINSGVTILQPYSSQEGSKWFEGTSHAVYQNISYIDQQNPEYVLILSGDHIYKMDYEAMLESHKEREASLTVSVMEVPLEEASRFGIMNTDDNDRIIEFEEKPKEPKSNLASMGIYIFNWKRLREVLVNGYSKGNPMEDFGGDVIPAYIEAGENVFAYRFKGYWKDVGTIDSLHQSSMEFLDLNNELNITDKSWRIYSHNDISAPQFITEKSNVKNALVGDGCYVDGTVLHSILSQNVHVQEGTVIEDSFIMSGTFIGENVTIKNAIIGENAKIGDNVEIIGENEVAVIGHGEIKGENKNEQ

SEQ ID NO: 91453 - protein, 201 aa, Zea mays
  misc_feature (180)..(180): Xaa can be any naturally occurring amino acid
  misc_feature (187)..(187): Xaa can be any naturally occurring amino acid
MPPQFPTARLLLPSHRLLPLLSPLPSASLSPAPRTLRLPPPQLLHRVARRRPLLRGMASAAAPGSHAAAEAPPVDVGGGGAGAPRRLVLEELPWDHSFVRELPGDPRSDTIPREVLHGCYSRVSPSAKVDNPKLVAWSDSVADLLDLDHKEFERPDFPQVFSGATPLVGSLPYAHGYGGXHQFGVWXAGQLGDGRAINLGE

SEQ ID NO: 91454 - protein, 179 aa, Zea mays
MVLSHASSGRDDDDAVASTFASRYVRERLPRYRMPERSIPREAAQQIISDELMLDGNPRLNLASFVTTWMEPECDKLIMDSINKNYVDMDEYPVTTELQNRCVNMIAHLFNAPIKEDETAIGVGTVGSSEAIMLAGLAFKRKWQNKRKEQGKPCDRPNIVTGANVQDPGTTNNGCKCWV

SEQ ID NO: 91455 - protein, 172 aa, Populus trichocarpa
MLVNLDIPWVILGHSERRSLLNESNEFVGDKVAYALSQGLKVIACVGETLEQREAGSTVEVVAAQTKAIAARVSNWADVVLAYEPVWAIGTGKVATPAQAQEVHYELRKWLQENTSPEVAATTRIIYGGSVSGANCKELAAKPDVDGFLVGGASLKPEFNDIIKSAEVKKSA

SEQ ID NO: 91456 - protein, 178 aa, Physcomitrella patens subsp. patens
MLSRFSCGFLPIAVVRQLQRGCGKLVSPKTYHEKVVEHYNNPRNVGSFDKDNPDVGTGLVGAPACGDVMKLQIRVDEKTGKIIDSCFKTFGCGSAIASSSVATEWIKGRPEKEVLSIKNSDIAKYLVLPPVKLHCSMLAEDAIKAAIKDYQSKQILVIITMVLKIEIEIIMVHHFINT

SEQ ID NO: 91457 - protein, 428 aa, Salmonella enterica subsp. enterica serovar Typhi str. CT18
MKLYNLKDHNEQVSFAQAVTQGLGKQQGLFFPHDLPEFSLTEIDEMLNQDFVSRSAKILSAFIGDEIPQQILEERVRAAFAFPAPVAQVESDVGCLELFHGPTLAFKDFGGRFMAQMLTHISGDKPVTILTATSGDTGAAVAHAFYGLENVRVVILYPRGKISPLQEKLFCTLGGNIETVAIDGDFDACQALVKQAFDDEELKTALGLNSANSINISRLLAQICYYFEAVAQLPQGARNQLVISVPSGNFGDLTAGLLAKSLGLPVKRFIAATNINDTVPRFLHDGKWAPKATQATLSNAMDVSQPNNWPRVEELFRRKIWRLTELGYAAVDDTTTQQTMRELKAKGYISEPHAAVAYRALRDQLNPGEYGLFLGTAHPAKFKESVESILGETLALPEALAERADLPLLSHHLPADFAALRKLMMTRQ

SEQ ID NO: 91458 - protein, 367 aa, Bartonella henselae str. Houston-1
MGFKCGIVGLPNVGKSTLFNALTKTATAQAANYPFCTIEPNTGEVAVPDLRMEKIASIAGSKEIIPTRINFVDIAGLVRGASKGEGLGNKFLANIREVDAIIHVLRCFQDDDITHVEGRIDPVSDATTVETELMLADLESLERRIVQIRKRATGKDKEALTILPVMESALNLLHKGSPVRLLLEEISSDERRILDSLNLLTSKPVLYVCNVSENDAAHGNSFTQTIEKMATEQNAQSILISASIEAEITQLNDAEAIEYLNALELFEPSLNRLIRAGYHLLNLITYFTCGPKETRAWTITRGTKAPQAAGVIHSDFERGFIRAQTISYEDYIALGGENGAKEAGKARDEGKEYIVQDGDIMLFKHNT

SEQ ID NO: 91459 - protein, 431 aa, Legionella pneumophila str. Lens
MDMDIKHKPLKRELSLFGATMMGLGSIVGTGVFVSIGIAAGVTGPSVILAIALAALVATCNAFSSAQLAANHAVSGGTYEYGYRYLHPAFGFTAGWMFLCAKSASAATAALGFAGYFIHLSGLETVPVIPIALAASITLILLVLSGLRRTNTVNIIIVMITLITLTVFIISGLPDFMQRGTANLRPFFPVSKQEGLSHFFYATALMFVAYTGYGRIATLAEEVKNPGKFIPAAIIITLMVSAALYILVGLVAIGAVGVEKLAQVTETNATPLESAARAIGIPGLSVLVSIGACTAMLGVLLNLILGLSRVALAMGRKGDLPKMFCYVSETRHVPVFAVIGVGVVIIALVLTGSVETTWTFSAFTVLIYYAITNLAALRLPKEEQLYPPLFAIGGLLSCLFLAFWVPIGVWITGISLLVLGLLWKVVANRFL

SEQ ID NO: 91460 - protein, 243 aa, Triticum aestivum
NTADFEFCLPRGNHTGASSLGAPGPGSSRGAGAGTRGGGGGRWMAEAALEGSEPVDLTKHPSGIIPTLQNIVSTVNLDCKLDLKAIALQARNAEYNPKRFAAVIMRIREPKTTALIFASGKMVCTGAKSEQQSKLAARKYARIIQKLGFPAKFKDFKIQNIVASCDVKFPIRLEGLAYSHGAFSSYEPELFPGLIYRMRQPKIVLLIFVSGKIVLTGAKVREETYTAFENIYPVLTEFRKVQQ

SEQ ID NO: 91461 - protein, 139 aa, Populus trichocarpa
MEDNLNQAMIPTFHKRKERKTTHEKSEMAKHESLVSLKRSRRAENVHKRSRRKREEMLKVQEKDQASTVGAGEDDEKAEVDRKIVALQMIIPGGESFGVDKLFEETADYIMALQCQIKAMRVLAGFLEGLEKEKRKSGG

SEQ ID NO: 91462 - protein, 456 aa, Shewanella oneidensis MR-1
MTHTASTNTTLPNAELAPQDIGSQSTAPESIASNYFASERVVPESSTLPRQAFDLNSQIRSQFPTLTQMLGDYPLCYLDTAATSQKPQCVLDAMAQYYLHDNANVHRAAHQLSARATSSYENVRDQLQLFINAKRREEIIFTHGTTESINLVAFGLTPQLKSGDLILIDSAAHHANIVPWQELAKRTGAIIKPIPLTQDCRLDLNAYQALLELKPKVVALCHVSNALGTVNPVVELVRQAKAQGALTLVDGAQAVAHLSVDMAAIDCDFYVFSGHKMYGPTGIGVLYGRFEILDTLTPLLTGGEMIKRVSFDGTEFGSLPNRLEAGTPPISAVIGLGAAIRFLQLSLTLEVKAHEAELLQYLQNQLRALGDVHLYGAHSDNIGAIAFNLADEHHQDVGILLDQQGVAVRCGHHCAMPLMQTLNLKGCCRASIGIYTNKTDIDRFIAALASVKELLL

SEQ ID NO: 91463 - protein, 121 aa, Rhodopseudomonas palustris CGA009
MNDTIFISGLVLHARHGVMEHETEVGQRFVIDLELSADLSESSRTDRLSDTVSYSNVVACTTAAFKDANYRLLERAAGAVADAILASFDKITAVKVTVHKPHAPIPAIFEDVGVIITRRRS

SEQ ID NO: 91464 - protein, 347 aa, Triticum aestivum
  misc_feature (199)..(199): Xaa can be any naturally occurring amino acid
  misc_feature (221)..(221): Xaa can be any naturally occurring amino acid
  misc_feature (270)..(270): Xaa can be any naturally occurring amino acid
HASFTVPAHWNLLDAGSSFKKIPLYQHIANLAGNKQLVLPVPAFNVINGGSHAGNKLAMQEFMILPTGATSFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWXVHYAKMTEECGVEVQIVGDDLXLSTNPTRVAKAIQEKSCNALLLKVNQIGSVTGEYPRPLKMSKHAGWGVXMTIHRSGETEDTFIADFGCWACPTVKIKTGVRALKTSCQIQPLPKIEDWSPCTLAQSLHGGYWIAQFCENGVLTDEL

SEQ ID NO: 91465 - protein, 253 aa, Glycine max
MAAKISLAIGLRTLFTVLGLLMLAIVLYTVFTDGLPFRKELLTPWMAATLIDFYINVVALAVWIAYKESNLISSILWIVLLVCLGSITTSAYIVVQFLKLSSQESSQDPMYYVLLRNPNKNGTAPQRKHSSIVTLRIIFSILGVVMLGTLVYTLITDGSPFRIELITPWLAATLVDFYFNVVALAVWVAYKESSWISAIFWIILLICFGSITTCFYITWQLFQISREDPAYLVLVHHGDRAENRYKGISGEAT

SEQ ID NO: 91466 - protein, 393 aa, Buchnera aphidicola str. Bp (Baizongia pistaciae)
MSIIKITDLNLLNKKVLIRSDLNVPIKNNKISSYARIHASLPTIKFALKNLAKVIVTSHLGRPTEGIYKKKFSLFPVFKYFKKILPETNIYFSQNLTECSSIKSGELIILENVRFNQGEKENSKILSKKYATLCDIFVMDAFGAIHRNEASTNGIIKYAKLACSGLLLESELKTLNSALTNPVRPMVAIVGGAKVSTKFKTLTTLAKISDTLIVGGGIANTFISIDHNIGKSLHDPKFIEQAKILKEKYNIFIPTDSRVSTTFTYDSIATIKSTSDIHANEEIMDFGDISIKNMINIIKKAKTILWNGPIGVFEFKNFSKGTEQLSKAIASSDAFSIAGGGDTLSVVEMFKVQNNISYLSTGGGSFLKFLEGNKFRIIELLEKHFNKFKNNNF

SEQ ID NO: 91467 - protein, 230 aa, Mycobacterium avium subsp. paratuberculosis K-10
MSRAELDKNPRDVASMFDGVARRYDLTNTVLSLGQDRYWRKATRSALGIGPGQKVLDLAAGTAVSTVELNKSGAWCVAADFSVGMLAAGAARRVPKVAGDATRLPFADDVFDAVTISFGLRNVVDTQAALREMARVTRPGGRLVVCEFSTPSNALFATVYKEYLMRALPRVARAVSSNPDAYVYLAESIRAWPDQAALADQIAGAGWAGVRWRNLTGGIVALHAAHRPPR

SEQ ID NO: 91468 - protein, 381 aa, Physcomitrella patens subsp. patens
MANLSASLASTADDVITCKAAVAYEPNKPLTLEEIHVAPPEPSEVRIKITNGAICQTDLYYLKGKDADKIFPRIFGHEGAGVVESVGSDIKNLKRGDKVIPAWMAECKKCPKCLRGKSNICDTLVYNWSNGFMPSDKKTTRFSKASNGMPINHFFGTSTFSQYTVCDEACVAKINPEADLSKVCLLGCGVPTGIGSAWNIAKVTPGSSVAVVEGAKVAGASMIIGIDRDDHKLKQGLEWGLTDTLNTCGLAKPIEAIIKEMTDDQGVDFSFDCTGNPGVIYSAMECANPAGGVAVILGLMDSSKEISFHPSKLLWGKSWTSGLFGGFKGRSQLPDLVDKCVEGVINLDHYITHKMPFSEINKAVELLEKGECLRCVMDYDR

SEQ ID NO: 91469 - protein, 496 aa, Thermotoga sp. RQ2
MKCSLGLEKCPDDTLRCFPKIEQPFGIVIFGASGDLTKRKLIPALNRLFEAGILPERFFVLGAARTKMDDKKFRSRFDANPDFLEHCSYISVDYQDPESFKQLKNTIETLMKRIDSNNLVFYLAVPPDLYIPILENLSKSGLNEKPARVVIEKPFGKDLESARRLEETLKKYFQEDQIFRIDHYLGKETVQNILVFRFANFIFEEIWNNKFVDHVQITMAEDIGVEHRAGYFENVGLLRDIFQNHMLQVLALIAMEPPSSFNGENFRNERVKLLRSIRPFPVEEMGNWIVRGQYGRGVVNGKEVPAYREEPGVDEDSNVETFVAMKLFIDNWRWSGVPFYLRAGKRLPRKITEVAVVFKKIPHSIFAGVPSDELEPNTIVFTLQPNEGISLEFQVKRPCPGMFPQLLSMDFRYEDYFGVKLPDAYERLLLDVILGDPTLFMRRDDLEVSWELLDPVLKAWENDPIRFSPHVYPAGTWGPREADLLIERDGRKWRKL

SEQ ID NO: 91470 - protein, 159 aa, Buchnera aphidicola str. Bp (Baizongia pistaciae)
MKIVQETISTKTKKNIAIIISRYNNFINQHLLDGALDILKRIGQINQKNIPIIHVPGAYEIPIIASIISKQKKYNAIIALGTIIKGHTLHYSHISHAVNSGLTNISITNNIPISIGIITANNIEQAIERAGTKLGNKGSEAALTALEMINIINILAQNK

SEQ ID NO: 91471 - protein, 474 aa, Frankia sp. EAN1pec
MSIDRLPTAGHTGAQAPGPGRATPAFLRELLADPLRLFTRLRTSYGPIVRVPVGRGGFHLVCGPEAVEQVLVGEQRAYAKGLRRRTMPPGEGIQPLSLLLGSGLLTSGGDLHRTRRRLIQPMFHRERIAGYGAAISELSRATALGWADGSRREVHTDMSELTLAIVARTVFGVDVDSEVVRRVRRAVAANMRLSQLAVLPGAIRLQQHLPIGPLRAARDARDDLTAVVMEMIEQRRSLDAAGSDLLSTLLATRDADTGAPLDDTSIRDEALTILLAGHETTANAMAWAYHLLATNPQARDRMHTELDDVLNGRKPTTADLAELPYTRAVFSETLRLYPPAWILLRRTTRDVTLTGYHLPADTNVLLSQWVIHRDPTWWPAPEEFRPQRWLTPDPTRPKYAYFPFGGGTRQCIGNTFAEMEGALALAAISSIRTLTPTPGRPVTPIPRVTLRPQPLQMTAHPRTPHPTPATHQPH

SEQ ID NO: 91472 - protein, 333 aa, Silicibacter sp. TM1040
MTIKVGINGFGRIGRCTLAHIAGSFRNDIEVIKVNATGPIETAAHLIKYDSVHGRFPGQVDFSEGRLNLGRGDMQVFSTYDMDTLDWEGCDVVLECTGKFNDGLKAKKHLERGAGKVLLSAPGKNVDRTVVYGVNDEDLLSTDKMVSNGSCTTNCLAPLAKVLDEAFGIEHGIMTTIHAYTGDQPTLDRRHDDLYRARAAAMSMIPTSTGAAKALGEVLPNLKGRLDGSAIRVPTPNVSAVDLTFRAGREVTAEEVNAAVAEASKGHMSRVLGYEPAPLVSTDFNHTEESSIFAPDQTRVVDGRMVRVLAWYDNEWGFSVRMADVATAMGRLN

SEQ ID NO: 91473 - protein, 324 aa, Fusobacterium nucleatum subsp. nucleatum ATCC 25586
MQTILVTGGAGYIGSHAVVELLDNNYNVVVIDTLENGFKEFVDKRAKFYQGNVQDYELMSRIFQENKIEAVMHFAGYIRVPESVDDPNKYYLNNTYTTMCLIQSMVKHNIKNIIFSSTAAVYGEITEDNPIDEKHSTIPINPYGASKLMSERIIRDCAKAYGLNYSIFRYFNVAGAHEKYPIGQKGAGVTSLITLTLQAAKDSNRILEVFGDDFPTKDGTGIRDYIHVVDLVKAHVLSLKLLFKNESNIFNLGNGNGFSVLETVEAARKVTNKEIICKIAARRKGDPACVIASSEKAKKILGWKAQYTNVEKIIETGWHFVEKQ

SEQ ID NO: 91474 - protein, 542 aa, Methanosarcina barkeri str. Fusaro
MLTVIQYLLDRLKQLGIRDIFGVPGDFAFPINNAICDDKELRWIGCCNELNAAYAADGYARVKGMSALSTTFGVGELSTLCGIAGSYAEYNLVFHIVGMPKMQAQKTHAIVHHSLGAGKSSIFMEMATPVVCASTMLTPENCVQEVERVIETALENHRPVYIAIPHDYVNADISSFNSPARKPVKSDPVALEEVVSIIAGKLLNAKQACVIPGFLVDRFGLKDLSMAVITASGLPYVTMALDKSVLDETNPSYLGLYMGQLINPEIRKFVESCDCILAMGTILSDVNTGKFTANLDKSRIINIMPSSVHIGYTDYINVKMLDVLEELTRRLNKRTDISGPVARRPAVPEVNAEDPITADYLYAKYAEFFKPDDIIIADSSSSFYGLIPLLLPKGAKFESQMLWGAIGWATPASFGTALAAPDRRVILITGEGSHQMTAQEISQFYRHGLKPIIFVLNNHGYLIERMLSEKVDYCYNDLVEWQYYKLPDVFGCNDWITSKVTTCGDLDKVMRELDNAKVGAYIEIITPKLSAPQLMETIHKNL

SEQ ID NO: 91475 - protein, 776 aa, Desulfovibrio vulgaris subsp. vulgaris str. Hildenborough
MSGNETIRIGGLDNGERVSSRRLEERIQQAVQDGARTIDIEAAGQHGIGGRLWVARTEPVRVTVRGAVGQRLGSMGCEGTSIEVMGPASEDVGWLNAGADILIHGNVGGGTANAMAQGRIRVGGNIGSRGMTMTKQNPRFTAPELWVLGSVGDYFAEFMAGGTAVVCGFNAQNPANVLGYRPCVGMVGGRILVRGPYDGFSQADARLDPIDDALWQWLVDGLADFTAALGKPELAAALSVREEWQCIVARGPYEKTGKTRRSISDFRRNVWDRELGMGGLVGDLTSLDRSPIPLITTGELRRFVPVWENARYAAPCQSSCPTGIPVQERWRLVRDGLVDEAVDMALAYTPFPATVCGYLCPNLCMQGCTRNLQRMKPVDVTMLGKAGVRSDIPALPPLTGQRVAVVGGGAAGISVAWQLRMRGIEAVIHDMEPLLGGKIASAIPESRIPREVLDAELERVRKVLPHIHLHRKLTKDDFEQLRADFDFVVLATGASKPRMLPVPGRELATTALDFLRDAKSGNGKPCKRVVIVGAGNVGCDVATEAARLGAESITLVDIQTPAAFGKERDEAEHVGATFRWPCFTREVTADGLVLTTGELIPADTVVFSIGDAPDLDYLPDTIATERGYVTVNDLGQTTDARVFAIGDVVRPGLLTQAIGAGRKAAGAIADMAEGKRPVSDTREMVDTARIKLEYFDPRISGFDDLERCGEACVSCGACRDCGVCETICPQGAISRRDLGEGRFEMTVDGERCIGCGFCAGACPCGIWNLVENTPLE

SEQ ID NO: 91476 - protein, 322 aa, Bradyrhizobium sp. BTAi1
MAVVVHAKAPGGAENLLLETVELPEPRPDEIRLRQTAIGVNFIDIYQRSGLYPLPDRVPGVEAAGIVTAKGSDVTGLSVGDRVAYAGGPAGAYASERNLPAWRAMPLPDSVSDARAASTLLKGITAAMLLGRTYVVGPGTTLLVHSAAGGLGQVLTRLARLRGATIIGTVSSEAKADLARAAGAHHLIVGRDADFVDAVRRWTAGRGVDVAYDGVGGRTLARTLACVRPFGMVASIGQSAGPIPDIAVEELGPRRSLSLARPSVMAHVNDVADYRRDAEIVLAALANGELGGDGTPYPLAQAVQAHLDLESGRSRGALYLVP

SEQ ID NO: 91477 - protein, 379 aa, Lactococcus lactis subsp. lactis Il1403
MNNSNKMAAILSNISSSKHLSPLTEVRPIATLPFDCKYHLIDFPLSSLSNAHVDNIFMTFNEGETQSVFDHLGSGGEWGLDGFNSRYFVYIQQDFDRLREQGKDYFAQQLNFLRKSKAPYTVLLGSKFICNVDLTAVLKIHKLAGKEITTVYKKVSPDLASEYDTILRFDESGKMSNCYVNQLENPQEKEALCLNLFIVNTDWLINFIKEMQDIGELTSIARLIRVYMKNYDVNTYEYTGYMSNITNIKSFYDANMVMLDPQNFTSLLYSSQPVYTKIKNEVPTYFSENSKVENSQLGSGCIINGKVKNSLISRGVKIQDDALIEESLVFTNSEVKSGAQVKFAIIDKGVVVENNVKIIGSSEKPVVIPKGTVVTADIL

SEQ ID NO: 91478 - protein, 103 aa, Glycine max
MLTRLARRRSIRFRLSDFVYLCPPEALKLFSALKMADWGPVVIAVVLFVLLSPGLLFQMPARGRVAEFGNMQTSGASILVHAIIYFGLITIFLIAIGVHIYTG

SEQ ID NO: 91479 - protein, 324 aa, Sulfitobacter sp. EE-36
MGLLIDGEWRDKWYDTESTGGKFERSTSKFRNWVTADGSAGPSGKSGFQAQSGRYHLYVSYACPWAHRALIFRALKDLTDHISVSVVHPDMMEDGWTFATDFEGATGDTLFGSDFLRDIYIKADPNFTGRVTVPVLWDKAQSTIVSNESAEIIRMFNSAFNEITGNTDDYWPTDLRDQIADINERVYETVNNGVYKAGFATSQDAYDDAVHPLFDSLAWLESILENNRFLAGNKLTEADWRLFTTLARFDLVYHTHFKCNHKRLTDYPNLWAYTRQLYQHADIAETVHFDHIVRHYHFSQTTVNPHQIIPINPTVDFTAPHGRD

SEQ ID NO: 91480 - protein, 378 aa, Oryza sativa Japonica Group
MAAVAGTTGEEDKAEEEVTAVEPQTVVPVAAQLLLFAAPSSSPRALPFQSQSPPEPSSDSSISLCNREPVPARGFGSLVQIPDKIQNSLKVHFGRFLKKNGFGGGSEAEMLPMQMQGTCTTVAPEVRLDKQLQAWKNNPIWSDEPPEIKVTVPQGSLCNLNLKFKAGLPPDAVYNIIIDPENKRVFKNIKEVISRKVVLDEGQRQIVEVEQAAIWRFLWWSGVLSVHVKFKQGRTGFMKKFEGCWKIEPLFVDKEACHPLDPCTLEKYDSCTNGTGRVGSSITLDQLIEPAMVPPPPFSWYLRGITTRTTEMLVNDLIAETARLRGLANNAIDKQYVEGKCDTSRDHLTEECNDIKERWRQRRKTGRHGNSLRLTAQG

SEQ ID NO: 91481 - protein, 528 aa, Issatchenkia orientalis
MSVIKAIAADVQRYALLAYSHFQTFSLLQQTLLVISIPFLYSALWQLLYSFRKDRVPMVHYWIPWVGSAVVYGMQPYEFFENCRKQHGDVFSFLLLGKVMTVYLGPKGHEFVLNAKLSDVSAEDAYTHLTTPVFGKGVIYDCPNWKLMEQKKFAKVALTKESFIRYVPLIKDEMLKYFNANFRGDSGKTDVLKSQSEMTLFTASRSLFGDALRNRLDASYAEMYSDLDKGFTPLNFVFSYLPLPNYWKRDAAHKNISNTYLDLINTKRAGGEIKNEDLVDALLKNSVYKDGTRMTDEELAHLMIGVLMGGQHTSSATSAWFLLHLGEKPQLQEEIYREIQSVLGENFERELTYDDLQKLDLVNATIKETLRLHMPLHSIFRKVTRDLPVPNTSYIVPKGHYVLISPGYTMLSERYFPNASEFQPHRWDEIKSIDGGISLPAEGENAKETVDYGFGKISKGVASPYLPFGGGRHRCIGEPFAYTQLGTLLVHYIQNFKWTAKVPPIDYTSMVTLPTQPAEIKWEGRQKN

SEQ ID NO: 91482 - protein, 192 aa, Marinobacter sp. ELB17
MRVHSLFLYPVKSLAGIAVDSFELDQFGPAGDRRWMLVDDECQFVTQRTVPQLALVQPSLGADGGVSITLPGQPLIALQASGENLSVRVWRDWVQGQVGCDAANGAVSRFCGLSLRFVFMPYSSFRQVQTNLATERRRVSFADGYPLLVTNTASLVELNERLAVSVDMRHFRPNIVVDGAAAWSEDNWQPLP

SEQ ID NO: 91483 - protein, 1215 aa, Shewanella oneidensis MR-1
MKTKLSLAISAALLTSAAVAGTTAQYNTTNQTTDKYAGLSVTKNDSNEQKQAVAWMVKLKAPSLAQQSQLKGFNKQSVMSQIESSQTKVKNAITSMDADLKIVATTSKLVNSIIVEGNHKQLVSLLNNAEVADILPIYDYKLDVAASAEYIKAKAVIDAGIASGKGQRVAVLDTGVDYTHKALGGSGLVADYKAAVAAKSEMPNWPQGKVIGGWDFVNNDPNPIDVTTNHGTHVSHSVVGTAPDVELLVYSVCNSGCSGIAQLNALEASMDPNGDGDISDRVDTVNMSLGGDFGDVEDGAVQVMINEMVQLGVNLVISAGNDGPTPFVVGGPSTTNSALSVGAMTHPTTKVGKIEASIAGNTVTAVGAGFNKSNAYSFTNTVAPIVYPAANKNGCTAYTEDLTGKTVLIDRGTCGFVVKVLNAQLKGASFVIVANNAANAGAFVMGGTDDKITIPSVMVSKEDGDAIKTALASGDVAFSIASTELGTAGAIATFTSRGPSIGGTLKPEITAPGTDILTAHPGLGEGLTPISGTSFSSPITAGAVSIIREALPHRNAFEVKATIMNAANLDVTLEPKEINPDTELAPISYIGSGLVDVEKAINLPVAAWNKDTKQAALAFGLLALNKTTSITKTVTVKNFSATEKTYTLKVDQRFQNDLDSGALSFALPASVTIPAGQTINFDVTATIDPTKLPEWSLTSSYELDGTAADASAALTLSEYDGAIQFMEGDVKALHLVYHVLPKAAAAISVETEVTEDGLVRTLTNVGATSITDPFTAPLIATSPVDQSKRHDLLNASSELLLSSSCDTGIAIYNTLQMRDPIIHALVASYDVDYDLNNDGVWDYTAATVNLDWFSTRDNPLPRSIYGLVAKYGTSSGTLEPVFHVTGNNFLTSKVCLEDIGLAEADLGKTIKVRYRVEDSDWAPIPSGDEDSVVASLVLDGSGTSAMLLDAKGNEVTELKPGESAILETKVGSNAKGFMFLSDSGSMSVVANTTDEGNSAPTVENLTLSVNKGTAAGSVLGQLKATDPDMLTSPFSEFVTLSSNSSMVVIAKDGTVRLSDNAVINQQSKTIEVEVIALDTMGNASTPAKVTVLINNTKPSVTPTNANATENSYVALLANGKDVDGDELTYTWTQTSGPSVSFVNGKDRIGFTAPAGENVYTFTVVASDGVDNSNVGTSTVTVKTAKSNNGGGTSGGALGWLTALLLPLAALRRRMK

SEQ ID NO: 91484 - protein, 205 aa, Buchnera aphidicola str. Bp (Baizongia pistaciae)
MTLYDKEINKNSLLIPMVIEKTSYGERSYDIYSRLLKERIIFLTGTIDDNTANLIVAQMLFLEAENAKQDIYIYINSPGGVITAGMSIYDTMKFIKPNVNTICIGQACSMAALILTAGKKGYRYCLPNSRIMIHQPIGGYNGQASDIEIHAKEIIKVKRKLNELMAFHTSQSINTIEKDTERDCFLSANQAIKYGLIDTILSYRT

SEQ ID NO: 91485 - protein, 551 aa, Oryza sativa Japonica Group
MEASDEDRPLIHHLPPQEQCSKYTCDGTVNIDSVEFTECICFYGVSKNLVTYLTSVLHESNVNAAQSVSIWIGSCFFTPLIGAFLADTYWGRYWTVVMSILVIILGMIVLTVSASPLFLNASFYNGGISRLTVYLGLYLFALGTGGIKPNIPAFGADQFDGADPVERVTKGSFFNWYYFSINVGSLLSSTVVVWVQDNIGWSVGFAGPMLLLGFGLAMFIAGRRAYRYKKLGGSPLTRVFQVLVAAVRNHRLNLPDDSSLLHELPGVTEGDYRTQHTYQFRFLDKAAILSDKNCAPAAPSSPWRLCTVSQVEELKMLLRTFPVWASLVGFFMVTAQMTSTLIEQGVAMDGRVGRFTVPPASLATFDVVAVLALIPVYDAALVPLARRVTGRDRGVSHMQRIGVGLALSAVAMAYSALVEARRLAMAAAAAGTRMSIAWQVPSFFVLGAGEVFAVIGMLEFCYEQSPASMKSLGTALVQLAVAVANYLNSGMLRVVAAATARGGGAGWIPDKLDEGHLDYFFWMMAALSVLNLLQFLHCSIRFRGNNTLSSS

SEQ ID NO: 91486 - protein, 176 aa, Brassica napus
  misc_feature (117)..(117): Xaa can be any naturally occurring amino acid
MVGGGSRRDEGSMRPIQNTNLSAALDTRKKKKKSDKAKASSVNKEPEPQVFWAPTPLKAKAWADIDSDDEDEDYFATTAPPPPPQPLWSASDAKEAHVEESESEEDVLDEGDDDDDXEEEHETQVHPEAEPEVKKAPEVPAPPKEAERQLSKKERKQKEQAEFDALLADFGVAPKD

SEQ ID NO: 91487 - protein, 337 aa, Zea mays
  misc_feature (264)..(264): Xaa can be any naturally occurring amino acid
MGSGEEPSQMRRALVDSLAGAISGGISRTVTSPLDVIKIRFQVQLEPTTSWGILRRDIYGPSKYTGLLQATKDILREEGLPGFWRGNVPALLMYMPYTAIQFTVLHKLKTFASGSSKTEDHLHLSPYLSYVSGALAGCAATIGSYPFDLLRTILASQGEPKIYPNMRSAFVDIIKTRGVQGLYSGLSPTLVEIIPYAGLQFGSYDTFKRSMMTWNRYKYSHLNFGSEDDSVSSFQLFLCGFAAGTFSKAACHPLDVVKKRVQIXEGLKRHPRYGARIESSTYKGMYHALKEIVAKEGFGGLYKGLFPSLVKSAPAGAVTFVAYEYISDWIGSKAGVE

SEQ ID NO: 91488 - protein, 425 aa, Xylella fastidiosa Dixon
MMSNSPQTPLVTRQRLSEVRYEIRGELARRARELEAEGRKLIKLNIGNPGAFGFRAPEHLQRAIADDMGRTDPYTHQQGLPIAREAIAAAYARRHYPDADADRVFVGNGVSELIDLSLRALLNPGDEVLVPSPDYPLWSAATILNDGRPVYYRCAPENGFQPDAVEIETLVSSRTRAIVLINPNNPSGANYSQELLERIAAIAVKHHLLLLVDEIYDQILYDGAVFVPVAPLAGTHPCITFSGLSKVHRACGWRVGWALLSGSSIQVDNLRNAMDLLGALRLCANVPGQYAIDAAVNGPDTITPLCSPGGPLYETRRAVIDACAASEHLSLVVPAGALYAFPSVVGPAARHFDDYAFALELMNEEGVLVVPGSSFNVPYRDHFRVTLLPDAGLIREVFSRIDRALSRRAEVAEKVVPLKLRSAAA

SEQ ID NO: 91489 - protein, 571 aa, Escherichia coli
MMSYVDWPPLILRHTYYMAEFETTFADLGLKAPILEALNDLGYEKPSPIQAECIPHLLNGRDVLGMAQTGSGKTAAFSLPLLQNLDPELKAPQILVLAPTRELAVQVAEAMTDFSKHMRGVNVVALYGGQRYDVQLRALRQGPQIVVGTPGRLLDHLKRGTLDLSKLSGLVLDEADEMLRMGFIEDVETIMAQIPEGHQTALFSATMPEAIRRITRRFMKEPQEVRIQSSVTTRPDISQSYWTVWGMRKNEALVRFLEAEDFDAAIIFVRTKNATLEVAEALERNGYNSAALNGDMNQALREQTLERLKDGRLDILIATDVAARGLDVERISLVVNYDIPMDSESYVHRIGRTGRAGRAGRALLFVENRERRLLRNIERTMKLTIPEVELPNAELLGKRRLEKFAAKVQQQLESSDLDQYRALLSKIQPTAEGEELDLETLAAALLKMAQGERTLIVPPDGPMRPKREFRDRDDRGPRDRNDRGPRGDREDRPRRERRDVGDMQLYRIEVGRDDGVEVRHIVGAIANEGDISSRYIGNIKLFASHSTIELPKVCRVKCCNTLRALAFSTSR

SEQ ID NO: 91490 - protein, 325 aa, Physcomitrella patens subsp. patens
MGSGGQGELPQDLVSVLPSDPYEQLDVARRITAMAVATSMSKLESETGKLRQKLTEKEQVIHGLQGRVLEAEAALQVLNAKLSQSEAEQTKLVDEKNSLALQVKGLLRDVAKLETFKRTLMHSLEQEEDDNLAPNSAIWKASQAESAVVKAQNFEDHGRYAKTSSRPDPPKYQGDLDAVSDGRTTPPKSRNGRTVPKQIVGGSTTLRPSSQLIPIGSRLPKNVDSPLNSMIQLPSSQPTSGASSPPSHGSGQSRSTRLDGKEFFRQARSRLSYEQFSSFLANIKELNAHRQTREDTLGQAERIFGPENRDLSIAFEAILSRHLPS

SEQ ID NO: 91491 - protein, 476 aa, Methanosarcina barkeri str. Fusaro
MENYDLIIIGTGSAMNYINPILDSNLKMRVAVIDKDEPGGICLTRGCIPSKILLYPAELIREIETASIFGIKLEIKDIDFLAIMERMRRKSGEDIEAIRKSLTDDPYLDYYHESAEFISPYTLKVGEKTLHSKMIFLCTGSKPAIPTIKGLEEAGYLTSDTVLKLTECPKKLAILGGSYIAAEYGNFFSAIGSRVTVIGRNSQFLPQEEPEISRLASMKMSEYMQIITNHEAIEVRKEDNGQKTVVARNKNSGKEVKVTVDEVLVATGRAPNTDILHPDRAGIKTDTHGWILVNEFLETSQPNIWAFGDANGKYLLKHVANYESGIVYLNAILKEKAKADYHAVPHAVFSYPEIAGVGMREQEAVEKYGEERILIGLKFFEDTAKGSAMEIRDYFVKVILDSEEEKILGAHIIGPHASVLIHQIIPLMYTESRSPEPIMRGMDIHPSLSEVVTRAFYSRLPPEHYHHFLKHIGLED

SEQ ID NO: 91492 - protein, 298 aa, Buchnera aphidicola
QKKAYKLVSSMLKNISAKFKNEPCVSYIGPNGAGHYVKMIHNGIEYGDMQLIAESYFLLKYLLNMSNKELANTFSEWNQGELNSYLIDITKDIFLAKDNNGNYLIDCILDVAEDKGTGKWISQDALELREPLSLITESVFLRYLSSLKSQRVAASKILTGPNIERGVIKDKKIFIEEIRRALYLGKIISYAQGFSQLKKASEKYNWDLKYGEIAKIFRSGCIIRAKFLQKITEEYSYNEKIVNLLLTPYFSKIANKYETSLRKIVVESVKNGIAIPAFSTAISYYDSYRTVHSSANLI

SEQ ID NO: 91493 - protein, 421 aa, Mesorhizobium loti
MSQSQVWHPFTQHALEPAIPEIVRTEGAYLYKADGTRILDAISSWWVVTHGHRHPRIIRAIETTASSLDQIIFAGFTHEPAERLARALVGLAPTGLDWVFYSDSGSTSVEVALKMALGYFRNIGAPRSRIVVMEHSYHGDTIGTMSVGARGVFNAAYEPLLFEVDTIPFPASGREQETLDRFEAVSRDRRAAALIVEPLVLGAGGMLMYPASVLTELKKIAETSGTLLIADEVMTGWGRTGTMFACEQASISLDILCTSKGLTGGAIPLAATLATDAIFQAHYSEDRTKTFFHSSSYTANPIACAAALANVEIWRDEPVAERIATLSAKQAAGLQRFRDNPYFTDCRATGTIAALDLRTGSAGYLAEIGPKLRAFFLERGLLVRPLGNVLYLLPPYCITGEELDGLHDAIEEAGERFGTKP

SEQ ID NO: 91494 - protein, 588 aa, Alkalilimnicola ehrlichei MLHE-1
MSEPLPPPAPMRRWRLRLLPAACALVALLMAANASGDVQPWVPEEKRSAQTEGAMAVTANPHATRAAHELLAAGGSAVDAAIAAQLVLTLVEPQSSGIGGGAFLLHHDAGTGETLAYDGRETAPAAADAGLFLQDGEPMDFREAVSGGLAVGVPGVVRLFEQAHARHGARPWAELFQPAIELAREGFEVSPRLNDILQREWAILDNEAARAYFHTDEGEPLPVGQRLRNPALADTLSRIAEAGAEAFYTGPIAEAIVDAVQGAAHNPGRLTLEDMAGYRAEVREPVCAPYAGHRVCSAPPPAGGFVVLQILGLLERAEAVHPPEDEADRAHLLAEASRLAYADRARFAADPDHEPVPVADLLDADYLDERAALIDPVRSMGEAEAGLALEPEQAAMPRRPARPSTSHLSIVDAQGNAVSMTSSVEMPFGSGLFVRGFILNNQLTDFAFEPEDGNGDPVANRVAPGKRPMSAMSPTLAFEDDALRLAVGSPGGPWIIGYTARHLALVLGEGAPLAEAVAAPNWNNRNGPTKLEAVEGSEALAGALRERGHEVSVRGMTSGVHAIFVDGDGVRHGAADPRREGTALGVAP

SEQ ID NO: 91495 - protein, 541 aa, Phaeosphaeria nodorum
MATDGSDPIPPHKTFDTILVLDFGSQYTHLITRRLRELNVYSEMLPCNTKLADLPFTPKGIILSGGPYSVYEEGAPHVDHAVFDLGVPILGICYGLQEMAWHFGKNAGVAAGEKREYGHANLKVESHGGHMDELFKDVGNELEVWMSHGDKLSNMPENFTTVATTTNAPFAGIAHKEKKYYGIQFHPEVTHTKMGKTVLKNFAVDICQSTTDWTMGKFVDQEITRIRKLVGEKGQVIGAVSGGVDSTVAAKLMKEAIGDRFHAVMVDNGVLRLNEAKQVKETLEKGLGINLTVIDASDMFLDRLKGITDNPEQKRKVIGNTFIEIFQEKAKEIAAAAKNSSNAGEIEWLLQGTLYPDVIESLSFKGPSQTIKTHHNVGGLPANMNLKLIEPLRELFKDEVRALGVELGIPEDLVWRHPFPGPGIAIRILGEVTREQVRIAREADYIFIEEIKAAGLYRNISQAFAALLPVKAVGVMGDKRVHDQVIALRAVETTDFMTADWYPFDGEFLKRVSRRIVNEVNGVCRVVYDITSKPPGTIEME

SEQ ID NO: 91496 - protein, 297 aa, Buchnera aphidicola
QKEVYDFIAPLFEKISAKFEGQPCVSYIGTDGSGHYVKMVHNGIEYGDMQLIAESYFLMKHLFNMSNKELSDIFSKWNQGELNSYLLSITVDILVKKDNIGNCILDYILDEASNKGTGKWATKSALDLNEPLTLITASVFFRYLSSLKSQRLLASKLLFGPKYRSISNDKLDLVEQIRQALYLGKVISYSQGFSQLNSASKKYNWKFQYSEIARIFQSGCIIRAKLLKNISQEYLRNKNIVNLLLTSYFSDIANNYQNSLRRVVSIAVKLGIPVPALSSAISYFDCYRTSFLPANLI

SEQ ID NO: 91497 - protein, 297 aa, Buchnera aphidicola
SRKAYDYIAPILKKISSKFEGQPCVSYIGKDGSGHYVKMVHNGIEYGDMQLIAESYFLMKNLLKLDNQELSDIFLEWNKGELNSYLISITTNILIKKDINNSYIVDYILDEADNKGTGTWATKSALDLNEPLTLITSSVFFRYLSSLKSERMLASKMLFGPKNNHMLSNKIDLIEKIRKSLYLGKIISYAQGFSQLSSASKKYDWNLQYSEIARIFQSGCIIRAKLLKYISQGYLKNKDIVNLLLISYFKNIVNSYQDALRDVVSIAIKSGIPVPALSSAITYFDCYRSAILPANLI

SEQ ID NO: 91498 - protein, 408 aa, Frankia sp. CcI3
MAIIVQKYGGSSLATIEKIRGVARRVVDTAAAGKQVVVVVSARGRTTDELLGEARALGGHWRSRESDQLVSTGEVVSAATTALALRELGQPAVSMTGGQAGIQVSGEFGSAAVHSVTPDRLRTSLEEGKVVVVAGFQGVDASGDVRTLGRGGSDTTAVALAAALGATCEIYTDVDGVYTADPRLVPRARLLPTVPAPLMHEMAHTGAGILHPRAVDLAATRRIPVQVRNSLGTNPGTVVEVVPGNPLESDGVVAAVTQDEDTTLVMMRGRGEPLDSWAALARMASAKVAPADLFALADSTHGSTLGFTSSPARQIDLAHIARQAGGTVELRDDLGRLSLVGTRMNLCGAVIETLAEILSTHGIRSPWIAISERRISILVPRGGMRRLALTIHDALVLGRGLEAHSSDR

SEQ ID NO: 91499 - protein, 461 aa, Frankia sp. CcI3
MQHNGADRPGRRATDHGAKAVTMSAPTLPVGRQRLSSDLPVVAKAHGSRIYDEDGREFIDGSSGTICVNIGHGSTDVLAAMREQAELVTFAHRSQFTSRSVLALTEKILSIGGPGYREVVYTNSGSEATETALRLALFHHALAGSPERSIVLTQQPSYHGMTAGALSVSGHPPRREHLDALVSTGVSTVPVTSDDPAADPLPATSAWEEAFGRIGPERIAAVLVEPVSGAAGGAAVLRDDVLRRLRELTSASGALLVMDEVMTGFGRTGDWFGYQRSGVTPDLVVTGKGLSGGYTPIGAVLVGASVLPGRSASDLALGHTMSGNPLSAAVALAVLRVTEQQRLPERAERIGAELRRRLEEEVTGKVGFLDQPRGRGLLLGLPVRQAAGAHARAPLAATICRAAREFGLVVYPAGVNHWTQALLVAPSLTIEDAELAELVRRLARTVTAVDTQLARTRGRRW

SEQ ID NO: 91500 - protein, 392 aa, Legionella pneumophila str. Lens
MDIALAKRVQKVKPSPTLAVAAKAAQMKAQGLDIIGLGTGEPDFDTPQHIKLAAISAIEAGDTKYTAVDGIVELKEAVKNKFKRDNELDYQLNQILVSVGGKQSCYNLCQAYLNPGDEVIIPAPYWVSYPDMVLLADGVPVIIETTPAQRYKINAQQLEQAITPKTRMIFLNSPSNPSGIAYTQQELKELGEVLKKHPQILIATDDMYEHILWSQAFTNILNACPELYDRTIVLNGVSKAYAMTGWRIGYAAGPAPLINAMKTIQSQSTSNPCSIAQRAAVAALNGSNESIEEMVNAFHQRHDYVADRLQSIDGIEVIPADGTFYIFPSVQAIIEKRGYANDIEFSEKLLNEVGVALVPGSAFGTEGCIRISFATGIDTLKDALNRLQRFCS

SEQ ID NO: 91501 - protein, 570 aa, Physcomitrella patens subsp. patens
MSFLSTDLVHEWSAPLLVHGSSVVSSSISSSTGTTSCSFRPNLRSGRLGLLKAQTTENVLAALTGSALHNEGYKVTGGSSRSTVRCKGMNGAHVSRADINNRAVVGLDSKDLQERPSLAQNGVPTVDQFLEIDANEKSVDIGEGFATIEEAVDAIKAGKFVLVVDDENRENEGDLIMAGSLVTPQAMAFLVRYSTGIVCVSMKGEDLDRLGLPLMVPQDENGEIMRTAFTWTVDAKHGTTTGVSASDRCQTIRALASPDSTRGDFVAPGHIFPLRCREGGVLTRRGHTEAALDLAVLAGLPPAGVLCEVVNDDDGSMARLPYLKKFAKEHGILLISIDELVKYKEERNKKVLVKRTAQARLPTEYGEFQVYSFESNDGLEHAAIVEGDISSGLEVYVRVHSECLTGDVFRSTRCDCGSQLSDSLSFIKKMGRGVVVYMRGHEGRGIGLGHKMRAYNLQDAGADTVEANLQLGLPVDSREYGISAQQILQDLGIKTITLLSNNPAKVTALKELGIRVNERRSIFSPVTKENRRYLETKRIKMGHMYTSRLPAVGSTNEVDITGILNNNDLD

SEQ ID NO: 91502 - protein, 722 aa, Frankia sp. EAN1pec
MSSAAMTLEHPDEVVTQAHVRYAQLSGVSGPVALITLDNGQDHTRPSTFGPGGLRSLLTAVEEIEAHDPPVAAVAVTGKPFIFCAGADLSYRSSLTDPAEVRPKLTALGELGHTALRRVGEGRLGDRRVPTFALVNGAAMGGGLELALHCDYRAISAGAAPIALPEVFLGLVPAWGGTQLLPNLVGPENAVTIMIDNALSQNRTLRGPKAFALGLGDVLLDAADFLEEALHWVGQVLRGEVDPTKGRRPVEQGAAWAAALERGRVLADARLHGAAPAAYRALELMALAETADADTGYAAETAALADLGSSEELVAGLYSFDLVNRRAKRPVGGPDRSLAQAVTKVGVVGAGLMASQLGLLFAQRLEVPVVLTDLDQARLDAGVAHVHSEIDNLLLRGRISHDRANRLKASVTGSLTKDAFADADLIIEAVFEDMSVKKAVLAELESVVKPETLLLTNTSALSVTEMAADLTHPERVAGLHFFNPVAVLPLVEVVRTPRTDDTTIATTLQVAKQLKKNAVLVADAPAFVVNRLLTRFMGEVLAATETGTPIEQADGALDPLGLPMSPLVLLSLVGPPVALHVARTLHQAMPDRFRTPDGLARVVAAGKSSFYTAGPGGEQIVDPEVADLVRSMDDGTAPTAREGAAMTPEQVREAALSALAQEIRLLLDEGVVAEAADVDLCMILGAGWPFHLGGITPYLDRTGISERVTGRRFNPPGVATVA

SEQ ID NO: 91503 - protein, 181 aa, Arabidopsis thaliana
MASSMLSSAAVVTSPAQATMVAPFTGLKSSAAFPVTRKTNKDITSIASNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTEA

SEQ ID NO: 91504 - protein, 170 aa, Debaryomyces hansenii CBS767
MSLLRHSVRPALRLVSKRAAPMAVRFNSSVPVEEKKAVDPKISTIVDQISTLTLLETSALVTELKERLNIPDISFPAAGGAPAAPAAPVEEEVQEEVEEKTIFSIKLESFDAKSKPKIIKEVKGLLGLSLVESKKFVEAAPKVLKENVAKEDAEKIKAALEGLGAKVALE

SEQ ID NO: 91505 - protein, 597 aa, Bradyrhizobium sp. BTAi1
MTSLDAVSIAILLGAVLVMAGILSSLLALRFGAPLLLVFLVIGMLAGDSGPGHIEFQDVRTTYLVGSVALALILFDGGLRTRFQSIRTVLAPSMVLATVGVLMTAFITAPVAKYALDLGWTEALLVGAVIASTDAAAVFLLVHAQGLRLRPRVGATLEAESGSNDPFAVFLTLMLVELISVGHGSFGHFLFELVREAVLGTLFGIVGGRLVVMGLNRVALPQGLHAPFVTTAALVIFGMAQIVHGSGFLAVYLAGIIIGNRPTRAHNSVVTFLDAATWLAQIVMFVLLGLLVSPQRLLDSLLPAIAVALMLMLVARPAAVFFCLYPFRFNWREKAFIAWTGLRGAVAIFLASIPMLVGLSNAYLYFDVAFVVVIISLLAQGWTLAVAARKLHVALPRTDRGPRRIELDLPGQLEQQLVGYAIRPKSLYFRRGLIPSWSKPTLVIRNQQILSPAEAEPIAPGDYLYLLAPPEKAESLDRFFVDMPPSSAPDPHLLGDFMVSAEHTLDEVAGIYGVKLGEGEERLTLADYFDIHLDNAPKEGATVALDTIVLVARSISGGRVNVVGLRLPEDEEEVPVLTRKEQVKRRLADVWSSVAGV

SEQ ID NO: 91506 - protein, 274 aa, Bradyrhizobium sp. BTAi1
MSYIEATDTAARKNGQIKLHGASGFAGMRKAGALVSKCLDALTDIVKPGIPTSRIDDFVRDFAFSHGAYPATLMYRGYRYSTCTSINHVVCHGMPNDRPLKEGDIINIDVTFIFDGWYGDSSRMYAIGPISRKAERLIEVTYESMMRGIAAVKPGATTGDIGHAIQSFVEPQGMSVVRDFCGHGLGRLFHDEPNIIHVGRPGEGVLLKPGMFFTIEPMINLGKPHVKILSDGWTAVTRDRSLSAQFEHSVGVTDHGVEIFTLSERHGEKPLTQV

SEQ ID NO: 91507 - protein, 79 aa, Triticum aestivum
KKVEEALRSKMKQKALKECDVLCSKYAECARGRTFSVVWTCRKQAKELNNCLHQFTNDAILEDMKKAYMDEQESKEKNK

SEQ ID NO: 91508 - protein, 376 aa, Xanthomonas oryzae pv. oryzae KACC10331
MSKRDYYEVLGVARGASDEELKKAYRRCAMKHHPDRNPGDAAAEAAFKECKEAYEVLSDGNKRRAYDAHGHAAFEHGMGGGGGGPGSPDMGDIFGDIFGNIFGGGAAGPRAARRGADVGYVLELDLEEAVAGIERRIEIPTLIECVSCHGSGSEDGKVQTCGTCHGRGQVRIQRGIFAMQQSCPHCDGRGTLIQNPCKTCHGAGRVEENKVLSIKVPAGVDTGDRIRLAGEGEAGPAGTPPGDLYVEVRVREHAIFQRDGDDLHCEVPIRISQAALGDTVRVATLGGEAEIRIPAETQTGKLFRLRGKGVRSVRSRSEGDLYCRVVVETPVNLTADQRELLQQFEATFTGEDARKHSPKSATFIDGVKGFWDRMTS

SEQ ID NO: 91509 - protein, 483 aa, Escherichia coli
MSQCLYPVIIAGGTGSRLWPLSPVLYPKQFLNLVGDSTMLQTTITRLDGIECENPIVICNEDHRFIVAEQLRQIGKLTKNIILEPKGRNTAPAIALAAFIAQKNNPNDDPLLLVLAADHSINNEKAFRESIIKAMPYATSGKLVTFGIIPDTANTGYGYIKRSSSADPNKEFPAYNVAEFVEKPDVKTAQEYISSGNYYWNSGMFLFRASKYLDELRKFRPDIYHSCECATATANIDMDFVRINEAEFINCPEESIDYAVMEKTKDAVVLPIDIGWNDVGSWSSLWDISQKDCHGNVCHGDVLNHDGENSFIYSESSLVATVGVSNLVIVQTKDAVLVADRDKVQNVKNIVDDLKKRKRAEYYMHRAVFRPWGKFDAIDQGDRYRVKKIIVKPGEGLDLRMHHHRAEHWIVVSGTAKVSLGSEVKLLVSNESIYIPQGAKYSLENPGVIPLHLIEVSSGDYLESDDIVRFTDRYNSKQFLKRD

SEQ ID NO: 91510 - protein, 482 aa, Oryza sativa Japonica Group
MKTPQNDKLQYHTPPLPSKSQQKSEAKSRTHRLAMPSPSLRLAVVGAGAAGLVAARELRREGHSPVVFERAASVGGTWLYDAAPATSDPLAAGAAHSSLYASLRTNLPREVMGFLDFPFASSAAEAGGGGDTRRFPGHDEVLRYLEEFARRFDLYGLVRFGTEVVRVRRDGGGGGGRWAVTSRKIGEKGRREEEEEVYDAIVVCNGHYTEPRVAHIPGVEAWPGKQMHSHNYRVPEPFHDQVVIIIGASASAVDISRDLAGVAEEVHVADRSAPACTCKRQPGYDNMWLHSMIDHAQEDGCVVFQDGSSIKADVIMHCTGYLYDFPFLEDDSAITVDDNCVDPLYKHVFPPEVAPHLSFIGLPWKVIPFPLFELQSKWVAGVLSGRVKLPSSEEMMEDVKAFHSKMEARGWPKRYAHNFSDCQFEYDDWLAEQCGHPPIEQWRKLMYAANSENKAARPESYRDEWDDDHLVAEAAEDFKKYL

SEQ ID NO: 91511 - protein, 150 aa, Brassica napus
  misc_feature (102)..(102): Xaa can be any naturally occurring amino acid
  misc_feature (121)..(121): Xaa can be any naturally occurring amino acid
MEQTFIMIKPDGVQRGLIGQIICRFEQKGFTLKGLKLITVDRPFAEKHYQDLSAKPFFSGLVDYIISGPVVAMIWEGKNVVLTGRKIIGATNPAASEPGTIXRGDFAIDIGRNIIHGSDSXVESANKECALWFPDGPVNWQSSLHSWIYE

SEQ ID NO: 91512 - protein, 173 aa, Natronorubrum sp. Tenzan-10
MRDDIKRLPYHDSISLCTAPSHTRTTVEFSMDYDEDTFVVDGEELDGRAYERVEAVVEKARSKSDAAHTVYPVRLESENSFPSNVGLGSSSSGFAAAAMALAEAAELDASKPEISTIARVGSASAARAVTGAFSQLHTGMNDEDCRSSRIPTDLHEELKIIVGLVPYHKETEH

SEQ ID NO: 91513 - protein, 525 aa, Salmonella enterica subsp. enterica serovar Paratyphi A str.
MTENIHKHRILILDFGSQYTQLVARRVRELGVYCELWAWDVTEAQIRDFNPSGIILSGGPESTTEENSPRAPQYVFEAGVPVFGVCYGMQTMAMQLGGHVEGSNEREFGYAQVEVLTDSALVRGIEDSLTADGKPLLDVWMSHGDKVTAIPSDFVTVASTESCPFAIMANEEKRFYGVQFHPEVTHTRQGMRMLERFVRDICQCEALWTPAKIIDDAVARIREQVGDDKVILGLSGGVDSSVTAMLLHRAIGKNLTCVFVDNGLLRLNEAEQVMDMFGDHFGLNIVHVPAEERFLSALAGENDPEAKRKIIGRVFVEVFDEEALKLEDVKWLAQGTIYPDVIESAASATGKAHVIKSHHNVGGLPKEMKMGLVEPLKELFKDEVRKIGLELGLPYDMLYRHPFPGPGLGVRVLGEVKKEYCDLLRRADAIFIEELRKADLYDKVSQAFTVFLPVRSVGVMGDGRKYDWVVSLRAVETIDFMTAHWAHLPYDFLGRVSNRIINEVNGISRVVYDISGKPPATIEWE

SEQ ID NO: 91514 - protein, 342 aa, Alkalilimnicola ehrlichei MLHE-1
MSYKVLIEPTGHEFTVEPGEAVLTAALRHGLILPYSCRSGTCGACMGKVVSGEVTYPEGRPEALSDTEEAVGQALFCQAQPNTDLSIEVRELREAGELTPRTMPTRVVRIEDLAHDVRRLWLKLPQNERLQYLAGQYIDVLLRDGRRRGFSLANPPHDDELLEVHVRHVPGGEFTGYVFNELKEKALLRIEGPLGTFSLDEESDRPIIMLAGGTGFAPIKAMVEHAIYVGIQRPIHIYWGVRARRDLYLDGLPRRWASEHDHIHYVPVLSEPRPDDRWEGRVGLVHNVLLQDIPVLSRYEVYAAGPPAMIAAARRDLVAHGLPEDRFFYDAFEYSRDRPGAE

SEQ ID NO: 91515 - protein, 139 aa, Populus trichocarpa
MNLIRAKSMEKGWDLELGELARIWKGGCIIRAVFLDRIKKAYDRNPDLANLLVDPEFAKEIIERQSAWRRVVCLAINSGISTPGMSSSLAYFDTFRRERLPANLVQAQRDYFGAHTYERVDVEGSFHTEWFKIARQLKN

SEQ ID NO: 91516 - protein, 540 aa, Aeluropus littoralis
MGPGVVAHLVRLGVLSSTSGHASVVSINLFVALLCACIVLGHLLEENRWVNESITALIIGLCTGVVILLTTKGKSSHILVFSEDLFFIYLLPPIIFNAGFQVKKKRFFRNFMTITLFGAVGTMISFFTISIGAIAIFSRMNIGTLEVGDFLAIGAIFSATDSVCTLQVLNQDETPLLYSLVFGEGVVNDATSVVLFNALQHFDLNKIDVAVVLKFLGNFCYLFLSSTFLGVFAGLLSAYIIKKLYIGRHSTDREVALMMLMAYLSYMLAELSDLSGILTVFFCGIVMSHYTWHNVTESSRVTTKHAFATLSFIAETFLFLYVGMDALDIEKWKFASDSPGKSIGISSILLGLVLVGRAAFVFPLSFLSNLTKKADFEKITWRQQIVIWWAGLMRGAVSIALAYNKFTRSGHTQLHGNAIMITSTITVVLFSTMVFGMMTKPLIQFLLPASSHTVTSEPSSPKSLHSPLLASMQGSDLETASHSHIVRPSSLRMLLSKPTHTVHYYWRKFDDALMRPMFGGRGFVPFSPGSPTEQSIHWGR

SEQ ID NO: 91517 - protein, 910 aa, Arabidopsis thaliana
MMVLNLPQELLEEILCRVPATSLKQLRLTCKEWNRLFNDRTFSRKHFDKAPKQFLITVLEERCRLSSLSINLHSGFPSEEFTGELSPIDYHSNSSQVIIMKIFHCDGLFVCTILKDTRIVVWNPCTGQKKWIQTGENLDENGQDFVLGYYQDNKSSDKSYKILSYKGYNYGDQEFKIYDIKSNTWRNLDVTPIPGNYFTCSDYRVSLKGNTYWFAYDLKDEQLGLISFDYTTERFERLWLPFQCDISDHDYSLSVVGEEKLSVVLQLKDAPRREIWITNKMDDETKEMSWRKLFEVEVGTRYYMWSGRPFLVDEEKKIVVCCEKCQKKCQPVITVSMVEADSNATRVYFPVVTMTSYWPHFVDYVPSLIQIQQSEANEKELNSLLLKKFLVTSLFMLEKLSFLLHKFPLVSKCGFIKKLASESSNDSNIIRIPDFPGGAEGFELVIKFCYDISFEINTENIAMLLCAAEYLEMTEEHSVENLVETIEVYLNEVILKSLSKSVKVLQKSQDLLPIAERVRLVDRCIDSIAYAICQESQSNEDIVDWWADDLAVLKIDMFRRVLVAMIARGFKRYSLGPVLKLYAEKALRGLDIFGKEAKKMEAEQEHEKRLILETIVSLLPRERNSVSVSFLSILLRAAIYLETTVACRLDLEKRMGLQLRQAVIDDLLIPYYSFNGDNTMLDVDTVQRILMNYLEFEVEGNSADFASDIGELMETYLAEIASDRNINFAKFIGFAECIPKQSRMYRAIDIFLKTHPNISEVEKKKVCSLMDCKKLSRDVYAHAAQNDRFQENLSNSDSPAPATAEKTLSPPELSSYKNELSKLNRENQYLKLELLKVKMKFKELEKEKAFEVMSGSDCSSSVSTASVAKPRLPRKSFINSVSQKLGKLINPFGLKQGQTKQPKSRRHSIS

SEQ ID NO: 91518 - protein, 650 aa, Frankia sp. EAN1pec
MSLLSTIDSPQDVKRLDHEELVTLAAEIRDFLIHAVARTGGHLGPNLGAVELTLAIHRVFDSPFDRVLWDTGHQSYVHKILTGRREQFDRLRQRGGLSGYPSQAESEHDIIENSHASTALSYADGLSRAYELRGENRAVVAVVGDGALTGGMCWEALNNIAASDRQVVIVVNDNGRSYSPTIGGLADHLASLRLAPEYEQVLDVVKQVLGRTPLVGAPLFDALHGIKKGIKDVVTPQGMFEDLGLKYVGPVDGHDVVAMESALRRAKDFGGPVIVHAMTRKGFGYPAAEQDDADNFHAVGVIDPVTGKPKSASKGTTWTSIFSEEIVRIGSERPDVVTMTAAMLQPVGLKSFAKAFPDRVFDVGIAEQHAVTSAAGLAMGGLKPVVCIYATFLNRAFDQVLMDVAMHRQPVTFVLDRAGITGEDGASHNGMWDMSFLQVVPGLAIAAPRDAATLRAELDEAVSNTDGPTVVRYPKGKVAADSPAIDQVGGVDVLYRAPAAARHREVLLVSIGAMAPTCLDVAERVASQGIGITVVDPRWVKPLDPALVDLARDHDLVVTVEDNGRVGGVGACVAQLLRDADVDVPVREFGVAQRFLDHGKRDDVLAEVGLAPQDLARKVIEAVAKRQHALMGDEVGADESNQTPAGGGQA

SEQ ID NO: 91519 - protein, 133 aa, Triticum aestivum
  misc_feature (34)..(34): Xaa can be any naturally occurring amino acid
  misc_feature (70)..(70): Xaa can be any naturally occurring amino acid
  misc_feature (91)..(91): Xaa can be any naturally occurring amino acid
  misc_feature (100)..(101): Xaa can be any naturally occurring amino acid
  misc_feature (103)..(104): Xaa can be any naturally occurring amino acid
MAPAVMASSATTVAPFQGLKSTAGLPVGRRSSGXLSSVSNGGRIRCMQVWPIEGIKKFETLSYLPPLSTXALLKQVDYLIRSKWVPCLEFXAKVGFVLRXXHXXSPGYNERGEYWDNVESWMRHLTPIHATER

SEQ ID NO: 91520 - protein, 331 aa, Haloarcula marismortui ATCC 43049
MERPIVALVLAGGTGTRLYPASRSDRPKQFLSFGEDESLLAETVSRVGFADETYVLTRDSFADGVREHVPNVAVLTEPEPKDTGPALAYAAHRIREQVGDCVLLCLPSDHRISGPFETVARTATRVAVETEGLVTVGIEPDRPATGYGYIKPGPSENGFAPVETFHEKPDRETATEYVREGFYWNAGLFAWAPTALLSAAASSPLAPMVERLDDGDHDDAFAAVDPVSIDYAVLEDAENAFVVPAALDWDDLGSWDAFERVLDGQDGNAVLGEAVSIDADGNVLASDGHISAVGVEDLVVASFDDRTLVVPKEEAQRVREVVGELRDDGRF

SEQ ID NO: 91521 - protein, 451 aa, Gibberella zeae PH-1
MATQAAYGVEKIVGHSDNAITAQDVTSYQETGDHSQTMKALAWMGKNKVQMVDAPKPKVIEDRDVILRVTGSTVCGSDLHLLHGTVIQLSEGDILGHEFCGVVDEVGAGVTGIDVGGRYVASFQIACGDCFFCKQKLSSQCEKTNSNTTERAMYGGRTAGMFGYSHFTGGFAGGQAEYVRVPLGDVNLLKIPDDVPDEKALYLSDVLATSYNAVKDTAVYPNDSVAVFGAGPIGQMAGIFALKEGASKVIFVDTEPRLSFVRERWPAEHKDKLELVDFKQLSHGVTNKPTVVSRLKELTGNRGPDCAIECVAGEYPKGWMHTIELAIGAETDTSEIINEMIEGVRNYGRCGVTGVYVGYTNHFNIGSLMERGIRLIGNGQAPVHKYWDELLEMIQRGELDPAQMLSHRVRLEDLDKVYYKFEKKEDGMQKVFVETKFSFPRDPSTPALTTY

SEQ ID NO: 91522 - protein, 636 aa, Oceanobacter sp. RED65
MIRLQSLNLHLGQKDIFVGADLAVHDGQKLAVVGANGAGKSTLFKLLLGELVPDQGELDIPKAWRIAHMAQEVAASEQSALDYVLDGHQDYRRLSEGIANAEQTGAEAELVKLHGEFETLQGYQVPQQAKTMLAGLGFTEAQMQHSVSAFSGGWRMRLNLARALIMPSDLMMLDEPTNHLDLDAALWLEGFLQQYRGTLLLISHDRDFIDSVVDGIVHLHQNKLNLYSGNYADFERRRAERLAQQQSLFEQQQREIAHIESFITRFKAKASKAKQAQSRIKALERMERIAPAHIDSEFHFSFPNADKVSDPLTKLEQAEIGYGERAQLTQVSLQLRPGMRIGLLGANGAGKSTLIKALVGQLPLMEGEQFSGEYLSVGYFAQHQVDELDLSLSPVQHLQKLIPETSEQEARNFMGGFGFHGDQAVESCEAFSGGELARLALARIAFLKPNLLILDEPTNHLDLDMRHALTLALQDFEGAMIVVSHDRHLLANTVDEFYLVHQSKVSPFDGDLEDYRQFIKLEQQREAGITSEKSSGEHSAEAKKERKRKAAQLRQQLSPLKKAVNKLESQLETVQEQLSDVEQQLADTSLYEASEKDRLQSVLSQQAELKKQSETIEEEWMEKLEELETLESQLQE

SEQ ID NO: 91523 - protein, 449 aa, Methanosarcina barkeri str. Fusaro
MTEISSMVISHKKAKIEEMESAWHGDLDGLLHNLYNHEYIHECVVLKTCNRVEIYVVSPSSSILFSFAKEMGASTHIIDFYGHDESLEHLLRLAGGLESMIVGEDQILGQIKELYAYSKKAGTTGKILDTAFDKAIQVGKRIRNETRINKGSVSIGSAAVDLAEEILDGLAGKSVLVIGAGEIGVLVAKALAAKDIEAIYIANRTFKKAEELAYELGGYAVKLNDVQTQLKNADVVISGTGAPHYILTREIVEKAIEERDKTRKLLLIDIANPRDIEESVAELDNVKLCNIDNLRVISEKTLKMRKEEAKKAEAIIQEEIKLLNLQYKRQRADKIISDLYKQIYDVRIREREKAVNRLCAYHTIGKIETDVLDDLTHSIANKILAEPTKVLRQAAELGNDEFLDVAARIFCLEKDKVKAEKIKSDCGIKVEKMKPDCESATDRVSEKGN

SEQ ID NO: 91524 - protein, 614 aa, Medicago truncatula
MRLTPTTSDTEVSGLEKKNIGRITQIIGSVLDVVFPPGKMPNIYNALIVQGRDTVGQEINVTCEVQQLLGNNRVRAVAMSATDGLKRGMVVINTGAPLSVPVGGATLGRIFNVLGEPIDNLGPVDTGTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEKNIAESKVALVYGQMNEPPGARMRVGLTALTMAEYFRDVNEQDVLLFIDNIFRFVQAGSEVSALLGRMPSAVGYQPTLGTEMGTLQERITSTKEGSITSIQAVYVPADDLTDPAPATTFAHLDATTVLSRGLASKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDSLPEQAFYLVEMTLNLCVLTPNRTVWDSEVKEIILSTNSGQIGVLKNHAPIATALDIGILKIRLNNNNQQWVTMALMGGFARIGNNEITILVNDAEKSIDIDPQEAQQTLKIAEANLNKAEGKRQKIEANLALRRARTRVEAINRIS

SEQ ID NO: 91525 - protein, 186 aa, Zea mays
MMATSASGVSLLLLLAHPAPPPHPANGASSLWRGGGAALAPHPARFAAKRRTLRLVNVSVSCSAEALRSDGAGAEPAVPRSVPVRVAYELQQAGHRYLDVRTEGEFSAGHPEGAVNIPYMNKTGSGMTKNAHFLEQVSRAFGKDDEIIVGCQSGKRSLMAATELCSAGFTAVTDIAGGFSTWRENE

SEQ ID NO: 91526 - protein, 659 aa, Physcomitrella patens subsp. patens
MQTAITSPTLSLVKLPVNYSTHGLDSISATLYCYIAELDASANATSRSFRLELGGTDGAMLFNPYNDTGGAFISSVWGTAEYLISSDTVVSLIPEPGSIFPPLLNALEIYLNLPDAVAGTNELDVAAMEKIKVALRLTGWGGDPCLPVPHSWVSCSPATKSSAARVISVRLSGYNLTGIIPADFANLTALQTLWLDNNKLDGIIPNLQTLQQLKSLHLNDNALIGSIPNSLSFIPTLEELFLQNKNFNGTVPDALKNKPWLKLNINGNPACGPTCSTPFTNSDSGSKPNVGLIVGVVVASFILAVAGVSNFEVPNLSGTNAQGAKPFSHPEIKAATSNFSKQIGSGGFGPVYYGKLANGREVAVKVSDVNSHQGAAEFNNEVQLLSRVHHKNLVSLLGYCQEDGQQMLVYEYLHKGTVREHLWERPLAKEPLDWKQRLDVSLNAAQGLEYLHTGCSPNIIHRDIKSNNILLTDKYVAKVADFGVLRLGPEESSGATHVSTVVKGTIGYLDPEFLSTNQLSVKSDVFTFGVVLLEVLCGRQPINNGLLDKSQSDIVEWVRNLMLAGDIESILDPTIRDCHPNMDSVWKVAELAIQCVEPLGIHRPFMRDVVKQLHEAIVLEDGHLGTFSEMDRSNNTRTSIASAEYNRGNSDEHYSGNDP

SEQ ID NO: 91527 - protein, 354 aa, Prochlorococcus marinus str. MIT 9211
MTNQPFPNESTEAVPTDRLWLRSELMGTQVITRDTGRRLGVVGEVVVDIDGREVVALGLRDNPLTRFLPGLPKWMLLERIRQVGDVILVDSIDSLSQEFISERYSKVINCQVITESGQQLGRVLGFSFDIETGELMSLVMGAVGVPLLGEGVLSTWEIPVNEIVSSGADRIIVYEGAEEKLKQLSSGLLEKLGVGGSSWEERERERYRVNLVPVENQLSSGEDIELDQKSLKASSEEEFIQEEQEMEYVEVQDSSSFSQLKSRYLEDSSISSSPALSDYPQENRGDSRFSDQTYSSRESLDNNMLISKKKTLSRRPIKSSEDLVDVEPLELEIKDSKSNKEDNKSTNNIIEDPW

SEQ ID NO: 91528 - protein, 565 aa, Azospirillum brasilense
MGSSHHHHHHSSGLVPRGSHMKLAEALLRALKDRGAQAMFGIPGDFALPFFKVAEETQILPLHTLSHEPAVGFAADAAARYSSTLGVAAVTYGAGAFNMVNAVAGAYAEKSPVVVISGAPGTTEGNAGLLLHHQGRTLDTQFQVFKEITVAQARLDDPAKAPAEIARVLGAARAQSRPVYLEIPRNMVNAEVEPVGDDPAWPVDRDALAACADEVLAAMRSATSPVLMVCVEVRRYGLEAKVAELAQRLGVPVVTTFMGRGLLADAPTPPLGTYIGVAGDAEITRLVEESDGLFLLGAILSDTNFAVSQRKIDLRKTIHAFDRAVTLGYHTYADIPLAGLVDALLERLPPSDRTTRGKEPHAYPTGLQADGEPIAPMDIARAVNDRVRAGQEPLLIAADMGDCLFTAMDMIDAGLMAPGYYAGMGFGVPAGIGAQCVSGGKRILTVVGDGAFQMTGWELGNCRRLGIDPIVILFNNASWEMLRTFQPESAFNDLDDWRFADMAAGMGGDGVRVRTRAELKAALDKAFATRGRFQLIEAMIPRGVLSDTLARFVQGQKRLHAAPRE

SEQ ID NO: 91529 - protein, 508 aa, Glycine max
  misc_feature (192)..(192): Xaa can be any naturally occurring amino acid
  misc_feature (194)..(194): Xaa can be any naturally occurring amino acid
MMELFLSCMVLFVLTLATLGAHWIWVVSSSRAGSKLPPGPFPLPIIGNLLALGKKPHQSLAKLAETHGPIMTLKFGQVTTIVVSSADMAKEVLLTHDHSLSSNRVIPQAVQVHNHHNHSITFLPVSPLWRDLRKICIANLFSNKTLDASQDLRRSKLHQLLHDIHRSSLAGEAVDVGKAVFNTSMNLLSNTXFXSLDLVHSSSSAAAVDFKDLVLKIMEESGKPNLADFFPVLKFMDPQGIKTRTTVYAGKIIDTFRALIHQRLKLRENNHGHDTNNDMLNTLLNCQEMDQTKIEHLALTLFVAGTDTITSTVEWAMAELLQNEKAMSKAKQELEETIGRGKAVEESDIGRLPYLQAVIKETFRLHPAVPFLIPRKANADVEISGGYTIPKDAQVFVNVWAIGRNSSIWKNNANVFSPERFLMDSEDIDVKGHSFELTPFGAGRRICLGLPLAMRMLYLVLGSLINCFNWKLVEDDDVMNMEDSFGITLAKAQPVILIPEKVHGVIVS

SEQ ID NO: 91530 - protein, 254 aa, Natronobacterium gregoryi
KATARAHPIQGLVKYHGMRDHVERLPYHDSISVCTAPSHTRTTVEFSMDYDEDTFVVDGEELGGRAAERVEAVVEKARSLSDAAHTVYPVRLESENSFPTNVGLGSSSSGFAAAAMALAEAAELDASMQEISTIARVGSASSARAVTGAFSQLQTGLNDEDCVSRRLPTDLHENLKIIVGLVPYHKETEDAHNEAEDSHMFEARNAHIHSQIAEMRDALRENDFHRTFELAEHDSLSLAATTMTGPEGWVYWKP

SEQ ID NO: 91531 - protein, 237 aa, Fragaria x ananassa
MAQSVTGIQIGGTSFPPAVKPPGSGNTLFLGGAGVRGMEIQGNFVKFTAIGVYLEDKAVPALSVKWKGKTAEELTESVEFFREIVTGPFEKFTQVTMILPLTGQQYSEKVSENCVAIWKKFGIYTDAEAKAIEKFIEVFKDQTFPPGASILFTQSPNGSLMIGISKDGSIPEVGNAVIENKLLSESVLESIIGKQGVSPEARKSVATRLSELLKESDHCVAGNEKVDECTKEAENKA

SEQ ID NO: 91532 - protein, 288 aa, Candidatus Pelagibacter ubique HTCC1002
MSSLREEELINILPKDGPTVEEVKKYLEKYNDEFIIIKCGGSVLVDPKLFKVFIEDVVVLKKLGFNPIIVHGGGKRINNKLSEVNIKSNFINGLRVTDKDTINIVKDVLIEFNKEIVEALNELDCKAKRITSKENNIITVEQEDKDLGFVGKPTGINKEFLTEIIKANEVPVIAPLGVDKDNQTFNINADTTAGSIAIELKARRLMIISDVEGVLDSEKKLIPEINSKKANELIDQEVISGGMIPKIKNCLDVASNGVKAVVIIDGRKNHSLLFELLSDKGSGTLIRE

SEQ ID NO: 91533 - protein, 451 aa, Alkalilimnicola ehrlichei MLHE-1
MEPHYDLLVIGGGSGGMATARRAASYGAKVALVERSRLGGTCVNVGCVPKKVMWSAAHTADALHRAADYGFRVGPATLDWAELKRRRDAYIRRLNGIYERNIDKSGITLLTGEARLADARTVEVNGERYTASHILLATGGRPSRPDIPGQELGIDSDGFFELAQQPRRVAVVGAGYIAVELAGVLHHLGTQTDLVVRREAALRSFDPLVRDSLLEAMDQDGITLQTHSVPKALERADDGTLTLALEDGRHIGGYDQVIWAIGRDLCTDGLGLEAAGVARNADGSIPVNAYQETNVQGVYAVGDIIGHHPLTPVAIAAGRRLADRLFGGQADRHLDYRYVPTVVFTHPPIGTVGLTEPEARAEYGDDEVEVFTTRFVAMDYALGEDKRRSAMKLVTVGDNRRVVGAHLFGVGSDEMLQGFAVAIRMGATKQDLDDTVAIHPTAAEELVTLPG

SEQ ID NO: 91534 - protein, 130 aa, Prochlorococcus marinus str. MIT 9215
MSSSQIIKNAEAIVSIDARGFIFGSAISLQTSKPMIVARKPGKLPGELIEERYKLEYGENSLFIQKKALNKFHSYAIVDDLLATGGTIDCVSKIISSKNKKIEGILVVIELNNLRGRAKLNFPIESMISL

SEQ ID NO: 91535 - protein, 400 aa, Xanthomonas oryzae pv. oryzae KACC10331
MATEVKVPVLPESVSDATIASWHKKPGEAVKRDENLVDLETDKVVLEVPSPVDGVLKEIKFEAGSTVTSNQILAIIEEGAVAAAAPADEKKAAAPAAAAPAAAPAAAAAPAPASKSAADSLPPGARFSAITQGVDPSQVEGTGRRGAVTKEDIVNFAKAGGVGKASGARPEERVPMTRVRKTIAKRLMESKNSTAMLTTFNEVNLAKVSAARKELQDEFQKAHGIKLGFMSFFVKAAANALQRFPLVNASIDGDDIIYHGYSDISIAVSTDKGLVTPVLRNVERQSFADVEQGIADYAAKARAGKLGLDDLQGGTFTITNGGTFGSLLSTPIINPPQSAILGMHTIKERPIAENGQVVIAPMMYLALSYDHRIIDGKDSVQFLVDIKNQLENPGRMLFGL

SEQ ID NO: 91536 - protein, 143 aa, Zea mays
  misc_feature (14)..(14): Xaa can be any naturally occurring amino acid
MSCVPTMPGIALKXPHIEAAVADISKPRIEGWNSDTLPIYEPGLDDVVKQRRRRNLFFSTDDDKHVAEADIIFVSVNTPTKTRGLGAGKAADLTYWESADRMIADVSKSDKIVVEKSTVPVKTAEAIEKILTHNSKGINLPDP

SEQ ID NO: 91537 - protein, 152 aa, Neisseria gonorrhoeae
  misc_feature (94)..(94): Xaa can be any naturally occurring amino acid
  misc_feature (139)..(139): Xaa can be any naturally occurring amino acid
GSHMAATYKKPSDAELKRTLTEEQYQVTQNSATEYAFSHEYDHLFKPGIYVDVVSGEPLFSSADKYDSGCGWPSFTRPIDAKSVTEHDDFSFNXRRTEVRSRAADSHLGHVFPDGPRDKGGLRYCINGASLKFIPLEQXDAAGYGALKGEVK

SEQ ID NO: 91538 - protein, 193 aa, Brassica napus
LEFHGRPLLGRELRLDVAQERGERPAYTPQSGTGNNSRSGGGGGQEVFVKGFDSSLAPNDIKSALTEHFASCGEITRVSVPVDRETGGSRGIAYVEFKEGTEKAFELNGSDMGGWNLVVDQPRPKENNSGGGFNSGGGFNSGRSNSFSGGRDNFRGRGSGRDGFRGRGRGGRDNGRGRPSFTSQGKKTVFNDE

SEQ ID NO: 91539 - protein, 215 aa, Bartonella henselae str. Houston-1
MTEYSSLSGIFFHNWVFIRGVPTIRFLPPEGPPEIAFAGRSNVGKSSLINALVRQKSLARTSNMPGRTQELNYFVPDGFSGRPEDLPPIALVDMPGYGFAKAPKNLVDAWTDLIYSYLRGRTTLKRVYVLIDSRHGIKKNDAEILELLDKAAVSYQIVLTKSDKIKSSVLEQRIITTKTKLLKRPAAYPEILATSSEKAFGLEELRAAILQTIAV

SEQ ID NO: 91540 - protein, 216 aa, Legionella pneumophila str. Lens
MSELKIKAAKAAIAYIEDDMVIGVGTGSTVNFFIKELAAIKHKIEACVASSKATEALLRAEGIPVIDLNSVQDLPIYVDGADEVNERGEMIKGGGGALTREKIVANVATQFICIVDESKVVKRLGEFPVAVEVIPMARSFVARQIVKLGGDPEYREGFITDNGNIILDVFNLNFSTPMALEDSLNVIPGVVENGVFAKRLADKVLVASASGVNNLK

SEQ ID NO: 91541 - protein, 394 aa, Oryza sativa Japonica Group
MIMEDLIVSLDPEVTNFVFQQEERLFQMWYPDSFIRIIGTDSLIRTHGLLHRHIKNLALRLFGPENLRREIIHDVQKTVEASLSSWLNQPSIELKEAVSSMIFKVTAKKLISYDSSTSDGKMWKQYDAFTQGLFAFPLCIPGTAFYKCMQGRKNVIKMLKEILDERKNTEEHHESVDFFDVIEEVKAKNPDQMTENAVLDLLFLLLFASFETTSSGITAMLIFLTDNPEALQELIEEHNNIRKRKADKNSEITWEEYKSMKFTSHVIHEALRLASIAPVMFREAIEDVHIKGFAIPKGSKIMICPYTVHLNPVVYKDPNTFNPWRWKWCLQGFHGLWRGAALVCWCSFCQAADGGFPPLPSHKSSWKAIKGGRMALSPGLRFPEGFHIQLFPKA

SEQ ID NO: 91542 - protein, 206 aa, Bartonella henselae str. Houston-1
MERTLVLIRHGQSEWNLKNLFTGWKDPGLTEKGRTEAIAAGKKLKETGLKFDIAYTSALQRAQKTAQNILEQMEQSDLELIKTPALNERNYGDLSGLNKDEVRQKWGEQQVQIWRRSYTIAPPNGESLRDTGARVWPYYLHHIQPHILRSQTVLIAAHGNSLRALIMALEGLNSEEIISQELATGIPIVYTFNSDSTISSKTIITP

SEQ ID NO: 91543 - protein, 284 aa, Arabidopsis thaliana
MAERGGEGGAERGGDRGDFGRGFGGGRGGGRGRDRGPRGRGRRGGRASEETKWVPVTKLGRLVADNKITKLEQIYLHSLPVKEYQIIDHLVGPTLKDEVMKIMPVQKQTRAGQRTRFKAFVVVGDGNGHVGLGVKCSKEVATAIRGAIILAKLSVVPVRRGYWGNKIGKPHTVPCKVTGKCGSVTVRMVPAPRGSGIVAARVPKKVLQFAGIDDVFTSSRGSTKTLGNFVKATFDCLQKTYGFLTPEFWKETRFSRSPYQEHTDFLSTKAVSATKVITEGEDQA

SEQ ID NO: 91544 - protein, 354 aa, Bartonella henselae str. Houston-1
MEQQYILGKYTRVVVHKKNAIFGAGSKQFIINDRKHWENLVLLAAQWIEKKTKEETYNSLSSIMSRENFNRAFNFLFSNHFLVLAETSDNIFHNRYSRSHLHYQSYGMHPASVQHTLSQKVVVILGCGGIGNHVSAILASSGVGKLILVDNDVIEMTNLTRQILFTEEDIGLPKTTVLQRELIRRNSQSEVHELQMFITEKEDINKLPKADLWIISADSPDMLRPWINEWCVKNKQAYINSGYVNDIAIFGPFYIPGQTGCYACSTSIENLPEKGDSLIHEACTAINNNFKVATFPPVNALSAAMCANDALKFLGGYGNLLSIDRRVGIWSSQLFTEERSLKKNPHCKVCGTPQ

SEQ ID NO: 91545 - protein, 571 aa, Methanosarcina barkeri str. Fusaro
MTLSPEDLKTIEKYAYQNAVKYGKAPQPKAVMGKVMGECPQLRSDPNAVSEALKVIIPEIAKGNPETWETKLSEIAPELIEALSVKKEPDKGLKPLEGAENGKVVMRFAPNPNGPATLGSARGMVVNSEYVKMYGGKFVLRFDDTDPDIKRPLLQAYDWYLDDFKWLGVVPDQVVYASDHFPMYYDYARKLIEMGKAYVCFCKGGDFKRFKDAKQSCPHRDTSPEENLMHWEKMLAGEYEDQQAVLRIKTDIKHKDPALRDWGAFRIRKMSHPRPEIGNKYVVWPLLDFAGAIEDHELGMTHIIRGKDLIDSEKRQGYIYKYFGWKYPRTTNWGRVKIHEFGKFSTSTLRKAIEAGEYSGWDDPRLPTIRAIRRRGIQAEALKKFMIEMGVGMTDVSISMESLYAENRKIVDPIANRYFFVWNPVELEITDAEPTVAKLPLHPTDHKRGFREIAVGNKVLVCTEDVEKLEVGSIIRLKDFCNIEITSLSPLQAKLSDVSLEALKKAKAKIIHWAPLDGINVKVRGPEGDLNGIGEQGIAAELDKIVQFERFGFCRIDAVSEDEIVAYFAHK

SEQ ID NO: 91546 - protein, 178 aa, Frankia sp. EAN1pec
MRQDGNVAIYALGDLEPSIDPSAYVHPDATVIGNVTIGPESTVWPGVVLRGDQGRIVIGARTSIQDGTVIHTTAQFPTIVGDDCVIGHIVHLEGCVVEDGSLVGSGSIVLHQARVARGALVAAGAVVGNRMVVPERAMALGIPAKIREGAASQELITMAAAHYVENGRRFRKDLRRLD

SEQ ID NO: 91547 - protein, 170 aa, Zea mays
  misc_feature (153)..(153): Xaa can be any naturally occurring amino acid
MEADTNARPAKENGRAPAVAEVVAQEAAADPRLQGISDAIRVVPHFPKHGIMFNDITTLLLRPRVFKDAVDLFVERYRGMRIDAVAGIEARGFIFGPAVALAIGAKFIPLRKPRKLPGEVISEKYVLEYGTDCLEMQAEPIERPGERVLITDXLVATGGTLLCCNQASCS

SEQ ID NO: 91548 - protein, 569 aa, Onion yellows phytoplasma OY-M
MQKQSNFIKTIIQKDLQSGKCSQIITRFPPEPNGFLHLGHARAIIINFELAHFFEGKTLLRYDDTNPSKEKQIYVNAILNDIKWLGYTPYKITFASDYFPQMYQMALFLIKQGKAYVDDQTAEQIAQSRGNLTQKGTNSPYRNRSIEENILLFEQMKKGKFVEGSKVLRAKIDMQSPNLNLRDPILYRILSAFTLKQKHWHIFPTYDYAHPLEDSFENITHSLCSLEFEDHRPLYDWIIKETKAKHTPRQIEFGRLNLTQTLMSKRHLNNLVEKNLVTGWDDPRMPTLSGIRKKGYTPEAIKNFVLETGLSKVNSQVKQEMLESFVRDDLKGKSLPRMAVINPLKLTITNFPENQIENLKAPWTNNFHTCKCCNTSQTQGKTPEQNQEQTKGKEQTQEREIYFSRHLYIEKDDFALQKPDKNYKRLTLGEEVRLFHAYFVKAYDVVKNNKGEITEILATYDPQTKSGSGFKDRKPNGTIHFVEAKTACKATFNFFAPLLCTNGNFNYKSWHIKKGFVESSLQKSCCCKNHLQFLRQGYFAADKITKDTNGKTQELNFNEVVSLKSNPQK

SEQ ID NO: 91549 - protein, 316 aa, Pseudomonas aeruginosa UCBPP-PA14
MADFEILCFGETMAMFVAEQPGELDRVEQFGKRIAGADSNVAIGLARLGFAVAWLSRVGDDSLGRFVLDSLTREGLDCRFVEVDAQAPTGFQMKSREVDGADPRVEYFRRGSAASRLGLAHIREEMLGARHLHATGIPPALSASACELSHELMRRMRGKGASLSFDPNLRPSLWPSERRMIAEINALAAHAHWVLPGLEEGRLLSGWQEPADIAAFYLDMGVDAVAIKLGPSGAYYRDAHGEGLVPGVPVATVVDTVGAGDGFAVGVVSALLEGLPLPDAVARGNWIGSRAVQVRGDMEGLPKRSQLLDREHRKSA

SEQ ID NO: 91550 - protein, 729 aa, Haloarcula marismortui ATCC 43049
MGLFDRIRRAVGGDDSSTDGDERTAKDNGPSDDGPDRLDTAALDPTTFREYAENVVDGADPLTFDPDALARLDTAIEESYGGETVGDAAGTTTYTENTVRFGSYLGELLVRAYDGEWVQSDGRWGVTVSGPDDEVTVAVFDVAARSFGDEPVFAAVVTRLESELALDSIQTPDGDGRADLEADETDADSVVSEPTRIVSRVGDAQADERGEAPAGDTTDSEPSQAVETEPTRIVKRVESESEADDRSDDTDPTPVASAVDDEPENEPPRGSDDPDSNESADSDTTDSVSDAAGSEPPATAATEEESIADPSDRPAADDTAPERSADDTALERSADDTATEWLADDTADEQPTVETLAEESAVDDSADEPAADTTNAVETTTDAAAADEPVAYIDEAESSFDSATADSSDETTAAETPSEDSAVDSRDEDGTDDTTPARAATDTADDEAATDTAADEAATDTADDTSSDTSMDDEPIRDSSPDALSDAVPDAEAAAETTADESPADIADTRADDTLAAVSDSDTTELFDDSPNTSAPVADVKATDTSEHAASQDVTADETAATADTDESDLSAPSDSDSTASSMARSWESGTVRADHADTAVEFADFWGEHDLDFSPASLSRLDDLVDAEWDDERFAETTFGSDASFDDRAFSSVVRELGGYFGEVLVRHLDGDWTDETDHEAAVVVGGPAGQFAVPVFKVAITSLRKQAVFGRSYDALLDDLGREGPAR

SEQ ID NO: 91551 - protein, 358 aa, Fusobacterium nucleatum subsp. nucleatum ATCC 25586
MYNRQLILEDGTVYKGYAFGADVENVGEVVFNTSMTGYQEILSDPSYNGQIVTLTYPLIGNYGINRDDFESMKPCIKGMVVKEVCATPSNFRSEKTLDEALKDFGIPGIYGIDTRALTRKLRSKGVVKGCLVSIDRNVDEVVAELKKTVLPTNQIEQVSSKSISPALGRGRRVVLVDLGMKIGIVRELVSRGCDVIVVPYNTTAEEVLRLEPDGVMLTNGPGDPEDAKESIEMIKGIINKVTIFGICMGHQLVSLACGAKTYKLKFGHRGGNHPVKNILTGRVDITSQNHGYAVDIDSLNDTDLELTHIAINDRSCEGVRHKKYPVFTVQFHPEAAAGPHDTSYLFDEFIKNIDNNMK

SEQ ID NO: 91552 - protein, 304 aa, Frankia sp. EAN1pec
MSTVDAPPSTLRPAPAALLDLGLDVAREAGALLVTGRAGTVAAEATKSSPTDVVTALDRASEALVARRLREARPDDGLLGEEGSDTAGTSGVRWIVDPLDGTVNFLYRLPNWAVSIAAELDGEIVAGVVHAPAMGVTYTAVRGGGAFRWETPVGTDRGGDQGAGTGAGAPLGPTAGEPTKLTGSAVTELGGALVATGFGYTERRRTTQAAVLTRVVPRVRDIRRMGAASLDLCAAAAGIVDAYYERGLHPWDHAAGALIAAEAGLRVGGLDGREVSEDLVIAAPPSLFANLTALLAEHPRADTD

SEQ ID NO: 91553 - protein, 398 aa, Oryza sativa
SAAPTETSLLSPLSRVHGGSDPPQPIRCKAAVCRAAGEPLAVEEIVVDPPKAHEVRIKIVCTSLCHSDVTFWRMQDFPGVFPRIFGHEAFGVVESVGEHVEGFAAGDPVVPTFLGQCTECVDCASERSNVCSTYRFAVRPGMPRDGTARFRDRHGAPIHHFLGVSSFSEYTVVDANQVVRVDPAVPPATASLLSCGATTGVGAAWKLAKVEPGSSVAIFGLGAVGLAVAEGARICGASTIIGVDLNPEKHELGKKFGVTHFINPQELGDKPVSQAIIEMTDGGADYCFECIGLASVMSDAFRSSREGWGKTIILGVEMHGAPLSIPSLEILNGKCVMGSLFGGVKPKQDIPILADKYLNKELELDKFITHEVPLKDINTAFDLLLQGKSLRCTIWMDK

SEQ ID NO: 91554 - protein, 548 aa, Bradyrhizobium sp. BTAi1
MLADPENQRDNHARAAVLDEAHIGDIKGAFGSIQRGDELPRASLKARLTTLLAIIGPGLIVMVGDNDAGAFGTYTQAGQVYGTRLLWVLLVLVPVLYVNQEMVLRLGVVTGVGHARLILERFGKFWGAFSVIDLFILNALTIVTEFIGISLGMDYLGIPKMFGVPISAVLIVAAASTGSFKRFEQVCMALVAGSLLLVPIFVMAHPSGGQMLHDFVVPGLPKGSDLSAVVLLIIAIIGTTIAPWQLFFQQSYLIDKRITPRFMNYERTDLWIGIAIVIIGAAAIIAFTAATFAGHPEFGNFTDAEGVAQGLQKYVGHVAGVLFALALIDASIIGAAAVGLATSYALGDVLGLKHSLHRKISDAKGFYAVFAGILFVSAIVVLVPGSPLGLLTVGVQVLAGVLLPSATVFLLLLCNDTEVVGPWVNGLFANLFTSAVIAVLVVLSLVLTASVLFPDISAQTIILILEIGAAVSAVSAAAFFTYRRLHPAAPKVAVDTSLRATWRMAPLALLKAPQLSAEVRIGLTVLRTYLLIAMILVIVRVVEVALGH

SEQ ID NO: 91555 - protein, 339 aa, Medicago truncatula
MATTTATRSFLQAVATEEVATPLRVVQMEGLVILKIIKHCKDHSPSLVTGQLLGLDVGSVLEVTNCFPFPMREEDEEIEADGANYQLEMMRCLREVNVDNNTVGWYQSTLLGSYQTVELIETFMNYQENIRRCVCIIYDPSRADQGVLALKALKLSDSFMELYRSNNFTGEKLREKNLSWVDIFEEIPIKVSNSALISAFMTELEPDTPVTQCDFDRLQLSTSSLMERNMEFLIECMDDLSIEQQKFQFHYRSLSRQQAQQQAWLQKRRADNMARRAAGEEPLPEEDPANPIFKPLAEPSRLESFLITNQISNYCNQINGVAGQSFNRLYLLKALHEED

SEQ ID NO: 91556 - protein, 419 aa, Prochlorococcus marinus str. MIT 9211
MMTINEKNLAKLTRKDFPLFSSEDLKNNPLVYLDHAATSQKPKKVIEAISHYYKYENANVHRGAHQLSAKATEAFEKARTITSKFINASSEREIVFTRNATEAINLVAHSWGDSELKEGDEILISLMEHHSNIVPWQLLAERKKCNLRYIGITSSGQLDLEDAYSKLNEKTRILSLQHISNTLGCCNPIAEITQKAHSADALILVDACQSLAHQPIDVKKLNIDFLAGSSHKLCGPTGCGFLWAKENLLEKMPPFLGGGEMIQEVSLNKSSWADLPHKFEAGTPAIGEAIGMGAALTYLESIGLNNIHAYEKKLTKYLFQQLETIEGINIIGPNPKIQSNRAPLATFTINKLHSNDIASLLDTSNICIRSGHHCCQPLHKHYGISSSARASLSFTSTIDEIDTFVSQLISSINFLQENS

SEQ ID NO: 91557 - protein, 491 aa, Oryza sativa Japonica Group
MGSTSRPVDDEVLDAATGVHYSALRLEELNMNGSVSGEDQPTTSGVENGHQEPFVIGVAGGASSGKSTVCKMIIDQLRDQRVVVVTQESFYYGLSDEELVHVHDYNFDHPDAFDTELLLSCMENLKHGKAVDIPNYNFKTYKSVASARKVNPSDVIILEGILVFHDSRVRDLMNMKIFVDTDADVRLTRRIRRDTIEKGRDIKTVLDQYSKFVKPAFEDFILPTKKYADIIIPRGGDNDVAIDLIVQHIRTKLGQHDLCKVHPNLYVIQTTYQIRGMHTIIRDAATTTHDFIFYADRLIRLVVEHGLGHLPFKEKQVITPTGSVYTGVEFSKRLCGISVIRSGESMENALRACCKGIKIGKILIHREGDNGKQLIYHNVPKDIANRHVLLLDPILGTGNSAVQAISLLLKKGVQETNIIFLNLISAPQGVHVVSKRFPRVKIVTSEIDFGLNDDFRVIPGMGEFGDRYFGTDDYQSSTPFFCDEKNRVRLL

SEQ ID NO: 91558 - protein, 394 aa, Alvinella pompejana epibiont 7G3
MNLEELDKQFVLQTYARDYTNFVRGENATLFSEDGRDFIDFASGIGVSSVGHGNRRLSDAVCEQVRNIIHISNLQVIEPQVKLAQKICELSGYDGAIFFANSGAEANEGAIKVARKYGEVNFDKKRYKVITLEHSFHGRTISTLKATGQKSFHTPSFSPYPDGFLYVKSIEDIYGSIDDETVAVLIELVQGEGGVEPFSIGEVQNLAKFLRENGILLIVDEVQTGVFRTGEMLASNIYQIEPDIITLAKGLGGGVPIGAILTKHRDILKAGEHGSTFGGNYLSTRAGLEVLSILNGLYESGELKETISYFEERLKGIRERFSNLFSQDVGVGLMRGLRAEEADIPSKVVKSSMDSGLIVLKAGRNTVRFLPPLTISKSEIDKGFERFEKAISSI

SEQ ID NO: 91559 - protein, 391 aa, Alkalilimnicola ehrlichei MLHE-1
MNLHEFQAKHLFADYDIPIPQGYVARSSGEAVEAAGRLGGSVWVVKAQVHAGGRGKAGGVKVLKTKEEVEEFTDSLLGSRLVTHQTDAKGQPIHAVLVEQGLDIARELYLGALVDRASKRVTFMGSAAGGMDIEEVAASTPEKILTLAVDPAAGFQAYQGRKMAFALGLEGKQIGQLVKIMKSLYRIFEEKDLSMIEINPLIVTGDGQLLALDAKVNVDDNAVEIGRQPQIADMRDITQEDEAEVQAAEHNLNYITLDGNIGCMVNGAGLAMATMDVVNLHGGSPANFLDVGGGTTTERVTAAFKLILSSDTVEGILVNIFGGIVRCDVIAEGIIAAVKEVGVDVPVVVRLEGTNVEQGKQMLADSGMDLIPADDLTDAAKKVVAAVGKAA

SEQ ID NO: 91560 - protein, 159 aa, Buchnera aphidicola
MRRILSILLENESGALSRVIGLFSQRGYNIETITLAPTEDPTLSKMTIQTIGDEKNIEQIEKQLHKLIDVLRVVQIDQFSHIEREIMLVKVQINTSSKRDDIKHTTEVFRGQIVDMTSTTYILQLSGTTKKLNSFLKVIRKISDIIEISRSGIVGISRG

SEQ ID NO: 91561 - protein, 174 aa, Arabidopsis thaliana
  misc_feature (167)..(167): Xaa can be any naturally occurring amino acid
MDHDKTGCQSPPEGPKLCTNNCGFFGSAATMNMCSKCHKDMLFQQEQGAKFASAVSGTSSSSNIIKETFTAALVDIETKSVEPMTVSVQPSSVQVVAEVVAPEEAAKPKGPSRCTTCNKRVGLTGFKCRCGSLFCGTHRYADVHDCSFNYHAAAQEAIAKANPVVKXAEKLDKI

SEQ ID NO: 91562 - protein, 509 aa, Aspergillus oryzae
MRSRRTSGASVCERPLLGARSEELEDSDSKDFSNKRHLGLFSTALLLTNRMIGAAIFSVPSSIFLSVGSVGAALSLWVVGILLTFCGFYIYLELGCLMPRTGGEKVYFDTAYPRPYRLASTLYAFYVVFGFPGMASIVVADNTLLAFNIVPSEIVQRLAAVGIMALVAACLSISREWSVRIVNSLSLLKLATFLLILATAFAIVVGVLPNNVDTGSNFRQPFAGSSTTVYDYTVSLFKVLESFLGWNSAGMVLGEVKNPQRTLKVAGLLGVGSVGILYLLINVSYFIVATPDDISRAGVQLVARLLGNLFGSAASRVTAAMVALSTFGSMISTAFAVTRVIRELALEGIIPAAGILSKMSKSGNPASATSVFMFGPSVVAVLLLPFGDAYAFLLDVNQYFLVMVYGAIVVALFIIRRHVPSAQYPFRVWTWVPYLFLACQVFLLLSPLVSPSGAGDTNLPFWLAPAVSFLVIGLGVMYWRLKSFVAPVGEEPIWTRRDNLQSYRSVAAS

SEQ ID NO: 91563 - protein, 434 aa, Ralstonia eutropha JMP134
MQLLAIGINHTTAPVSLRERVAFPLEQIKPALGALRTHLAGRNGTEAAILSTCNRTEIYCATDILKPGAEGFEHTLRWLSQHHNVPASDLAPHLYSLPQSEAVRHAFRVASGLDSMVLGETQILGQLKDAVRTAGEAGSLGTYLNQLFQRTFAVAKEVRGQTEIGAHSVSMAAAAVRLAQRIFESVSTQRVLFIGAGEMIELCATHFAAQKPRQVVVANRTVERGEKLAEQLAEQGLTTQAIRLQELGERLHEFDIVVSCTASSLPIIGLGAVERAVKRRKHRPIMMVDLAVPRDVEPEVARLDDVFLYTVDDLGAVVREGNALRQAAVAQAEAIIESRVQNFMHWLETRSVVPVIRELQTAGESIRQAELERARRMLARGDDPEAVLEALSGALTRKFLHGPTHALNHMQGEDREALVRLVPGLFRQSSHSER

SEQ ID NO: 91564 - protein, 420 aa, Lupinus angustifolius
MASVNQSVSVSPTASSDSVFAHLLPAPEDPILGVTVAYNKDPSPVKLNLGVGAYRTEEGKPLVLNVVRRVEQQLVNEASRNKEYLPIVGVADFNKLSARLIFGADSPAIQENRVTTVQCLSGTGSLRVGGEFLARHYHQRTIYIPQPTWGNHPKIFTLAGLSVKTYRYYAPATRGLDFEGLLEDLGSAPSGSIVLLHACAHNPTGVDPTTEQWEQIRKLLRSKALLPFFDSAYQGFASGSLDIDAQAVRLFVADGGELLLAQSYAKNMGLYGERVGALSIVSKSADVASRVESQVKLVVRPMYSNPPIHGASIVAAILRDRDLYNEWTIELKAMADRIIKMRQQLFDALQSRGTPGDWSHIIKQIGMFTFTGLNAEQVSFLTKEYHIYLTSDGRISMAGLSSKTVPHLADAIHAAVTRVV

SEQ ID NO: 91565 - protein, 338 aa, Debaryomyces hansenii CBS767
MSTNDLPSTQKVVLFEENSDSVDVIKYTDFDTPKIAAPNEIIIKNKFAGVNFIDSYFRKGIYPSQKPHIFGREAVGVVAAVGDKVTKFSVGDKVAYLSGSTFAQYTKLTDSYVQILKLDPSTSDESLKFYAAALLQGLTALTFIHEAYAVKKGDYVLVWAAAGGVGKILTQLISQQGAHVIAIASTEEKLALAKKYGAEYGVNHLTDDIVEKVKEITDGKGVNASFDSVGKDSAEISLTSLARKGTFVSYGNSSGVVPPLSINRLSPKNLTVLRPQLLGYLTTSEEWEHYVRLLFKLIDSGDLKIDILKTYPLSEYKQATSDLEGRKTTGKLVLEVPQ

SEQ ID NO: 91566 - protein, 343 aa, Oceanobacter sp. RED65
MSIKIAINGFGRIGRCVLRSIYERNLENDIQVVAINELADIETMSYMLRYDSTHGRFPHEVQIHDDQLLIDGDAIQVFHHKHIDQLPWQDTNVDVVLDCTGKFKSHEQLSGHIKQGAKKVLLSQPGDSDVDYTFIAGVNDQDLTNDHKIVSVGSCSTNCVLPIMKILDEMFHIESGMSTTIHSAMNDQSVIDAYSKDLRRTRAAVTSIIPVDTALPKGIARIMPHLDGRIESLHMRVPTLNVSAMDLTLQLKHSCSVEQINGLLKASSEQDLKHIIGYSDEPHASVDFNHDAHSGVVDGTQTRVSGNHLLKLLVWFDNEWGFANRMVDVLQHSSFNQDVQSRD

SEQ ID NO: 91567 - protein, 730 aa, Ralstonia eutropha JMP134
MSYQVLARKWRPRDFTTLVGQEHVVRALTHALEQQRLHHAYLFTGTRGVGKTTLSRILAKALNCTGADGNGGITAQPCGQCKACTEIDSGRFVDYIEMDAASNRGVDEMAQLLDKAVYAPTAGRFKVYMIDEVHMLTNHAFNAMLKTLEEPPGHVKFILATTDPQKIPVTVLSRCLQFNLKQMPPAQIVSHLDNILGQEGIGHDGNALRLLAQAAHGSMRDALSLTDQAIAYSAGEVSEEAVRGMLGAIDQGYLVQLLDALAAEDGAALIGIADAMADRSLSFAGALQDLGSLLHKIALAQAVPASVQDEWPEAGDVRRLAGVFDAQEVQLFYQIANLGRSELALAPDEYAGFTMTLLRMLAFRPSSTPEPLPASAPGQGGGATPRARTVAASAPVVAEPVARYAESAASPTPAPAPAPAAQAPAVAAPARQDAGGDAPMSPARAALAAARQASAARGGGSGSGRALAAAPMSTPAGGAARQPAQPLRAPAPAAAASRPAPAPTARPVPPAAAPAPARKPAPQAESAPPWEASGGSDIPPWEDLPPDLPVFGPYDNEPVSLPTKAAAPARASKPEAPAPEAPRPRPVAKAVPPRPPAAAEDGTPPVFTGEWPTLAANLPLKGLPQQLAYQSELTQVVGRTFNLRIPVAALGENGVAERLQQVLSDHFGVPVRVQCEIGAVSETAAAADAQARAERQREAEANIEADPFVQGLLRDFGGQIVPGSIQPRVA

SEQ ID NO: 91568 - protein, 529 aa, Physcomitrella patens subsp. patens
MATKTSIEHILGKTADDGRLKIAKTKIICTLGPKSREVPVLEKLLKAGMNVARFNFSHGTHEYQQYTLDNLRQACLNTQTMCAVLLDTKGPEIRTGQLASGKPIQLVRDKEIWITTDYTHLGDENMIAMSYKKLATDLQPGNIILCSDGSITMTVLECDVEKGMVKCRCENTAMLGEKKNVNLPGVVVDLPTITEKDIDDIMTWGVPNKIDFIAASFVRKGSDVLAIKKLLGEASKSIHIISKVENQEGLVNFDDILKETDGVMVARGDLGMEIPTEKIFLAQKMMIYKCNSAGKPVVTATQMLESMIKSPRPTRAEATDVANAVLDGTDCVMLSGETANGSYPELAVAVMSHICQEAEAALDHESIFKEIMKSVPLPMSPLESLASSAVRTCAKVCASLIIVLTRGGSTARLVAKYRPFVPILSVAVPVMTTDHLTWTCSEESPAHHSLVVSRRALVCRGLIPLLAEGSAKATDSESTDDILNDAIGYALKRKLCLVGDSIVALHRIGVASVIKIMEVKEPTHSFPMV

SEQ ID NO: 91569 - protein, 77 aa, Nesoluma polynesiacum
TIQCLSGTGSLRVGAEFLARHYHERTIYIPQPTWGNHPKIFTLGGLSVKTYRYYDPATCGLNFQGLVEDLGSASSGA

SEQ ID NO: 91570 - protein, 360 aa, Blastopirellula marina DSM 3645
MLHAVIMAGGAGTRFWPASRVDRPKQLLDLTGDGTMIQATASRLGDLMSPERILIVTNERLIEPIQQQFPSLPASAIVGEPCKRDTAPCIGLAALLVARHDPDAIMVVMPSDHVISPESAFQSAIRYGAALVADSADKIVTFGIQPKYPAETFGYIERGDSLTSDAEAPPTFSVARFREKPKGDVAREYFESGRFYWNSGIFIWKAKTILDALRRHEPEMFAHLEAIGAAWGTPEQAETFTAEFTAIRGKSIDYAVMEHHQDVAVIEAPFLWDDVGNWQSLQRLNDSDLDGNTVLANHLGIDTQQCIIKADDDHLIVTLGMREVIVVHTRDATLVADKNREEEIREVVKQLQANGWDAHL

SEQ ID NO: 91571 - protein, 639 aa, Oryza sativa Japonica Group
MLSARAAATAAAAAASPLWKRGEGGSSGSGSGCTSCREVRRRAAAVRVRAAAPRRVEAVAMESAAETEKKEEVAAAGGGVEDMATEEVPVTPWAFSVASGYTLLRDPHHNKGLAFSEKERDAHYLRGLLPPAVVSQDLQVKKIMHNLRQYSVPLQRYMAMMDLQERNERLFYKLLIDNVEELLPVVYTPTVGEACQKYGSIFRQPQGLYVSLKDKGKVLDVLRNWPERNIQVIVVTDGERILGLGDLGCQGMGIPVGKLSLYTALGGVRPSACLPITIDVGTNNEQLLNDEFYIGLRQRRATGKEYHELMEEFMSAVKQIYGEKVLIQFEDFANHNAFDLLAKYSKSHLVFNDDIQGTASVVLAGLLSSLKVVGGTLAEHTYLFLGAGEAGTGIAELIALEISKQTKAPIEECRKKVWLLDSKGLIVNSRKESLQAFKKPWAHEHEPVTTLLDAVQSIKPTVLIGTSGVGKTFTKEVIEAMASFNERPVIFSLSNPTSHSECTAEEAYNWSQGRAVFASGSPFDPVEYNGKIHVPGQSNNAYIFPGFGLGVVISGAVRVHEDMLLAASETLADQATQENFEKGSIFPPFTNIRKISARIAASVAAKAYELGLATRLPQPRDLEKYAESCMYTPVYRSYR

SEQ ID NO: 91572 - protein, 410 aa, Blastopirellula marina DSM 3645
MPPEFVARCREQFPALRREQNGQPIVYWDGPAGTQVPQSVADAVSDYLLHHNANTHGAFATSRETDALMDDAHAAVADLLGAGYSDLIAFGANMTSLTFALSRALARTWRPGDEIIVSGLDHDANVSPWVLAAQDAGVSVKQIAVRLDDCTLDLEDFRSKLSSKTKLVAVGCASNAVGTINPVAEITRLAHDAGALVFLDAVHYAPHALIDVTDWGCDFLACSAYKFFGPHVGILYGQRMRMETLRPYKLRPAPESLPGRWMTGTQNFEGISGVVAAIEYLSQIAGVGGSRRDQLKATYAKIVAYEQTLSAKLLAGLETIDAVSVYGMTDPRRLEERLPTFSIRHQALPPKQLAKYLSDRGVFAWHGNYYALPLTEALGLEPEGAVRLGMVHYNTPDEIDRVLAILRELE

SEQ ID NO: 91573 - protein, 880 aa, Medicago truncatula
MNFRFQNLLGAPYRGGNAVISNNTLLLSPVGNRVSVTDLRKSQTTTLPIQSSSNISRIAVSPDGTFLLAIDENNRCLFINLRRRALLHRITFKHRVGAVKFSPDGKLIAVAAGKLVQIWRSPAFRKEYFPFELIRTFADFHAKVTAFDWSSDSNYLLVASKDLTARILCLKKVYGGVKYKPFLFLGHRDSVVGSFFGVDSKTSKVSKVYTVTRDCYILSWGFTEDEELSEPPSPGTPDRDVEGDLMVEDDGDVKKRKEREFEDGGYLCKGKWELLRKDCFNQAPAKVSACDYHRGLDMVVVGFSNGVFGLYQMPDFVCIHLLSISKAKITTAMFNDLGNWLSFGCAKLGQLLVWEWRSESYILKQQGHYFDVNCVAYSQDSQLLATGADDNKVKVWTVSSGFCFVTFSEHTNAVTALHFMASNNCLLSASLDGTIRAWDLVRYRNFRTFTTPSSRQFVSLAADQSGEVICAGTSDSFEIFVWSMRTGRLLDVLSGHEAPVHGLVFSPTNAVLASSSWDKTVRLWDVFDGKGAVETWPHTHDVLTVVFRPDGKQLACSTLDGQIYFWDPVDGLLMYTIEGSRDIAGGRLMTDRRTAANSSTGKCFTTLCYSADGSYILAGGSSRYICMYDVADQVLLRRFQITHNLSLDGVLDFLNSKNMTEAGPLDLIDDYNSDVEEGVETQTRGKLGLDLPGSVSNRGRPIIQTKCLRIAPTGRSFVAATTEGVLVYSVDESFIFDPTDLDIDVTPEAVDKALNENQPSRALILSLRLNEDSFIKKCIFTVSPADIPAVATSIPYKYLQRLIEALASLLENCPHLEFILRWSQELCKAHANSIQQNSRNLLPSLKSLQKSITSIHQDLADTCSSNEYMLRYLCSSSASK

SEQ ID NO: 91574 - protein, 159 aa, Buchnera aphidicola
MKRIISVLLENESGALSRVVGLFSQRGYNIESITVAPTEDSSISKITIQTMGDKKIIEQIEKQLHKLIDVLRVTEIEYENHLEREIILIKNQKYNSNTRKEIKQITDIFEGIIVKLTSLYYIIQLSGTSNKIDSYLAVIRNISEIIEISRSGVISISRN

SEQ ID NO: 91575 - protein, 96 aa, Zea mays
MASSNGQTEAPAPSVPKNPAMASCRKKKTDDATFLEDLKDHMDEFIHASMDEHKSCFKKTIQKMFGMSKAVAERSAAEANKAEVESALPLQTSVSQ

SEQ ID NO: 91576 - protein, 449 aa, Xanthomonas oryzae pv. oryzae KACC10331
MRVAIFGTGYVGLVTGTCLAEVGHHVICVDIDRAKVDGLNRGVIPIYEPGLEPMVKANHASGRLRFTTDAAEAIAHGEITFIAVGTPPDEDGSADLQYVLAVARTVGRHIDGPAIVVNKSTVPVGTADKVRVAIQEELDARGVDHEFDVVSNPEFLKEGDAVADCMRPDRIVIGAKKPAAIARMRRLYAPFNRNRDRIVEMDVRSAELTKYAANAMLATKISFMNEIANIAERVGADVEHVRNGIGSDPRIGWHFIYPGAGYGGSCFPKDVQALAKTAEQYGMQPTLLNAVESVNNAQKGHLFELVQRHYGTEGTGSVAGKTFAVWGLAFKPNTDDMRAASSRRLMEQLWEAGATVRAYDPEATHEAKRIFGERDDLTFCDDAFSALQGADALVVVTEWKQFRSPDFGKIKQALKDDVVFDGRNLYDPQEIEAAGLAYYAIGRGRSLHA

SEQ ID NO: 91577 - protein, 653 aa, Salmonella enterica subsp. enterica serovar Paratyphi A str.
MNRFIMANSQQCLGCHACEVACVMAHNDERHVLTPQRYQPRITVIKHQRQRSAVTCHHCEDAPCARSCPNGAIAHINDSVQVNAQKCIGCKSCVVACPFGTMQMVLTPVAPNQFKASAHKCDLCQGREQGPACVENCPADALQLVTEDSLTRLAKTRRLRTARQEIRPWHTVDTQHRGTASSKVERMQATPPRGEPDKLAIEARKTTFEEIYLPFRAAQAEREASRCLTCGEHSICEWTCPLHNHIPQWIELVKAGDIDAAVELSHQTNCLPEITGRVCPQDRLCEGACTLRDEYGAVTIGNIERYISDRALSKGWRPDLSDVQKSDKRVAIIGAGPAGLACADVLARHGVSATVYDRHPEIGGLLTFGIPAFKLDKSLLARRREIFSAMGIRFELNCEVGKDISLETLLESYDAVFVGVGTYRSMKADLPNEDAPGVYDALPFLIANTKQVMGLPALPDEPFIDTAGLNVVVLGGGDTAMDCVRTALRHGAANVTCAYRRDEANMPGSKKEVKNAREEGANFEFNVQPVELVLDTHGRASGIRFLRTRLGEPDGQGRRRPVPVPDSEFVMPADAVIMAFGFHPHGMSWLESHGVKVDNWGRIAASVESEFRYQTSNPKIFAGGDAVRGADLVVTAMAEGRHAAQGILDWLAK

SEQ ID NO: 91578 - protein, 291 aa, Candidatus Pelagibacter ubique HTCC1002
MKDINIFCFGFGQVAKNFIKKLSVEQYNINLSATSRSESSKKTFKGINYNSYLFNRDNFDQNLVVKLKEADHILVSIPPENQEDLVIKNFSKFIESSKVKWITYLSATSIYGDHKGEWVNENSKTNPISNNGIARLKAENAWFSLEKNKKIPIQIFRLSGIYSNEKNILIRLKSGGVKLINKKNHFFSRIHVDDISNILFKSLSKFKSGEIYNLSDDKPSTSEEVTLFGAKILNIENIEKIEVDQIKSEMLKNFYNESKKVSNKKMKSYFDYNLKFPSYIEGLNHISCNFI

SEQ ID NO: 91579 - protein, 386 aa, Oceanobacter sp. RED65
MSVLRMLDQDLKGKRVLIREDLNVPVKDGKVTSDARLRASMPTIKHALEAGAKVIVMSHLGRPTEGEYAEEFSMQPVANYLADALGKDVPVVKDFREGVDVAEGELVLLENVRFNKGEKKDEDDLAKAYAELCDVFVMDAFGTAHRAQASTHGVAKFAPVACAGPLLAAELDALGKALDKPERPLVAIVGGSKVSTKLEVLESLSDICDQIIVGGGIANTFLAAAGKPVGKSLCEEDLIPNAKALMEKVSIPVPTDVVCGKEFSESAEATLKDAADVAEDDMIFDIGPDSAKALAEQLKEAKTIIWNGPVGVFEFDQFGEGTKALSLAIAESQGFSIAGGGDTLAAVDKYEIADKVSYISTGGGAFLEFVEGKTLPAVAILEQRAK

SEQ ID NO: 91580 - protein, 288 aa, Brassica napus
ARRYVVALAGAGNAVDYLPFSRWVSDYEKRAMKLASRLDEFLQGLVDEKRDAKEKGNTMVDHLLSLQETQPDYFTDRIIKGNMVALILAGTDTSAVTLEWALSNLLNHPDVLKKARDEIDCKVGLDRLIDESDISNLPYLQNIVSETLRLYPSVPMLLPHVASEDCKVGAYDMPSGTILLTSAWAIHRDPQLWEDPTSFKPERFEKEGESQKLMPFGLGRRACPGSGLAHRLINLTLGSLIQCLEWERIGEEKVDMSEGKGGTMPKAKPLEAMCRARASVGKIFYEGA

SEQ ID NO: 91581 - protein, 77 aa, Nesoluma polynesiacum
TIQCLSGTGSLRVGAELLARHYHERTIYIPQPTWGNHPKIFTLGGLSVKTYRYYDPATCGLNFQGLVEDLGSASSGA

SEQ ID NO: 91582 - protein, 257 aa, Glycine max
MAGLLAWAVGGGGGKEAEDDGIIPILFSADQQKYVNELDQKASSLRRWIHDLRQRLPPQDISQSLPHLHAHSLASNAALALQLNSHSTTRQQAQLREVTLKEENAAFENAISDCENKIKEKLQEADLLREKLKEMDETEKKLKAEVENMKQPSWVSDGWEEEKKANSKAGLEAESALLDELEKKKKDMSSMENAVHELEKKWAQVQENALKQPSPGQREKTLDKHLHGLIEQLAVKQAQAEGLLGEIHLKEMELERL

SEQ ID NO: 91583 - protein, 125 aa, Oryza sativa Japonica Group
MATRMAAAVAAMVAAVAISLAAGGAAQSSPSTPSCASKLVPCAQYMNGTDTPPAACCDPLKEAVKNELKCLCDLYASPEIFKAFNINISDALRLSTRCGISQTTSMCPGNQLILPSSSSFYPLFF

SEQ ID NO: 91584 - protein, 76 aa, Nesoluma polynesiacum
IQCLSGTGSLRVGAEFLARHYHERTIYIPQPTWGNHPKIFTLGGLSVKTYRYYDPATCGLNFQGLVEDLGSASSGA

SEQ ID NO: 91585 - protein, 383 aa, Fusobacterium nucleatum subsp. nucleatum ATCC 25586
MNYFDNAATTYPKPKEVYEFMNDFYKNYGGSYARGNYGLENSTTRIVSDTRAKLKKLLKAENKSVVFTPTATIALNIIIQGLIKKNREKKNIYISPFEHNAVVRILEYYKNQGEIELNILKVENDYTYNLERLKYQFDKKKPDILIISHASNVTGIILPVEEIAILAKEYSSFTVLDMSQTAGLIEINLNLEAIDFAVFAGHKTLYAPTGISGFLTKENIKLETILFGGTGYDSANLEMPSSVPERYEMGTLNIQAIAGLNAALKWIEEIKIINLYKKELHNRNKLKNILKKYNFIKIVGDNDEANYVGIISFIVENISSESLAPVFSHKNIIVRTGLHCAPLAHKFLGTFPAGTIRLSTSYFTNDEDFENLTRLLDYIEENI

SEQ ID NO: 91586 - protein, 296 aa, Bacillus clausii KSM-K16
MKQVQVWHYEAFSRHKGKGNPAGVVFEGDALAERNMQEIAKKVGFNETAFVLHSDVADLRLRYFTPGHEMDLCGHGTVAALQALVEAGTIDKQTKLTLETKAGILNIELETKEGQLMIAMEQAAPQFERFNGSAAKLAEALGLSSSDLDDQLPIMYGSTGTWTLLVPIKSIHAFSQMKPQNREFPAILTEKPRCSVHPFCVETIDPDADLHGRHFSSPYSGTTEDPVTGTASGVMGAYATMYIYSGKQEWLVEQGQEIGKDGRVLVVVQTDNNGKPHVSIKGEGVYVGSLMVEIGE

SEQ ID NO: 91587 - protein, 1083 aa, Gibberella zeae PH-1
MISLFDQTHQYIIAEASATTPLIPSLGYDSHHETLWHCGTAIPRAHSACENTLCSDDPPEAGPDGFKAGHQLPVIVVDDVTTHPEYSAKPYCRPGGAARFYAAVPIRTDRGVNIGVICVIDTKPSLPWDSRMSRMMRELSKAVTEHLETISLKSNQRRSEKKATGLTAFVEGDAQSVPSAERPQENEKRLNGDPKPQRPKIEDIQSALGEMDIKLSTTTSRDPRELTSGRAKDTGAVQPAPDGFTVYHDPNRVLETPREIFSKAARIVKNSIEIDGYRSRPSCQVLGSSEKTALKGQRVSISLPQTLLARMIRRYPKGHIFNLDANGDLQPDELSDKSNYRALHNGQDTSHTSGDAHSKQENRLRIQRREANILREAFPGSRSIAFVPIWDLRKKRWSAGGFIYSFNIKRSFTIDLDLSYLRALGMLAAAEAFRLETLVADKAKTDALGSLSHELRSPLHGAVLSVELLNDTDLSIPQQNIVRTIETCCRTLSDTIDHLLEYSKVNKPPPQERSLGNQADKYGLSRAPTTGRNPNSSRKVVQLDVLAEEVLESVYAGFNFQHVSLAQAAQSTSPPLRRPGHTSIRRMDTVQAIEELRTPVKDRGCVETKIGDVEIFLVIDSRPSWGFYTQPGPVRRIIMNLFGNSLKYTTKGLIRVSLEQTGALGADDNDCWVTITVSDTGVGISDDFLQNGLFKPFSQENHLSPGTGLGLSFVKQITAQFGGQISVKSRVGTGTTVTVRLPMKLGDDCHKGVCEARQREEEFEAQTDKLRGLRVKVIDFENNESDSSGTKMESPCQLVRNMCNEWLGMQVNTGFETPCLLPDLAIWSEQGFEKPCDQQDAMPDVPNIVLCANALTVHQYACGTKTIPRPGVFEFISQPLGPRKLAKACSLALYRWTVAQTSTDSPTTAPRGQESLTIPDTTASSIPHPASPFPQSAEATPTQTTQSYFRNPEFLLVDDNFINLKILSSYMKKLKQPYQTASDGLQAVTAYEADPGRYTCVLMDISMPVMDGFEATRRIRAFETQQGLRPALILALTGLASEEAQREAEVSGLDLFLTKPVRLKELGPILRAKGVLEEESNLG

SEQ ID NO: 91588 - protein, 491 aa, Fusobacterium nucleatum subsp. nucleatum ATCC 25586
MENILKKSYKMFINGEWIDSSNGVMVKSYAPYNNELLSEFPDASESDIDFAIKSAKEAFKTWRKTTVKERARILNKIADIIDENKDLLATVETMDNGKPIRETKLVDIPLAATHFRYFAGCILADEGQATVLDEKFLSLILREPIGVVGQIIPWNFPFLMAAWKLAPALAAGDTVVLKPSSTTTLSLLVLMELIQDVIPKGVVNLVTGKGSTAGEFLKNHPDLDKLAFTGSTAVGRDIALAAAEKLIPATLELGGKSANIILDDADIEKALEGAQLGILFNQGQVCCAGSRIFVQEGIYDEFISKLVKKFENIKIGNPLDPTTIMGSQIDARQVKTILDYVEIAKQEGGVILTGGVKYTENGCDKGNFVRPTLITNVNNGCRVSQEEIFGPVAVVIKFKTDDEVIAQANDSEYGLGGAVFTKNINRALKLAREIQTGRVWINTYNQIPEHAPFGGYKKSGIGRETHKVILEHYTQMKNILIDLEEGTSGLY

SEQ ID NO: 91589 - protein, 479 aa, Candidatus Pelagibacter ubique HTCC1002
MSEKMLKFVKIGQQTPPKREVGNRKEDFNEIYKEFINDKASEQSSRCSQCGVPFCQVHCPLSNNIPDWLKLTAEGRLKEAYELSQSTNNMPEVCGRICPQDRLCEGNCVIEQSGHGTVTIGSVEKYITDNAWEQGWVNPIKVKNEKSQSIGIIGAGPAGLAAAEQLRKSGYQITVYDRYDRAGGLMIYGIPNFKLEKFVVERRTKLLEKGGIKFIQNFEVGKDATLEQLRKKHDALLIATGVYKAREIDLPGKDLGNIFPAMEFLTASNKKGLGDKVELFDNGTLNAEGKNIVVIGGGDTAMDCVRTSIRQKAKSVKCLYRRDKENMPGSAREVANAEEEGVEFVWLSSPKEFIGTNKVEGLMVDKIKLGEPDDSGRRKPEIQNNSHFNIKADIVIKALGFDPENLPKLFGSEDLQVTKWGTLKTNFDTMETNLPGVFAAGDIIRGASLVVWAIKDGRDVAVSIKNFLETKELSKEKVA

SEQ ID NO: 91590 - protein, 286 aa, Streptococcus pyogenes MGAS315
MITLKSAREIEAMDRAGDFLAGIHIGLRDIIKPGVDMWEVEAYVRRRCKEDNVLPLQIGVDGHMMDYPYATCCGLNDEVAHAFPRHYILKEGDLLKVDMVLSEPLDKSIVDVAALDFDNVPEMKKWTGSYTGGLADSCWAYAVGTPSDEIKQLMDVTKEAMYRGIEKALIGNRIGDIGAAVQEYAESFGYGVVRDLVGHGVGPTMHEEPMVPNYGTAGRGLRLKEGMVLTVEPMINTGTWEIDTDIKTGWAHKTLDGGLSCQYEHQFVITKDGPVILTSQGEERTY

SEQ ID NO: 91591 - protein, 352 aa, Xanthomonas oryzae pv. oryzae KACC10331
MLPVHRVLRYLGLAFARCTGGGTRMSAAKHQVVCFGEALIDMLALPQASPAEARTFAQYAGGAPANVAVAVARLGGAAHFVGMLGRDMFGDFLLQSLQQSGVVTDGIVRTDQAKTALAFVALDEAGERSFSFYRPPAADLLFRPEHFAADGFMQAAVLHVCSNSMTEPEIAQCTLDGMRRARADGAIVSLDLNLRPMLWPQDVDPAPLLWDALALADVVKLSREELDYLAGTLDSDASAVTQKLWQGSASWLLVTDGGGPVHWQTRTDSGQVPAFRVQVRDSTAAGDAFVGGLLYQLAARASSLEQLCGDPAAINEVIRFAAAVGALAVTRKGAFAAMPSVDEVHTLIQEQS

SEQ ID NO: 91592 - protein, 434 aa, Candidatus Pelagibacter ubique HTCC1002
MATNQCQQNYKMSDKEIKVPNIGEFKDVEVIEVLVSNGQSVSKNDPLITIESDKSSVEIPASFDGKVKSVKIKVGDRVSEGDLILTVEQSGEQEKNIEQKTIKEEEPVANQNQVEKNAKVNPAQNTIKKDNSETSSASPKVRKFARELGVNINEIAGSERQGRIVEDDVKNFISSKINKAPDKTEAQPKKIISEFSHSDFGEIEVKDIPRVKKLASTYLVNSWTTIPHVTNHDEADITEMEVFRTSLTDMYTGERKKITPLAFIIKALVASLKKFPSFNSSIDNIENGKITIKKYFHVGIAVDTPHGLMVPKIRSADNKSISYISNELKTVSDQCRNLKIDKKEFFGGSMTITSLGGIGGSFFTPIINYPEVAILGVGKAQKKQIFINGKFETRTMLPLSLSYDHRIIDGAEAARFNNDLKENLGKNFAYKLAV

SEQ ID NO: 91593 - protein, 759 aa, Salmonella enterica subsp. enterica serovar Paratyphi A str.
MDEQLKQSALDFHEFPVPGKIQVSPTKPLATQHDLALAYSPGVAAPCLEIEKDPLAAYKYTARGNLVAVISNGTAVLGLGNIGALAGKPVMEGKGVLFKKFAGIDVFDIEVDELDPDKFINVVAALEPTFGGINLEDIKAPECFYIEQKLRERMNIPVFHDDQHGTAIISTAAILNGLRVVEKNISDVRMVVSGAGAAAIACMNLLVALGMQKHNIVVCDSKGVIYKGREPNMAETKAAYAVDDSGKRTLDEVIDGADIFLGCSGPKVLTQEMVKKMARAPMILALANPEPEILPPLAKEVRPDAIICTGRSDYPNQVNNVLCFPFIFRGALDVGATAINEEMKLAAVRAIAELAHAEQSEVVASAYGDQDLSFGPEYIIPKPFDPRLIVKIAPAVAKAAMDSGVATRPIADFDAYIDKLTEFVYKTNLFMKPIFSQARKDPKRVVLPEGEEARVLHATQELITLGLAKPILIGRPSVIEMRIQKLGLQIKAGVDFEIVNNESDPRFKEYWSEYYQIMKRRGVTQEQAQRAMIGNHTAIGAIMVQRGEADAMICGTIGDYHEHFSVVKAVFGYRDGVHTAGAMNALLLPSGNTFIADTYVNEDPTPEQLAEIAVMAAETVRRFGIEPKVALLSHSNFGSSNSLSASKMRETLERVRERAPDLMIDGEMHGDAALVESIRNDRMPDSPLKGAANILVMPNMEAARISYNLLRVSSSEGVTVGPVLMGVSKPVHVLTPIASVRRIVNMVALAVVEAQTTPL

SEQ ID NO: 91594 - protein, 252 aa, Oryza sativa Japonica Group
MPVSRIAVGAPGELSHPDTAKAAVAEFISMLIFVFAGSGSGMAFSKLTDGGGTTPSGLIAASLAHALALFVAVAVGANISGGHVNPAVTFGAFVGGNISLVKAVVYWVAQLLGSVVACLLLKIATGGAAVGAFSLSAGVGAWNAVVFEIVMTFGLVYTVYATAVDPKKGDLGVIAPIAIGFIVGANILAGCAFDGASMNPAVSLGPAVVTGVWDNHWVYWLGPFVGAAIAALIYDIIFIGQRPHDQLPTADY

SEQ ID NO: 91595 - protein, 141 aa, Rhodopseudomonas palustris CGA009
MDNVSNVRTGGCHCGAVRFEVTLSDGFDSIRRCTCSYCRMRGAVVAMAEMGGIKILQGEEVLTTYRFHTRAAQHFFCSRCGIYTHHQRRSNQNLYAVNVACLDGVSPFDFTEVPVMDGINHTNDTGQPTRRAGTLRFIASE

SEQ ID NO: 91596 - protein, 105 aa, Zea mays
  misc_feature (35)..(35): Xaa can be any naturally occurring amino acid
CFRYIQILERLLELERCFIFRVPWIDDRGEAHVNXSSLFQFNHVSDPCRGGLQFHPLMSFSVAKCLAFEHVILYFPKLPFHSRTHKIFVFSLFTRHCHSTTLREL

SEQ ID NO: 91597 - protein, 336 aa, Oryza sativa Japonica Group
MVQRTSSDSAASAEAMVMDLSPKRPAKSYGGEGGSYFDWCPSELPMLRAASIGAAKLSLAAGGLALPFYSDSAKVAYVLQGKGTCAVLLPETPSEKILPIKEGDAVALPFGVVTWWHNLHAATTELVVLFLGDTSKGHTAGRFTNMQLTGSTGIFTGFSTEFVARAWDLPQDVAASLVSTQPGAGIVKLKDGFRMPEGCDKDREGMVLNCLEAPLDVDIKNGGRVVVLNTQNLPLVKEVGLGADLVRIDGHSMCSPGFSCDSAYQVTYIVRGSGRVQVVGIDGTRVLETRAEGGCLFIVPRFFVVSKIADDTGMEWFSIITTPNPIFSHLAGRTSV

SEQ ID NO: 91598 - protein, 200 aa, Legionella pneumophila str. Lens
MPINLYSKAVFLKSAARVNQLPEDSGYEVAFAGRSNAGKSSALNCLTNNKNLARTSKTPGRTQLINLFSLDEQRRLVDLPGYGYAKVAMEVKLEWQKNLAHYLEARQCLRGLILLMDVRHPLKDLDQILVNWALHRELPVHILLTKADKLSRSEVKNAVLKVRQYYELAEHLVSVQAFSSVKKDGVEELISVLDRWYEWN

SEQ ID NO: 91599 - protein, 371 aa, Clostridium acetobutylicum ATCC 824
MNSQDFNYRNGELGIVALESCRELGQKIDNRIKTKRKSEDSFLIPTQEIRFSNGEGKVKLSESVRGKDIYILCDVGNYSCTYNMFGIENHKGPDEHFQDIKRTVSAIRGKARRITVIMPLLYESRQHRRKGRESLDCALALQELERLGVQEVLTFDAHDPNVQNAIPLMSFENLYPTYDIVKTIIMEEKNIEVNKNSMLVISPDTGAMDRAIYYSSVLGVDVGLFYKRRDHSTIVNGKNPIVKHEYMGRDVENQDVLIVDDMIASGESVLDIAKELKARKARNIYVATTFAFFTEGLEKFQKYYDDNIISRVYSTNLTYIPPELEKTEWFRKVDMSELISRIIHKLNKDESIAKFMDATYVLHELLNSRKK

SEQ ID NO: 91600 - protein, 77 aa, Argania spinosa
TIQCLSGTGSLRVGAEFLARHYHEQTIYIPQPTWGNHPKVFTLGGLSVKTYRYYDPATRGLNFQGLLEDLGSASSGA

SEQ ID NO: 91601 - protein, 867 aa, Frankia sp. EAN1pec
MHAEHHEPRKQPSSVTPAPTALPYPSEPDTDRAKIPDHADSPGHTENPDHPEKPDRLPGRRPWRRARRAPASPAADSSDNPASDNPPSGGAARHDPDGTGRPGSGGSAGRTLRGAWRHDLEASVVVFLVALPLSLGIAVASGAPVVAGIIAAVVGGVVAGAVGGVPLQVSGPAAGLTAVVAEIVATHGWRVACFVTAAAGVVQILFGLSRVARAALAISPAVVHGMLAGIGLTIVIGQIHVVLGGTAGSAAWDNLIVLPGEIVSPAVPAAALLGIAAIALTVVWTRLPRPLSSIPAPLAAVSIVTAASLPFDVPRVALPDDLLGAIALPELPAGGEWGAITLAVLTVALVASIESLLSAVAVEAMHSGPRGDLDRELLGQGAANTVSGLLGGLPVTGVIVRSSTNVRAGARTRASAILHGLWMAGFALLLAPLVGRIPLAVLAGLLVVIGIRLVDLAHIRAIARHGELAIYLTTVVGVVLFNLLEGVLIGIATALLLALRRTLVAPVHVHPPTGPGSPWRVVVEGALTFLSLPRLSRRLAEVPAGASVRLDLAVDYLDHGAHKMLDDWIAERHRAGATVTVDEVGAAPLAIPTVAARPREGRLSKSLFGGRSTGRHARSARPPRWLAPWSDWQHGQLHDRQHLLNGVDEFHRRTAPMIEPFLTELTSGQRPSTLFITCSDSRLVPNVITSSGPGDLFTVRTPGAFVPGPQAVGDSTLAAIEYAVEVLRVRTIAVCGHSGCGAVAALLDRGTPGHSGSIVGPLRNLEAWLRHGEPALARAARDAGGLPPEPDELSRVSVAQQLVALRGLSVVRRAEAEGRLQLVGMWFDIATARAIVLNESTDRFEIPTVSVVPALESGQRLADATRG

SEQ ID NO: 91602 - protein, 391 aa, Streptococcus thermophilus
MAERILMTNGKLKVTDNPIIPFIEGDGVGRDIWKNAQAIFDKAVEAAYEGQRRIEWQEFLAGKKAFDKTGEWLPQETLEAIRESLVAIKGPLETPVGGGIRSLNVALRQELDLYACVRPVRYFEGVASPLKEPEKTDITIFRENTEDIYAGIEWEAGTVDVERVIAFFQTEMNVDKIRFPKSSSIGIKPISIEGSKRLIRSAIDYALKNNLKKVTLVHKGNIQKFTEGGFRKWGYEVAEEEYKEEMLAGRLEVNDIIADNFLQQILLNPEKFDVVALTNLNGDYASDALAAQVGGIGISPGANINYQTGHAIFEATHGTAPDIADQDRANPCSILLSGCMLLEYIGWSEAAELIISAIEKNFKSGIFTVDLAFGKRAYSTSGFSNQILSII

SEQ ID NO: 91603 - protein, 290 aa, Frankia sp. EAN1pec
MPDLLEDRVVVVTGGASGIGRASVLRFLAAGARVVFGDVNGATAQRLLDEVADPARLHFERADVADEAEVAALVAAAVERFGRLDVMFNNAGVGGAFGPLTDIDVADWDRTFGVISRGMFLGTKHAARAMIAQGGGGSIINNSSVAGVGGGGGPTAYSAAKAAVINFTCNAAVELAAHRIRVNAICPGLVDTPLVMGRDEAAIRARMATFQPWPDLGRPEDIAGIVLFLAGPDSAFLTGEAIRVDGGMVAWGPRMTDTSDPRGVTRRFTGFTEGSTGRPLTKRPLDGAGT

SEQ ID NO: 91604 - protein, 340 aa, Streptococcus thermophilus LMG 18311
MKKQKIAVLGPGSWGTALAQVLNDNGHEVRIWGNIPEQIDEINEKHTNTRYFKDVILDENIKAYKELSEALDSVNAILFVVPTKVTRLVAKQVAELLDHKVVVMHASKGLEPGTHERLSTILEEEIPSEMRSEIVVVSGPSHAEETIVRDITLITAASKDLETARYVQGIFSNSYFRLYTNSDVIGVETAGALKNIIAVGAGALHGMGYGDNAKAAVITRGLAEITRLGVKLGADPLTYSGLSGVGDLIVTGTSIHSRNWRAGDALGRGEKLEDIERNMGMVIEGISTTKVAYEIAQELGVYMPITTAIYKSIYEGADIKESILNMMSNELRSENEWDKK

SEQ ID NO: 91605 - protein, 522 aa, Prochlorococcus marinus subsp. pastoris str. CCMP1986
MSNFTKYLSKNWLDDPKSNILSGLVVAFAMIPEAIAFSGIAGVDPKVGLYGAFCLSITIAILGGRRGMITSATGSTALLMTGVVAIGEAQAPGTNLGLSYLIAAGLLTGVFQILWGYLRLAYQMRFVPTGVLSGFVNALALLIFQAQFLQLGIGINEGKLLENELSKYPTNSQIPTVWILVILGLIVIYGFPKITKVIPSQLVAIVLLTLISVFFKLEIPTVSDLGTLPNGFPSLSLPFGELANGKVPFNLSTLGVILPTSLAISLVGLMETFLTQDILDDATDTSSNKNKEARGQGIANIISSLFGGMAGCALVGQSVMNNENGGKSRLSTLISGLSLLLMIILLKPWIGAIPMAALVAIMITIAISTADLTGLKNIRKIPKSDTAVMLMTFAVTMLTKPHNLALGVIAGVGLAAILFSRKVAKVITVSRVKGKNQITYKVEGQLFFVSKIYFLQGFDIHEHPKDILIDMSLAHIWDQSGVVALDQIIRKFKNSGSKVEIIGLNKESLNLFERLGGLETSH

SEQ ID NO: 91606 - protein, 575 aa, Prochlorococcus marinus str. MIT 9211
MIRLERVTKIYPTGEVLKDITWEIKAGQRVGLVGVNGAGKSTQLKIIFGLEQPTSGEVVRQGEPCIAYLKQEFDVDTSRTVREELFQAFADAALILNQKLVVESAMETQAALKDGEYLDGLVKELGILQAKFEALNGYQLEAKIEKLLPKIGFNSKEAEQLVGDYSGGWQMRIALGKILLQDPDLLLLDEPTNHLDIETIEWLESYLIEQNAAMVIISHDRKFLDKICTHIVNTERGKSRTYLGNYTSYIEQKILEEESMQAAFERQQKDLNTQQAYIDRFRASATRSTQAKSREKMISKIDRIEAPLHSLSKPIFSFPKAPRPGRKVASIEDLSLTYGEKIIFLGANLQIEPGDHIALVGPNGSGKSTLLRLLMGLEKPEDGLISLGPHNIIPNYFEQNQSEALDLSNTVIETLFSAVPDWTQTQVRSLLGNFGFTKDEVFKHVGNLSGGEKARLALALIIVRPCNLLLLDEPTNHLDIPAKEMLENAIRDFSGSVVIVSHDRYFISKVANRIVEIRDGQMFLYRGNYNYFLDKKKEEVKLKQEELALAEKEAKRIANRANQRKKKLLRKQTRN

SEQ ID NO: 91607 - protein, 577 aa, Streptococcus thermophilus
MTKMLKGIAASDGVAVAKAYLLVQPDLSFETVTVEDTSAEEARLDAALAASQDELSVIREKAVESLGEEAAAVFDAHLMVLADPEMTGQIKETIRAKQVNAEAALTEVTNMFIAIFEGMDDNPYMQERAADIRDVTKRVLANLLGKKLPNPATIDEESIIVAHDLTPSDTAQLNKKFVKAFVTDIGGRTSHSAIMARTLEIPAVLGTNNITELVKDGDILAVSGITGEVVINPTEEQIAEFKAAGEDYAKQKAEWAQLKDAPTVTADGKHFELAANIGTPKDVEGVNDNGAEAVGLYRTEFLYMDSQDFPTEEDQYEAYKAVLEGMNGKPVVVRTMDIGGDKELPYFDLPKEMNPFLGYRALRISISETGNQMFRTQLRALLRASVHGKLRIMFPMVALLTEFRTAKGILEEEKAKLVAEGVAVANDIEVGIMIEIPAAAMLADQFAKEVDFFSIGTNDLIQYTMAADRMNEQVSYLYQPYNPSILRLINNVIKAAHAEGKWAGMCGEMAGDQTAVPLLVGMGLDEFSMSATSILRTRSLMKKLDTAKMEEYANRALTECSTMEEVLELSKKYVNVD

SEQ ID NO: 91608 - protein, 719 aa, Zea mays
MGDSTSTGFAAALELWQEHQLSILVVASLAIQWFLFVFAPLRQHRIPGLLRLSIWLAYLGSDAVAIYALATLFNSHRCDTDTGRPGVELLWAPILLVHLGGQDSITAYNIEDNELWRRHVVTAVSQVAAAIYVFVKAWPKSLVTTAHQAVNQATLDKVNAIQAHNEEMEAYGRIFTPALLLFFCGITKCVFKPWDLKRVSVNSLVDSSSGSEEKGGESEMNSLQEYVGAATRYFESRGHGRGAGLQEDDGDDDTCKAGEVWKPYNLCVDLAPPYSGRLSCLKHLARSPADEAHRLVKSSLSATFHQLYTKESLKLHDISHFVFTNNAALNRWKVLTSARGLRTVAAATLLGAIAVFHYGGGAADQVKADVTVTYALLWSAFVMEYVLPTVIHHTFGRVQRLFTGHRTWPDQVAQYNLMGYVARRRKHSWLMEVVGWLGCRDLVDQLWTMDPCKGASSREITGLVHGHVAGGWMEGHIAGADSFRAFNDYRGQWTLNNSSVPSMVLMSVSRPFDESVLVWHLATDFCFHLLQEDPSPSSATARRCREMSNYMAYLLFVKPEMLMPGARRSLFRDTCGELVGLLGEDRPGAPRARGKRGLAHKVVQLLKRDDGGGVLGSAGVGVVRRAWCVAEDLMDSHRGSEEKMWAVIQGVWVEMLCFSASRCKGYLHAKGLGTGGEYLSYVWLLLLYMGMETLAEKMQRTELYEGPTAAASSISGHNV

SEQ ID NO: 91609 - protein, 155 aa, Fusobacterium nucleatum subsp. nucleatum ATCC 25586
MNINIICIGKIKDKYINDGIAEFSKRMTSFVSLNIIELKEYNKEDNINISIEKESLEILKQISKSNSYNILLDLEGKEINSENMSKYIENLKNIGISSINFIIGGSNGVSKNVKNSVDMKLKFSHFTFPHQLMRLILLEQVYRWFAISNNIKYHK

SEQ ID NO: 91610 - protein, 316 aa, Zea mays
APRDSRMKIFSGTANRPLAQEIAAYLGIELGKILIKRFADGEIYVQLQESVRGCDVFLIQPTCSPVNENLMELFIMIDACRRASARSITVVIPYFGYARADRKAQGREPITAKLAANLLTEAGSDRVIVCDIHSTQALGYFDIPVDHIYGQPVILDYLASKTISEDLVVVSPDVGGVVRARAFAKKLLNARLAIVDKRRQGHNMSEVMNLIGDVKGKVAILIDDMIDTAGTITSAAALLKQEGAEAVYACCTHAVFSPPAIERLSGGVFEEVIVTNSILLPEDKCFPQLTVLSMANLVGETIWHVHRDGSVSSIFQ

SEQ ID NO: 91611 - protein, 361 aa, Alkaliphilus metalliredigens QYMF
MKAKLILENGSIFEGKAFGYIGESVGEVVFNTGMTGYQEILTDPSYHGQIVTMTYPLMGNYGINLEDVESSKVRVKALIVREQCVKPSNWRCEMDLDGYLKQNQIMGLQGIDTRALTKVLRNNGTMKGIITTEELTTQEIQAKLSAFSNEKAVEAVTTEDVYEIQGTGKHIAVMDFGVKENILRSFRKRNCRITVFPANTRAEEVLAVNPDGIFLSNGPGDPQDLESVIENIKQLIGKKPIFGICLGHQLLALSLGGNTSKLKFGHRGCNHPVKDLINSKVYITSQNHGYVVKNEDLPKEMVVTHINLNDETIEGMQHKTLPIFSVQFHPEACPGPQDTGYLFDRFMKMLGGELICQEITV

SEQ ID NO: 91612 - protein, 594 aa, Oryza sativa Indica Group
MGTYKCCIFFTRRFALSDASTPGDVRMLFTRHAGGAPYMGIDELRRYLAASGEAHVDADTAERIIDRVLQERSRTPRFGKPSLTIDDFQYFLFSEDLNPPICHSKEVHHDMNAPLSHYFIYIGHNSYLTGNQLSSDCSDIPIIKALQIGVRVIELDMWPNSSKDDVDILHGRTLTAPVSLVKCLKSIKEYAFVASPYPVIITLEDHLTSDLQAKVAKMVLEVFGDTLYYPESKHLQEFPSPEALRGRVILSTKPPKEYLESKGGTMKDRDIEPQFSKGQNEEAVWGTEVPDIQDEMQTADKQHENDILYTQRDVEEDDEKKMCQHHPLEYKHLITIKAGKPKGAVVDALKGDPDKVRRLSLSEQELAKVAAHHGRNIVSFTHKNLLRIYPKGTRFNSSNYNPFLGWVHGAQMVAFNMQGYGRSLWLMHGFYKANGGCGYVKKPDFMMQTCPDGNVFDPKADLPVKKTLKVKVYMGEGWQSDFKQTYFDTYSPPDFYAKVGIAGVPSDSVMQKTKAVEDSWVPVWEEEFVFPLTVPEIALLRVEVHEYDVSEDDFGGQTALPVSELRPGIRTVPLFDHKGLKFKSVKLLMRFEFV

SEQ ID NO: 91613 - protein, 556 aa, Streptococcus pyogenes MGAS315
MYQALYRKYRSQTFDEMVGQSVISTTLKQAVESGKISHAYLFSGPRGTGKTSAAKIFAKAMNCPNQVDGEPCNQCDICRDITNGSLEDVIEIDAASNNGVDEIRDIRDKSTYAPSRATYKVYIIDEVHMLSTGAFNALLKTLEEPTENVVFILATTELHKIPATILSRVQRFEFKAIKQKAIREHLAWVLDKEGIAYEVDALNLIARRAEGGMRDALSILDQALSLSPDNQVTIAIAEEITGSISMLALGDYVRYVSQEQATQALAALETIYDSGKSMSRFATDLLTYLRDLLVVKAGGDNQRQSAVFDTNLSLSIDRIFQMITVVTSHLSEIKKGTHPRIYAEMMTIQLAQKEQILSQANLSGELISEIETLKNELAQLKQQLSQLQSRPDSLARSDKTKPKTASYRVDRVTILKIMEETVRNSQQSRQYLDALKNAWNEILDNISAQDRALLMGSEPVLANSENAILAFEAAFNAEQVMSRNNLNDMFGNIMSKAAGFSPNILAVPRTDFQHIRKEFAQQMKSQKDSVQEEQEVALDIPEGFDFLLDKINTIDD

SEQ ID NO: 91614 - protein, 338 aa, Salmonella enterica subsp. enterica serovar Paratyphi A str.
MIIERARELAVRAPARVVFPDALDERVLKAAHYLQQYGLARPVLVASPFALRQFALSHRMAMDGIQVIDPHSNLSMRQRFAQRWLARAGEKTPPDAVEKLSDPLMFAAAMVSAGEADVCIAGNLSSTANVLRAGLRVIGLQPGCKTLSSIFLMLPQYAGPALGFADCSVVPQPTAAQLADIAIASADTWRAITGEEPRVAMLSFSSNGSARHPNVANVQQATELARERAPQLLVDGELQFDAAFVPEVAAQKAPDSPLQGRANVMIFPSLEAGNIGYKIAQRLGGYRAVGPLIQGLAAPLHDLSRGCSVQEIIELALVAAVPRQADVSRERSLHTLVE

SEQ ID NO: 91615 - protein, 516 aa, Triticum aestivum
  misc_feature (262)..(262): Xaa can be any naturally occurring amino acid
MASERNGDGGKERAGENGNGGGSGVSLEMPEIRYTKLFINGAFVDAVSGKTFETRDPRTGDVIASIAEGDKKDVDLAVKAAREAFDHGKWPRMPGSERGRIMMKYADLVEGHADELTLLESLDAGKPCTVTRAVDMATAVRSLRYFAGAADKIHGETLKMSRQFQGHTLREPMGVAGLIIPWNFPAIMFFSKVAPALAAGCTMVVKPAEQTPLSALYFAHLAKQAGVPDGVINVITGFGPTAGAAIASHMDVDMVSFTGSTXSVGRLVMEASARSNLKPVSLELGGKSPLIIFDDADVDMAVGLAIAANFFNKGEACIAASRVYLQEGIYDRFVKKLAQRMESWVVGDPFDPRVNQGPQVDKAQYERVLGFIDHGKREGATVLTGGKPFGQRGYYIEPTVFTDVKDDMIIAKEEIFGPVMCLMKFTSVEEAIARANDTRYGLAAGVVTKDIDVANRMTRSIRAGVVWVNCYFAMDSDCPFGGRKMSGFGKDDGMHALDKFLAVKSVVTPVYDSPWL

SEQ ID NO: 91616 - protein, 297 aa, Saccharomyces pastorianus
LILVACIFTPIGIGLIVSATKVQDLTINYSHCDTKASINAFTDVPKKYTKYHFKNKVESKPQWKLAEDESGKKTCELQFEVPNDIKKSIFIYYKLTNFYQNHRRYVQSFDTKQILGESIKLDDLDTNCSPLRSIDKKIVYPCGLIANSMFNDTFSQKLSGVNNTGDFGLTNKDISWSIDRHRFKTTKYNVSDIVPPPNWMKKYPDGYTDDNIPDIHTWEEFQVWMRTAAFPKFYKLALKNESTTLPNGTYQMNIELNYPISLFGGSKSFVLTTNGAIGGRNMSLGVLYLIVAGLCAI

SEQ ID NO: 91617 - protein, 261 aa, Oryza sativa Japonica Group
MGFCTVQSPIDGIFVLTMASSDGHQYLTDEAIGDLIASLTAVRDTPGLRGLVTTSRLGSFCDGVDHDAARQPDEQVAARVGEVVRLLLEMPAPTAAAVNGDATSLGLALALAHDHCVVWEGAAVALPEARRRRPLPGYVAALLRDKVAYARLRKLLMLRAEACTGKELVGTWYSANDPAAADREVVAAEACELLEGIEVGSGKNYATARQAMWPESCAAVGMEITRPRRPSSPEQILHVSEKEKEKHGASDQYQIKQTKIM

SEQ ID NO: 91618 - protein, 499 aa, Legionella pneumophila str. Lens
MGYNVPHYIGGQLINETDTEAQAIYNPALGEIIGQVHFASKATCDRAVAIAKAAGNEWSQTPAIKRARVLFRFRELLEKYQMDLARIVTREHGKTLDDAKGSVARGIEVVELHCGLVNELKGDFSAEVASHIDCHTFRQPLGVCAGISPFNFPVMVPIWMMIPAIACGNSFILKPSEQDPSAPVRLLELLNDAGLPPGVANCIQGNKTTVEHLLAHPDIAAFTAVASTPVAEYIYTTAAAYGKRAHTFGGAKNHCVVMPDADLDQAANAIVGAAYGSAGERCMALSVVVTVGQHTADALINKISPLIRAIRVDAGDVEGTDMGPLVSQAHRQRVLAAIEKGVNEGARLIIDGRTFQHPQYPQGFYLGPCLFDEVTEEMSVYQNEIFGPVLVIVRVNHFEEALALVNKHQYGNGTAIFTRDGFTAREYSQRVQAGLVGINIPIPVPIANHPFGGWKRSVFGDTNMHGEESIHFYTRRKTVTSKWPITELKDSSFAMPTHD

SEQ ID NO: 91619 - protein, 315 aa, Oceanobacter sp. RED65
MGLLIEGQWHDQWYDTKSQGGRFKRQESEFRHTISPDGPFKPESDRYHLYVSMACPWAHRALIFRKLKDLSEHISVSVVHPNMLSNGWEFRQDDGFYKDHLYDFEFAHQLYTKAKSDYTGRVTVPILWDKQSQTIVNNESSEIIRIFNSAFNELTGNNHDYYPQTLQSEIDAVNERIYHTVNNGVYKAGFATTQDAYKEAFNELFDSLDWIEQRLSEHRYMVGDQITEADWRLFTTLVRFDAVYVGHFKCNKKRIVDYPNMWAYLRELYQHADVATTVHMDQIKRHYYYSHTMINPTQVIPEGPDLDFWAPHDRD

SEQ ID NO: 91620 - protein, 169 aa, Methylocella palustris
MIPIENSLAGRVADIHHLLPRANLHVVGEYFLPIHFQLLGLKGAKLGDIKSVYSHVHALGQCRKIIRKLKLKPHVAADTAGSAREVAEWGDASRASIATSLAGAIYGLDVLAENIEDEAHNTTRFVILSKTAHWAAPSPEPTVTTFVFRVRNVPAALYKALGGFATNGI

SEQ ID NO: 91621 - protein, 254 aa, Streptomyces exfoliatus
NDLSGKTVIITGGARGLGAEAARQAVAAGARVVLADVLDEEGAATARELGDAARYQHLDVTIEEDWQRVVAYAREEFGSVDGLVNNAGISTGMFLETESVERFRKVVEINLTGVFIGMKTVIPAMKDAGGGSIVNISSAAGLMGLALTSSYGASKWGVRGLSKLAAVELGTDRIRVNSVHPGMTYTPMTAETGIRQGEGNYPNTPMGRVGNEPGEIAGAVVKLLSDTSSYVTGAELAVDGGWTTGPTVKYVMGQ

SEQ ID NO: 91622 - protein, 474 aa, Legionella pneumophila str. Lens
MLRRTKIVATLGPASKEPEILRSMLAAGVNVVRINFSHADSSALQLIALVRKIADELNHPVAVMADLQGPKIRVGRFQNKSITLIDGQNFTLDCMAPDTLGDISGVSVAYPNLANELSIGDHLLINDGLIELEVIETSGSKIHCKVVEGGVLTDLKGLNRKGGGLAARTLTEKDRNDLRTAIEAEVDYISLSFVKDAEDIRQARALMKDYGAQITPIIAKIERMEALDHLTDIIREADAIMVARGDLGVEVGAAEVPAIQKHIIEQTRLLDKVVITATQMMESMISNPQPTRAEVSDVANAILDGTDAVMLSAETASGLFPVKVITMVNKICLSAEKHASFFYHSDPETCHYQRADQAIAMATMHTANHFPIQAIITLTESGDTALWISRQHSTVPIFAISANKRTIGRLSLVNNVFPIYIDFHQFNPEGLNQQILHELVKSGHLEKKGYVLLTRGTQIGTPGGTNCMEIIPVI

SEQ ID NO: 91623 - protein, 396 aa, Legionella pneumophila str. Lens
MNLIKMSDIDLSGKRVLIREDLNVPIKDGMITSDQRLQAALPTIKSALDSGAAVIVLSHLGRPEEGKYEKKFSLEPVADYLRKNLEYPVRFVKDYLSGVDVNPGELAVCENVRFNPGEKSNDESLAKKLANLCDVFVMDAFGTAHRAQASTYGVAQYAPVAVSGPLLIRELEALNQVLKAPKKPIVAIVGGAKVSSKLSLLKQLVGMVDVLIPGGGIANTFLKAQGFEIGISLYEPDLLDEARHILILAKEKGCQIPLPTDVVVGKTFSETCPAFNKSLSNVAADDMILDIGPETIRDYVDLIHEANTIIWNGPVGVFEFPQFAYGTRAIAIAIAESNAFSIAGGGDTLAAVDLYDLNQQISYISTGGGAFLECLEGKTLPAVAILQERAKHVKTN

SEQ ID NO: 91624 - protein, 500 aa, Streptococcus thermophilus LMG 18311
MNKRVKIVATLGPAVEIRGGKKFGEDGYWSEKLDPDASAKNIAQLIEEGANVFRFNFSHGNHAEQGERMDVVRMAESIAGQKVGFLLDTKGPEIRTELFEGDAKEYAYKTGEQIRIATKQGLKSTRDVIALNVAGALDIFDDVEVGKQVLVDDGKLGLRVVDKDAEKREFIVEVENDGIIAKQKGVNIPYTKIPFPALAERDNADIRFGLEQGINFIAISFVRTAKDVQEVRAICEETGNGHVKLLAKIENQQGIDNIDEIIEAADGIMIARGDMGIEVPFEMVPVYQKMIITKVNAAGKIVVTATNMLETMTEKPRATRSEVSDVFNAVIDGTDATMLSGESANGKYPVESVRTMATINKNAQTLLKEYGRLNSSTFDRSSKTEVVASAVKDATNSMNIKLIVALTESGNTARLISKYRPEADILAITFDELTQKSLMLNWGVIPVVTETPSSTDDMFEVAERVALESGLVESGDNIVIVAGVPVGSGNTNTMRIRTVK

SEQ ID NO: 91625 - protein, 77 aa, Sideroxylon salicifolium
TVQCLSGTGSLRVGAEFLARHYHERTIYIPQPTWGNHPKIFTLGGLSVKTYRYYDPATRGLNFQGLLEDLGSASFGA

SEQ ID NO: 91626 - protein, 335 aa, Rosa hybrid cultivar 'Kardinal'
MGVERVQDIASATSKDTIPVEFIRSENEQPGITTVPGTVLECPIIDFSDPDEEKLLKQIFEASTDWGMYQIVNHDISNEAIAKLQAVGKEFFELPHEEKEVYAKDPNSKSVEGYGTFLQKELEGKKGWVDHLFHKIWPPSAINYCFWPKNPASYREANEEYAKNLHKVVEKLFKLLSLGLGLEAQELKKAVGGDDLVYLLKINYYPPCPRPDLALGVVAHTDMSALTILVPNDVQGLQACRDGQWYDVKYIPNALVIHIGDQMEVMSNGKFKAVLHRTTVSKDKTRISWPVFLEPPPDHIIGPHPKLVNDKENPPKYKTKKYSEYVYNKLNKIPQ

SEQ ID NO: 91627 - protein, 492 aa, Arabidopsis thaliana
  misc_feature (292)..(292): Xaa can be any naturally occurring amino acid
MAALCHIHRLLSPKSWKNWDLKDKNQRKKMESERLESHLLNKQEEEASSFTSGLLLSTSVVVAGSFCYGCAMSYSSPAQSKIMEELGLSVADYSFFTSVMTLGGMITAVFSGKISALVGRRQTMWISDVCCIFGWLAVAFAHDIIMLNTGRLFLGFGVGLISYVVPVYIAEITPKTFRGGFSYSNQLLQCLGISLMFFTGNFFHWRTLALLSAIPSAFQVICLFFIPESPRWLAMYGQDQELEVSLKKLRGENSDILKEAAEIRETVEISRKESQSGIRDLFHIGNAHSLIXIGLGLMLLQQFCGSAAISAYAARIFDKAGFPSDIGTTILAVILIPQSIVVMLTVDRWGRRPLLMISSIGMCICSSLIGLSYYLQKNGESQKLCSVMLIVGLVGYVSSFGIGLGGLPWVIMSEVFPVNVKITAGSLVTVSNWFFSWIIIFSFNFMMQWSAFGTYFIFAGVSLMSFVFVWTLVPETKGRTLEDIQQSLGQLS

SEQ ID NO: 91628 - protein, 387 aa, Oryza sativa Indica Group
MSSCFNGGAGWPEPVVRVQAVSDSCGATIPERYVKAPSERPSSLDGGGGLNNIPVVDMSMPDGEETARAVAAACREWGFFQAVNHGVRPELLRRARAAWRGFFARPAEAREAYANSPATYEGYGSRLGTAKGGPLDWGDYYFLHLLPAALKSHDKWPTSSVPAGGGGLREATEEYAEEVVRLCRRVMRLLSRGLGLDDGRLQAAFGGVGGEGACLRVNFYPRCPQPELTLGVASHSDPGGMTMLLVDDHVRGLQVKNAGHWITVDPVPDAFIVNIGDQIQVLSNAVYKSVEHRVTVSAAEERLSLAFFYNPRSDLPLAPMPELVAPPARPALYPPMTFDEYREHIRRCGLSGKAQLQSQQMATAICGAPPAATASSSSSSSASSLAR

SEQ ID NO: 91629 - protein, 297 aa, Oryza sativa Indica Group
MSSCFNGGAGWPEPVVRVQAVSDSCGATIPERYVKAPSERPSSLDGGGGLNNIPVVDMSMPDGEETARAVAAACREWGFFQAVNHGVRPELLRRARAAWRGFFARPAEAREAYANSPATYEGYGSRLGTAKGGPLDWGDYYFLHLLPAALKSHDKWPTSSVPAGGGGLREATEEYAEEVVRLCRRVMRLLSRGLGLDDGRLQAAFGGVGGEGACLRVNFYPRCPQPELTLGVASHSDPGGMTMLLVDDHVRGLQVKNAGHWITVDPVPDAFIVNIGDQIQDFICTSEISYKNGMKAN

SEQ ID NO: 91630 - protein, 76 aa, Zea mays
RNYNLPQQAVAVNNLGKWKTATQMTALTLLLASRDPSLPAQGALVAPGVALLYVSTGLAVWSLVVYMRKIWRILLK

SEQ ID NO: 91631 - protein, 205 aa, Desulfococcus oleovorans Hxd3
MPLIPMVIEQTSRGERAFDIYSRLLKDRIVFIGSAIDDETANLLIAQLLFLESEDPDKDINFYINSPGGKVSAGMAIYDTMQYIKSDIATVCIGHAASMGAFLLAAGAKGKRFSLPNSRIMIHQPMGGAQGQASDIAIQAKEILRMKDILNQILAHHTGKPLEQIQVDTDRDFFMSGEEAKAYGIVDHVITDRSDLDKLEKPQEA

SEQ ID NO: 91632 - protein, 212 aa, Picea sitchensis
MAASIMAVALCGLVFLLLCGLSSCSAGFGKQKLYSGSRGNDTNLAAEEASFFLGNDSSTPTPSTPTSAGTTWCVAKNNVGDSTLQVALDYACGLGGADCTAIQQGGVCFDPDNVQAHASYAFNSYYVKNGMLPGTCDFAGSAAPTTNNPSFGKCMFETSTGSSSITSSTGGSITGAMGPSTFNPNGATFMVPPLLISTIIYISATVCNVWAY

SEQ ID NO: 91633 - protein, 467 aa, Streptococcus pyogenes MGAS315
MNGEWKLSENEITIYAPATGEELGSVPAMTQAEVDAVYASAKKALSDWRALSYVERAAYLHKAADILVRDAEKIGAILSKEVAKGHKAAVSEVIRTAEIINYAAEEGLRMEGEVLEGGSFEAASKKKIAIVRREPVGLVLAISPFNYPVNLAGSKIAPALIAGNVVALKPPTQGSISGLLLAEAFAEAGIPAGVFNTITGRGSVIGDYIVEHEAVNFINFTGSTPIGEGIGKLAGMRPIMLELGGKDSAIVLEDADLVLAAKNIVAGAFGYSGQRCTAVKRVLVMDKVADQLAAEIKTLVEKLSVGMPEDDADITPLIDTSAADFVEGLIKDATDKGATALTAFNREGNLISPVLFDHVTTDMRLAWEEPFGPVLPIIRVTTVEEAIKISNESEYGLQASIFTTNFPKAFGIAEQLEVGTVHLNNKTQRGTDNFPFLGAKKSGAGVQGVKYSIEAMTTVKSVVFDIQ

SEQ ID NO: 91634 - protein, 574 aa, Streptococcus pyogenes MGAS315
MLKGIAASDGVAVAKAYLLVQPDLSFETVTVADTNAEEARLDVALQAAQDELSVIRENAVESLGEEAAAVFDAHLMVLADPEMISQVKETIRAKQTNAETGLKEVTDMFITIFEGMEDNPYMQERAADIRDVAKRVLAHLLGVKLPNPATINEESIVIAHDLTPSDTAQLNKQFVKAFVTNIGGRTSHSAIMARTLEIAAVLGTNDITKRVKDGDVIAVNGITGEVIIDPSEDQVLAFKEAGAAYAKQKAEWSLLKDAHTETADGKHFELAANIGTPKDVEGVNDNGAEAVGLYRTEFLYMDSQDFPTEDEQYEAYKAVLEGMNGKPVVVRTMDIGGDKELPYFDLPKEMNPFLGFRALRISISETGDAMFRTQMRALLRASVHGQLRIMFPMVALLKEFRAAKAVFDEEKANLLAEGVAVADDIQVGIMIEIPAAAMLADQFAKEVDFFSIGTNDLIQYTMAADRMNEQVSYLYQPYNPSILRLINNVIKAAHAEGKWAGMCGEMAGDQQAVPLLVGMGLDEFSMSATSVLRTRSLMKKLDSAKMEEYANRALTECSTAEEVLELSKEYVSED

SEQ ID NO: 91635 - protein, 591 aa, Desulfococcus oleovorans Hxd3
MTDGRNEIKLVGVAGSPGICIGKAYLIDTDTSGVEVVEKYFIDSKNISKEVNRFKAAVKKAKDELSAIIKDVPEDLQDHVHILETHMVMFKDKMLYGKTIETIENEQVNAEWALKKTVADVREMFRDIADPYIKGRVTDIAQVTNRIMQQLLGTTTVDIGKIDKRVILVAHDLSPADTSQIQLDKIKGFVTDRGGRTSHTAIIAKTLDIPSVLGMENATKMIRNDDIIIVDGESGIVIVNPTDESIIKYQNREQEYEAYKIDVAKSSHLPVQTVDGVSVKVLANIELPAEIGHAKEYGADGIGLFRTEFLYLSRKEFPTEEELFLEYRKVVETMAPKPVTIRTLDINGDKVVAYDQTEEEANPALGLRAIRFCLKRPEVFQTQLRAILRASAFGNVKVMFPLISAYEEMVQAREALDTAADSLKKDGLAYNGDIEVGAMIEVPATVIIADMLADIVDFFSIGTNDLVQYSLAIDRGNRQVAHLFQTFHPAVIRMIRQVIEVGKSKGVDVVMCGEMAGFPINLPILLGLGLERLSMNPPAIPIMKNAIRSMKAGDTKSFMDEVFTKNTAAQISDLVHQRFGDLFPSLPDITQ

SEQ ID NO: 91636 - protein, 92 aa, Glycine max
GLCDFLSSGPVLAMVWEGEGVIKYGRKLIGATDPSKSEPGTIRGDLAVVVGRNIIHGSDGPETAKDEIALWFQPKELVSYTSNEEKWIYGVN

SEQ ID NO: 91637 - protein, 371 aa, Ralstonia solanacearum GMI1000
MTSQSDETSQNKDAALAAELAPLRAQIDAIDSQLLTLLSDRAKVAQAVGEVKKHYASPAFRPDRELQVIRKMQSGNPGPLHGESIAAIWREVMSACRGLEQALRIGYLGPVGTFTEQAVFAHFGHEIQPMPCPSIDEVFRAAEAGTVDCGVVPVENSTEGVVSRTLDLFLQTSLKISGEIALRVHHNLLHKTGDMSQVKVVRAHAQALAQCQRWLNTNYPNLAREAVSSNAEAARMAGEDETVAALASVQAANRYGLHVVRANVEDDPHNRTRFVVIGNYETEPSGRDQTSLILSVPNEAGAVYRLLAPLAENGVSMCRFESRPARSGAWEYYFYVDVEGHQRDPQVARALEKLRHDAAYFKVLGSYPSAH

SEQ ID NO: 91638 - protein, 241 aa, Zea mays
LTSSKGPKFAAVKKIITKKTINKYKEDVLNHKKKDVDKEKLGRNVPQVSSALFFSYNTALGPPYRVIVDTNFINFSIQNKLDLEKGMMDCLYANCTQWITCCVMGWLEKLWQNSCVALPTRKATAFAHAACDAWACYEGTPCITDCVMAELEKLGQKYRVALRIAKDPRFQRLACTHKGTYADDCIVERVTQHKCYIVATCDRDLKRRIRKVPGVPIMYITRHRYSIERLPEATIGGAPRI

SEQ ID NO: 91639 - protein, 327 aa, Gibberella zeae PH-1
MSGGWNTIESDAGVFTSLIENLGVKDVQFEELLTLDPSELLTLHPVYGVIFLFKYPTDQPYATPEGPRDGSFDHAASENIFFAAQTIQNACATQALLSVLLNKTKDVEVGEQLGDFREFTMVLPPEFRGEALSNSDLIREVHNSFARSSPFADETDKTGAETEDAFHFIAYTPINGTLYELDGLQPAPISHGACSSEEFSTKVVDVLQRRIARYDSTEIRFNLLAMCRDLRQRARDFGDEELLAREERKRRDWMFENALRRHNFVGFAGEVMKGVVRSKIAEGGDAACEKWVKEGLERRKNAEQAYRGRAGAGAGGGDGDGDVDMGA

SEQ ID NO: 91640 - protein, 263 aa, Salmonella enterica subsp. enterica serovar Paratyphi A str.
MGKLTGKTALITGASQGIGEGIARVFARHGANLILLDISDEIEKLADELGGRGHRCTAVKADVRDFASVQAAVARAKETEGRIDILVNNAGVCRLGNFLDMSEEDRDFHIDINIKGVWNATKAVLPEMIKRKDGRIVMMSSVTGDMVADPGETAYALSKAAIVGLTKSLAVEYAQSGIRVNAICPGYVRTPMAESIARQSNPDDPESVLTEMAKAIPLRRLADPLEVGELAAFLASDESSYLTGTQNVIDGGSTLPESVSVGV

SEQ ID NO: 91641 - protein, 489 aa, Zea mays
RGAAPQSLTRHEVAGNHVQSRRTELPEPQKPLVDDDGRPLRTGTLWTASAHIITAVIGSGVLSLAWGVAQLGWAGGPAAMVLFAAVIYYTSTLLAECYRCGDPTFGPRNRTYIDAVRATLGDSKERLCGAIQLSNLFGIGIGVSIAASVSMQAIRRAGCFHYRGHEDPCHASTSPYIAVFGVMQIVFSQIPDLDKVWWLSTVAAIMSFSYSTIGILLGVVQIVEHGGPRGSLAGVIGAGARVTMMQKVWRSLQAFGNIAFAYGFSIILLEIQDTIKSPPPSEAKVMKKATAVSVAVTTVIYLLCGCVGYAAFGGAAPDNLLTGFGFYEPFWLLDVANAFVVVHLVGTYQVMSQPVFAYVERRAAAAWPGSALVRDRHVRVGRAVAFSVSPARLAWRTAYVCVTTAVAMLLPFFGSVVGVIGAASFWALTVYLPVEMYIAHPRVARGIMRWLLLQGLSAGCLVVSVAAAAGSIAGVVEDLKAHNPFCWSC

SEQ ID NO: 91642 - protein, 77 aa, Anabaena variabilis
  misc_feature (75)..(75): Xaa can be any naturally occurring amino acid
MSQSETFEKVKKIVIEQLSVENPDTVTPEASFANDLQADSLDTVELVMALEEEFDIEIPDEAAEKITTVQAAVDXIN

SEQ ID NO: 91643 - protein, 248 aa, Thermoanaerobacter tengcongensis MB4
MIYIKSEKEIELMRVAGKVIANLFEVLEKVIKPGVTTLELDRIAEEFIIKNGCIPAFKGLYGFPASICASVNDEVVHGIPGLRKLQEGDIISIDLGANYKGYNADAARTFPVGEISDEAKKLIEVTRESFFEGIKYAREGNRLSDISHAIQVYVESHGFSVVRDYVGHGIGRKMHEDPQIPNFGPPGKGPRLKRGMTLAIEPMVNAGHYSVRTLEDNWTVVTVDGSLSAHYENTIVITEGEPEILTIL

SEQ ID NO: 91644 - protein, 78 aa, Comamonas testosteroni
MSDIEARVKKIIAEQLGVEESQVTNEKAFVADLGADSLDTVELVMALEDEFGIEIPDEDAEKITTVQNAIDYANTHQA

SEQ ID NO: 91645 - protein, 122 aa, Streptococcus thermophilus LMG 18311
MALNIENIIAEIKEASILELNDLVKAIEEEFGVTAAAPVAAAADGAADAGAAKDSFDVELTSAGDKKVGVIKVVREITGEGLKEAKAIVDGAPSVIKEGVAAAEAEEIKAKLEEAGASVTLK

SEQ ID NO: 91646 - protein, 189 aa, Synechococcus elongatus PCC 6301
MMDGRFVPNITIGPLIVEALRPVTQKPLDVHLMIVEPEKYVPDFAKAGADIISVQAEACPHLHRNLAQIKDLGKQAGVVLNPSTPVETLEYVLELCDLILIMSVNPGFGGQSFIPAVLPKIRKLRAMCDERGLDPWIEVDGGLKANNTWQVLEAGANAIVAGSAVFNAPDYAEAIAAIRNSKRPELVTA

SEQ ID NO: 91647 - protein, 507 aa, Burkholderia xenovorans LB400
MNVVNEQAKLSVQQLGHYIGGAPAAPTSGRFKDVFNPATGKVTGSVALASVEEVDAAVQAAKAAFPAWSETAPLKRARILFRFKELLNQHHDELAMLITREHGKVFTDAQGEVVRGIEVVEFACGIPNLLKTDFTDQIGGGIDNWNLRQALGVVAGITPFNFPVMVPMWMFPVALACGNTFVLKPSERDPSASLRIAELLKEAGLPDGVFNVVNGDKVAVDALIDHPDVAALSFVGSTPIAEYIHTEASKRGKRVQALGGAKNHLVVMPDADLDQAVDALIGAAYGSAGERCMAISVAVAVGNVADQLIEKLVPRVKSLVIRNGENLDAEMGPLVTAEHKAKVAGYIASGEAEGAKLIVDGRAHPVASEEGFFIGGTLFDNVGTQMKIYKEEIFGPVLAVVRVPDFASAVELINAHEFGNGVSLFTSDGGVARAFGRQIQVGMVGINVPIPVPMAWHSFGGWKRSLFGDHHAYGEEGVRFYTRYKSIMQRWPDSIAKGAEFTMPVAK

SEQ ID NO: 91648 - protein, 370 aa, Cucumis sativus
MADVGQNNPADFPALPTHGGQYVQYNIFGNPFEITSKYRPPIMPIGRGAYGIVCSVLNSETNEMVAVKKIANAFDNHMDAKRTLREIKLLRHLDHENVIGIRDVIPPPLRREFNDVYISTELMDTDLHQIIRSNQSLSEEHCQYFLYQILRGLKYIHSANVIHRDLKPSNLLLNANCDLKICDFGLARPTSENECMTEYVVTRWYRAPELLLNSDYTAAIDIWSVGCIFLELMNRRPLFPGRDHVHQMRLLTELLGTPSESDLGFIRNEDSKRYLRQLPPHPRQPLATVFPHVHPLAIDLVDKMLTFDPTKRITVEEALAHPYLERLHDIADEPVCSEPFSFEFEQQYLDEEQMKEMIYREALALNPEFA

SEQ ID NO: 91649 - protein, 343 aa, Synechococcus elongatus PCC 6301
MLTVPELLDRTAVVRSHRLSVAPMLDRTDRHCRYFLRQISRRTLLYTEMIVAQAIQYGDRARLLDYDPQEHPVALQVGGDNPQWLADCARIAEDWGYDEINLNVGCPSDRVQKGQFGACLMARPEQVAQCVEAMRSASTLPVTVKHRIGIDDRDSYEELQDFVRIVAESGCDRFSVHARKAWLQGLDPKQNRTIPPLRYDVVYQLKQDFPQLVIEINGGILDLDQAQQHLQQVDAVMMGRAIYDNPYLLAAADAQLYGDHLEPRSRLQVVLAMMPYIEQQLSQGVRLHSITRHLLQLFHGCPGSRAWKRVLTEQGCKPGAGPEVLLAALEQVSESPILIPVRS

SEQ ID NO: 91650 - protein, 409 aa, Oryza sativa Indica Group
MAPRKKKEVFASSQGKQIRFLHYKAETPPQRQEPNRLLLPKRPKPPTSSRPFSPPPPPLPPTRRRPMGSEEEPSQMRRALVDALAGAISGGISRTVTSPLDVIKIRFQVQLEPTTSWGVLRRDVYGPSKYTGLLQASKDILREEGILERKCSSPINVYAIYSYTIHCSTQAENICFWFIQNSPYLICVICPEDHLHLSPYLSYVSGAIAGCAATVGSYPFDLLRTILASQGEPKVYPDMRSAFLDIMKTRGFRGLYAGLTPTLVEIIPYAGLQFGSYDTFKRSMMTWNRYRYSHLNSGSEDDSVSSFQLFLCGFAAGTFSKAACHPLDVVKKRFQIEGLKRHPRYGARIESSTYKGMYHALKEIVAKEGFGGLYKGLFPSLVKSAPAGAVTFVAYEYISDWIGSKAGVE

SEQ ID NO: 91651 - protein, 77 aa, Sideroxylon foetidissimum
TIQCLSGTGSLRVGAEFLARHYHERTIYIPQPTWGNHPKIFTLGGLAVKTYRYYDPATRGLNFQGLLEDLGSASSGA

SEQ ID NO: 91652 - protein, 414 aa, Kluyveromyces lactis NRRL Y-1140
MLEAIAYAAAELLFKRQDVVTDGDTTEVDTHDHDEEDEDHVECESDNDYDGKDNMRVCALFIILISGGLGSYFPILSSRYSFIRLPDWCFFIAKFFGSGVIVATGFIHLLEPAADALGEECLGGTFADYPWAFGICLMSLFALFLSECVARYYTNKSYGFQNDHVHSHFPSSKDQKSLEDEDDEDSDKYNQVVDEENVSLTVANNNNGAEITATNPHPSMPGSNHFSHDKSHQDLATIGTPAQMTSKEKYQNQLLSVFILEFGIIFHSVFIGLALAVTGNDEFNTLFIVLVFHQMFEGMGLGARIAEVSWAKKHRFTPWLLAAGFTLTTPIAIAIGIGVRHSYAPGSRTALIANGCFDAISAGILIYTGLVELMAHEFLYSDNFKGENGLKKMLWAFFTMCWGAGLMALLGKWA

SEQ ID NO: 91653 - protein, 456 aa, Glycine max
MPEIGQAAVAAAADDTALFGKYELGRILGCGAFAKVHYARNVQTGQSVAVKIINKKKLAGTGLAGNVKREITIMSKLHHPHIVRLHEVLATKTKIFFIMDFVRGGELFGKISKGRFAEDLSRKYFHQLISAVGYCHSRGVFHRDLKPENLLLDENGDLRVSDFGLSAVRDQIRPDGLLHTLCGTPAYVAPEILGKKGYDGAKVDVWSCGVVLFVLAAGYLPFNDPNLMVMYRKIYKGEFRCPRWMSPELRRFISKLLDTNPETRITVDGMTRDPWFKKGYKELKFHEEDYHASGSGSFFGPKDERVVNLNAFDLISFSSGLDLSGMFGGEWGERLVTREPPERVLEAAEEAGAAAGMAVRWKKECGVELEGFNGRFGIGVEVYRLTAELAVVEVRKRGGDAAVRGVWEERLKPLLLGGATTSYSNSSEDEQQHQEEEQQHQEEKQEQEPESKVACE

SEQ ID NO: 91654 - protein, 158 aa, Arabidopsis thaliana
MVSREQKRGSLQEKFQLLRSITNSHAENDTSIIMDASKYIQKLKQKVERFNQDPTAEQSSSEPTDPKTPMVTVETLDKGFMINVFSGKNQPGMLVSVLEAFEDIGLNVLEARASCTDSFSLHAMGLENEDGENMDAEAVKQAVTDAIRSWGEINDPQN

SEQ ID NO: 91655 - protein, 589 aa, Coccidioides immitis RS
MFRSRGHLRQSLGAASESSSSTSPERVIDDDTDFFNQPNDSQSSVGVGTLRDLRVDAGQDIVLPPISRLPPELLIAIFAKLNSPTDMLNCMMVCQRWATNCVAILWHRPSCNTWENLKRVAGAITTQGSYFPYYDMVKRLNLSSLSTRVNDGTIISFAQCKRIERLTLTNCSMLTDTGVSDLVNGNGHLQALDVSELKSLTDHTLFIVARNCPRLQGLNITGCVKITDDALVALAENCRQLKRLKLNGVMQVTDRAIRAFADNCPSILEIDLHGCRLITNFTVTNLLCTLRFLRELRLAHCADITEQAFLDLPEGIIFDSLRILDLTACENVRDDAVERIINSSPRLRNLVLAKCRFITDRSVQAICKLGRNIHYVHLGHCSNITDNAVIQLVKSCNRIRYIDLACCNRLTDASVQQLATLPKLRRIGLVKCQAITDRSILALAKPRIPQHPLVSSLERVHLSYCVNLSTYGIHQLLNHCPRLTHLSLTGVHAFLREELTAFCREAPPEFTPQQREVFCVFSGAGVSQLRDFLNQAAIAYHRELEEGTMFNDTDELDEDEGQVTGLMNATGLNDDNDGTPDGGTAPVQS

SEQ ID NO: 91656 - protein, 468 aa, Kluyveromyces lactis NRRL Y-1140
MLRSSTRVAVKSALHKPLVRCATVSQLEAVRSFSSSRISSDISSRNGSFNAVSRRSSGPFQFRCSPSQLNTRFMAVRHATSVPVPPMAESLTEGSLKEYTKKVGDFIEKDELLATIETDKIDVEVISPISGTIAKLNFSPDDTVTVGEEIAQIEPGEAPAGGAAASESSSASAPAAEEQQQQAAPKKEEQPATPKKEEKAAAPAPKKEEKPAAAAPKKTEVDSSATESSTPSFTQFSRNEHKVKMNRMRMRIAERLKESQNTAASLTTFNEVDMSAVLEMRKLYKDEIIKTKNVKFGFMGLFSKACTLAAKDIPAVNGAISGDQILYRDYTDISIAVATPKGLVTPVVRNAESLSVLEIEQEIVRLGKKARDGKLTLEDMAGGTFTISNGGVFGSLYGTPIINMPQTAVLGLHGVKERPVTVNGQIVSRPMMYLALTYDHRLLDGREAVTFLRTVKELIEDPRKMLLA

SEQ ID NO: 91657 - protein, 459 aa, Pseudomonas putida KT2440
MSTHSSTVQNDLAALIHPNTNLAQHREVGPLVIARGDGVRVFDEQGNAYIEAMSGLWSAALGFSEQRLVDAAVEQFKQLPYYHSFSHKTNAPAAALAAKLAALAPGDLNHVFFTNSGSEANDSVVKMVWYVNNALGRPAKKKFISRQQAYHGATVAAASLTGIPSMHRDFDLPAIPVHHLTCPNFYRFARPGESQEAFTVRLANELERYILAEGPETIAAFIGEPVIAAGGVIPPPTGYWAAIQAVCKRYDILVVIDEIITGFGRLGTMFGSQLYGIQPDIMVLSKQLTSSYQPLAAVVVSDAMNDVLVSQSQRLGAFAHGLTCTGHPVATAVALENIRIIEERDLVGHVQHLAPVFQRHLRAFEDHPLVGNVRGVGLMGGIELVADKATRQPFAQPGTLGGYVFKQAHKHGLIIRAIYDTIAFCPPLITTQDDIEAIFSAFERTLADATDWARSQHLL

SEQ ID NO: 91658 - protein, 209 aa, Candidatus Pelagibacter ubique HTCC1002
MNDFMSLGVHRIWKKDLLSWMNPSNNKTLIDVACGTGDLGKLFLDATDKNGEIFCVDPNKGMIGKGKEKLNTYKNINWIIAPAEKLPIKDNSCDYYTISFGLRNTKDLNKALSEAYRVLKPGGRYLCLEFSKIQNSNLDFIYKNYSKLIPLVGKAIVGQKEPYEYLVKSIEEFINQEELIDLMNKNKFVNCSYRNLSGGIVAIHSGWKI

SEQ ID NO: 91659 - protein, 457 aa, Ralstonia solanacearum GMI1000
MRITIIGSGYVGLVTGACLAELGNDVFCFDVDQKKIDLLNAGGVPIYEPGLKELIDRNRTAGRLQFSTDVAASVAHGDVQFIAVGTPPDEDGSADLKYVLAAARSIAEHMDGFKVIVDKSTVPVGTGDKVRAVVAEALAARGKSGIGFSVVSNPEFLKEGAAVDDFMRPDRIVLGTYADEPGLRAKATMRALYAPFNRNHERTFYMDVRSAEFTKYAANSMLATRISFMNEMANLADKVGADIELVRLGIGSDPRIGYSFLYAGTGYGGSCFPKDVQALVRTAQEHGQTLHVLEAVEAVNDKQKEVLVGKIVDRLGEDLSGRTFAIWGLAFKPNTDDMREAPSRIVIAALLARGARVQVYDPVAMEEARHALAIDLSPEQLERVTFCAGQMDALKHADALVIVTEWKAFRSPDFNAVKALLKSPMVFDGRNLFEPQAMRDAGFEYQAIGRSTQSPSQ

SEQ ID NO: 91660 - protein, 303 aa, Salmonella enterica subsp. enterica serovar Paratyphi A str.
MNTLEQTIGNTPLVKLQRLGPDNGSEIWVKLEGNNPAGSVKDRAALSMIVEAEKRGEIKPGDVLIEATSGNTGIALAMIAALKGYRMKLLMPDNMSQERRAAMRAYGAELILVTKEQGMEGARDLALAMSERGEGKLLDQFNNPDNPYAHYTTTGPEIWRQTSGRITHFVSSMGTTGTITGVSRFLREQEKPVTIVGLQPEEGSSIPGIRRWPAEYMPGIFNASLVDEVLDIHQNDAENTMRELAVREGIFCGVSSGGAVAGALRVARATPGAVVVAIICDRGDRYLSTCVFGEEHFSQGAGI

SEQ ID NO: 91661 - protein, 77 aa, Leucothrix mucor
MSDIEQRVKNVVVEQLGVDEAEVTNAASFVDDLGADSLDTVELVMALEEEFGTEIPDEEAEKITTVQLAIDYVKSHQ

SEQ ID NO: 91662 - protein, 251 aa, Candidatus Pelagibacter ubique HTCC1002
MNSQLKKASIERYSRQIVLKDIGTIGQKKIISSKVLIVGMGGLGSPVAEFLTRAGVGSIGIVDDDKVSLSNLHRQSLYNTSDIGKFKVQIARVKIKKINPSIKIKIYKIRLDKNNFKKIIKDYDYIVDGSDNFSTKFLLNDFCYKFKKILVTGAISKFDGHIFTFNFKNKKIPCLRCFFQDSDISDDLLNCESEGILGTVAGIIGTIQANEVLKKILGIGKSLDGYIFILDLLQLNFRKVKLKKRKNCFCK

SEQ ID NO: 91663 - protein, 167 aa, Thermoanaerobacter tengcongensis MB4
MARVDWTKLNLKERVVSINRVSKVVKGGKNFRFSVTVVVGDPDKGYVGVGRGKAAEIPDAIRKAIEDAKKHLIKVPVVGTTIPHEVIGEFGAGKVLLKPAREGTGVIAGGPVRAVLESAGIRDVLSKSLGSSNATNMVYATIEGLKRLKTAEEVARLRGIPVHQLFE

SEQ ID NO: 91664 - protein, 300 aa, Ralstonia solanacearum GMI1000
MAYPTIEDTIGNTPLVRLQRIPGEDNARRGNVILGKLEGNNPAGSVKDRPALSMIKHAETRGRIKPGDTLIEATSGNTGIALAMAAAIRGYKMVLIMPEDLSVERRQSMAAYGAEIVLTPVKGGMEYARDLADAMERDGKGVILDQFANPDNPLAHYEGTGPEIWRDTEGRITHFVSAMGTTGTITGVSRFLKEKNPAIQIVGAQPAEGSRIPGIRKWPEAYMPKIYDPKHIDRTESVSQSDAEHMARRMAREEGIFCGISAAGALCVALRVAEAVENATIVFVVCDRGDRYLSTGVFPA

SEQ ID NO: 91665 - protein, 482 aa, Vitis vinifera
MASTTAAPVVHRPLAGNGRVLGRPMEDVRQTYIFGRELGRGQFGVTYLVTHKETKEQFACKSIATRKLVNRDDIEDVRREVQIMHHLTGHRNIVELKGAYEDRHSVNLVMELCAGGELFDRIIAKGHYSERAAAALCRQIVTVVHNCHTMGVMHRDLKPENFLFLSTAEDSPLKATDFGLSVFFKPGDVFKDLVGSAYYVAPEVLRRSYGAEADIWSAGVILFILLSGVPPFWGENEQSIFDTILRGHIDFSSDPWPSISNSAKDLVKKMLRADPKERLTAIDVLNHPWMKEDGASDKPIDIAVLTRVKQFRAMNKLKKVALKVIAENLSEEEIIGLKEMFKSMDTDNSGTITYEELKNGLPKLGTKLSESEVRQLMEAADVDGNGTIDYIEFISATMHMNRMEREDHLYRAFEYFDKDKSGYITMEELEHALKRYNMGDEKTIKEIIAEVDTDHDGRINYEEFAAMMRKGNPDLITNRRRK

SEQ ID NO: 91666 - protein, 77 aa, Oceanospirillum linum
MSTIEERVKKIVSEQLGVKEEEITNASSFVDDLGADSLDTVELVMALEEEFETEIPDEEAEKITTVQEAIDYVVSHQ

SEQ ID NO: 91667 - protein, 70 aa, Rhodobacter sphaeroides
MSDIADRVKKIVVEHLGVEEEKVTETTSFIDDLGADSLDTVELVMAFEEEFGIEIPDDAAETIQTFGDAP

SEQ ID NO: 91668 - protein, 512 aa, Apium graveolens
MENGTKELNKQPPPSAAMQVQTSPPKLPIATWKLILVAAIAAGVQFGWALQLSLLTPYVQLLGIPHKWAAYIWLCGPISGMLVQPIVGYYSDRCQSSFGRRRPFIASGAGCVAISVILIGFAADIGYKAGDDMTKTLKPRAVTGFVIGFWILDVANNMLQGPCRALLADLCNGDTRRMRSANAFYSFFMAVGNILGYAAGSYNNLYKLFPFSKTHACDLYCANLKSCFIISIVLLIFITVLALTVVREKQWSPDEADEEPPSSGKIPVFGELFGALKDLPRPMLMLLVVTCLNWIAWFPFILFDTDWMGREIYGGTAGQGKLYDQGVRVGSLGLLLNSVVLGLTSIAVEYLVRGVGGVKILWGLVNFLLAIGLVMTVVVSKVAQHQRQHGANGQLLPPSAGVKAGALSLFSILGIPLSITFSIPFALASIYSSGSGAGQGLSLGVLNLAIVVPQMIVSVLAGPFDSLFGGGNLPAFVVGAISAAISGVLAIVLLPKPSKDAAAKLTLSGPYH

SEQ ID NO: 91669 - protein, 576 aa, Glycine max
MGREGAPPPDLQLRRPPPPPPEKPLIQVNNREVAMPKPCDLKINIDGQQIFLLKEKVISKYCGGLKKILNHQKRRCHVKELGIRINDFPGGPKGFELVSMFCYNNGKIQITVANVSLLHCCAVYLGMTEEAFSNNLLQQTETFLERIYYWKWNDILASLKSCQLFYTYADGYGLLEKIISALAKFVQNSDSNLLTSSPSASSWSSSPESNFAKRFSFSSKKTTPEKIKSCLPRKAWWFDDLATLPPTIIEKLFQTIGAYKADNKDLILTRFLLHYLKIATQTKMVNCRNSNEYAALAETAAYGVISVGKETFSCRGLFWVLRIVSKFGLSRDCRTELEKLIGGMLEQATLDDLLVSGHDMGVYYDVNLVIRLVRLFVDINGSDGLSLQKVKRVGRLIDKYLREISPDQNLKISKFLGVAECLPDSARDCYDGVYKAIDIYLESHPTITFEERSRLCRCLNYSKLSFEACKDLAKNPRIPPRVAMQALISQQPKNSTSDRVTESPRMKHSQIVLYNEASRESFSQERRDMRLNIEKMQWGVIELAKLRKQTNVQMPQLFTHNVLLNPARASSSPRFC

SEQ ID NO: 91670 - protein, 308 aa, Erwinia chrysanthemi
KLPNIVILATGGTIAVDTLINAVPEVKKLANVKGEQFSNMASENMTGDVVLKLSQRVNELLARDDVDGVVITHGTDTVEESAYFLHLTVKSDKPVVFVAAMRPATAISADGPMNLLEAVRVAGDKQSRGRGVMVVINDRIGSARYITKTNASTLDTFRANEEGYLGVIIGNRIYYQNRIDKLHTTRSVFDVRGLTSLPKVDILYGYQDDPEYLYDAAIQHGVKGIVYAGMGAGSVSVRGIAGMRKALEKGVVVMRSTRTGNGIVPPDEELPGLVSDSLNPAHARILLMLALTRTSDPKVIQEYFHTYE

SEQ ID NO: 91671 - protein, 341 aa, Burkholderia pseudomallei K96243
MAQYMKAAVVHAFGEPLRIEEVPVPTPGAGQILVNVKASGVCHTDLHAADGDWPVKPTLPFIPGHEGVGFVAAVGEGVRHVKEGDRVGVPWLYTACGHCEYCQTGWETLCHEQQNTGYSVYGSYAEYVLADPNYVGHLPSNVAFDEIAPILCAGVTVYKGIRVTDTRPGQWIAISGIGGLGHVAVQYAKAMGLHVVAVDVAPQKLELARKLGAAFVVDASKDDPAAVIQKEIGGVHGVLVTAVSRGAFAQALGMVRRGGTVSLNGLPPGDFPLPIFSTVLNGITVRGSIVGTRRDLQESLDFAAEGLVRAHIHRDKLEHINGVFSALREGKVDGRIVLTGQ

SEQ ID NO: 91672 - protein, 310 aa, Erwinia chrysanthemi
LPNIVILATGGTIAALGVDTLINAVPEVKKLANVKGEQFSNMASENMTGDVVLKLSQRVNELLARDDVDGVVITHGTDTVEESAYFLHLTVKSDKPVVFVAAMRPATAISADGPMNLLEAVRVAGDKQSRGRGVMVVINDRIGSARYITKTNASTLDTFRANEEGYLGVIIGNRIYYQNRIDKLHTTRSVFDVRGLTSLPKVDILYGYQDDPEYLYDAAIQHGVKGIVYAGMGAGSVSVRGIAGMRKALEKGVVVMRSTRTGNGIVPPDEELPGLVSDSLNPAHARILLMLALTRTSDPKVIQEYFHTYE

SEQ ID NO: 91673 - protein, 308 aa, Erwinia chrysanthemi
LPNIVILATGGTIAGVDTLINAVPEVKKLANVKGEQFSNMASENMTGDVVLKLSQRVNELLARDDVDGVVITHGTDTVEESAYFLHLTVKSDKPVVFVAAMRPATAISADGPMNLLEAVRVAGDKQSRGRGVMVVINDRIGSARYITKTNASTLDTFRANEEGYLGVIIGNRIYYQNRIDKLHTTRSVFDVRGLTSLPKVDILYGYQDDPEYLYDAAIQHGVKGIVYAGMGAGSVSVRGIAGMRKALEKGVVVMRSTRTGNGIVPPDEELPGLVSDSLNPAHARILLMLALTRTSDPKVIQEYFHTYE

SEQ ID NO: 91674 - protein, 221 aa, Synechococcus elongatus PCC 6301
MAQIAERLASLRSQLPPSVQLIAVSKNHPAAAIREAYAAGQRHFGENRVQEAIAKQAELTDLPDLTWHLLGKLQSNKARKAVEHFDWIHSVDSWALAERLDRIAGELGRSPKLCLQVKLLPDPNKAGWDPADLRAELPQLSQLQQVQIRGLMVIAPLGLTAAETQALFAQARTFAAELQQQAPQLRLTELSMGMSSDWPLAVAEGATWIRVGTQLFGPRSL

SEQ ID NO: 91675 - protein, 307 aa, Erwinia chrysanthemi
LPNIVILATGGTIGVDTLINAVPEVKKLANVKGEQFSNMASENMTGDVVLKLSQRVNELLARDDVDGVVITHGTDTVEESAYFLHLTVKSDKPVVFVAAMRPATAISADGPMNLLEAVRVAGDKQSRGRGVMVVINDRIGSARYITKTNASTLDTFRANEEGYLGVIIGNRIYYQNRIDKLHTTRSVFDVRGLTSLPKVDILYGYQDDPEYLYDAAIQHGVKGIVYAGMGAGSVSVRGIAGMRKALEKGVVVMRSTRTGNGIVPPDEELPGLVSDSLNPAHARILLMLALTRTSDPKVIQEYFHTYE

SEQ ID NO: 91676 - protein, 501 aa, Glycine max
MGSAAKYELPFKLNNPDLLHNESFVHGKWVKSKSGKTFEVADPGTGKTWIDCPTNDASDVDEAVKSSHECFLEYKKISPRQRAQMLYKWDALIKENREDIATILVYETGKPRAEAYGEIDYSTGFTWWFAGEAERIQGSVFTPALPNRRIFTIKQPLGVAAALVPWNFPIAMILRKAGAALAAGCTMIVKPSPETPITVLALAYLADKAGFPKGALNVLTTDLDKTPELSEALCRHPLVNKVTFTGSTRVGKLVAKICSDNLKKVTLELGGNCPVLIFDDANIEQAMSQVFALKFRHAGQACITANRIYVQSGIFDKFLERWNAEAQKIVVGHGSDEKTTMGPVTTPRAVDKALSLVEDARKKGAKIHTGGNKVEKNGGYFFEPTVITGVTPDMDIAKEEVFSPISTFIKFETEDEVVKAANDTSMGLASYLFTKNVDRMWRLFENLEAGMIGLNTGNSSAAESPFGGIKQSGYGKESGKDVAVNEYMITKTGTFTLEDQS

SEQ ID NO: 91677 - protein, 264 aa, Synechococcus elongatus PCC 6301
MISSLGIIGGGVMGEALLARLLAQGQVAATAVTVSEPFAARCEFLNDRYGVRCVDDNAEAAQADWVLLAIKPQVFDPAVAGLANLRSDRLILSILAGVPLAKLEAAFPHEAVIRAMPNTPATVGAGVTAIAAGQQVTADQLSQAQEFFAAVGRVVTVPESQLDAVTGLSGSGPGYVALIVEALSDGGVAAGLPRAIATELAIQTVRGTAELLQETGWHPGELKDRVCSPGGTTIAGVATLEQNGLRSALIEAVKAAALRSQQLG

SEQ ID NO: 91678 - protein, 685 aa, Methanosarcina acetivorans C2A
MLSGRMVEIMDMLIYLAPICALIGLIFAGISYKNVQNEGAGNDLIKKITASIHGGAMVYLNRQYRAIAVFVVFLAIIIALILPNGALTAACFVFGAVLSATAGYAGMLTATIANGRTTNAATRGIGPAFRVSFASGTVMGMSVVGLGLFGLSLSFIILESVYTDLDLLTIVNIVAGFSLGASSIALFARVGGGIFTKAADVGADLVGKVEAGIPEDDPRNPAVIADNVGDNVGDIAGMGADLYESYVGSILATMLLAASTAATTFPNIPVENVILVPLIISAIGILASIVGTFFVRTNKTESSAIHMAFNMGLIAAIILTVIASYFVTSMLLGEYGLNVFFATVAGLVAGFLIGQITEHYTSYDRKPTLRVANSCQTGSATNIITGFAKGMESTLWPVVIISIAIYIAFQLSGLYGIAIAAVGMLATLGISLSVDAYGPVADNAGGIAEMSHQKEEVRQITDTLDAVGNTTAAIGKGFAIGSAALTALALFASYGIAVGLSAIDVMNPNVFIGLTIGAMLPYLFSSMTILAVGNAAGEVVVEVRRQFREIAGLMEGKADPDYGKCIAISTHSALKEMIPPGLLAVIAPLLVGLVLGPGALGGLLAGSVASGFMIAITMSNAGGAWDNAKKYIELGNFGGKGSDAHKAGVTGDTVGDPFKDTAGPAINILIKLMSIVAVVFAPLFM

SEQ ID NO: 91679 - protein, 225 aa, Oceanobacter sp. RED65
MNQDQLKQAVGQAAVDYIKPHLQKDSIIGVGTGSTANCFIDALAELKNDFDGAVASSEATAERLKSHGIPVYDLNSSGTLDFYIDGADETNDHLQLIKGGGGALTREKIVAACAKEFICIADESKWVDLLGTFPLPVEVIPMARSYVARELVALGGDPVYRQGFVTDNGNVILDVHNMSIQSATALEERINNIVGVVTNGLFACRPADVLLMGTADGVKTIKAKN

SEQ ID NO: 91680 - protein, 671 aa, Methanosarcina acetivorans C2A
MESLIFIAPLAGVISLVFAAFFAKSILKEDAGNKRMKEIAGAIQEGAMAYLNRQYKTIAVVSIILSFLILFLLDDGLKIAIGFLAGAISSAAAGYIGMSVSVRANIRTAHAASSGLEKAMSVAFRGGAVTGLAVVGLALLGTSSFYILYGDVDLVVGFGFGASLISLFARVGGGIFTKAADVGADLVGKVEAGIPEDDPRNAGVIADNVGDNVGDCAGMGADLFETYVVTSLAAMLLGSLIIGTYENAILYPLVLGSVAIFASIISVFFVKIGKEGKIMQALYKGVGGSAIISLIAFYFVTNSLMGDIRLFYATVVGIIITVLMVIITEYYTSTDYRPVKTIAASSETGAATNIISGLSIGFESTLVPTVVIVIGILISYFIVGGAADAGIGLYGIAIAAVAMLSTTGMIVALDSYGPITDNAGGIAQMANLPAQVRKVTDALDAVGNTTKAVTKGYAIGSAALGALALFADYRSKVNLGGQSLNLDDPVVLAGLLLGALLPFVFSAVTMSAVGKAAFEVVNEVRRQFREIPGIMEGTAKPEYGRCVDIVTKAALHEMAMPGFLAVLVPLLVGLILGPKALAGLLIGLIVVGFMLALMMDNGGGAWDNAKKLIEDGNHGGRGSEAHKAAVVGDTVGDPFKDTAGPALNALIKVVNMVAILFSSLIIHSGLF

SEQ ID NO: 91681 - protein, 393 aa, Prochlorococcus marinus subsp. pastoris str. CCMP1986
MSEVNLSKRALSIEPSLTLQISAKANQLAKEGKDICNLSAGEPDFDAPNEILKATSEAIFDGYTKYGPASGDLELRKAIAEKLQTQNNLNVEYENVMVTNGAKQSIYNLFQVLLNDGDEVIIPAPYWLSYPQMVRLAGGKPVFLNSSAEDGFKINIQDLKSKISPKTKFIIINSPNNPTGRVMPKEELLQIAELVRENKNINILSDEIYELILKKEFKHLSLASLATDLKERIFIINGFAKGWAMTGWRVGYLVGQKDVIKASSALQSQSTSNVCSFVQRGALEALKINREFFLEINSHYDLRREVLYKGLKNIEGLFISPPNGAFYAFPRLPNNSMTSVEFCKRILNDYGLVVVPGKPFGDDQCIRISCASSKEKILDGLTRLEKGILNYYF

SEQ ID NO: 91682 - protein, 443 aa, Pseudomonas putida KT2440
MSQSTSGASLRRSLGPFSVLLFGLAFLAPLIVFGTYGVITQASGNTTAMAYLVAATGVVFTALSYGRLVRVFPVAGSAYTYTRKMLNANLGFMVGWAALLDYFFIPMLIWLLGASYLNMAFPEVPQWVWITGFIVSTSLLNVLGIQVANRFNVLLMVVQLVIIAVFIGLCVHYIVAANGPGGLLSAKPFFNQDVPFATSMAGAAIAAYSFLGFDALSTLSEETRDPGRTLPRAILLVALIGGSVYVGSSYFMYLAHPSPTFELVDGAAFEIARMIGGDLFFAVVLTGIIVAHFAAGMSFQASVGRLLYALGRDNQLPRRLFGALHPRYKTPAFNILLCGVFGTAGFGLTIATATSLVNFGAFLAFTAVNLCALRLTFDARVKDGAGLLRGVLFPLIGLVTAGWMLVSLDKDALIMGGCWLGLGLVYLACRTSLFRNPVPDALV

SEQ ID NO: 91683 - protein, 576 aa, Oryza sativa Indica Group
MTSARPAPVSAGEASLGRHLARRLVQVGVSDVFAVPGDFNLTLLDHLIAEPGLRLVGCCNELNAGYAADGYARARGVGACAVTFTVGGLSVLNAIAGAYSENLPVICIAGGPNSNDYGTNRILHHTIGLPDFSQELRCFQTVTCHQAVVTNLEDAHEQIDTAIATALRESKPVYLSISCNLPGLPHPTFSRDPVPFFLAPRLSNKMGLEAAVEATVEFLNKAVKPVLVGGPKLRVAKAGKAFVDLVDASGYAYAVMPSAKGLVPETHPHFIGTYWGAVSTAFCAEIVESADAYLFAGPIFNDYSSVGYSFLLKKDKAIIVQPERVIVGNGPAFGCVMMKEFLSELAKRVNKNTTAYENYKRIFVPEGQPLESEPNEPLRVNVLFKHVQKMLNSDSAVIAETGDSWFNCQKLKLPEGCGYEFQMQYGSIGWSVGALLGYAQGAKDKRVIACIGDGSFQVTAQDVSTMIRCAQNSIIFLINNGGYTIEVEIHDGPYNVIKNWNYTGLVDAIHNGEGKCWTSKVKCEEELTEAIGMALGEKKDCLCFIEVIAHKDDTSKELLEWGSRVSAANSRPPNPQ

SEQ ID NO: 91684 - protein, 268 aa, Oryza sativa Japonica Group
MAAAAARSIPYRWTLAGATALVTGGSKGIGHAIVEELAGFGARVHTCARNAAELEASRRRWEERGLRVTATVCDVSARGDRERLVAAAAAEFGGRLDILVNNVGRTMFRAAAACSGEDFAVLVATNLESCFHLSQLAHPLLLAAGGARGGGGGCVVNISSVAGSVGMPALAVYSMTKGGMNQLTRSLAAEWAGDGIRVNCVAPGGVKTDICQDETIDPELIKSEMDRLPMRRLAEPEEVAATVAFLCMPAASYITGQVVGVDGGRTIS

SEQ ID NO: 91685 - protein, 273 aa, Ustilago maydis 521
MVTYDATASYGSSGSYADTGLRGPVPRDARLIALILSSMGVSDVEPAVLLQLLEFAHRYTYDVLSDALVYSDHANSRQAGSNLSLDDVNLAIQSRVNYSFTKPPEKDMLLALASTVNAIPLPPISDRHGVRLPAAQHCLTNVNFSIVPNPLPADFDDFEQAPPPLDPACPTSNGSGGGGVSQSTLADTQASTGSNLFDSNPARPARDKDDYDNDDADMSADDASVTTLHPSQSQTHLAPDTADPSSQSHTQSLPNTDSSRGVKRSLDEDDEYD

SEQ ID NO: 91686 - protein, 322 aa, Prochlorococcus marinus str. MIT 9211
MPIASDITTLVGKTPLVRLNRLPKAFGCEAELIAKLESFNPTASVKDRIAGAMVAAAEKDRTIVPGKTVLVEPTSGNTGIALAMVAAAKGYRLILTMPDTMSIERRSMLRAYGAELQLTPGKEGIQGAITLAQEIVSSLPDAYLLQQFDNPSNPEVHEQTTAEEIWVDCDGQIDGLVVGVGTGGTITGCAKLLKQRNPKILIYAVEPSASAVLSGKSANPHHIQGIGAGFIPSVLDTALIDEVIEVDDNQAMEIGRQLARQEGLLSGISSGAAVAAALKVGSRKEMKNKRLLVVLPSFGERYLSTSMFNSVSSIPPRPDGYI

SEQ ID NO: 91687 - protein, 291 aa, Blastopirellula marina DSM 3645
MSTGHSRRLIFGCGYVGLRVAQRWRKQGDVVFAVTRSADTAAQFAADGLQPIIADVTDEDSLGDLPAVDTVLFAVGYDRTAGKPIEDVYVAGLAKVLDHLPSHCGRLIYISSTGVFGDAAGQVVDEQTPCDPRRSGGKACLAAEELLRSHPSWQAKHVSLRLAGIYGPGRIPRAKEIAAQIAIPAPGAGALNLIHVDDAAETVLLAATHPAPQSLYIISDGHPVERTEYYAQIARSLNAPDPVYEAADPQSPAALRAATNRRMSNALAVEHLGLTPQYPDYRAGLAAILGM

SEQ ID NO: 91688 - protein, 515 aa, Zea mays
  misc_feature (405)..(405): Xaa can be any naturally occurring amino acid
LHARALRAGVPPAHPLLAKHLLFHLASLRAPPVRYAVAILTRVLPDPDPFALNTVLRIAASSPRPSLALALHARRLAPPDTHTYPPLLQACARLLSLRDGERIHAEAAKNGLAALVFVKNSLVHLYGACGLFESAHRVFDEIPVRERNPVSWNSMLNGFAANGRPNEVLTVFREMLDVDFTPDGFTMVSVLTASAEIGALALGRRVHVYLTKVGLVGNSHVGNALIDLYAKCGGVEDARRVFEEMGTGRTVVSWTSLIVGLAVNGFGKVALELFGVMEREKLVPTEITMVGVLYACSHCGLVDDGFTYFNRMKEEYGIAPRVEHLGCMVDLLGRAGKVEEAYDYILTMPLEPNAVVWRTLLGACAMHKKLELGEAAWARLVELDPGHSGGYVLLSNLYAAVGRWXDVHVLRKRMAKDRVRKNPGRSLVELRNSVYEFVMGDRSHPESEQIYQMLAEIADRLKREGYIPRTSNVLADIEEEEKETALNYHSERLAIAFALLKSLSGTPIRIVKNLR

SEQ ID NO: 91689 - protein, 414 aa, Cryptococcus neoformans var. neoformans B-3501A
MPGPAVTPNKPSHRRRSSVTNALNQIPLNHEQGSSIQPVEEVKPLTSRPRPKSKGTRDALPEIYKSNGFWDDVKTGRWMLIPSSSFKLMLIAPILYFNHRLLVHYGILGPDTPNIFEHLIFPSNRLPDGRYGKSWWDLVFLANYIIFWSFVRQFMTLKVFRPMAMSLGIKGGKIMRFTEQGYACFYFSILGSLGVYVMHGLPTWWYKTEHFWLEYPHREMSWELKTYYLVQAAYWLQQTILLAAKIEKPRKDFKELVAHHIVTLWLVGWSYNVYLTYIGVSIFVTMDVSDVFLALAKCVNYVSDFWSVPVFAWFIFVWSYFRHYLNIWILWSVWAQFDLIRPSERSAFDPLNDKWLSWWMKWQIFTPIFLLQLINLFWYFLIWRILVRAVFYRDLKDERSEDEEEEEEVKVKAE

SEQ ID NO: 91690 - protein, 643 aa, Cryptococcus neoformans var. neoformans B-3501A
MSAPHHQQGDRVEYDEPNLPRLNQNEFEDSSSEFSEDPKAPVKRGIASASRVLSVITKKDIRIAYLALTVLALGMAFAQYTQTTFTAYATSAFKSHSELAAAAVVSRVFSMIAYLIVPKICDNVGRISPSIIISMVVFTVLSDAMMAGCKNVQTYIGANVFSGLSSTGYTIALQIYYAETTAIRERALWNVAADSFSAIITLYSGSTIGGLILENWGTTSGWRWGYGMWSIINTVLAIPFIAILFSWHRRVRRNPNVPRLPPHTNVIDQLFHEYDLIGSCLLVASVALILVPLTLAKGVASQWTDDNIAMICVGFGLLVLFIVWSIPKKWRPKWFFTPRLPLIPWYTLKNRSLMSMFVINMCDFMSYGVFTTYFQTFMQVAVRTSASKASMIDNTLRIVFQVTALVVGLVMRFWTPACVKLGLGKRLFHTRYPVWIGIPLCALSIGIDINFVQHPRRKSAIASYVIAKAIYGVGRGMFQTSAQITVQASSRRRELAIATGIFYFAASLGGAIGIAVAGAIWLNILPDALANNLPAASANLASTIYGSITVAISYDPNSEIGLAILKSYVHTMKILAIVSTCLQIPMLISMFFIEDLQLTEDEQIILGGKRIGLGKKKQEQIDEREGEEEVKMVEKEKPVVRAD

SEQ ID NO: 91691 - protein, 503 aa, Oceanobacter sp. RED65
MAENYIKRILEANVYDVAVETPLSEAKFLSNRLGNNILIKREDKQPVYSFKCRGAYNCIAKKSPEQLAKGVVTASAGNHAQGVALSAQQLGIKATIVMPRTTPEIKVANVRARGAKAVLHGDTFDEAFAHSQKLVEEKGMTYIHPYDDPDVIAGQGTIAMEILRQHSGPIHAIFVCVGGGGLAAGIAAYTKYLRPETKVIAVESTESACLDAAMKAGKRVKLPHVGIFADGVAVGQIGKHTWKVCKEHIDEVITVTPDELCAAIKDIFDDTRSVAEPAGALGVAGMKKYIEKTGIKDETMVAIESGANINFDRLRYVSEMAEVGEKREVLMAVTIPERPGSFKQFCNVLGKSNITEFNYRYGKSDQAQIYVGVKIAEGGKQELFDELEKKGYPVLDLSENEISKYHIRHMVGGHAPEEVQDEILYRFEFPERPGALMQFLKHLGERWNISMFHYRNHGAANGRVLAGLQVSKDDQKAFKQHIKELGYPCWDESDNPAYQLFLK

SEQ ID NO: 91692 - protein, 347 aa, Pseudomonas syringae pv. phaseolicola 1448A
MPQPRPYKVALNGYGRIGRCVVRALCERGAKAGFEVVAINDLADMASLEYLTRFDSTHGRFPGEVRVEGQYLHINDHRIKVLRSATPEGIDWAGLEVDLVLECSGVYNTREDGQRFLEAGAPRVLFSQPMASERDVDATVVFGINQHKLTGRELLVSAASCTTNCSVPLLRLLDQAIGLEYMTITTIHSAMNDQPVIDAYHHEDLRRTRSAFQSIIPVSTGLARGIERLLPELAGRIQAKAVRVPTVNVSCLDITLQMSRDTDAVEINRILREAATSGPLKGLLAYTELPHASCDFNHDPHSAIVDASQTRVSGPRLVNLLAWFDNEWGFANRMLDVADHFLRVADQ

SEQ ID NO: 91693 - protein, 347 aa, Zea mays
MFFCLLLTYIYIFFAFQDAKEGTTTGVSAKDRAKTVMTLASPDSKPEDLNRPGHIFPLKYREGGVLKRAGHTEASVDLAMLAGLPPVAVLCEIVDDADGSMARLPKLRVFAEKENLKIISIADLIRYRRKRDRLIERASVARLPLKWGNVHAYCYKSVIDGIEHIAMVKGDIGDGQDILVRVHSECLTGDIFGSARCDCGDQLAMAMEMIEKAGRGVLVYLRGHEGRGIGLGHKLRAYNLQDDGRDTVEANEELGLPVDSREYGIGAQILRDLGVRSMKLMTNNPAKYSGLKGYGLSIAGRVPLITPITSENRRYLETKRTKMGHVYGLANAQANQANGSQSTEENH

SEQ ID NO: 91694 - protein, 398 aa, Bacillus amyloliquefaciens
MFHPIEEALEALKKGEVIIVVDDEDRENEGDFVALAEHATPEVVNFMATHGRGLICTPLSEDIAGRLDLHPMVDHNTDSHETAFTVSIDHKLTKTGISAQERSFTIQALLDEESVPGDFQRPGHIFPLIAKKGGVLKRAGHTEAAVDLAKACGSQGADVICEIMNEDGTMARVPEISEIAKSHQLKMITIKDLIEYRYNITTLVNREVDITLPTDFGTFRVYGYTNEVDGKEHLAFVMGDVPFNSGPVLVRVHSECLTGDVFASHRCDCGPQLHAALRQIAEEGRGVLLYLRQEGRGIGLINKLKAYRLQEQGYDTVEANEALGFLPDLRNYGIGAQILRDLGVQHMKLLTNNPRKIAGLEGYGLSISDRVPLQMEASEHNKQYLQTKMKKLGHLLHF

SEQ ID NO: 91695 - protein, 424 aa, Arabidopsis thaliana
MSSPAASTTNEPRHENIHRVSSSSLFSLVKGLITGLLQSQLMRRAINLINRNPRPYDIAADQSSLLFSSLPYDVVLNCLARVSRRYYPNLSCVSKSFQSLVRSPELAHMRSLIGKDDPVVYVCFSDTKPFLGRRLDWFTLNPNEKKTSVLNSFQVFSYYMLYCPSVSIGSKIYFVGGCMYKCLPGLLIFDSWSGELCVGPSMKEARMLPGVAVVNGKLYVMGGCREDQIQVEVFDPNSQTWEVGPLSSDGEVRYGKGLMRYGAIVTEAVALEGKVYCMSYKDGSHIIYDTKDGKCETFLMADGKAWRRGGVCVVNSVIYVYYINLGVMWYDPKDKVWREVKGLNKLDYKSIDMVGMVDCNGKLGFLWGNNTREIISGRTEKRIWCEMIVLERSGVEIHGTVEWSDLVGFVPHDYEIWRCLGVSY

SEQ ID NO: 91696 - protein, 489 aa, Methanosarcina acetivorans C2A
MNINVNINGRENMQIPDHKTKIVCTIGPASFSEEVLRKLVLAGMNVARINFSHGDFESHGKVIRRVRKVAEELDRTVAILADLPGPKIRVGKLKKEPLMLHKGNRITLTTDETSGSEDRIPVNYKQLPESVSPGSLIYLSDGFIQLLCLEISGKDVVCEVMVGGQLYSHKGLNLPGAKIYLDSVTEHDFKILEFALNEEVDAVSISFVEKAEDIRKVRNFASTMGKPVYVVSKIERSQAVQNIEEILEETDALMVARGDLGVEIPIQEVPSVQKELIRSAKLLSIPVITATHMLASMTDNIRPTRAEATDVANAILDGTDAVMLSEETAVGNYPVETVEMMAKIAKTTENWRSRTKWGLDTMLKGITAQKMSVDEVIALQVHEALQKLPVAVVLTPTRSGATPRRLSRFKPEPWILAFTRFPKTCSSLALSYGVYPIIVKEVSENWETETTEKAKELGFAKSGELVVFTQGPASGKPGGTNMLKILTLD

SEQ ID NO: 91697 - protein, 337 aa, Synechococcus elongatus PCC 6301
MTAEQVWLRSEIMGTQVITRDSGRRLGVVGELLVDIDRREVVALGLRDNLLTRFLPGVPRYMFLSSIRQVGDVILVDNDDVIEDNFDAIGLSNLINCEVITEAGEPLGRVRGFKFDIATGKLESLVIASLGLAFVPESVLSTFELGVQEIVSGGPDRVIVFEGAEDRMVQLTAGLLEKLGLGGWDDDEYDRYSLPITPVENQLGAGDPLPPQRDYNQQPFRARREDRRQEELVEPLRQSRPAARRMYLDEEESNPAPRSRSQQPSRDRYEEGDYEELPAPRVQRRPEPAPRSPAARPSAPQPLPQDDDPFGDAWGEPDDSPELQLPQRQRQPEYEEG

SEQ ID NO: 91698 - protein, 162 aa, Kluyveromyces lactis NRRL Y-1140
MSKVFFDVEADGQPLGRIVFQLYNDVVPKTTENFRALATGEKGFGYAGSVFHRVIPDFMLQGGDFTHGTGVGGKSIYGAKFPDENFVKKHEKPGLLSMANAGPNTNGSQFFITTVPCPWLDGKHVVFGEVADGFDVVKKVESLGSGSGATKARIVIAKSGEL

SEQ ID NO: 91699 - protein, 467 aa, Gibberella zeae PH-1
MSASAIPEMNGGLESHVTVQKRAYYSPPWADVSIIGVAGSSGSGKSTLSQAIVKKLNLPWDSFYKTLTPEQSKMAFANEHDFDSPDAIDFDVLVEKLRDLKAGRRAEIPVYSFAKHARLDHTTSIYSPHVLVLEGIFALYDPRVIELLDMGIYCEADADTCLSRRLVRDVRERGRDIEGIIKQWFGFVKPNFEKFVEPQRKVADLIVPRGIENRVALDMMVQFVEKKLFEKSRHHREALSRLEAASKDSALSDRVVVLNDTRQLKFMNTILQDIDTDPEDFIFYFDRLASLIIEQALNNAHFEAKKIITPQGYEYKGLVPTGEVCAVIVLRGGSAFEPALRKTIPDCRTGRLLIQSDYSTGEPELHYLRLPDDIASQQSVLLLDTQMATGGAALMAVQVLVDHGVQQDRIVLATYSAGKVGLHRLTSVFPEITVVVCNMLDYQQERWVEKRYFRFNIGGRVGIGMTG

SEQ ID NO: 91700 - protein, 442 aa, Glycine max
  misc_feature (403)..(403): Xaa can be any naturally occurring amino acid
MANALHNAAISRVMFGDQYSISRCVVPSLSTLPLRAMHKGKHVELNRTVMVVKAKTNSDFDDSDVDISLSHRVNAVKLSKTLSICDHATALLQAGVPVIRLFFGESDFDTPGAIAEAGMNAIREGYTRYTPNAGTLELRQAICHKLKEENGITYSPDQIVVSNGAKQSIVQAVLAVCSPGDEVIIPAPFYVSYPEMARLAHATPVILPSHISRSVYSKKLLEEIAQIVAKHPRLLVLSDENYEHIIYAPATHTSFASLPGMWDRTLIVNGLSKTFAMTGWRLGYIAGPKHFVAACEKIQSQFTSGASSISQKAGVAALGLGYAGGEAVSTMVKAFRERRDFLVESFREMDGVKICEPQGGFYVFLDFSSYYGREAEGFGVIENSDSLCRYLLDKGLVALVPGXAFGDDTCIRISFAESLTTLKTAVERIKKALIPLSSSALV

SEQ ID NO: 91701 - protein, 141 aa, Lactobacillus reuteri
MNLPNKLTVIRLIIIPFFLLLMVLPLQSWGAVSFWGATIPMAQLIAAILFIAATITDNLDGQIARRHHLVTNFGKFTDPLADKLLVMTAFIVLTGNGVVPSWVTSIIIWRELSVTGLRLLLVEQDGVVLAAKMPGKIKTTT

SEQ ID NO: 91702 - protein, 105 aa, Zea mays
AGAGTLYAGEAYQLQVDFPEHYPMEAPQVIFLNPAPMHPHIYSNGHICLDILYDSWSPPMTVSPVSMLSSSPAKQRPAGNDRYVRNCRNGRSPKETRWWFHDDTV

SEQ ID NO: 91703 - protein, 487 aa, Bacillus cereus ATCC 10987
MGVLLPVNAGQISKLRLEGDVQELEKNLKKDLKIRHITMISIGGVIGAGLFVGSGAVVHSAGPGSIISYALAGLLVIFVMRMLGEMAAINPTSGSFATYAREAIGPWAGYTIGWLYWFFWVIVIAIEATAGAGIIQYWIPEIPLWLLSLILTILLTLTNVFSVKSFGEFEYWFSFIKVISIVLFLCLGLAVILGFVPGTEAPGTSNLVGQGGFMPNGISSVLLGITVVIFSFMGSEIVAVAAGESAEPVKAVKTATNSVIWRILVFFIGSIAVVVTLLPWNSANILKSPFVAVLEHIGVPAAAQIMNFIVLTAVLSCLNSGLYTNSRMLFSMAERGDAPKAFLKLNNSGVPVRAVLFGTFFAYIGVVFSYISPDKVFLFLVNASGGIALLVYLVIAVSHLKIRKKMGKVEQQNLKVKMWFFPYVTYVTIAAIIAVLVAMLAIESLRSQALLTMLVTVLIILSYFIFNRNKNSTVSNTTSKNEESVRF

SEQ ID NO: 91704 - protein, 200 aa, Photobacterium phosphoreum
MVNVRERVSLKVGINSNAPAELLSFNGLESGKEHIALIFKDAYKAFVPLVRMHSECLTGDGFHSTRCDCGEQLDETIEIMAELGGIILYLRQEGRWGLGLYNKIDAYKLQSQGMDTYEANNHLGFDDDLREFSEAAQMLTALGIKDIRLVTNNPKKIKDLQQNGINIVEVVGTKAHLKEGNEGYLKAKASHGRHCFNFDK

SEQ ID NO: 91705 - protein, 550 aa, Salmonella enterica subsp. enterica serovar Paratyphi A str.
MQNPYTVADYLLDRLAGCGIGHLFGVPGDYNLQFLDHVIDHPTLRWVGCANELNAAYAADGYARMSGAGALLTTFGVGELSAINGIAGSYAEYVPVLHIVGAPCSAAQQRGELMHHTLGDGDFRHFYRMSQAISAASAILDEQNACFEIDRVLGEMLAARRPGYIMLPADVAKKTAIPPTQALTLPVHEAQSGVETAFRYHARQCLMNSRRIALLADFLAGRFGLRPLLQRWMAETPIAHATLLMEKGLFDEQHPNFVGTYSAGASSKEVRQAIEDADRVICVGTRFVDTLTAGFTQQLPAERTLEIQPYASRIGETWFNLPMAQAVSTLRELCLECAFAPPPTRSAGQPVRIDKGELTQESFWQTLQQYLKPGDIVLVDQGTAAFGAAALSLPDGAEVVVQPLWGSIGYSLPAAFGAQTACPDRRVILIIGDGAAQLTIQEMGSMLRDGQAPVILLLNNGGYTVERAIHGAAQRYNDIASWNWTQIPPALNAAQQVECWRVAQAIQLAEVLERLARPQRLSFIEVMLPKADLPELLRTVTRALEARNGG

SEQ ID NO: 91706 - protein, 406 aa, Cryptococcus neoformans var. neoformans B-3501A
MPHKIILDTDPGVDDVLAILLALSSPEVDLALISIVFGNTHAPVAHSNLLKIYHLLAQEVAQTAGAEGRYGRLKGQVKTVLAMGEDGPIGGEKAVAAYFHGPDGLSNISETHPHFTPPEIQPGDMHAHLDTSPKPSYEVILDILRAEPDDSVTIVALGPLTNIAHSLRADPETFTKVSRVVWMGGAIDHPGNTSPVAEFNCFADPYAASSVISAAKEGKIELVMAPLDITTPHAIPFSDLIHPSVVPIPEPSTGAVRKAPETPTPLEAFISAMLVRVRGLQASFGLPDAMEMHDPVAVWYAIAHAGVPRGAGPVEGWALQGREFTVERTGEYTRGMCVVDRRGTGETGVDRSKDERILSQGLAQDTGNTLPEKALKPRMLPLVITRTPGAEVLRSTLLGRVFGERE

SEQ ID NO: 91707 - protein, 434 aa, Oryza sativa Japonica Group
MAASAAASRAQRLSRIFSSSSPSVRPPKPGQVKEAPKPAPTKKAPAPGAEANPNLRRNAIDDIIKGLLRERDPDKLVSGFIAASSTHPRFRARHRVYDVAVSRLATFGRLDGVEAIIDAQKPFLETSKEGFAARLIRLYGHASMASHAAATFHDLPPQLKSTMTFNSLLAAYVEAGEFEALAAAFKEIPVSNPSVVPSVYSYNILLQALCKVPDLSAALDTMTLMEKSGISPDLVTFNTLLNGFYNHGDMDGAEKVWEMITERNMVPDAKNYNAKLRGLVAQGRIEDAVAVVEKMEKDGPKPDTISYNELIRGYCKDGRLEEAKKLFEDMAENGYVANRGTYHTLIPCLVKAGELDYALKCCHEIYGKNLRVDCFVLQEVVTALVTASRVEDATKIVELGWNNSYPRRILNIPHATEKNKEESISEEEEEPENA

SEQ ID NO: 91708 - protein, 197 aa, Vitis vinifera
MSNFSAANPNPNKSIEVAQPPTDSVSSLKFSPKANFLVATSWDNQVRCWEITRDGATTGSVPKASISHDQPVLCSAWKDDGTIVFSGGCDKQVKMWPLLSGGQPVTVAMHDAPIKEVAWVPEMNLLVTGSWDKTIKYWDTRQSNPVHTQQLPDRCYAFTVRHPLMVVGTADRNLIVFNLQNPQICKMTDIQLLELFV

SEQ ID NO: 91709 - protein, 310 aa, Pseudomonas aeruginosa UCBPP-PA14
MYLVCGEALFDVFSLESAARSNELGFTAIAGGSPFNVAVGLRRLGVEAALFGGLSSDYLGARLRRVLEEEGVDCGFLVPSDAPTTLAMVGLDASGSAQYQFRGEGCADRQVRLEHLPTLDGRIRGLHVGSYTLVVTPVADTLLALVRRESGRRLVSLDPNVRLDPQPDIDLWRRRVEAFASHAHLIKASEEDLALLYPDRDPGEVARGWLNPRCRLVFVTHGGAGASVHCTHGSWSRPADTALALRDTVGAGDTFQAATLAYLRRLDADSPAGLAALSREAIDAMLAFAIRAAAVTCSRVGPDLPFAHEL

SEQ ID NO: 91710 - protein, 302 aa, Burkholderia pseudomallei K96243
MRNFSGKVAAITGAGSGMGRSLAVELARRGCHLALGDVNERGLAQTAAICAAHGVKITSQRLDVASRDAVFDWARRTRDAHGKVNLVFNNAGVSLAAPAETARIEDFEWIMGINFWGVVHGTQAFLPYLRESGDGHVINTSSLFGLVAMPTQSAYNATKFAVRGFTEALRMELELEGAPVSVTCVHPGGVATNIATASRIDSSIAALTGQDIETHRRAANRLINVTTPEAAARQIIAGVERNARRVLVGADARRIDKLARLFGSAYQVFVLRFVRKSRERNLARQPAAARPTPSSSISKDPA

SEQ ID NO: 91711 - protein, 179 aa, Triticum aestivum
  misc_feature (80)..(80): Xaa can be any naturally occurring amino acid
  misc_feature (100)..(100): Xaa can be any naturally occurring amino acid
  misc_feature (132)..(132): Xaa can be any naturally occurring amino acid
  misc_feature (151)..(151): Xaa can be any naturally occurring amino acid
KNFGGGPSTILLWCKWLILKGGGFDGVINRFVQRIRRRGVDFHHHLIDIVHRPIVAYWVNQIRCCDVHHAGQSQAKACIXHDQSVLCSAGKDDGTTGFSXGCDKVVKMWSLEYGVQATPFSGHEAPVKELRXWSSQMSLVVSGSWHETLRXWAISHPYADHVRHVRERTDTLSLSNPLM

SEQ ID NO: 91712 - protein, 500 aa, Pseudomonas syringae pv. phaseolicola 1448A
MNESPVIGHYINGHLNDGDGERYSDVFNPAIGTVQARVALASVKTVDEAVASAKAAFPGWADQSSLRRARVMFKFKELLDRHHDELAQIICREHGKVLSDARGEVVRGIEIVEFACGAPSLLKSDFSDNIGGGIDNWNLRQPLGVCAGVTPFNFPVMVPLWMIPMALVTGNCFILKPSERDPSASLLMARLLKEAGLPDGVFNVVQGDKVAVDALLQHPDIEAISFVGSTPIAEYIHQQGTAHGKRVQALGGAKNHMIVMPDADLDQAADALIGAAYGSAGERCMAISIAVVVGDVGQQLIDKLLPRIDQLKVGNGMQADSDMGPLVTAVHKAKVEGFIDQGVKEGAKLIVDGRHFKVPGAEQGFFVGATLFDHVTPQMQIYKEEIFGPVLGIVHVADFASAVELINAHEFGNGVSCFTSDGGVARAFARTIKVGMVGINVPIPVPMAWHSFGGWKRSLFGDHHAYGEEGLRFYSRYKSVMQRWPDSIAKGPEFSMPTAK

SEQ ID NO: 91713 - protein, 773 aa, Hordeum brevisubulatum
MVVAAAILPELATQLVVPVAAAVGIAFAVLQWFLVSKVKVAPERRGEGSGSAGAGGGKDGASEYLIEEEEGLNDHNVVLKCAEIQTAISEGATSFLFTEYKYAGGFMTVFAVLIFVFLGSIEGFSTKSQPCHYSVGKTCKPALANAAFSTIAFVLGAVTSLVSGFLGMKIATYANARTTLEARKGVGKAFIVAFRSGAVMGFLLAASGLFVLYVAINLFGLYYGDDWEGLFEAITGYGLGGSSMALFGRVGGGIYTKTADVGADLVGKEERNIPEDDPRNPAVIADNVGDNVGDIAGMGSDLFGSYAESSCAALVVASISSFGINHEFTPMMYPLLISSVGIIACLITTLFATDFFEVKEVDQIEPALKKQLIISTAVMTVGIALVSWLGLPYTFTIFNFGAQKTVHSWQLFLCVAVGLWAGLVIGFITEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAGITTVDVLTPNVFIGLLVGAMLPYWFSAMTMKSVGSAALKMVEEVRRQFNTIPGLMEGTAKPDYATCVKISTDASTKEMIPPGALVMLTPLIVGTFFGVETLSGVLAGALVSGVQIAISASNTGGAWDNAKKYIEAGASEHAKSLGPKGSDCHKAAVIGDTIGDPLKDTSGPSLNILIKLMAVESLVFAPFFATYGGILFKYL

SEQ ID NO: 91714 - protein, 619 aa, Zea mays
  misc_feature (149)..(149): Xaa can be any naturally occurring amino acid
EAQARHGEQGTRGVVAPSEAAATPSPPFVRPFPFSFPFASLAFLLPTPLHSNATASPRFIGRRPRHIATVSHRRGHPFSLVHRIAPAPSAIDPSVPRCASAMQFSSVLPLEGKACMSPVRRGSGGYGSERMRINCCSIRRNKALRRMCXVQGGAVSSTQCVLTSDAGPDTLVVRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGAALEEMKVDTSFLNFAIDSPAEYPYIASMGVYVFKRDVLLDLLKSRYAELHDFGSEILPKALHEHNVQAYVFTDYWEDIGTIRSFFDANMALCEQPPKFEFYDPKTPFFTSPRYLPPTKSDKCRIKDAIISHGCFLRECAIEHSIVGVRSRLNSGCELKNTMMMGADLYETEDEISRLLAEGKVPIGVGENTKISNCIIDMNARVGRNVSITNKEGVQEADRPDEGYYIRSGIVVVLKNATIKDGTVI

SEQ ID NO: 91715 - protein, 281 aa, Gibberella zeae PH-1
MSSSANLVESAKKLAAYQAVNDHLDASYKFVGIGSGSTVVYVVDAIVSKGPEFYKGMTFIPTGSQSKGLIRAAGLNLVNLDERPMVDGLPVPLDVAFDGADEVDEDLNLIKGGGACLFQEKLVAIAAKKFIAVADYRKQSPKLCTTWKTIPIEVLPLSAPDVLVRLRAMGSPKPAIRSGLPAKAGECVTDNGMWLIDAPFSPLLLPKDINSENKGRGENGAWEVNALAEELVRTPGIVEIGLFHGFNGNEAVKLGKESQAQKPIAAYFGLANGEVQVQNAA

SEQ ID NO: 91716 - protein, 538 aa, Pseudomonas aeruginosa PAO1
MIAGNDGVGGIVFDNYPMAYLVGNLALAVILLDGGLRTRVSSFRVALWPALSLATLGVLVTTGLTGIAAAWLFDLHWMEGLLIGAIVGSTDAAAVFSLLGGKGLNERVTATLEIESGSNDPMAVFLTVTLIEMLASGQTGLSWGFALHLVQQFGLGALLGLGGGWLLLQLINRMHLAGGLYPLLVISGGLLVFALANAVGGSGILAIYLCGLLLGNRPIRSRHGILHMLDGMAWLAQIGMFLVLGLLVTPHDLWPIALPALALALWMILVARPLSVLIGLIPFRAFHDREKAFIAWVGLRGAVPIILAVFPLMAGLPNAQLFFNVAFFIVLVSLLVQGTSLPWAARLLRVVVPPDPAPISRAGLEIHPTSEWELFVYHLNKEKWCIGAALRELKMPGGTRIAALFRGTELLHPSGSTILEADDILCVIGHEHDLPALGKLFSQAPDRGLGARFFGDFVLEGDAQLSAVASLYGLKLDGIDGEQALGRFIAHEIGGEAVIGDQVEWNGLTWTVAALEGNRIRKVGVKFPEGRPGPGLFL

SEQ ID NO: 91717 - protein, 832 aa, Kluyveromyces lactis NRRL Y-1140
MDDDHPGGGLFPKHYNVDTYGNGTSEEVVSNADTTTEISDIESNGTDSIDSSILAEIMVEQCNTNEEAFKESLSSNKFYISQLYNNKTGRHKDDNGKSDFIRYNQRIEQEYKLRGKLERLLNSSTVRNKLNVLNPEGLYENYVGGDEVALNNSKYSSFQDVFNKIKMPRSIKKASYINRQRDLSFEMLTTHSGDTHIIDMENHGEWPIDHDHLGKSGTHKLESWISVSKCSNNNSGSRKQSKFIKKYNALKGSHHSVQRKLEARHIQMIASGSSLGVGLFLTSGKAFTIAGPFGALLGYVLCGSIVMASTLSFTELCALIPLTSGFSGLASRFVEDAFGFALGWLYWFSFIIAVPSQVVASTMLLNYYQSLNLSSGKIAGFVTLFLVFAIFINLCDVRIFGNFVYFVTIIKIIFTIVMIFVMIVLNSGGAALGHDRVGFRFWDAGKSAPGLFYGLFRPTFNLKDEGSEIISGISGAKGRLLAIFLSMLIAAFTYSGIEMTFVASCEVRNPKKALPSAMKKTLYIMLLIYTISIFVVGLNIYSGDPRLPRFYTYSQDSSNYNIMHNIGMNWQVSTHCQSTLLSSGSLLSDGNRSAWVIALRSFGRCTFASVLNGILIFYGATSGCSSLYGASHTLYSMAIQGKAPRICKACTSYGVPWIAVLVSGIFGVISYMAVDQSSLNNFQILANISSATICIIWAGMNVSFLRFFYALKIRPDIMSRDDPMFPYRSPFQPYLSYYGLFGSLVMIFFAGFTSFFHGFWNIKIFFSCYGGLVFFIVLYIGYKLFGTSKLQRLDQIDMDIGRIELDRTIWNQQTEYQGNWKERLSSLVTWKY

SEQ ID NO: 91718 - protein, 597 aa, Synechococcus sp. RS9917
MSQLDVDASQSPLGSGSGDGAQALPKAEQRKIDSDYLREPLLTELANDRPQFSEDALQILKFHGSYQQDDRDRREKGKDKQWQMMLRLRSPGGRIPASLFLALDDLSNRLGDGSLRATTRQAFQMHGVAKADLKEVIGTIVRHMGSTLAACGDINRNVMAPAAPFDKDGYPAARQLADDIADLLSPETAEGSYLDLWVDGDLSYRIKPSRIVKAARQRQRDGAVFSGDPQEPLYGDTYLPRKFKVAVTVPGDNSVDLLTQDIGLVAFSEPSGALRGCNVYVGGGMGRTHNKEETFARIADPLGYVAADQVLDLVQAILALQRDHGDRTLRRHARMKYLIHDRGIDWFRDELLARYFHGELGALRHEAKPKLTDYLGWHRHRPGMWFVGIPLLCGRLEGELKAGLRRIVETYQLEIRLTPNQDLLLCNIGTPQRAGIRQALADLGIETPDAPAPLARHAIACPALPTCGLAITESERILPDVLERLNTQLEQLAINKPILVRMTGCPNGCARPYMAELALVGSGVNQYQLWLGGSANLQRLARPFLQRMPLDQLEATLEPLLISWRDAGGRRSLGDHVEKLGDQVVATLLGDPAVAPT

SEQ ID NO: 91719 - protein, 150 aa, Vitis vinifera
MLEEISLEATSFRQLQNVTEQLDIRTKLCIRDSLYRLARSAEQRHNCGSLNSSSRDDGDTGGLLMAAEPNKCTGFMDMETDTNPIDRSIAHLLFHRPSDPSIVPNDALSLKSQNMMQGSITSPPVVAEKLVSLEENAVGSDKNVADLDKK

SEQ ID NO: 91720 - protein, 762 aa, Candidatus Pelagibacter ubique HTCC1002
MKKTKIDHYTDKEALEFHSLNKPGKIEINSSKPMTTKRDLALAYSPGVAVPVQAIADDPETAYDYTSKGNLVAVISNGSAILGMGNLGALASKPVMEGKAVLFKRFADIDSIDLEIDSQDSDEIINSIKNFACSFGGINLEDIAAPDCFIIEEKLKEILDIPVFHDDQHGTAIITTAALINALDISGKSIKDIKVVVNGAGASAIACTNLFKNSGVPSENVIMLDRKGVVYRGRTEGMDQWKSAHAVETKKRTLEEAINGADVFLGLSAKGALKKELVKTMAKNPIIFACANPDPEITPEEIMEVRDDAIIATGRSDYPNQVNNLIGFPYIFRGALDVRATTINEEMKVAAANAIAKLAREDVPDEVVAAMGGDRPKYGKDYIIPSTFDPRLISVIPAAVAKAAMDSGVAKKPIKDFEAYRDQLKQRLDPSVTIMQGINSHIKKNQKRIVFADGEDENTLKAAIAFKNSKLGTPILIGKKNKIKERIKEIGYNENFDIEIINSEDTTKREKYVNFLFEKLQREKGLLERDCDRLVRNDRVIWASCMVACGDADGAVTGNTRRFGASFDKVTQVVDARPGEIMFGLNMVVAKGKTIFVGDTSVNEYPSSEELAEIAISSARVVKMFGFVPKVAFVSHSTFGQPLTSRTKHIKKAVEILKDKNVDFDFDGDMQPDVALNEEYKELYPFSSIVGNANILIMPGQHSAAISYKMMKSLGDTKVIGPLLIGLGQPIEIAPLRSSTSEIINLASVAAYSADVIDYKKS

SEQ ID NO: 91721 - protein, 526 aa, Cryptococcus neoformans var. neoformans B-3501A
MMRIPAAPRFASKASTSSRLLVPSRRATTAATSSAHTLNPAGTVTTLPNKLRVATESIPGHFHAVGVYIDAGSRYESQRTSGVSHLLDRLAFKSTDKHTDAQMTTLIDSLGSQVTCASSRETIMYQSTVFPQSLPLAFELISSTIRHPLLLPEELLAQKEAAAYEIREIWAKPELILPEILHTVAFRDNTLGMPLLCPESQLGVLGEEEVRGFMRDWYRPERMVVAGVGMPHEELVMLAEKFFGDMPATTTSPGSLHPSVTQAQQPLGSKSFATASALPVSQDYTDLAHAKAQYTGGELYMEKPEEEFVHIHIGFEGLGIHDPDIYALATLQTLLGGGGSFSAGGPGKGMYTRLYTKVLNQYHAVDFCAAFHHCYADSGLFGISASVYPQFASRIVDVMAGQLHALTGPMFGGVEEKEVRRAKNMLKSTLVMALESRLTAVEDLGRQVQIHGHKVPVEDMCAKVDALTMADLHRVANRILRPGNSSEGRVNYGLGSGKATVVAQGPGLGALGDVRRILKDRWVLGV

SEQ ID NO: 91722 - protein, 476 aa, Zea mays
MDDTTKVVRHKGTAGEPCRTRTRTRTQRRQRSCADRHLNSRPNPHAGRCTEQQPPVLLSAAYHTRHASPPVYMAGELRHRRAPSEDEGVASSQRLDSAPAGNGKAGTSSGGGEGAEPRGGKRDALGWLEWCRGWMAIVGEFLFQRIAASHLANPLELPPLDGVSIVVTGATSGIGLEIARQLALAGAHVVMAVRRPKVAQELIQKWQNENSETGRPLNAEVMELDLLSLDSVVKFADAWNARMAPLHVLINNAGIFAIGEPQHFSKDGHEEHMQVNHLAPALLAMLLIPSLLRGSPSRIVNVNSIMHSVGFVDAEDFNLRKHKYRSWLAYSNSKLAQVKFSSMLHKRIPAEAGISIICASPGIVDTNVTRDLPKIVVAAYRFLPYFIFDGQEGSRSALFAACDPQVPEYCEMLKSEDWPVCACINYDCNPMNASEEAHSLETSQLVWEKTLEMIGLPPDALDKLIAGETVPCRYGQ

SEQ ID NO: 91723 - protein, 303 aa, Desulfitobacterium hafniense Y51
MFNSSFLRWGDFMSDKLGRNEECWCGSGQKYKKCHASIEEKIKSYAAKGYAIPDRSLLKNQKQIEGIRGSSKINIALLDYIGDFVVEGVTTEELDRLIYNKTKELGGIPATLNYEGYQKSSCISVNDIVCHGVPSRGVRLRNGDIVNIDVSTLYKGFYSDSSRMFCIGEVSVEKRKLVTVAKECTELGVQEVKPWGFLGDVGQAVNDHAKKNGYTVVKEIGGHGIGEKFHEDPWVGYVSKRGTGMLLVPGLIFTVEPMINMGKAGIVLDQNDGWTVYTADGKPSAQWEKTVLVTDTGCEILTY

SEQ ID NO: 91724 - protein, 240 aa, Bacillus cereus ATCC 10987
MVKLVLIRHGQSEWNVENRFTGWTDVDLSSKGLEEAREAGVMLKASGFSFDIAYTSVLRRAMRTLWITLEEMDLMWIPVYKTWKLNERHYGALQGLNKEETARKYGDEQVTLWRRSTNVRPPALTKDDERYEAAHPKYRDIKDYEFPLTEDLEDTEKRVVSYWNEEIAPNVKAGKQVIIAAHGNTIRALVKHLDQISDKDIENVNIPTGTPLVYELDNDLKPIGHYYLNREIETLEEKQV

SEQ ID NO: 91725 - protein, 107 aa, Brassica napus
  misc_feature (100)..(100): Xaa can be any naturally occurring amino acid
METPNVTIPKVGPKPSRKVKLPTPKELISHYESKGMDTQDASLKVIEDLQKALFRVISSGKGKHDKLLTESSRKIDAINNRLTVLDMKLDSKPAYVETFXIGLASGA

SEQ ID NO: 91726 - protein, 425 aa, Burkholderia xenovorans LB400
MQNEALLQRKNNATPRGVGVMCPFYADTALNAELWDVEGRRYIDFAAGIAVLNTGHRHPKVMAAVREQLDRFTHTCWQVVPYPSYVELAEQLNRLAPGDFQKKASLFSTGAEAVENAIKIARAFTGRAAVIAFSGSFHGRTMMGMALTGKVAPYKVGFGPFPGEVYHAPYPNTLHGVTTTNALDSVRALFKTDVDPLRVAAIIFEPVQGEGGFYEAPADFVKGLRDICDQHGILLIADEVQTGFARTGKLFAMQHHAVAADLTTVAKSLAGGLPLSGVIGRADVMDAAAPGGLGGTYAGNPLSVAAALAVLDVIESENLCERATQLGNRLKSHLTSMRESLPHIAEIRGPGAMIAAEFFEPGTLIPDADFAKRFQARALELGLILLVCGVHSNVIRFLFPLTIEEAVFEEALVLIETAMKDAAAA

SEQ ID NO: 91727 - protein, 496 aa, Burkholderia xenovorans LB400
MTNHPTAMPSLQEPSLFRQECYIAGEWIESDPMARIDVVNPANGLKIGTVPRATLADVRTCIDAAERALPAWSGKTGKERAAILRRWYELMLQHQEDLAVIMTCEQGKPLAESRGEIVYAASFLEWFAEEAKRVYGDTIPTPASDRRIVVLKQPIGVCAAITPWNFPAAMLTRKIGPALAAGCTMVLKPASQTPFSALALCVLAERAGVPAGVLSCVTGKASMIGDEFCRNPAVRKLSFTGSTEIGKLLLQQCASTVKKTSMELGGNAPFIVFDDADLDAAVVGAIAAKFRNAGQTCVCVNRFLVQDTVHDAFVEKLSTAIAALKVGDGLDAGTRIGPLIDSKAVEKAREHVDDAIARGATVVTGGSGHALGGNYFEPTLLTGASKDMKIFREETFGPVAPVFRFRTEEEAIQLANDTEFGLASYFYGRDIGRVWRVAEALEYGMVGINEGLISTEVAPFGGVKESGLGREGSKYGIEDYLEVKYLCMGGLAARPV

SEQ ID NO: 91728 - protein, 528 aa, Synechococcus elongatus PCC 6301
MTAQQLWQRYLDWLYYDPSLEFYLDISRMGFDDAFVTSMQPKFQHAFAAMAELEAGAIANPDEQRMVGHYWLRDPELAPTPELQTQIRDTLAAIQDFALKVHSGVLRPPTGSRFTDILSIGIGGSALGPQFVSEALRPQAALLQIHFFDNTDPAGFDRVLADLGDRLASTLVIVISKSGGTPETRNGMLEVQSAFAQRGIAFAPQAVAVTGVGSHLDHVAITERWLARFPMEDWVGGRTSELSAVGLLSAALLGIDITAMLAGARQMDALTRHSDLRQNPAALLALSWYWAGNGQGKKDMVILPYKDSLLLFSRYLQQLIMESLGKERDLLGKVVHQGIAVYGNKGSTDQHAYVQQLREGIPNFFATFIEVLEDRQGPSPVVEPGITSGDYLSGLLQGTRAALYENGRESITITVPRVDAQQVGALIALYERAVGLYASLVGINAYHQPGVEAGKKAAAGVLEIQRQIVELLQQGQPLSIAAIADDLGQSEQIETIYKILRHLEANQRGVQLTGDRHNPLSLIASWQR

SEQ ID NO: 91729 - protein, 521 aa, Solanum tuberosum
MAASIGALKSSPSSNNCINERRNDSTRAVSSRNLSFSSSHLAGDKLMPISSLRSQGVRFNVRRSSLIVPPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPDWFQGTADAVRQYLWLFEEHTVLEYLILAGDHLYRMDYEKFIQAHRETDADITVAALPMDEKRATAFGLMKIDEEGRIIEFAEKPQGEQLQAMKVDTTILGLDDKRAKEMPFIASMGIYVISKDVMLSLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKSCKIHHSVVGLRSCISEGAIIEDSLLMGADYYETDADRKLLAAKGSVPIGIGKNCHIKRAIIDKNARIGDNVKIINKDNVQEAARETDGYFIKSGIVTVIKDALIPSGIII

SEQ ID NO: 91730 - protein, 803 aa, Magnaporthe grisea 70-15
MAHCQDRGSNSRRGSLAHGTFEDEELSLSLTAIDPRNTAATTTRTTPTQHRRDDSNGRPRPKHSHSHSRRHSQHAQHQNQHQNQDQNQQSPPSAMPPTVHRGGGGGGPNAMPADGSTSSKIRVDQRISAYEISKTLGEGSFGKVKLAVHKGTKQMVALKIISRKRLASTDMAGRVEREIEYLQLLRHPHIIKLYTVIKTDNEIIMVLEYAGGELFDHIVTNGRLSEDEARRFFQQMLCAVEYCHRHKIVHRDLKPENLLLDDNLNVKIADFGLSNIMTDGNFLKTSCGSPNYAAPEVISGKLYAGSEVDVWSCGVILYVLLVGRLPFDDDHIPTLFSKIARGTYVVPHWMSPGAAALIKKMLVVNPVNRATITEIRQDPWFTTELPEYLQPPIEPFFNTGIDPEKAIRPSDIAPNAPPKVQEKLHAEVTDKISKTMGYGKQDVLDALEAEEPSAIKDAYMIVRENKMMQSNPALGGDNPFFATTPLGDENGSTGIMETMDSAMSASGHDPNASPMTSMSVRSATSSTLSAALAYQRPYTSKIGILPSSLPAYHNAYMESEKSGTAQDVPDMMALNEPPAPARTPAEQEETARRLRPHARSSQSAADSKPQSLTPSNAPKKTKPTRWQFGIRSRNAPFEALLCIYKALKKLDCSWKIDRDYHKVHGDENEKHRSRGDAGTPYILPADPWHIEARWETGPLRTHSVMTDPKNSAAFPGGKVRVQKKHSNNSSEDDDEEANATYEVIAMRLSIQIYEMESGVYLVDFKCAGYELPDGRLMEEKDVTSPFPFLDLAARLIIQLADAD

SEQ ID NO: 91731 - protein, 91 aa, Oryza sativa
  misc_feature (38)..(38): Xaa can be any naturally occurring amino acid
  misc_feature (65)..(65): Xaa can be any naturally occurring amino acid
MVKASSMDGRTVNMGSLMTVEWDSRNQCWMGWRDCGDXWRELASPRRKLSEENWYGALSEFDSVXICASGTQYTYVNQRVLNQVGEKVVGM

SEQ ID NO: 91732 - protein, 149 aa, Glycine max
  misc_feature (2)..(2): Xaa can be any naturally occurring amino acid
  misc_feature (7)..(7): Xaa can be any naturally occurring amino acid
  misc_feature (109)..(109): Xaa can be any naturally occurring amino acid
  misc_feature (139)..(140): Xaa can be any naturally occurring amino acid
MXTPAVXIRTIAPKPSKKLKLPSPKQLISLYESQGMHSQNASLKVIKDLQKALFGVISYGKGKHDKLLIECSSKIHAISNRLAVLGMKLDSKPGYVETFAIGLASGWCXLKGLVLIVPHIIAPLFQIWNSVFSATRSSXXMILNFVITS

SEQ ID NO: 91733 - protein, 522 aa, Coccidioides immitis RS
MTLLSRSNLSGLTLITPTTNRSVSDSIAIMTSPAPLLKIPTPGNRKPPKLTVGIPPSPNARPVNQVGTTSQNDPQAQHLPSRQLPPELRIATPMGSRGMIQQEDTSYHNGRPIPQPYSNSSNDLSAHSRSGSFTMHDGKNSGPASATSSSFSTLSFAMGMRDPLGGAGDPSSAISSVYSDRGGGLPMERENSMNGVLPDLDKLSQELGRPLDVEDLDDEKWAAASEQRKIIELDSLGEGAGGAVTRCILKGGKTVFALKVITTDPNPDVKKQIFRELNFNKDCASEHICRYYGAFMDRSSSTISIAMEFCEGGSLDSVYKEVKKLGGRTGEKVLGKVAEGVLNGLTYLHGRKIIHRDIKPSNILLCRTGQVKLCDFGVSGEFGTKGDANTFIGTSYYMAPERITGQSYTITSDVWSLGVTLLEVAQHRFPFPADGTVMQPRAGLIDLLTYIVRQPIPKLKDEPENGIYWSDNFKYFIECCLEKEPPRRATPWRMLEHPWMLEMKNKKVNMAHFLKQVWDWKE

SEQ ID NO: 91734 - protein, 473 aa, Arabidopsis thaliana
MEIKSYQNQAEYFVEHYLLADPFLPYTSVLVGICLCKLVYDLTELFSSIHVKSYSALTKIKRIEWNNRGISTVHAIFISFMALYFAFFSDLFSDQRSLETLTVFRNSPLSTFGLGVSVGYFLADLGMIFWLYPSLGGSEYILHHCLSGTAVAYSLFSGEAQLYTYMVLISEVTTPEINLRWYLDIAGLKRSKAYLVNGVAIFFAWLTARILLFIYMFYHVYTHYDQVIEMHTFGYLLVLLGDVGAGKSSLVLRFVKDQFVEFQESTIGAAFFSQTLAVNDATVKFEIWDTAGQERYHSLAPMYYRGAAAAIIVFDVTNQASFERAKKWVQELQAQGNPNMVMALAGNKSDLLDARKVTAEDAQTYAQENGLFFMETSAKTATNVKEIFYEIARRLPRVQPTENPTGMVLPDRAMDRADFRRIKKRSGEMEFGNEDFVRGQPERLKTMMYKAWRKSRAKQRANEAVKEMQSLQI

SEQ ID NO: 91735 - protein, 353 aa, Halobacterium sp. NRC-1
MGNTTDELLDDITFDADEPDRAEIVSMGERTSVRMLKAALAARGVDATFLEPGTTDWPIVTNERGEVDADATAAGVDRLAGRLGDTVPVITGFLAEDPQGNVTTLGRGGSDTTAVMLGRYLDADEVVIVTDVEGIMTGDPQVVEGARNVGRITVDELRNLSFRGAEVIAPSALSFKDDALDVRVIHYQHGDLLSGGTRIEGTFESMIDMRDSPLACLTVAGRAIRNRPGITSALSTALSDSDINVDAVASGMDSMTFYVDESVAERAENILHQEVIAVSELSSVTVTDDIAAIRVLGGELPNRPGVLCRIIDPLADRNINVIDIISSATSVAVFVSWADREPALDVVQNGFGS

SEQ ID NO: 91736 - protein, 364 aa, Alkaliphilus metalliredigens QYMF
MIMKKFKIAVIPGDGIGNEVTAEGVKVLNTYAEIKGNVEFSYEYFPWGCEYYLKTGKMMDDDGLKTLEAFDAILLGAVGDPSVPDHISLHGLLINIRQGFNQSINLRPIKLLQGAPCPLKDKGPQDIDFTVIRENVEGEYAGVGGFRFPGRPEEVALQTSVFSRKNTEKVMDYAFKLARKRKKFNKVTNVTKSNALNYSMVFWDKIFEEIATNYKDIKTETTHVDAVSMYFIQKPEVYDVLVASNLFGDIITDLGAALQGGLGFAASANLNLEKEYPSMFEPVHGSAPDIKGKQLANPIAMIWTAKMLLDFLLEEDDTEMIIDAITAVLQEEKTLTPDLKGKAKTHEVGDAICGKLKEIMNAKI

SEQ ID NO: 91737 - protein, 413 aa, Trichoderma atroviride
MADLQGRKVFKVFNQDFVVDERYTVTKELGQGAYGIVCAAVNGQTNEGVAIKKVTNVFSKKILAKRALREIKLLQHFRGHRNITCLYDMDIPRPDNFNETYLYEELMECDLAAIIRSGQPLTDAHFQSFIYQILCGLKYIHSANVLHRDLKPGNLLVNADCELKICDFGLARGFSVDPEENAGYMTEYVATRWYRAPEIMLSFQSYTKAMDVWSVGCILAELLGGRPFFKGRDYVDQLNQILHILGTPNEETLRRIGSPRAQEYVRNLPFMPKKPFPALFPDANPDALDLLDKMLAFDPSQRISVEQALEHPYLHIWHDASDEPDCPTTFNFDFEVVEDVGDMRKMILDEVLRFRQLVRTAPASGNQAAAQQIQVPMPQAGGQWTAEDPRPQEYMGHANGLEQDLAAGMDIRR

SEQ ID NO: 91738 - protein, 501 aa, Desulfococcus oleovorans Hxd3
MNPSDFPCDVQPHLVPRPGGDMVYKCLGCDATHDINTLLYTCPSCNSVLLIEDRDFDRHRAIPGPLWRKIFDFRKSLNIPALKGVYRFHEFIGPDLPLEAVVWLGEGGTPVVEASPLLQQKVGIRLFFKNDGQNPSASFKDRGMASAFSRINFLLQSGILSNVLAVCASTGDTSASAALYAAYLKPRVTSAVLLPHGKVTPQQLSQPLGNGAAVFEIAGVFDDCMKVVEELSENYNVALLNSKNAWRILGQESYSYEIAQDFSYDTRNLTVVVPIGNAGNITAVMNGFLKFFRIGIINALPKIIGVQSDHASPVFQYYREPDPARRRFAPVTVKPSVAQAAMIGNPVSMPRVIRLADRYDQAAGQRRVFVVEVSEQQIMDWQLTANRHGNIVCTHGGESLAGLVTARQQGLVTDDDMAVLDSTAHMLKFSNFQQMYFENAFPAHYGVTPDPALVNAPQLVEVPGIATPADRETLSGPEMTTFVRKTADEIANRLGLKRTKQ

SEQ ID NO: 91739 - protein, 608 aa, Ralstonia solanacearum GMI1000
MTQPQNGSGAIAHAESDTDTLIANAATQASAFAALGLDERIARALGELNYTQPTPVQAQAIPACLSGRDLLVTSQTGSGKTAAFMLPAIQRISEQPEPQRPRADGPQQRVKGRRPRPAPAKPSLLVLTPTRELALQVTTATAQYGRHLRRIVCASILGGMPYPKQLDMLARMPDIIIATPGRLLDHIDSGRIDLSALDMLVFDEADRMLDMGFADDIEAIVGATPASRQMLMFSATMDRRIEQLAERMMREPQRIEIAAARIDQSHIEERLHFTDDLSHKQQLLDHLLRDATLKQAIVFTATKRDADSLAERLTETGFSAGALHGDMHQGARNRTLTALRRGQLRVLVATDVAARGIDVPDITHVVNFDLPKQAEDYVHRIGRTGRAGRSGIAINLVNHGDTFQWRRIERFVDRRIDATVVEGLEPKRSPKPRSGGPRAGGDRGGYRGNGGGNWRGQRDGYAARTGNGGNGGNSEGRFQRSFGGDRESFAPRRDDRGDRGTGYQGGQQRDWGNRDNAAPRQSYGQQTRNGDRFDPRQPRSQEGRSDWQQRPARGGYGNSNGNGSSYGNRDGAPRRFGDDNSNGAPRRSYGNSNGNSYGSKGRSRDFDR

SEQ ID NO: 91740 - protein, 288 aa, Populus trichocarpa x Populus deltoides
MEGKEEDVKLGANKFSERQPIGTSAQTDKDYKEAPPAPLFEPGELKSWSFYRAGIAEFIATFLFLYITVLTVMGVTKPGTSKCSTVGIQGIAWAFGGMIFALVYCTAGISGGHINPAVTFGLFLARKLSLTRAVFYIIMQCLGAIRGAGVVKGFQGSHNYELQGGGANVVNHGYTKGDGLGAEIVGTFVLVYTVFSATDAKRNARDSHVPILAPLPIGFAVFLVHLATIPITGTGINPARSLGAAIIFNKDHAWDDHWIFWVGPFIGAALAAVYHQIVIRAIPFKSRA

SEQ ID NO: 91741 - protein, 227 aa, Synechococcus sp. RS9917
MSTKPLVISPSILSADFARLGEEVKAVDQAGADWIHVDVMDGRFVPNITIGPLIVEALRPVTQKPLDVHLMIVEPEKYVPDFAKAGADIISVQVEACPHLHRNLAQIKDLGKQAGAVLNPSTPLDTLEYCLELCDLVLIMSVNPGFGGQSFIDNQVQKIRDLRRMCEAKGLDPWIEVDGGVKGANAWKVIEAGANAIVSGSGVFNQPDYAAAIEGIRNSKRPEGVLV

SEQ ID NO: 91742 - protein, 220 aa, Thermoanaerobacter tengcongensis MB4
MFKTLKEDIEVVFERDPAAKSVLEVLLCYPGLHAIILHRIAHYFYKKGFILLPRLISHINRFLTGIEIHPGAKIGRRFFIDHGMGVVIGETTEIGDNVTIYQGVTLGGTGKEKGKRHPTIKDNVVIGSGAKVLGPIVVGENSKIGAGAVVLKDVPPNSTVVGVPARCVKKDNIRIARSYEVDLEHGKLPDPVEEELRRLRERIERLEKILMERDEEDEAV

SEQ ID NO: 91743 - protein, 803 aa, Oryza sativa
  misc_feature (506)..(506): Xaa can be any naturally occurring amino acid
MTVTPRITVAEGRLVAHGRTILTGVADNIALTHASGAGLVDGAFVGATADEPKSLHVFTFGTLRDLRFMCCFRFKLWWMTQRMGTSGRDVPLETQFMLLESRDGGGGGEAVYVVMLPLLEGQFRAALQGNDRDELEICIESGDKAVQTAQGTYMVYVHAGANPFDTITQAVKVVERHLQTFHHREKKKLPSFLDWFGWCTWDAFYTDVTADGVKQGLQSLAEGGTPPRFLIIDDGWQQIGSENKEDAGNAVVQEGAQFASRLIGIKENTKFQKTTTTAMADGGETAASAAGLKALVEEAKKEHGVKYVYVWHAMAGYWGGVKPAAEGMEHYESAVAFPVQSPGVMGNQPDIVMDSLSVLGLGLVHPRMALAFYGELHAYLASCGVDGVKVDAQNIIETLGAGHGGRVSLTRAFHRALEASVARSFPDNGCISCMCHNTDMLYSARQTAVVRASDDFYPLDPASHTIHISSVAYNTLFLGEFMQPDWDMFHVYASSPLLLNLLLCSXIQDDDDGGGGDVMNLQSLHPAAEYHGAARAIGGCPIYVSDKPGNHNFELLKKLVLPDGSVLRARLPGRPTRDCLFVDPARDGASLLKIWNVNKCTGVVGVFNCQGAGWCRITKKTRVHDAAPGTLTGSVRADDVDAIADVAGTGWTGDAVVYAHRSGELVRLPKGATLPVTLKVLEFELFHVCPVMTVAPGGGGGGVTFAPIGLLDMFNSGGAVEECDVVRALDAAGEAEAEAEAAVVRLRARGCGRFGAYSSRRPARCALDAVEVEFSYDADTGLVALDVPVPAHELYKWTVEIQV

SEQ ID NO: 91744 - protein, 429 aa, Synechococcus sp. RS9917
MHIAVVGLSHRTAPVEVREKLSIPEQTMESSLQTLRDHEQVLEASILSTCNRLEIYTLVQHPELGMSAVREFLSGHSGLPTDDLTPHLFTYHHQDAVAHLLRVSAGLDSLVLGEGQILSQVKKMMRLGQEHKSIGPILNRLLTQAVSTGKRVRTETNLGTGAVSISSAAVELAQLKLGQARGLDQLVTLESEQVAVVGAGRMSRLLLQHLQAKGCSGVVLLNRTRERAQMLAADFPGLPAQCRTLEELDHCLSTCSLVFTSTAADDPIIDAARLQRLNRRSSLRLIDIGVPRNIASDVADIAGVEAFDVDDLQEVVARNQEARQQVAREAQGLLDEEGRLFLEWWDSLEAVPTINRLRSALEQIRSDELQKALSRMGPDFSARERKVVEALSKGIINKILHTPVTQLRSPQPRQDRQQALRVVERIFEL

SEQ ID NO: 91745 - protein, 357 aa, Arabidopsis thaliana
MGQKRLLFLLAVFTFLVSSSYGRVLKLKSDDDRPVYNHTLAVTLVEYASAVYESDLTKLFTWTCERCNGLTKDFEVIEVIFDVEHCLQAYVGVAKDLNAIIIAFRGTQEHSIQNWVSDLFWKQLDLNYPDMPDAMVHHGFYSAYHNTTLRPAVLDAITRVKKVYGANINIIVTGHSMGGAMASFCGLDLVVNEGEENVQVMTFGQPRVGNAAFASYYSLLVPNTFRITHDRDMVPHLPPYYYHFPQKTYHHFPTEVWVKDFSFSNFVLFGLEKVCDNTGEDPTCSRSVRGNSISDHLRYFGVELKCESWRQCSIVMNQDMERYSRKDSRGNLFLSRTVPPKDVVKTSSLSKTGISSL

SEQ ID NO: 91746 - protein, 428 aa, Roseovarius nubinhibens ISM
MAVGGDGCFLIDASGKRYFDGSGGAAVSCLGHSNERVVAAIKAQVERLAFAHTGFFTSEPAEALADLLIAHAPGDLDRVFFVSGGSEAVESAIKLARQYHLERGEGQRRHLIARKQSYHGNTLGALSAGGNAWRRAQFAPLLTEMSHIDACYEYAERREGESLETYGQRTADALETEILRLGPETVMAFIAEPVVGATLGAVPAAPGYFARIREICDKYGVLLILDEVMCGMGRTGHLFACEAEGIAPDILCIAKGLGAGYQPIGAMLCSKAIYDAIAGGSGFFQHGHTYLGHPVAAAAGLAVLQELLDRDLVAQVQARGAYFETALRARFAQHPHVGDIRGRGLFWGIEFVAERDGKTPFDPALGVAGKLKKAAFDEGLVCYPMAGTRDGRQGDHVLLAPPFIASEAELDGALDALGRAVDRVLASV

SEQ ID NO: 91747 - protein, 431 aa, Synechococcus sp. RS9917
MKRVLAIILGGGAGTRLYPLTKMRAKPAVPLAGKYRLIDIPISNCINSNITKMYVLTQFNSASLNRHLSQTYDLSAGFGQGFVEVLAAQQTPESPSWFEGTADAVRKYQWLFQEWDVDEYLILSGDQLYRMDYSLFVEHHRQSGADLTVAALPVDPQQAEAFGLMRTDAHGTIQEFREKPKGDSLKEMAVDTSRFGLSPESAEQKPYLASMGIYVFSRKALIDLLNDHPQHKDFGKEVIPEALAGGMTLKSYVFDDYWEDIGTIGAFYEANLALTQQPSPPFSFYDEDFPIYTRPRYLPPSKLVDAQITESIIGEGTILKSCSIHHCVLGVRSRVENDVVLQDSLLMGADFFESSTERSVLRERGGIPVGVGQGTTVKRAILDKNTRIGSNVTIVNKDHVEEADRPELGFYIRNGIVVVVKNASIPDGTVI

SEQ ID NO: 91748 - protein, 631 aa, Desulfitobacterium hafniense Y51
MGILAKIEQPRDLKGLTYPELEQLAQEIRAEMIDVVSANGGHLAPNLGVVELTLALHRVFDSPKDKIIWDVGHQSYVHKLVTGRQKEFKSLRLYKGLSGFPKRCESPHDCFETGHSSTSISAAVGFAKARDLRKEKNQVVAVIGDGAMTGGMAFEALNHAGHTKTNMIVVLNDNEMAIAQNVGAMSSYLNRLRTDPRYDRSKDEIENLLKRIPGIGSKMAKAAEKAKDSLKYLLVPGLLFEEMGFTYLGPVNGHDQIALEQVFEQAKMVKEPVLVHVLTQKGRGYEPSEKNPALFHGVGPFNKVTGEVIKKPAPPTYTQVFGETLCELAEKDPRITAITAAMPSGTGLNLFAQKFPDRFFDVGIAEQHAVTFSAALAFGGMKPVVSIYSTFYQRAYDQVLHDVCLPHANVVMAIDRAGVVGDDGPTHHGVFDISFLRVIPNLVFMAPKDENELRHMLYTSLQLDGPVALRYPRSVGQGVELTEELRELPVGKAEILQEGKDITLIGVGPMVYTCLAAAVELRHRGVEATVINLRYINPLDRESILRYARMTKRIITVEDHMLAGGMGSAVMEVLGDEGLTDVVVERLGYDEYVDQGAISLLHQGYGLSVVGILKAAERLKVLQRIEGRSSV

SEQ ID NO: 91749 - protein, 460 aa, Oryza sativa Indica Group
MSHVRSAPAGKSGGGGGSTPAKRGRPFGSTTGSGAAAAAAAAAIGDAAAPAALVGPSLQVLTALSDQNNKRIVLALQSGLKSEILWALNALTVLSFKEKDDLRRDTTPLAKVPGLLDALLQVIDDWRDIAMPKDHTKPPRVRTLGVNTTLSGFGHENVEKVYSDTIIPSDDQTKTADSTVTKKRSAGFLFDEEGLFNVDDEGRTEKQQCAVAASNIIRNFSFMPENETVMVQHRHCLETVFQCLEDQNTEDDELITNMLETLVNLAPVLDLRIFSSSKPSFIKITEKRAVQAIMGMLASSIRVWHCAAAELIGRLIINPDNEPFLLPAIPQIYKRLVDLLSVPAVDAQAAAISALYNVAEVNMDFRLKLASERWAVDRLLKVVKTPHPVPEVCRKASMIVESLVSEPQNRMHLLVHENTFAEILTSEGKYSDTFARILYELTARPSNKVTAGQAIWGNIN

SEQ ID NO: 91750 - protein, 396 aa, Rhizobium leguminosarum bv. viciae 3841
MSKNRGVVYLRPGKVEVRDIDDPKLEAPDGRRIEHGVILKVISTNICGSDQHMVRGRTTAMPGLVLGHEITGEIIEKGIDVEMLDIGDIVSVPFNVACGRCRCCKSQDTGVCLTVNPARAGGAYGYVDMGGWIGGQARYVTIPYADFNLLKIPDRDKAMAKIRDLTMLSDILPTGFHGAVRAGVGVGSTVYVAGAGPVGLAAAASARILGAAVVMIGDFNKDRLAHAAKVGFEPIDLSKSDRLGDMIAQVVGTNEVDSAIDAVGFEARGHSGGEQPAIVLNQMMEITRAAGSIGIPGLYVTEDPGAVDNAAKHGNLSLRFGLGWAKAQSFHTGQTPVIKYNRQLMQAILHDRLPIADIVNAKVIPLDDAAAGYESFDHGAATKYVLDPHGEVAKAA

SEQ ID NO: 91751 - protein, 472 aa, Synechococcus sp. RS9917
MSKAHFGLIGLGVMGENLVLNAERNGFSSVVYNRTYAKTEEFLAGRGAGRNIQGATDLQDFVNKLERPRRILMMVKAGGPVDAVIQQISPYLEEGDLLIDGGNSEYHDTERRVAELESKSFGFIGMGVSGGAKGALEGPSMMPGGTKASYDAIESLVCKMAAQVEDGPCVTYIGPGGSGHFVKTVHNGIEYGIEQILAEGYDLMKRVGGLSGSAMAEVFAHWNSTEELSSYLVEITEVCLRTKDPDDGSDLVEKIQDKAGQKGTGLWTVVSALQMGASVPTIYAALNGRVMSSMKDQRIKAEPLLKGPAIKPFDMGSPADGMAPLMDAMVLACMASYAQGMELLRIASAEHNYNLHMPSIAQIWKGGCIIRARLLKRIQDAFNADPQLPNLLIDPWFADQVNRRLPGLARIVAGAAEAGIPVPCLSSTLDYINSYRTSRLPQNLVQAMRDCFGSHTYERVDKDGVFHTEWLN

SEQ ID NO: 91752 - protein, 798 aa, Catharanthus roseus
DEMLKGISGGQKKRLTTGELLVGPSRVLLMDEISNGLDSSTTYQIIKYLRHSTHALDGTTVISLLQPAPETYELFDDILLLSEGHVVYQGPREAALDFFAFMGFQCPQRKNVADFLQEVASRKDQKQYWAVPDRPYRYIPVGKFAESFGSYRLGKNLTEEMNIPFDRRYNHPAALSTSQYGVKRRELLKTNFDWQLLIMKRNSFIYVFKFIQLLFVALITMSVFFRTGLHHDSIDDGGLYLGSLYFSMVIILFNGFTEVSMLVAKLPVLYKHRDLHFYPCWAYTLPSWLLSIPTSVIESGFWVAVTYYVIGYDPNIVRFFRQFLLFFFLHQMSLALFRLIGSLGRNMIVSNTFGSFALLIIMGLGGYVISRDRIPGWWIWGFWISPLMYAQNAASVNEFLGHSWDKSSGLNPEFPLGEAILRARSLFPQSFWIWGYWISPMMYAQNAIAVNEFLGTSWQKVPPGMSEPLGVLVLKSRGISTNARWYWIGVGALAGFMFLYNLLYALALSCLKPLHKSQAILSEEALAERRPSSKGELTELSSRGKNLPERRNDMQSVSSSLLSSQEGEQKRKRGMVLPFKPLSLNFEDLTYSVDMPQEMKARGFTEARLELLKGVSGSFRPGVLTALTGVSGAGKTTLMDVLAGRKTGGYIKGTITISGYPKKQKTFARVAGYCEQNDIHSPHVTVYESLQYSSWLRLPAEVDAATSKMFVEEVMHLVELMPLKDALVGLPGVNGLSTEQRKRLTIAVELVANPSIIFMDEPTSGLDARAAAIVMRTVRNTVNTGRTVVCTIHQPSID

SEQ ID NO: 91753 - protein, 160 aa, Thermoanaerobacter tengcongensis MB4
MGKMRVGIGYDVHRFEEGKKLMLGGIEIPFEKGLKGHSDGDVLIHALIDGILGAAGLGDIGEHFPDTDVAYKEVDSKILLKRVLELVSEHYVVNNVDCIVVTERPKLSPYKDRIRTSLAELLGVSKERVNVKAKTEEGLGFTGREEGIKAYAVVLLEERY

SEQ ID NO: 91754 - protein, 534 aa, Vitis vinifera
MIAVLLRNLVNLVSEGWSWWWDGLTENTIFRVVAALSTAAIAISWYVWLIKKASRGLPPLPPGPRGLPLLGNLLFIEPDLHRYFSKLSQLYGPIFKLQLGSKTCIVISSSSVAKEILKDHDVIFANRDVPISALALTYGGQDIAWSHYSPEWRKLRKVFVQEMMSSASLDACSALRRREVQEMVRDVYGKVGTPINMGDQMFLTVLNVVTSMLWGGTLHGEDRSRIGMEFRRVIVETVGLMGKPNISDLFPALAWFDLQGIESRAKKLVLWFDRIFESLIAQRTQLDGADGGGKNKSKESKDFLQFMLELMHQGDDKTSVSITQLKALFMDIVVAATDTSSTTVEWAMAELLQHPQTMQKAQEELEKVVGNKNIVEESHLFQLPYLGAVIKETLRLHPPLPLLVPHSPSTSCIISGYTIPKGSRILFNAWAMQRNPEVWEHPLEFIPERFLEDAASADYKGNNFNFMPFGSGRRICAGLPLAEKMLLYVLASLLHSFDWKLPDGRTSVDLEERFGIVLKKSETLLAIPTARLSN

SEQ ID NO: 91755 - protein, 289 aa, Desulfitobacterium hafniense Y51
MFQKELEDYARLVDSYLAQFPWPTGTLAESMNYSLSAGGKRIRPVLALAAAHAVGGDCEDILPAVCALELIHTYSLIHDDLPAMDNDDYRRGRLANHKVFGEGQAILAGDALLTYAFELIAQPMSGVEPQRQLRAIREVAQAAGPEGMVGGQMLDLEAEEKQLNLAELEQVHRLKTGAILVVAARLGAILAGGTEEKIEALTSYAQAIGLAFQIKDDILDLESDSETLGKPVHSDLRQHKSTYPSLMGLAGAKLELKIKTDEAHAALAVLGERAGFLHELADYIAQRKY

SEQ ID NO: 91756 - protein, 422 aa, Yersinia pseudotuberculosis IP 32953
MIRTKINSGGLDVDFIRDQFPILKKQINGHPLVYLDNASTCQKPQAVIDAITKCYCEYYANAHRGVHTLSQCATTAFEHVREQVRDFLHARSTDEVIFTRGTTEAINLVATSWGKSYLHEGDEVLISALEHHSNLVPWQQICRVTGARLKVLPIEPSGVLQIDSLEHLLSNRTRVLALSHVSNVLGTINPLAAIIQKVRIYDQMQQGKKEKTIVLIDGAQAVPHISINVQELDADFYAFSGHKLYGPSGIGVLYGRNDILRKMLPWQYGGGMVADVSFEQSTFVVPPRCFEAGTANIAGVIGLGAAITWLQNLGIGVIAEHEQILLKYVTDQLSQFSCIRILGQVPLKAAVVAFIIKDIPARNIGLALDKQGIAVQVGRHCAQPLMNFFGLQETVRVSFAVYNTLEEIDVFISALHEIINQH

SEQ ID NO: 91757 - protein, 494 aa, Burkholderia xenovorans LB400
MADQVEVFSMYIDGEFVQAEGGRTLDSINPWSGSVWAKVPDATAADVNRAVEAAHRAFTSGPWPKMTPTERAVLLQKLADKLVEHKERLGYVETQDTGKLLKETTWQAGHTARAYTYFAGLADKLQGDIPPSGASMLNLVLHEPVGVVAAIIPWNSQLQLSAYKIAPALATGNTIVVKASEDASTPLLTLAKLVHEVGFPPGVINFVSGGANPCAITLTSHPLVRRIAFTGGADTARRLIPNSAHNIAKLSLELGGKSPVIVFDDADLDSCVNGIVAGIFGASGQSCAAGSRLLAHESIHDVLVERLVERCKTIRVGDPFDAATNMGPLATARQVDRIETLLASSVEQGARVVSGGKRIGGLPFNQCFEPTIALCDRSDYPIVQEELFGPVLSVLKFRDDDEAVALANDSKYAFAGGIFSRDFARAMRTARVVNAGRLWINTYRVTGVNVPFGGFKQSGYGREAGIDALKDYTETKAVMIEVGGEAVADPFVMR

SEQ ID NO: 91758 - protein, 358 aa, Streptococcus agalactiae 2603V/R
MKRLLLLEDGSVFEGEAFGADVETSGEIVFSTGMTGYQESITDQSYNGQIITFTYPLIGNYGINRDDYESIRPTCKGVVIYEWAEYPSNWRQQMTLDEFLKLKGIPGISGIDTRALTKIIRKHGTMKACLINEGNSIHEALENLQKSVLLNDQIEQVSTKLAYASPGVGKNIVLVDFGLKHSILRELSQRQCHITVVPHTTTAQEILNLNPDGVLLSNGPGNPEQLPNALQMIQEIQGKIPIFGICMGHQLFAKANGAKTYKMTFGHRGFNHAVRHLQTGQVDFTSQNHGYAVSREDFPEALFITHEEINDKTVEGVRHKYYPAFSVQFHPDAAPGPHDTSYLFDEFINMIDDFQQKS

SEQ ID NO: 91759 - protein, 313 aa, Salmonella typhimurium LT2
MLAVITRLFPLWALLLSLTAYYTPSTFTPVGPWVATLLMLIMFGMGVHLNVDDFKRVLSRPAPVAAGIFLHYLVMPLAAWLLALLFKMPPDLSAGMVLVGSVASGTASNVMIYLAKGDVALSVTISSVSTLVGVVATPLLTRLYVDAHIQVDVMGMLLSILQIVVIPITLGLVIHHLFPRVVKVVKPYLPAFSMVCILAIISAVVAGSASHIASVGFMVIIAVILHNTLGLLGGYWGGRLFGFDESTCRTLAIEVGMQNSGLAAALGKIYFGPLAALPGALFSVWHNLSGSLLAGYWSGKPIVEKSGETAKVN

SEQ ID NO: 91760 - protein, 414 aa, Clostridium saccharobutylicum
MTCNDIQLLDEADRCLLCKKPRCKENCPIQTSIPEIISLYKENRLREAGEILFNNNPLSAVCSLVCIHEDQCKGNCIKGIKGEPIRFHDIEYEISMKYLEEVRFENLPKDKDRIAIIGGGPAGITIAFILANKGYDVTIFDAHVKIGGVLRYGIPEYRLPKKILDTIEDRLVELGIKIRPNTLIGPVITLDRLYEDGYKAIFIGTGVWNPKTLNIKGETRGNAHFAIDYLKSPEAYRLGEKVAVIGAGNVAMDAARSAKRNGAKEVTVLYRKGFDEMSATKQEIMEAKEDGVIFNLFKSPIEITEKGIRLSSTENVTDENGKIVTKVIEGKEEFFECDSIIIAVSQTPKTNIVSNTKELNTNKWGLIITDEKGNTTRKGTFASGDVVTGAKTVVEAVVQAKTVANTIEEYCKNN

SEQ ID NO: 91761 - protein, 262 aa, Solanum tuberosum
MGSGKLGDSGMIAITAKVMMAVVVFLFFAVVLVFFLHIYSKFFTREDANPNDSTRRRRRRRRFDFAGGYQEVNALRGGLDRSILKTIPVIPFDTKDFKDGLECSVCLSEVCEGEKARLLPKCNHGFHVDCIDMWFQSHSTCPLCRNPVSEMSSTKSIIVESNSGAIRAPVEQGSVASTETRNLPTNVLFWGDETTTSSASTSTSRPDGVLMIDIPRQNSEEAEEEQKTPTPTRLRSLTRLFSSLNPCSPRNVDVEQGSRGQS

SEQ ID NO: 91762 - protein, 724 aa, Solanum tuberosum
MASAAIFSSLRRQRSPTLEAFLAPVDLTDVGLLQTLTALSSELISAYSGKKLPFYQRKNCKSLLRKIQVFSVLLECLLENNLNRSRGSSDLPFTAFLCFKELYLLLYRSKILLDYCSHSSKLWLLLPNHSISGHFHDLNQEISTLLDVFPLKDLKSLPEDVREQVELLKKQARKSPLFVDKHDEMLRLKLFSFLNEFENGGVPDYAQLYSFFVEKLGISNPRSCRVEIEFLEEQIVNHEGDIEPTTSVLNGFVALMRYCRFLLFGFEEDDMGLRLGKHKKPKRGLISQEIADTFISVPKDFCCPISLDLMRDPVIVATGQTYDRASISRWMEEGHCTCPKTGQLLDHTRLVPNRALRNLIMHWCAARKIPYDPLESGDPCIECFPSASPSRAALEANKATAALLIKQLENGTQIAKTIAAREIRLLAKTGKENRAYIAEAGAIPHLKNLLSSPDAVAQENSVTAMLNLSIFDKNKGRIIDEVGCLALIVGVLRFGHTTEARENAAATLFSLSAVHDYKRQIAKEDGAVEALAGLLREGSPRGKKDAVTALFNLSTHTDNCARMIECGAVTALVGALGSEGVAEEAAGALALIVRQQVGATAVGNEETAVAGLIAMMRCGTPRGKENAVAALLELRRGGGAAATERVLKAPSLASLLQTLLFTGTKRARRKAASLARVFQRCEHASVHYSGFGVGYAFSGNSAAARDSTFPGDVSVSRSISVPVL

SEQ ID NO: 91763 - protein, 352 aa, Physcomitrella patens subsp. patens
GRVGTYIREGNVSLASFGIKVKRDKRGQKVDVTKSLSQLLPYVVLATAVSALTQPASFAWVSKDYYAPALGGIMLSIGVQLSVSDFTLVLKRPLPVLVGYMSQYMVKPLLGLLVCAAFSVSPAFSSGLILTSCVAGAQLSSYAAFLSEGDVALSIILTSLTTVTSVIITPLLTKLLIGSVVPVDIIAMGKSILQVVILPIVLGLSLNTYAKGFVDKIRTFMPLMAMVCTSLCIGSPLALNRSRIVSMEGFRLLFPVLAFHIGAFVLGYWIPRLPFWKQDEKVSRTISLCTGMQSSTLAMLLATQFLGGSHAVPPACSVVVMATMGLSLASFWGKGHEIRDMKKVLNGGVSYA

SEQ ID NO: 91764 - protein, 340 aa, Prochlorococcus marinus subsp. pastoris str. CCMP1986
MKIGINGFGRIGRLVFRALWDRADTEITHINEMAGDSNAAAHLLEFDSVHGRWVKDIKVKEEEIIIDGKKLAYTSFKNYLDVPWEKSSVDIILECTGKNKKPDKLNPYFDSLGMKRVIVACPVKGIVAEAESLNIVYGINQNLYDPSKHKLVTAASCTTNCLAPIVKVINENFSIKHGAITTIHDVTNTQVPVDFYKSDLRRARGCMQSLIPTTTGSAKAIAEIFPELKGKLNGHAVRVPLLNGSLTDAVFELNNAVTEEQVNNEFKKASETYLEGILGYEERPLVSADYVNDSRSSIVDSLSTMVVNSNLLKIYAWYDNEWGYSCRLADLTEYVIKKEI

SEQ ID NO: 91765 - protein, 163 aa, Klebsiella pneumoniae
MRLILSVLLENESGALSRVIGLFSQRGYNIESLTVAPTDDPTLSRMTIQTVGDEKAIEQIEKQLHKLVDVLRVSELGQGAHVEREIMLVKVQASGYGREEVKRNTEIFRGQIIDVTPSIYTVQLAGTSDKLDAFLASLRDVARIVEVARSGVVGLSRGDKIMR

SEQ ID NO: 91766 - protein, 346 aa, Streptomyces argenteolus
MTAIEVTAEGRSAREVLLWSRDTVESALRPAIDRLPPAMRRIAGYHFGWSDERGEPARAGGGKAIRPALVLLAAEAVGGAADAALPAAVAVELAHNFSLLHDDVMDGDRTRRHRPTAWTVFGVSPAILAGDALLALAFDVLATAGHPAAPEATRIFGAAIQELLEGQNADMAFERRQDVELAECLVMAAGKTGALLGCACALGALLGGGAPEQVEHLRAFGRDLGLAFQLVDDLLGIWGDPQVTGKPVYSDLRSRKKSLPIVAALTSSSPAGRELAGLYQRERPLSDADLVHAAELVDAVGGRAWSQTQADELLARALHHLRSAGSVSRPIAELGTLARLVTHRDH

SEQ ID NO: 91767 - protein, 172 aa, Lactobacillus plantarum WCFS1
MALDLKKYVASIPDYPEPGIIFRDISPLMADGEAYREATDQIVQFARDKHVDMIVGPEARGFIVGCPVAYELGVGFAPARKKGKLPRETVKATYDLEYGQSALYLHKDAIKPGQNVLVTDDLLATGGTISATIQMVEELGGNVVGTAFLVELKELHGRDKIKDYDMLSLMQF

SEQ ID NO: 91768 - protein, 513 aa, Streptococcus agalactiae 2603V/R
MSILEVKNLSHGFGDRAIFENVSFRLLKGEHIGLIGANGEGKSTFMSIVTGHLQPDEGKIEWSKYVTAGYLDQHTVLEEGQTVRDVLRTAFDELFKTEARINDIYISMADDGADVDSLMEEVGELQDRLESRDFYTLDAKIDEVARALGVMDFGMDSDVTELSGGQRTKVLLAKLLLEKPDILLLDEPTNYLDAEHIDWLKRYLQNYENAFVLISHDIPFLNDVINIVYHVENQDLVRYSGDYTNFESVYAMKKAQLEAAYERQQKEIADLQDFVNRNKARVATRNMAMSRQKKLDKMDIIELQAEKPKPSFEFKESRTPGRFIFQAKDLQIGYDRALTKPLNLTFERNQKIAIVGANGIGKTTLLKSLLGIIPPISGNVERGDFIDLGYFEQEVPGGNRQTPLEAVWDAFPALNQAEVRAALARCGLTSKHIESQIQVLSGGEQSKVRFCLLMNRENNVLVLDEPTNHLDVDAKDELKRALKAYKGSILMVCHEPDFYEGWMDDVWDFNQLS

SEQ ID NO: 91769 - protein, 221 aa, Ustilago maydis 521
MPGLRLGSIAPNFTAETTHGVLNFHEYLGDSWGILFSHPDDFTPVCTTELGEVARKAPEFEKRGVKIIGLSANDIASHDRWIKDINEVGNTSVNFPIIGDKDRKVSTEYDMLDALDPTNVDAKGIPFTVRDVFVIDPKKVIRLKISYPASTGRHFDEILRVIDSLQIGDKYRVTTPVNWQKGDKVIVHPSVQGEEAEKLFPGYETVKPYLRFTKDPSTSSA

SEQ ID NO: 91770 - protein, 448 aa, Clostridium perfringens str. 13
MKIVVAGTGYVGLVTGACLSEIGHNVTCVDVDEKKVEIMKKGISPIYEPGLDELLEKNYKEGRLDFTTDYKNAYKNADIVFIGVGTPERSDGSANLDYVFTVCSQIAENLENDCLVVVKSTVPVGTNDKVEAFLKENVKDGIHIEVASNPEFLAQGTAVVDTLKASRIVIGVESERAENTLREVYERFNQPIVATNRRSAEMIKYASNDFLALKISFMNEIANFCEIVGADIEDVAKGMSYDPRIGDKFLRAGIGYGGSCFPKDTKALHWLANDNGYEIKTIKATIEVNQNQKLKMFREAKKRFGDLKGKKVAVLGLTFKPGTDDLREAPSIVNVRRLLDEGAKIVAYDPVGIENFKKLYPTEIQYVNNPGEALKEADMAFLFTEWKEIKGIELSVYETLMKTPIIFDGRNCYEIKDVEKSNVEYHSVGRKIVYNLDEAKVEAAATLI

SEQ ID NO: 91771 - protein, 263 aa, Lactobacillus plantarum WCFS1
MTNLVGKTVLVTGASSGLGEQLALAVASQGANVVLAARRRERLTQVADQCRLLSKGQAVAITCDVGHVADVDHVFTTIDELFGQLDVVINAAGFGDMTTVITMDAPVMAKMLRVNTLGTMYVSQLAAQRMVKQHAGEIVNIASMAGKIATPKSAVYAASKAAIIAYDNALRLELKDAHVNVLTVNPGPIKTDFFKIADPTGHYLDRVDQLALNPVKFAELIVSKLGHQRRELNRPWVMSAANLGYQLAPKLGDWLTGTVFNFK

SEQ ID NO: 91772 - protein, 206 aa, Coxiella burnetii
MLCLRLKWANWFGRKFGINFGLQTIEQFQMLYAFEDREPKLLGDNYFIADSADVIGSVIIHNNVSILPHAVIRADNDVIEIGEGSNVQDGALLHTDPGIPMRVGKGVTIAHRAMLHGCKIGDHSVIAIGAIVMNNAIIGKNCIIGANALILENQKIPDGSLVIGSPGKVKSQLSQKQIEEMQGYAKHYIEKIDRFKHELKVFQRVK

SEQ ID NO: 91773 - protein, 348 aa, Clostridium perfringens str. 13
MLCALIMAGGKGTRFWPLSTEEKPKQFLNLIGDKTMIQMTIDRVKPIIPIERIFVCTGEKYIDLVKEQLPELPENNIIVEPEGRNTAPCIALSALVIKRYYKDATMVVLPSDHLISNEDRFRNILLDGEEYLKENGKSILTLGMTPNRAETGYGYIKFTEDKSLVNNSEVIKVEKFVEKPNKERAEEYLKDGSYLWNGGMFLWTIDNIINRIKEHIPNTYESLKEIEEVKEEKLQELINNNYKKTDSISVDYAILENADEIRVIPSDIGWDDIGTWRSVERYREKDINNNIIDENVRVIESKSNMAINKEKRVVMIGIEDIMTVETEDTIFIVKKDYMDNLRDYKEVL

SEQ ID NO: 91774 - protein, 394 aa, Halobacterium sp. NRC-1
MDVHFATVRSTNSSEGTLDVLIDGQAVTIEDNTEGDRSVGDLVEVWIDKGGRVAVEEVGRASPSVGVIREAIGGNEYLVERNGRVEVCESLDAENPEEGATVKIYGGKVTATISDEVIAPKGIEDRFGEQNRSKAYLKDPEEISEVDSGYDDVGGLTDTIEEVKDVVEIPLRESDKETNRFNKHGVEPDTGILFHGPPGTGKTLLAKAVAKETGSSIYLVNGPEIISKWYGETEDIIREIFSNAKKKKRAIIFIDEVDSIAPDRGDTKQFQRKIVAQLLTELDGFEPLNDVVVIGATNALNEVDSAIIRPGRFDRKIKFSKPTQTERMEIIEKITKDVDFGESVDLQLFAESTDGWTGADLSGVISRAVTISIRREGDLVTQDDLFRAIKGAGE

SEQ ID NO: 91775 - protein, 275 aa, Desulfococcus oleovorans Hxd3
MPGIRELKDKVVVITGAGSGIGRAAAHAFAKEGACVVITDIHAERLAAVEDELVRMGARASSRVVDVADKAQLEDLCRFVIDTHGRVDVLHANAGIGYGGPLEVFPMADFEKVMAVNFWHVVYSVGFFLPHMIKQHFGHIVVTASAASYFGLPGLGAYTASKFAVAGYLELLRAELRRHNIGVTTICPGFINTNIVKDGKSTLLPGAKADQEKMAAFYKRFGWPPERVAKAVLKGVRKNKALVPVGPEAWAQWYLKRLSPGLYNLILRIGAKLSL

SEQ ID NO: 91776 - protein, 126 aa, Glycine max
  misc_feature (6)..(7): Xaa can be any naturally occurring amino acid
  misc_feature (18)..(18): Xaa can be any naturally occurring amino acid
  misc_feature (20)..(21): Xaa can be any naturally occurring amino acid
  misc_feature (27)..(28): Xaa can be any naturally occurring amino acid
  misc_feature (43)..(43): Xaa can be any naturally occurring amino acid
DIFVDXXRDMDISVVAGXEXXGFIFGXXIALGIGAKFVPLCKXGKLPGEVISEKYVLEYGTDCLEMHVGAVQHNERVIIIDDLVATERADAEVVECACVIGLSDLNKLNGKPLYILVEPRQVENGF

SEQ ID NO: 91777 - protein, 568 aa, Xylella fastidiosa Ann-1
MSSSSIEDIKGQSHRLRGSLLESLANPTTGALGESDQTLIKYHGSYQQDDRDLREERRRQKLEPAYQFMIRTRTPGGVITPQQWLQLDAIATRYANHSLRVTTRQAFQFHGVIKRELKTTMQAINAALIDTLAACGDVNRNVQVAANPLISRAHADLYTDAAHLSEHLLPNTRAYYEIWLDEKKVAGAGEEEEPIYGPHYLPRKFKIGFAAPPINDVDVFANDLGFIAVIVDNTLLGYNVTIGGGMGTTHGDPDTWPRIGNIIGFITRADLIIISTAIVTTQRDFGNRTLRKRARFKYTIDDRGLDCIVGEIQQRAGIILQPARPFVFEHNGDRYGWIEGEDGHWHLTLSLPAGRIADTESSPLLSGFRAIAQLGIGQFRMTPNQNVVIAGISPGQRAAIDALVTQYGLDTGNRAPTALARHAMACVALPTCGLAMAEAERYLPDFNAKLQPILEKYGLAETPILLRISGCPNGCSRPYLAEIALVGKAPGRYNLMLGGDQRGQRLNTLYRENITETEILTALEPLLGRYQQERIPSEGFGDFLHRTGIIALPPYPTHRHVISSTLQA

SEQ ID NO: 91778 - protein, 569 aa, Zea mays
  misc_feature (469)..(469): Xaa can be any naturally occurring amino acid
  misc_feature (502)..(502): Xaa can be any naturally occurring amino acid
MDQYEVLEQIGKGAFGSALLVRHKLERKKYVLKKIRLARQTDRTRRSAHQEMQLIANVRNPFIVEHKDSWVDKGCYVCIVIGYCEGGDMAEAIKRANDTHFSEEKLCQWLVQLLMALDYLHAHHILHRDVKCSNIFLTRDQNIRLGDFGLAKILTADDLAFSIVGTPSYMCPELLADIPYGTKSDIWSLGCCMYEMAALKPAFRAFVSSENAFIDCLSAVCARYLIKWLSTKVTSRYAKPYQQDYQVDSITFANKIFWCIPYVLQLHLKSHLSRSIVPVHQSPSEKRMTFAAEPVCRSKGRRNSLGSERMIAAFSKPSPDRSSVSSIRSVKDDYTATQSVRELSVDESMVEVASKPVASRTSDVMRTPKATPWKMMTTLRNRLEAPQASYDRTSHTEFSRTPVDKRNSRVARRASLPLPVFETPKQRSSMSVLERLESPDVSVNSPRIDRIAEFPLASCEDPLFSTVKXRHPPAPAPAPRLRFVDRSITKDKCTAQTLRRRXRFDTTSYQQRAEALEGLLEFSAQLLQQERYEELGVLLRPFGPDEMVSPRETAIWLTKSFKEAMATGL

SEQ ID NO: 91779 - protein, 545 aa, Vitis vinifera
MIAVLLRNLVNLVSEGWSWWWDGLTENTIFRVVAALLTAAIAISWYAWLIKKANRGLPPLPPGPRGLPLLGNLLFIEPDLHRYFSKLSQLYGPIFKLQLGSKTCIVINSSSVAKEILKDHDVIFANRDVPISVLAFTYGGQDIVWSHYSPEWRKLRKVFVQEMMSSASLDACSALRRREVQEMVRDVYGKVGTTINMGDQMFLTVLNVVTSMLWGGTLHGEDRSRIGMEFRRVIVETVELVGKPNISDLFPALAWFDLQGIESRAKKLVLWFDRIFESLIAQRTQVDGADGEGKNKSKESKDFLQFMLELMHQGDDKTSVSITQLKALFMDIVVAATDTSSTTVEWAMAELLQHPQTMQKAQEELEKVVGNENIVEESHLFQLPYLGAVIKETLRLHPPLPLLVPHSPSTSCIISGYTIPKGSRILVNAWAMQRNPEAWEHPLEFIPERFLEDAASADYKGNNFNFLPFGSGRRICAGLPLAEKMLLYVLASLLHSFDWKLPDGRTSVDLEERFGIVLKKTEPLLAIPTARLSNLGHYDPSERIF

SEQ ID NO: 91780 - protein, 534 aa, Vitis vinifera
MIAVLLRNLVNLVSEGWSWWWDGLTENTIFRVVAALSTAAIAISWYAWLIKKASRGLPPLPPGPRGLPLLGNLLFIEPDLHRYFSKLSQLYGPIFKLQLGSKTCIVISSSSVAKEILKDHDVIFANRDVPISALALTYGGQDIAWSHYSPEWRKLRKVFVQEMMSSASLDACSALRRREVQEMVRDVYGKVGTPINMGDQMFLTVLNVVTSMLWGGTLHGEDRSRIGMEFRRVIVEMVGLMGKPNISDLFPALAWFDLQGIESRVKKLVLWFDRIFESLIAQRTQLDGADGGGKNKSKESKDFLQFMLELMHQGDDKTSVSITQLKALFMDIVVGATDTSSITVEWAMAELLQHPQTMQKAQEELEKVVGNENIVEESHLFQLPYLDAVIKETLRLHPPLPLLVPHSPSTSCIISGYTIPKGSRILFNAWAMQRNPEVWEHPLEFIPERFLEDAASADYKGNNFNFMPFGSGRRICAGLPLAEKMLLYVLASLLHSFDWKLPDGRTSVDLEERFGIVLKKSEPLLAIPTARLSN

SEQ ID NO: 91781 - protein, 421 aa, Thermoanaerobacter tengcongensis MB4
METREIASQRRKNLYLGIELKKFLKYLGPAFIVSVAYVDPGNFATNISGGSLFDYHLIWVILWSNVIAIFLQIQSAKLGIATGYNLPEMCSIIFPRKWNWFLWITAELAAMATDLAEFLGGTMGLYLLFHIPMTYAAFLTGVVTFAIVYMEKYGQKVVEGIIFGLVAVISLAYAFELFIARPDWSKVLYHTFIPSIPNKDAMLIAVGILGATVMPHVIYLHSQLVQYRNKDGSLQAKKEHLKMEKIDILVAMNTAFIINAAMLIVSAAVFYKNGIVIESIEEAHKTLEPLLGVFSSWAFGIALLASGFSSSAVGTMAGQTIMKGFVGLNIPLNVRRLVTMVPAITIIALGIDPLKSLIVSQVVLSFELPMAIIPLLLITSNKKFMKEFADTPLERIMGVLVASFVMILNGLLLYLTLKGEV

SEQ ID NO: 91782 - protein, 178 aa, Synechococcus sp. RS9917
MTLDLPRMRVPRRLTTLAISLAACVLAIGFWLPAAPALAITAPELRGQRAVQEIVPDMHGMDLKEKEFLKADLQGVDLSGSDLRGAVINTSSLQGADLQGADLSDVVAFASRFDGADLRNAVFTNAMLMQSRFGDAQIDGADFTDAVIDLPQLKALCARAAGENSRTGVLTRDSLGCR

SEQ ID NO: 91783 - protein, 338 aa, Populus trichocarpa x Populus deltoides
MGKIKIGINGFGRIGRLVARVALQRDDVELVAVNDPFITTEYMTYMFKYDTVHGPWKHHELKVKDSKTLLFGERPVTVFGSRNPEEIPWGETGAEYIVESTGVFTDKEKAAAHLKGGAKKVIISAPSKDAPMFVMGVNEKSYTPDLNIVSNASCTTNCLAPLAKVIHDRFGIIEGLMTTVHSITATQKTVDGPSSKDWRGGRAASFNIIPSSTGAAKAVGKVLPALNGKLTGMAFRVPTVDVSVVDLTVRLEKSAKYDEIKAAIKEESEGKMKGILGYTDEDLVSTDFIGDCRSSIFDAKAGIALNDNYVKLVAWYDNEWGYSTRVVDLICYIASVSS

SEQ ID NO: 91784 - protein, 394 aa, Thermoanaerobacter tengcongensis MB4
MDLKKEALKLHRENKGKIEVVSKVPVKNEEDLSLAYTPYVAEPCKEIEKDKDLVYEYTVKGHMVAVVTDGSAVLGLGNIGPYAALPVMEGKAVLFKEFGGIDAIPICLATQDVDEIIRTVLNIAPTFGGINLEDISAPRCFEIEKRLDEMLDIPVFHDDQHGTAIVTFAALVNALKIVKKSLYEIVAVVNGAGAAGVAISKFLVNAGVKDVIVCDRSGIIYEGRKDLDSSKQKIAKITNKKKIKGTLKEALEGADVFIGVSGPNLLTKEMVKKMAKKPIVFALANPVPEIHPEEAKEAGAYVVGTGRSDFPNQVNNVLAFPGVFKGALRVRATTINERMKLAAAYAIANTISEEELSSEYILPKPFDKRVAENVAYAVAKEAINTGVSRITKFD

SEQ ID NO: 91785 - protein, 303 aa, Rhizobium leguminosarum bv. viciae 3841
MSAQPPVPTEKGILQFLAICDAFYPPDAVQASIEQQRDWYDALCARFDRPLPPEMIFADGMLQRMPIRRYRPRKISTRTILLYLHGGGFVVGSLESHHAICAEIADFAGAELVSVDYRLAPEYRWPAQTDDGFTVLKHLLSANSKVVLIGDSAGGNLAAGLALRARDEGLSGVVGQVLIYPTLSGNLDAGSYAEMAAAPGLTTADVAYYREMLQAPAGNEIAEPLQASSLAGLPPAFITVAHFDPLRDDGRHYAARLAAEGVEVWFREEPQMVHAWLRARNMSEGARDGFRAVCEAIRRFAAS

SEQ ID NO: 91786 - protein, 93 aa, Brassica napus
MAFLLKNNSISSHLRSSSQKMDGGALGQSRRGFHVELGAREKDLLAENDALRRFKSHKKGVRQLKRIGDVITAVVVAGCCYEIYARATMKKDA

SEQ ID NO: 91787 - protein, 453 aa, Zea mays
MKERSGSRAAVDERYAQWKSLIPVLYDWFANHNLVWPSLSCRWGPQFEKATYKNRQRLYLSEQTDGSVPNTLVIANCEVVKPRVAAAEHISQFNEEARSPFVKKYKTIVHPGEVNRIRELPQNSKIIATHTDSPDVLIWDVEAQPNRHAVLGASESRPDLILTGHKENAEFALAMCPAEPYVLSGGKDKSVVLWSIQDHISALGDSSSSPGASGSKQSIKTANEKESPKVDPRGIFHGHDSTVEDVQFCPSSAQEFCSVGDDACLILWDARTGTAPAVKVEKAHSGDVHCVDWNPLDVNYILTGSADNSVRMWDRRNLGSGGAGSPIHKFEGHKAAVLCVQWSPDRASVFGSSAEDGFLNVWDHEKVGKKKNSNVPAGLFFQHAGHRDKIVDFHWNSSDPWTIVSVSDDGESTGGGGTLQIWRMSDLIYRPEDEVLAELENFKAHLASCAPKN

SEQ ID NO: 91788 - protein, 364 aa, Zea mays
  misc_feature (305)..(305): Xaa can be any naturally occurring amino acid
MERMLARLMRRRSSVPLSGLLHHGGAPAPLQAAGATGASPLILSHQQQQQHTAASAVLPGLKIRDSASQLIGRTPMVYLNKVTEGCGARVAAKLEFLQPSFSVKDRPAISMLEDAEKRGLITPGKTTLIEPTSGNMGIGLAFMAALKGYELVLTMPSYTSLERRVTMRAFGANLVLTDPAKGMGGTVRKATELYERHPSAHMLQQFQNPANVKVHYDTTGPEIWEDTLGQVDIFVMGIGSGGPVPGVGKFLKGKNPNAKIFGVEPAEANVLNGGKPGPPLFPGNGVGFKPDFLDMDVMEKVLGVXVGISSGANPVAALELAKGPGNKGKLFVTVLPSLGERYLSSALFDELGKGAQPLEPVAVD

SEQ ID NO: 91789 - protein, 796 aa, Ustilago maydis 521
MDRPRRSARQSASAHHSPAPTSTPFASANVGSSSQIASNMVAPVGMANGISVSSRYEAGSYASPVAYSHPAASRPAYHQTPSASDSGLARSQQPVMQPRHSSFGPSDSQVVSQIALQSLPQTFIMGRGAAPIAPGTPSAPSRPCGTAASGATVPQAMYSTFPARIKAGTTNLLQTMPQSEWYDPSGKPLDPFSTPSHDASGGSTPYRSSRASGRRRAAAGFIRYAEAGSSDDEFEEDVGTEDEAGSRGVKRGIEHESEEDSSRAYLGLPPPASKMVAKRVYHRTNHVYHTDDDLVRQASRNEILVPIKIDLEAEQYRIKDSFTWNMNERLISPHHFAKLLLEDLDIPVEPYATQIMNMINQQIDDATGVADIEMEPAAGGVWASARFDDKQGELELLLPECERDQYDPVEEATKEGRPWNWGLERTDEQQRQWRKQMAQRLDAGRGLGEFEDDLRVIVDYEVQILRHMLRDRLEWDLCSPLTPESFARKLCDDLGLSGEAQALIANSVREQLINHKRAALELGLVGSGKVLKDKEKEIEAAWAELHAEKLEKQRKRLERGESATSVTDWQVQSRDATRANPTREASVQPSAPDSDQERKPAEDGEHDKTHLSSAAAQAGETAREDSGTPAARGDEAQDDEEDVETLHLTATATAAPTREGTCTPAIQASTTSSSIPATRSSARLSNMLLDATPAQPTTLSTSTPPAAGATSGVAIQPTLSAAQRLHNATYTVREILSRGPRPLDGIWRDWLESREFGPLLETLNDDDLDKLEEANIRASRRNRRDAARSLGGRRRR

SEQ ID NO: 91790 - protein, 412 aa, Glycine max
MELFATTMVAMAAATASTQLIFSKPCSPSRLCPFQLCVFDTKQVLSSGRRRHVGGSGVRCMAVGEAATTGTKKRSGYELQTLTSWLLKQEQAGVIDAELTIVLSSISMACKQIASLVQRANISNLTGVQGAVNVQGEDQKKLDVVSNEVFSNCLRSSGRTGIIASEEEDVPVAVEESYSGNYIVVFDPLDGSSNIDAAASTGSNFWIYSPNDECLADIDDDPTLDTTEQRCIVNVCQPGSNLLAAGYCMYSSSIIFVLTLGNGVFVFTLDPMYGEFVLTQENLQIPRAGKIYAFNEGNYQLWDEKLKKYIDDLKDPGQSGKPYSARYIGSLVGDFHRTLLYGGIYGYPRDKKSKNGKLRLLYECAPINFIVEQAGGKGTDGLQVLRLQGTEIHQRVPLYIGEEVEKVEKYLA

SEQ ID NO: 91791 - protein, 306 aa, Clostridium perfringens str. 13
MNKKIRKAIIPAAGLGTRFLPATKAQPKEMLPIVDKPTIQYIIEEAIASGIEEILIITGRSKKCIEDHFDKSVELEMELEKSGKNELLDLVRDISDMVDIHYIRQKEPRGLGHAIHCAKTFVGDEPFAILLGDDVVYNEEKPCLKQLIDCYNEYKTSVLGVQTVPESHVSKYGIVDGKHIEGKVYKVKGLVEKPSVEEAPSNVAILGRYIVTPRIFDILEKTKPGKGGEIQLTDALLELMGQEAMYAYDFEGRRYDVGDKLGFLEATVEYALRRPELREGFVEYLNNLSEKESLFKKEVEKEIVTV

SEQ ID NO: 91792 - protein, 742 aa, Halobacterium sp. NRC-1
MNEVQLEVAKAYPNDSGRGIARLDPDTLLHLKLSPGDIIEIEGAETTAAKVWRADRQDWNTDTIRIDGFTRQNAEVGIGERVKIRKADAEKADTLVLAPPEEASVQFGSDAAGMVKRQILKRPVVARDIVPVMSSTNHPFMRSPGQAIPLIAVETEPEGVCLVTEDTDVELREEPISGFERTGGGITYEDIGGLENEIQRVREMVELPMKHPQIFQKLGIEPPQGVLLHGPPGTGKTLLAKAVANETSASFFSIAGPEIISKYYGESEQQLREIFEDAKDDSPSIIFIDELDSIAPKREDVTGEVERRVVAQLLTMMDGLEGRGQVIVIAATNRVDAVDPALRRPGRFDREIEIGVPDEIGREEILKIHTRGMPLSDDVNLSTLADDTHGFVGADIESLSKEAAMRALRRYLPEIDLDEEDIPPSLIDRMIVKREDFKGALSEVEPSAMREVLVELPKITWDDVGGLTEAKNNVKESVEWPLNQPEKFTRMGVEPPAGVLLYGPPGTGKTLMAKAVANETNANFISVRGPQLLSKWVGESEKAIRQTFRKARQVAPTVIFFDELDSLAPGRGQTGGNNVSERVVNQLLTELDGLEEMEEVMVIAATNRPDIIDPALIRSGRFDRLVQVGQPGIEGREQILKIHTQDTPLAADVSLRELAERADGYVGSDLANIAREAAIEALRDDEDADDVGMAHFRAAMENVRPTITDDLMEYYDQVEDQFKGSQGPNVNSRQGSEHIGFQ

SEQ ID NO: 91793 - protein, 150 aa, Zea mays
LMQEAAREFNWKLNKPSIALMWGGGCIIRSVFLKDITHAYRSQPDLQNLLFDDFFNKAIHKAQPGGRDVVSKAALLGIPTPAFSTALSWFDGYRTKDLPATLLQAQRDYFGAPPFRIKPENASDKSPNGQDIHVNWPGRGGNVSAFTSQA

SEQ ID NO: 91794 - protein, 488 aa, Streptococcus pneumoniae
MFASKSERKVHYSIRKFSIGVASVAVASLFLGGVVHAEGVRSENTPKVTSSGDEVDEYIKKMLSEIQLDKRKHTHNFALNLKLSRIKTEYLYKLKVNVLEEKSKAELTSKTKKEVDAAFEKFKKDTLKLGEKVAEAQKKVEEAKKKAKDQKEEDHRNYPTNTYKTLELEIAESDVKVKEAELELLKEEAKTRNEDTINQAKAKVKSEQAEATRLKKIKTDREQAEATRLENIKTDREKAEEAKRKAEAEEVKDKLKRRTKRAVPGEPATPDKKENDAKSSDSSVGEETLPSPSLKSGKKVAEAQKKVAEAEKKAKDQKEEDRRNYPTNTYKTLDLEIAESDVKVKEAELELVKEEAKESRNEEKVKQAKAKVESKKAEATRLEKIKTDRKKAEEAKRRAAEEDKVKEKPAEQPQPAPAPQPEKPTEEPENPAPAPKPENPAEQPKAEKPADQQAEEDYARRSEEEYNRLTQQQPPKTEKPAQPSTPKT

SEQ ID NO: 91795 - protein, 238 aa, Picea sitchensis
MCSLEKRDGVFILTLSGEGEHRLNPASIDSILSALAHVNENAHLVSALITTNDGKFFSNGLDLQWVSEFSSSRESRSQILGLKYAQLLVAVMELKLPSIAAVCGHASAGGFIFALAHDYRFMRRDRGFLYMSEVDVGISIPPSIMSIIRSKVGSRHLTEVLLGGRKYTAPMAFKAGIVDSVHENSGETLQAAMDASVKMGKRNWNKEAYLQLRFSLFPEVTEKLGLRLKGRSPLLSSL

SEQ ID NO: 91796 - protein, 100 aa, Kluyveromyces lactis NRRL Y-1140
MSAIPIKLLNESQGHEITLELNNGDMYRGKLVENEDNMNCQLRDVIFTQANGKMTRMDDVFIRGSNIKLVVVPDMLKHAPLFKKTAVSKPPPPIRGPKRR

SEQ ID NO: 91797 - protein, 449 aa, Bacillus anthracis str. A2012
MISIGGVIGAGLFVGSGAVVHSAGPGSIVSYALAGLLVVFVMRMLGEMAAINPTSGSFATYAREAIGPWAGYTIGWLYWFFWVIVIAIEATAGAGIIQYWIPEIPLWLLSLILTILLTLTNVFSVKSFGEFEYWFSFIKVISIVLFLCLGLAVILGFVPGTEAPGTSNLVGQGGFMPNGISSVLLGITVVIFSFMGSEIVAVAAGESAEPVKAVKTATNSVIWRILVFFIGSIAVVVTLLPWNSANILKSPFVAVLEHIGIPAAAQIMNFIVLTAVLSCLNSGLYTNSRMLFSMAERGDAPKAFLKLNSSGVPVRAVLFGTFFAYIGVVFSYISPDKVFLFLVNASGGIALLVYLVIAISHLKIRKKMGRVEQQNLKVKMWFFPYVTYVTIAAIIAVLIAMLAIESLRSQALLTMLVTVLIIISYFIFNRNKNSTVLNTKSKNEESVRF

SEQ ID NO: 91798 - protein, 109 aa, Griffithsia pacifica
MSISQVIDTSFHEEVINSRQPVLVDFWAPWCGPCRMIASTIDEIAHDYKDKLKVVKVNTDQNPTIATEYGIRSIPTVMIFINGKKVDTVVGAVPKLTLLNTLQKHLKST

SEQ ID NO: 91799 - protein, 249 aa, Coprinopsis cinerea okayama7#130
MTASRTDLLAWLNELLQINYTKIEQCGSGGAYCQIMDSIYGDVPMNRVKMNAKHEYEFLVNYKVLQTFFKNKKIDKPIPVEKLTKCKMQDNLEFLQWMKRFWDANYGGQGYDAVARRKGVPLEPPATVAPVPTSRSTGAGLAAGGARAGGRTPLGGFRSGSAQSQETIVHLQNQVSELTGQLEGLEKERDFYFEKLREIEILVQEQLDLPKEEQGDQEVFTRIQKILYSTEDGFEVPDPQAAVDEEETF

SEQ ID NO: 91800 - protein, 525 aa, Oryza sativa Indica Group
MRSSSDCKVVAAAARKKEKEAAAWPWSLWGFLLTGCLGGGGGGGKKKSGGKKVRPRGGGGGLRRLSFTDLTGAADQDLSVSLVGSNLHVFTVAELRDATRGFVSGNFLGEGGFGPVYKGLVGDGVKPGLRPQAIAVKLWDPEGAQGHKEWLAEVIFLGQLRHPNLVKLVGYCCEDENRLLVYEYMEHGSLENHLFKQIPAVLPWSTRLNIAVGAAKGLAFLHDAEKPVIYRDFKASNILLDSDYKAKLSDFGLAKDGPEGDDTHVSTRVMGTHGYAAPEYIMTGHLTAKSDVYSFGVVLLEILTGRRAVDKTRPNREQSLVEYARPCLRDPLRLIRIMDPALEGRYSPAAAREAAAVAYRCLSGSPKNRPDMSAVVDALEPLLVATDDVPLGPVVLFVAPDQEADAAAAADDDEDDKARRRQRRTRKDEQHRRRSRLRTSPKGSPRKPAVAAACRNEEFWVWHVPADHKARKMELPLRCFHGAKVAAGDGGVAGRAAVPAKGGGGGGVARGVKVVPYSSSIRCFV

SEQ ID NO: 91801 - protein, 204 aa, Heliobacillus mobilis
MVLERLRDAFEEEKPARAIDWTPEEAEIVRGLFLLTSKPVLYVANVSEDEVGQPDNPLVKEVRARADQEGAGVVVICAKIEAEIAELTDPEERAMFLSDLGLEESGLDRLIRETYTLLGLITYFTAGVQEVRAWTITKGMKAPQAAGVIHTDFERGFIRAEVTGYDDLISTGSQAAARDKGLMRLEGKEYVMHDGDVVHFRFNV

SEQ ID NO: 91802 - protein, 521 aa, Arcanobacterium pyogenes
MSELRPVLVIDNGAQNAQLIARRVRDAGYYSELVPHSWSAQQVLDKQPRAIILSGGPSSVYAEGAPQLDPALLEAGVPVLGICYGFQQMTHALGGAVGRTDLKEYGTTPAQMVADGVVTGPAGRSATVWMSHGDSVTRAPEGFTVTATTPGAQVAAFENAERKLFGLQWHPEAKHCEHGQEQIEAFLRDGAGLEPNWDSSSVIEEQVRKIREQVGDKHAICGLSGGVDSSVAAALVHKAIGDQLTCVFVDHGLLRKGEAEQVVRDYAASLGIRVVAVDESERFLSALDGVTDPETKRKIIGREFIRSFEAAQRALVAEAGAAGKEIKFLVQGTLYPDVVESGGGDGTANIKSHHNVGGLPDDLDFELVEPLRDLFKDEVRAIGLELGLDEKLVWRQPFPGPGLGIRVVGAVNRERLDILREADAIAREELSAAGLDREIWQCPVVLLADVRSVGVQGDGRTYGHPIVLRPVSSEDAMSADWTRIPYDVLSKISSRITNEVDEINRVVLDVTSKPPGTIEWE

SEQ ID NO: 91803 - protein, 254 aa, Rhizobium leguminosarum bv. viciae 3841
MKNLFDLTGRRALITGSSQGIGYALAEGLAQHGAEVIINGRTPESVKRAVESLKDQGLSAHAAIFDVTSKDAAKEGIDAIETDIGPLDILINNAGMQFRTPLEDFPADKWELLLTTNISSVFYVGQAAAKPMIARGQGKIINIASVQSELARPGIAPYTATKGAVRNLTRGMCADWAKYGLQINAIAPGYFKTPLNQALVDNPEFSSWLEKRTPAGRWGNVEELVGAAVFLSGRGSSFINGHTLYVDGGITTSL

SEQ ID NO: 91804 - protein, 425 aa, Arabidopsis thaliana
  misc_feature (238)..(238): Xaa can be any naturally occurring amino acid
MLVPNKRFHYLLQFQMWCLPSVRPNVSEMFFKSPMLKPTAKFSSTSSPYLPPSFSVAPMMDWTDNHYRTLARLITKHAWLYTEMIAAETLVHQQTNLDRFLAFSPQQHPIVLQLGGSNVENLAKAAKLSDAYGYDEINLNCGCPSPKVAGHGCFGVSLMLKPKLVGEAMSAIAANTNVPVTVKCRIGVDNHDSYDELCDFIYKVSTLSPTRHFIVHSRKALLGGISPADNRRIPPLNXRYEYYYALVRDFPDLRFTINGGITSVSKVNAALKEGAHGVMVGRAAYNNPWQTLGHVDTAVYGVPSSGLTRRQVLEQYQVYGDSVLGTHGNGRPNVRDLVKPLLNLFHSENGNSLWKRRADAAFKECRSVGSLLEESLRAIPDCVLDSPISGSPESGDEDVFADVFADVRNVLPPPYEAGEEIILCA

SEQ ID NO: 91805 - protein, 251 aa, Clostridium acetobutylicum ATCC 824
MRQHFLSRTELLIGKERLEKLKNSKVIVFGIGGVGSYAVEALTRSGVGRIVLIDDDTVCLTNINRQIQATFKTIAKPKVDVMKERILDINPNCQVETHRIFVTEDNISDLIAPDTNYVIDAIDTVSAKISLILWCQKNNINIISCMGTGNKLDPTRFEITDIYKTSICPLAKVMRHELRKRGVKSLKVLYSKEMPMKPKSDEVITCKEGCVCANGSRKCTAKRQIPASISFVPPVAGMIIGGEVIKDIMDS

SEQ ID NO: 91806 - protein, 475 aa, Bordetella parapertussis 12822
MSKQFDVVIIGAGPGGYIAAIRAAQLGMSVACIDAWQNGQGGPAPGGTCTNVGCIPSKALLQSSEHYEQANHHFAEHGIEVKGVSLKLDTLIGRKNTVVKQNNDGILYLFKKNKVTYFHGKGAFAGQVDGGWSIKVTGTTDADLVAKHVIVATGSSARELPGLPFDEKNILSNDGALNIGAVPKKLGVIGAGVIGLEMGSVWRRLGAEVTILEAMPEFLAAADQQVAKEALKSFAKQGLDIQTGVKIGEIKAAAKSITVPYVDAKGAEQKLVVDKLIVSIGRVPYTGGLNAEAVGLKLDERGFVAVDEDCKTNLPNVWAVGDVVRGPMLAHKAEEEGVAVAERIAGQHGHVNFATVPWVIYTSPEIAWVGKTEQQLKAEGREYKAGSFPFMANGRARALGDTTGFAKVIADAKTDEVLGVHIIGPMASELISEAVTIMEFRGAAEDIARICHAHPTLSEAVKEAALAVDKRTLNF

SEQ ID NO: 91807 - protein, 554 aa, Oryza sativa
MAARRAASSLLSRGLIARPSAASSTGDSAILGAGSARGFLPGSLHRFSAAPAAAATAAATEEPIQPPVDVKYTKLLINGNFVDAASGKTFATVDPRTGDVIARVAEGDAEDVNRAVAAARRAFDEGPWPRMTAYERCRVLLRFADLIEQHADEIAALETWDGGKTLEQTTGTEVPMVARYMRYYGGWADKIHGLVVPADGPHHVQVLHEPIGVAGQIIPWNFPLLMFAWKVGPALACGNAVVLKTAEQTPLSALFVASLLHEAGLPDGVLNVVSGFGPTAGAALSSHMGVDKLAFTGSTGTGKIVLELAARSNLKPVTLELGGKSPFIVMDDADVDQAVELAHRALFFNQGQCCCAGSRTFVHERVYDEFVEKARARALQRVVGDPFRTGVEQGPQIDGEQFKKILQYVKSGVDSGATLVAGGDRAGSRGFYIQPTVFADVEDEMKIAQEEIFGPVQSILKFSTVEEEVVRRANATPYGLAAGVFTQRLDAANTLARALRVGTVWVNTYDVFDAAVPFGGYKMSGVGREKGVYSLRNYLQTKAVVTPIKDAAWL

SEQ ID NO: 91808 - protein, 405 aa, Bordetella parapertussis 12822
MAITDVLVPQLSESVSEATLLTWKKQAGAAVEADEILIEIETDKVVLEVPAPSSGVLSEIVMGDGSTVTSGEVIARIDTAAKAAAAPAAAAEAPAAAAAAPAAAAPAAASSAASGVASPAAAKILAEKGVDAASVAGTGRDGRVTKGDALAAGNAPAAKAAAPVAPPTLSLDGRPEQRVPMSRLRARIAERLLQSQAENAILTTFNEVNMQAVMDLRARYKDKFEKEHGVKLGFMSFFVKAAVAALKKYPVLNASVDGKDIIYHGYFDIGIAVGTPRGLVVPILRNADQLTIAEIEKTIADFGKRAADGKLGIEEMTGGTFSISNGGVFGSMLSTPIINPPQAAILGIHATKERPVVENGQIVIRPINYLAMSYDHRIIDGREAVLGLVAMKEALEDPQRLLLDL

SEQ ID NO: 91809 - protein, 463 aa, Oryza sativa
MLNPIMSSDRSSKKVCVVGAGMAGLAAARELRREGLDVTVLEQLAGVGGQWLYDAATDAGDPLGMAGVHSSVFASLRINGPRESIGFSDFPFRPTNDAGGDARRYPVHGELLRYIRDFCDAFGLMDAVRLNTTVTRVAMAPPRRDGSLRWAVRSKRHGEAETEEVFDAVVVAIGHYSQPRLPTIDGMDRWRRKQLHSHSYRVPDSFAGEVVVIVGCSVSGAELALELRRVAKEVHLSTKSTEETITSAMSKSVARYENLHLRPQVEHLREDGTVVFDDGSFVVADAVIYCTGYNYSFPFLDTNGKVTVDDNRVGPLYEHVFPPELAPSLSFVGIPGKVVLPVFIEVQARWVAQVLSGRRTLPSPEEMQRAVEEHTRGMEAAGLPKRWTHDMFLNLERCDDYGERICGFPRMEQWKKEIFVSSLSDMVDDIENFRDGYHDSDLVRDALRRHGWTPAEEDDDAHK

SEQ ID NO: 91810 - protein, 850 aa, Azoarcus evansii
MEAVQTSEIRWWKASKPAGMAEFGAPVKLSIDGVEVEAPAGASVLNAATAAGLYIPALCAHPDLPPAGQRGAGEGGCNLCMVEIDGVDGVVKACSTTVTAGMVVTTKSPAIQEVRQASLAKILGPHPHVCLTCPQRDGCSRSQCSYGNPQETRCCTIFSSCELRKVSDYIGIPNTTPPYKPAQLPVVLDEPFFDRDYNLCIDCRRCLVACNDVRGVGCLEFKGSRDAWQGKRTYVGTIAPTLIESGCTFCQACVTVCPTGALMDRTLDPAKREESMVPCKNACPAGIDVPRYVQLAAEGKYGEAIAVVRERLPFPGILGRACFAMCESACRRKDLDDPLSIRNLKRIAADNDTGVWREHAKKLPATGKKAAVIGAGPAGLTVAYYLAKQGHGVTVFDAQPAAAGMARYGIPSYRVPAEVIDNEVAEVSALGVEFRFGAKVENVDTLFNDGYGAVFVGIGAQGGDKLGIPGDDLPGVVDSPTYLKAVTMGLVNTPEGIQTGKKVAVIGGGNVATDNARSSRRFGAEVDMVYRRTREEMPARLEEFEGCVEEGVNIRYLLAPKKIEPGTNGFRLQITYAKMALGEPDASGRRKPVETGEEVVEGVDLVIAAIGQFPNRFEGFGVETDRKGRITVREDSMLTSRPKVYAGGDCVLGPSTLIESVAQGRVAASAMDIVLGGDGDISEVLLRTGWETNPCIGRKEGFNKIRKFHPIMLAPEQRTGWDEVELGFDDATARAEAARCFKCNLAPKIADAILPPESSLKFDEATIASVPTESGVFQLLDGDKNVLIIKGVENLREGLMEQLERGGDATNFVFEEAALFTSRESQMIQAYLQQYGKMPGGGSDELDDLF

SEQ ID NO: 91811 - protein, 338 aa, Clostridium perfringens str. 13
MNILLTGGIGYIGSHTIVELLRDDNNSVVVIDNLVNSRKEVKDIVEKITGKSIKFYEGDLVNFEDIDKVFKNEKIDAVIHFASLKAVGESVEKPLEYYNNNIIGTLNLLTSMRNHNVKKFIFSSSATVYGESEIVPVHEGLQAGFATNPYGRCKAMIEDILRDLYISDNSWNIVLLRYFNPVGAHESGLIGELPNGIPNNLMPYVSKVADGELDYVRVFGDDYNTPDGTGVRDYIHVVDLARGHVAAMKKLKDGSGISTYNLGTGQGYSVLDIIKAFSKASGKEIPYKIVDRRAGDIAISFADPSKAEKELGWKAEKNLEDMCKDFWKWQCVGMKNFK

SEQ ID NO: 91812 - protein, 148 aa, Triticum aestivum
  misc_feature (104)..(104): Xaa can be any naturally occurring amino acid
MLIKLSVEPDQRADVMFVANVFRAKVVDISENSLTLEVTGDPGKIVAAQRNLSKFGIEEICRTGKIALRREKIGATARFWGFSAASYPDLVEASRKNPLTSVNXTVNGSFDQPSSAGGDVYPVEPYESLSMNQVLDAHWGVLDDEDSS

SEQ ID NO: 91813 - protein, 139 aa, Zea mays
LLKATTEGYLDEQFCQIEDLQDEASPNFTEEVVSLFFKNSTRLMTNIEQAMDRNPRDFSKWDVNMQQLKGTCSSIGACRMKNECTSFRNRCGDENVEGCMRSFQNLKREHGVLRQKLESYFQLLRQAGPAVTATRPRGM

SEQ ID NO: 91814 - protein, 314 aa, Clostridium perfringens str. 13
MNNKIRKAIIPAAGLGTRFLPATKAQPKEMLPIVDKPTIQYIIEEAIASGIEEILVITGRSKKSIEDHFDRNVELEMELEKSGKTELLDLVRDISDMVDIHYIRQKEPRGLGHAIYCAKTFVGDEPFAILLGDDVVYNEEKPCLKQLIDCYNEYRTSVLGVQTVPEENVSKYGIVNGKHIEGRVYKVKGLVEKPSPEEAPSNVAILGRYIVTPRIFDILENTKPGKGGEIQLTDALLELMSEEAMYAYDFEGRRYDVGDKLGFLEATVEYALRRPDLRDGFIDYLRELSATENIFTEANGKEKKDKEEELVTEA

SEQ ID NO: 91815 - protein, 768 aa, Bordetella parapertussis 12822
MRRKGCAPMDENLTKLALDYHAYPTPGKISVTPTKTLANQDDLSLAYSPGVAAACMAIFDQGNDAASKYTSRSNLVGVITNGTAVLGLGNIGPLAAKPVMEGKGCLFKKFAGIDVFDIELAENDPDKLVDIIAALEPTLGGVNLEDIKAPECFYIEKKLRERMNIPVFHDDQHGTAIISSAAILNGLKVVGKDIGQVKLACSGAGAAAIACLDLLVHLGIKREHIYVVDSRGVIWEGRDENMEPNKRRYAQKTEARTLADVVNGADVFLGCSTAGVLTPEMVKTMAAQPLILALANPEPEIRPELAKAARPDCIVATGRSDYPNQVNNVLCFPFIFRGALDAGATRITEEMKLACVKAIAELAQAEQNDEVARAYAGQELSFGPDYIIPKPFDPRLIVQIAPAVAQAAADSGVATRPIEDIEAYRQKLMGFVYHSGQLMRPLFQQAKQAPKRVVYADGEDERVLRAVQTVIDEKLAEPILVGRPSVIEMRIKKFGLRMVPGQNVEIVDPEDDSRFNDTWNGYYQLRGREGVTPAIAKAMIRKHNTLIGAMLLRRGDADALLCGVTSKYDNQLKYVEEVIGRKPGQTYGALNVLMLPNQTLFVTDTHVNENPSADEIANITIQAAEEMLRFGVMPKIALLSHSNFGSRPTDSSRKMAHARKLVAERAPHLEVDGEMHADAALSESIRLQAYPDSTLKGRANLLVMPNLDTGNITYNMLKMTGSNGIAMGPILLGSARPVHILTTSATVRRIVNMTALAVVDAQQEAAEG

SEQ ID NO: 91816 - protein, 192 aa, Kluyveromyces lactis NRRL Y-1140
MSDKPFEDIDVDDEMNEFDDNEEAPVDNEALFARAEQEGEEGKTKIEDGSNRLFELPEFTRKDKTLQEILDLMEDNPPIIPDAVIDYYMTKNGFDCSDVKVKRLLALATQKFVSDIAADAYEYSRIRSAITVHNSNNGQARARQLLIGQQLTQQQQQQNEKTNANKVVLTVNDLSSAVAEYGLNISRPDFYR

SEQ ID NO: 91817 - protein, 253 aa, Zea mays
  misc_feature (71)..(71): Xaa can be any naturally occurring amino acid
  misc_feature (100)..(100): Xaa can be any naturally occurring amino acid
MRNYISYGMSLLEENGHDEISIKAMGRAINKTVMVVELIKRRVGGLHQNTATESVDITDTWEPLEEGLLPXTTRHVSMITVTLSKNPLDTSSPGLPAHYXYQPPIPAEEVKPAFDYDHEESYPTGRGRGRGGGRRGRGRGMSNGPPPPAYGYNEEWEEEGDYYNRGRGRGRLRGRGGRGRGGYYGGGRRGGYGYDYGYAPRGGYYEEQDEYYDEPEEYAPPPGRGRGRGRRGGMPWRGRGGRGPPRGGRGSYY

SEQ ID NO: 91818 - protein, 197 aa, Lactobacillus plantarum WCFS1
MEVHNVELVMSAVAPSQYPTTGFPEIGLAGRSNVGKSSLINVLINRNSYARTSSQPGKTQTLNFYKVEDQLYFVDVPGYGYAKVSKKEREKWGQMIETYLTSRETLRGVVILVDARHAPTKDDVAMYEWMRYYEMPLLVVATKSDKIPRGKWNKQESLIKKTLNFQAEDDFIAFSAKTKEGKDAVWQWIEAHTVGGN

SEQ ID NO: 91819 - protein, 585 aa, Arabidopsis thaliana
MDVMKLDHDSVLKELERITSKAAEVQDNILRGILERNKDTEYLSKYMNGSKDVLEFKRAVPIIIYKDIYPYIQRIANGEDSSLITGHSITEILCSSGTSAGEPKLMPTIPEDLDRRTFLYNLIIPIVNKYITGLDKGKAMYLNFVKAETSTPCGLPIRAVLTSYYKSKHFQCRPYDPFNDLTSPIQTILCEDSNQSMYCQLLAGLIHRHKVMRLGAVFASAFLRAISYLEKKWSQLCEDIRTGSLNPMITDPGCQMAMSCLLMSPNPELASEIEEICGRSSWKGILCQLWPKAKFIEAVVTGSMAQYIPALEFFSQGKIPLVCPMYASSETYFGVNVEPLSKPSDVVFTLLPNMCYFEFIPLGKNGTLSFDLDDDEQVPCDKVVDLVNVKLGRYYELVVTTFAGLYRYRIGDVLQVAGFYNGAPQFRFICRRNVVLSIDLDKTNEEDLHRSITLAKKKLGSNAFLAEYTSYADTSSVPGHYVLFWEIQGHLEPKLMEECCVAVEEELDYIYRQCRTKERSIGALEIRVVKPGTFEKLMDLIISQGGSFNQYKTPRCVKSNSATFKLLNGHVMASFFSPRDPTWVP

SEQ ID NO: 91820 - protein, 376 aa, Glycine max
  misc_feature (251)..(251): Xaa can be any naturally occurring amino acid
  misc_feature (337)..(337): Xaa can be any naturally occurring amino acid
MTTAEDRFVFLVEWYDAAASLVRTYNLTYYPKDKTIEMFDLKNKKLFLKRCEYPGVSLNDLYLGSIVTVYSRQLKIVDYADTFTRKNFETTRERTFGMIKPDCYQHIGKIIDIIEHSGFVIGNIKMARMTLNDAEEFYAEHKGKPFYPELTNFICSDFVVGMELVAEGAIAKWRKLIGPTNCQVARVEAPGSLRALFGTEGVRNACHGSDAPTSAQRELDFFFGDKCKLKPTAFLNNCTCCVIKPHIVSEXKCGKVIDHILSEGFEVSALQMFFIDKATSEEFLEIYKGVLPEFSGIANHLTTGPCIALEVRQENAVESFREICGPHDPEVARTLEXNSIRAIYGFDRIKNAVHCTDLSEDGPLEVEYFFTILNHK

SEQ ID NO: 91821 - protein, 300 aa, Synechococcus sp. RS9917
MSKRHPVVAVTGSSGAGTSTVKRAFEHIFARENITPAVVEGDSYHRFERAAMKEAMAEAMAKGENFSHFGPEANLFDKLEELFRVYGESGGGQKRYYLHSPEEAAEHNARLGTDLAPGQFTPWENIPASTDLLFYEGLHGGVQGDGYDVAALADLLVGVVPITNLEWIQKIHRDNAERGYSAEAIVDTILRRMPDYINHICPQFSRTDINFQRVPTVDTSNPFICRNIPTPDESFVIIHFRKGAREKWGIDFPYLLSMIHDSFMSSPTSIVVNGGKMGFAMELILTPIIHRMIEEKQKLA

SEQ ID NO: 91822 - protein, 359 aa, Synechococcus sp. RS9917
MRQHRVVLLPGDGIGPEITAVARMLLEAVAARHGFALQFDEQLIGGAAIDATGVPLPEASLEACRGADAVLLAAIGNPRFDALPREQRPESGLLALRSGLGLFANLRPVKIVPALSAASSLKAEVIEGVDLLVVRELTGGIYFGQPKGRVTADGEERGFNTMTYSASEVDRIARVAFELAKERRGQLCSVDKANVLDVSQLWRDRVEAMAATYPEVSVSHLYVDNAAMQLVRDPRQFDVLLTGNLFGDILSDEAAMLTGSIGMLPSASLGSAGPGLFEPVHGSAPDIAGQDKANPMAMVLSAAMMLRIGLKETEAADALEAAVNRVLAAGYRTGDLMAEGCTPLGCRAMGEQLLVHCNG

SEQ ID NO: 91823 - protein, 440 aa, Vitis vinifera
MATIKVIKARQIFDSRGNPTVEVDVTLSDGTFARAAVPSGASTGIYEALELRDGGSDFLGKGVLKAVENVNAIIAPALIGKDPTEQVKIDNFMVQQLDGTVNEWGWCKQKLGANAILAVSLAVCKAGAMVNKIPLYKHIANLAGNKKLVLPVPAFNVINGGSHAGNKLAMQEFMILPLGASSFKEAMKMGVEVYHHLKSVIKKKYGQDATNVGDEGGFAPNIQENKEGLELLKTAIAKAGYTGKVVIGMDVAASEFYDNKDKTYDLNFKEENNDGSQKISGDSLKNVYKSFVNDYPIVSIEDPFDQDDWEHYAKMTSEIGEKVQIVGDDLLRVEKAIKEKACNALLLKVNQIGSVTESIEAVKMSKRAGWGVMASHRSGETEDTFIADLSVGLATGQIKTGAPCRSERLAKYNQLLRIEEELGSAAVYAGAKFRAPVEPY

SEQ ID NO: 91824 - protein, 178 aa, Glycine max
  misc_feature (53)..(53): Xaa can be any naturally occurring amino acid
  misc_feature (101)..(101): Xaa can be any naturally occurring amino acid
  misc_feature (125)..(125): Xaa can be any naturally occurring amino acid
MASSTISSPTVTTVNRAGAGMDAPFTGLKAMAGFLTTKTNNDITSIASTGGRXHCMQVWPPPGNKNIETLSYLPHLDDAQLAKEGQHLLKKGWIPCLELQXEHSCRYREHNRSPRYYDGRYCTMXNLPMFGCTDAYHALNELRDADTAYPNGFIRIIRCNIVEQVQCINFIAYKPPDF

SEQ ID NO: 91825 - protein, 348 aa, Glycine max
MASTTTLSFHFPYPTTSLSSHSQLSPSPQPSPFKPCTVASRQNLCTSNTLSVSASRKNSTSPIFLATASGKSEPMLPPFNVLITGSTKGIGYALAKEFLKAGDNVLICSRSDERVKTAVQNLRVEFGEQHVWGTKCDVKNAEDVKNLVSFAQEKMKYIDIWINNAGSNAYSYKPLVEASDEDLIEVVTTNTLGLMICCREAIKMMVNQPRGGHIFNIDGAGSDGRPTPRFAAYGATKRSVVHLTKSLQAELRMQDVKNVVVHNLSPGMVTTDLLMSGVNTKQAKFFINVLAEPAEVVAEYLVPNIRSVPANGSMKPTYIRFLTGLKAYSQIFSRLAFGARRNRYILED

SEQ ID NO: 91826 - protein, 181 aa, Synechococcus sp. RS9917
MSASGTGNSGEVPTVLVKDSGGLDLLCFLEQLIPLDGEDYALLTPVDTPVCLFRLKDGQDPELIDAIADSEPILSVADVVLQEHDLTLVRSAVTLTVSGELDEPDPDDLDDEGEDDDDSETYELLVSFLVAEQEYGLYIPLDPFFVVARMVDGAAELVEGEAFDRIQPRIEAELEERELPN

SEQ ID NO: 91827 - protein, 472 aa, Roseovarius nubinhibens ISM
MAQLKTDLLVIGAGSGGLSVAAGAVQMGADVILLEGHKMGGDCLNYGCVPSKALIASGKAAQAQAHAARYGVADVVPQVDYAAAMGHVSDVIAQIAPVDSQERFEGLGVKVIRAYGRFLSGDEVQAGEHVIRARRIVIATGSLPLVPPIPGLESVPYVTNETLFEMREKPEHLLIVGGGPIGMEMAQAHRRLGSRVTVIEGARALGKDDPELAAIALDRLRGEGIEIAEEALAQEVRGQAGAIEIEAKDGRVFKGSHLLMAVGRKANIERLDLDKAGIETAKAGIKVDASLKTSNRRVYAIGDVAGGLQFTHVAGYHAGIVIRSALFGLPAKTRTDHIPYATYTDPEIAQVGLTEAAAREAHGAALEVVRFEYHHNDRAIAERKTTGLIKVMVVKGRPVGASIVGHQAGELISLWSLVIANGLKMKHVANMVAPYPTIGEINKRAAGAYFSPRLFENAMVKRVVGAVQRWLP

SEQ ID NO: 91828 - protein, 401 aa, Oryza sativa Indica Group
MLPQQQQQQKQQAAALMPPSMYAMPPPPPLHHHHHPLLAAAPPQQQIEPILTGNLPPGFDTSTCRSVYVGNVHVQVTEALLREVFQSTGLVEGCKLIRKEKSSYGFVDYYDRRSAALAILTLNGKQIPEVTDSALFAFFSGYSSCSFIWILNCTTFWYLVMPELCGIKRLEDLEVMALFPSGINRYGQWLGSRQIRCNWATKGASNGEQQTSDSKNVADLTNNLTEDGKEKANEDVPENNPQYRTVYVGNLAHEVTQDVLHRLFHALGAGAIEEVRIQLGKGFGFVRYSSHTEAALAIQMGNGRILGGKPIKCSWGNKPTPPGTTSAPLPPPAAPSVTAADLLEYQRSLALSKMVSSQALMQAQAQQHLKQAMGMGAGVSQAMYDASFPNVGPSQQQLMYY

SEQ ID NO: 91829 - protein, 404 aa, Populus trichocarpa x Populus deltoides
MASATFSVAKPSLQASGKGFTDFSGLRSSSAFLPFTKKTSDDFVSVVAFQTSAMGNSSGGYRKSAAEAKIKVAINGFGRIGRNFLRCWHGRKDSPLDVIAINDTGGVKQASHLLKYDSTLGIFDADVKPVGDNAISVDGKVIKVVSSRNPLDLPWKDMEVDLVIEGTGVFVDREGAGKHITAGAKKVIITAPGKGDIPTYVVGVNADAYSPDEPIISNASCTTNCLAPFVKVLDQKFGIIKGTMTTTHSYTGDQRLLDASHRDLRRARAAALNIVPTSTGAAKAVALVLPTLKGKLNGIALRVPTPNVSVVDLVVQVSKKTFAEEVNEGFRESAEKELKGILSVCDEPLVSVDFRCSDVSSTVDSSLTMVMGDDMVKVIAWYDNEWGYSQRVVDLAHIVADQWK

SEQ ID NO: 91830 - protein, 474 aa, Burkholderia xenovorans LB400
METHKNEFRRQTMQNTVYAATRLDRLPLSSFHWRLFFLIGAGLFLDAFDVYLGGVVTGALLKSGWSTLELNAWFTTLTFAGLTIGAWCAGILGDRFGRRFSYQLNLLIFGGASLAAAFAPSMTWLIALRFIMGIGMGAEIVISYGMLSEFVPPRYRGRLLAALSLFANSAVFVASLASLWIIPTFGWRYMFAITGVAATIVWVMRKKMPESPRWLVSQGRLEEAEAVLDGIETSVAKRHVLPDYLREDTVRAETVPLSVLFRTPVLWRSIVGSLIMVTIGYSVYGLINWLPSFFVQQGFNIVKSLTYSTVMSLGAPAGTVIGIFITDRMGRRPAIIGATLATAAIGLLYQHAASSAELLTAGFCLVAGIYVLVAVGQGAYVPELFATSYRLRGSGVCGTAGRAASALCQFFVLWLFTVGGVNMVVGSVVAVQLLLALAVWLLKIETSGLRLEQTVETGISTGTQERHRTVDISH

SEQ ID NO: 91831 - protein, 265 aa, Klebsiella pneumoniae
  misc_feature (219)..(219): Xaa can be any naturally occurring amino acid
MMTPIWLGTSWKMNKPLSQAMAWCETLAARMPEGCHPAIQPFVIPSFTAIQPVSHFLQTHQLPLLTGAQNMHEADQGAWTGEISAAMLAETGATLVELGHSERRAAFNESDAAINRKVHSALGHGLRPLICIGDSAEEKRWQVSRESVVRQMKIALYGLSHQQALRTLIAYEPVWAIGEHGTPASPQEAGVIHQALRQALCERFGHETGTRIPLLYGGXVTLQNAVELLRQQEINGLFIGRAAWDAQGYCDIVQRVTQEFILQAQ

SEQ ID NO: 91832 - protein, 449 aa, Salmonella typhimurium LT2
MTEIVVSKFGGTSVADFDAMNRSADIVLSDTNVRLVVLSASAGITNLLVALAEGMEPGERFATLDAIRKIQFDILDRLRHPNVIREEIERLLENITILAEAASLATSAALTDELVSHGELMSTLLFVEILRERDVQAHWFDVRKVMRTSDRFGRAEPDVAALAELAAQQLLPRLSETLVITQGFIGSESKGRTTTLGRGGSDYTAALLAEALHAARVDIWTDVPGIYTTDPRVVPVAQRIDEIDFEEAAEMATFGAKVLHPATLLPAVRSDIPVFVGSSKDPQAGGTLVCNKTQNPPLFRALALRRNQTLLTLHSLNMLHSRGFLAEVFGILARHNISVDLITTSEVSVALTLDTTGSTSTGDTLLTQSLLMELSALCRVEVEEGLALVALIGNNLSKACGVGKEVFGVLEPFNIRMICYGASSHNLCFLVPGDDAEKVVQKLHQNLFE

SEQ ID NO: 91833 - protein, 549 aa, Salmonella typhimurium LT2
MKNINPTQTSAWQALQKHYDEMKDVTIAELFANDSDRFAKFSATFDDLMLVDFSKNRITEETLAKLQDLAKETDLAGAIKSMFSGEKINRTEDRAVLHVALRNRSNTPIIVDGKDVMPEVNAVLEKMKTFSQAIISGQWKGYTGKAITDVVNIGIGGSDLGPFMVTEALRPYKNHLTMHFVSNVDGTHIAEVLKKVNPETTLFLVASKTFTTQETMTNAHSARDWFLKTAGDEKHVAKHFAALSTNAKAVGEFGIDTANMFEFWDWVGGRYSLWSAIGLSIILSVGFDNFVELLSGAHAMDKHFSTTPAEKNLPILLALIGIWYNNFFGAETEAILPYDQYMHRFAAYFQQGNMESNGKYVDRNGNAVDYQTGPIIWGEPGTNGQHAFYQLIHQGTKMVPCDFIAPAITHNPLSDHHQKLLSNFFAQTEALAFGKSREVVEQEYRDQGKDPAQLEHVVPFKVFEGNRPTNSILLREITPFSLGALIALYEHKIFTQGVILNIFTFDQWGVELGKQLANRILPELGDDKAISSHDSSTNGLINRYKAWRA

SEQ ID NO: 91834 - protein, 402 aa, Roseovarius nubinhibens ISM
MPGLQSAAIGIWVLAGARNEHREQNGIAHFLEHMAFKGTATRSALDIAEAIENVGGYINAYTSREVTAYYARVLKQDVPLALDVVADILRNPVFDPKEIEIERGVILQEIGQALDTPDDVIFDWLQEQAYPDHPLGRTILGPEERVRSFNRADLERFVAEQYQPQQMILSAAGAVDHDDLVQQAEALFADMTRGEAEAISPAKFAGGESRHEKQLEQAHFALAFESPNYCDSRIHASQIYATALGGSMSSRLFQEVREKRGLCYSIYASAGAYADTGMMTIYAGTSAEQLAGLAEITIDELKRAAEDMRPDEIERARAQMKAGLLMGLESPSNRAERLARMVQIWGRVPPLDEVITRIDAVTLDDVRRLAEETAAEAPAALALYGPVAEAPSLEALQQRRAA

SEQ ID NO: 91835 - protein, 334 aa, Zea mays
MPAPPAAPPVPPAAPWRRHAPTAASSTPRTVLLLLPILLLLLFVLSKATDLTFSTTTTSSSSSRHVPVNLRSFDCYASPQASPMVANLVEGVPYPFFYSLADMGTLPDHPHKNIARLLKGKRFRKPDISETIQELLGGEVGKGEPSGGLVVDVGANVGMASFAAAVMGFRVLAFEPVLENLQRICDGVYLNRVQDRVVVYHAAASDRVGTTTMHKVIGRLDNSAISAIGAKLAFKSNAEVAVEVSTIPLDEVVPDTERVLLIKVDVQGWEYHVLRGASKLLSRRKGEAPYLIYEEDEHLLQASNSSAQEIRAFLTSVGYNHCTRHGNDAHCTKE

SEQ ID NO: 91836 - protein, 965 aa, Arabidopsis thaliana
MASRRILSSLLRSSSSRSTSKSSLIGSRNPRLLSPGPAHGAAPCGTLLGRVAEYSTSSPANSVIGAIVDVRFEDQEGLPPIMTSLEVQDHPTRLVLEVSHHLGQNVVRTIAMDGTEGLVRGRKVLNTGAPITVPVGRATLGRIMNVLGEPIDERGEIKTEHYLPIHRDAPALVDLATGQEILATGIKVVDLLAPYQRGGKIGLFGGAGVGKTVLIMELINNVAKAHGGFSVFAGVGERTREGNDLYREMIESGVIKLGEKQSESKCALVYGQMNEPPGARARVGLTGLTVAEYFRDAEGQDVLLFIDNIFRFTQANSEVSALLGRIPSAVGYQPTLASDLGALQERITTTKKGSITSVQAIYVPADDLTDPAPATTFAHLDATTVLSRQISELGIYPAVDPLDSTSRMLSPHILGEEHYNTARGVQKVLQNYKNLQDIIAILGMDELSEDDKLTVARARKIQRFLSQPFHVAEIFTGAPGKYVDLKENINSFQGLLDGKYDDLSEQSFYMEGLPPIMTSLEVQDHPTRLVLEVSHHLGQNVVRTIAMDGTEGLVRGRKVLNTGAPITVPVGRATLGRIMNVLGEPIDERGEIKTEHYLPIHRDAPALVDLATGQEILATGIKVVDLLAPYQRGGKIGLFGGAGVGKTVLIMELINNVAKAHGGFSVFAGVGERTREGNDLYREMIESGVIKLGEKQSESKCALVYGQMNEPPGARARVGLTGLTVAEYFRDAEGQDVLLFIDNIFRFTQANSEVSALLGRIPSAVGYQPTLASDLGALQERITTTKKGSITSVQAIYVPADDLTDPAPATTFAHLDATTVLSRQISELGIYPAVDPLDSTSRMLSPHILGEEHYNTARGVQKVLQNYKNLQDIIAILGMDELSEDDKLTVARARKIQRFLSQPFHVAEIFTGAPGKYVDLKENINSFQGLLDGKYDDLSEQSFYMVGGIDEVVAKAEKIAKESAA

SEQ ID NO: 91837 - protein, 269 aa, Oryza sativa
DDSYLFNEQKPEDVYGEQAYQRDAMELLSSDQICTGQENLDMIGNRYSSENAMEQPEDQKFSIASGSQLSSSQNLLNQKNHLDSTSPSNITSESYPERNCQIIPSGASFAERNLKVQKKVASSASGQLISDNVTGHPGHQTLTRRASYPCENHEIGKRSLGKRGLGHSDVAMGTSMVVDGSFVSSISSDNSVEENSFRQLQDAVSQLDVKTKMCIRDGLYRLARSAQNRQVFPNTMNNNGDSHNVKDMQNAETSGKYVDFSENMLFVPL

SEQ ID NO: 91838 - protein, 296 aa, Erythrobacter sp. SD-21
MPDLLSDAFDQVQQDVDAAFDAYLPVPQDTRGRLVEAMRYAAIGGGKRVRPLLVCATAKLFGVDRDAAVAAGCAVEAIHAYSLIHDDLPCMDDDDLRHGKPTLHKVYDEATAVLAGDCLHALAFDILTMPGISNDPFVRAELVATLAKASGHEGMAGGQMMDIVSDEEEYDIRQVTRLQQLKTGALLAASVEMGAVLGKLPPEGRTHLRAYARDIGLAFQIADDLLDVEGDETKAGKALRKDEGQGKQTFVTLMGRDAARAQAEMLIDQAGQHLASYGEDARVLVELAHFVAKRDH

SEQ ID NO: 91839 - protein, 432 aa, Kluyveromyces lactis NRRL Y-1140
MSPIAVTRKEVEQHIKATPVNDVLLTTYPEDSSPIPLNWGAADCQERGPVVPSRNKSGISKHNCIGAHAGPYCIYNALAIGSNQLKRDHIPDYTNAQPVFTIPEQPSWFNNRDIVSMDPFGHLTPYLFDDVAKSANVDIRPTIAITKATMQLLELKEAVDKGELKIDGNIIVNSNGDLSVSKIAVEPVWYLPGVAERFGITEEELRKCLFEDTNGMYPELITRPDIKTYMPPIGGLTVYIFGNPQNISNPEKKIALRVHDECNGSDVFGSDICTCRPYLMFGIIEAVKEAQNGGTGLVIYFRKEGRALGEVTKYLVYNARKRGGDTADEYFHRTECIAGVRDMRFQQLMPDVLKWLGISKIDKMLSMSNMKYDAIVDQGIEIVERIPIPDEMIPPDSRVEIDAKINSGYFSSEKAPTKEELQSVHGRLWNDV

SEQ ID NO: 91840 - protein, 272 aa, Dioscorea polystachya
MSSSTLFHLFLLSSLLFSCLSNARPDEDDFSYIEGSPNGPENWGNLNPEWKTCGNGMEQSPINLCDDRVIQTPALGKLRTSYQAARATLKNNGHDIMVNFKSDAGSQFINQVRYQLKRIHFHSPSEHVLNGERFDLEVQMVHESQDQRRAVTAILFRFGRSDPFLSDLEDFISQISKSEKNEVDAGVVDPRQLLQFDDPAYYRYMGSFTAPPCTEDITWTVIKKLGTVSPRQVLMLKQAVNENAINNARPLQPLKFRTIFFYPRQKSNHDAI

SEQ ID NO: 91841 - protein, 142 aa, Xanthomonas campestris pv. vesicatoria str. 85-10
MQTVRQLLGTKQVEVFAVAADAAVIEAIRLMAEKAIGAVLVMEGTRLVGIVSERDYARKVVLRDRASSTTSVAEIMSAEVVTVSPSDTVERCMQLMTDGRFRHLPVVENGRVQGVISIGDLVKAVIEAQRQDIDQLQRYIAS

SEQ ID NO: 91842 - protein, 391 aa, Heliobacillus mobilis
MNTYGRLPIALVKGEGAKVWDADGREYLDFLAGLAVNSLGHCHPKVTEAVKAQVDQLIHVSNLYWIEPQIELAQSLVENSFADKVFFCNSGAEANEGAIKLARKYAKLHMGPDKYEIITMEKSFHGRTLATVTATAQPKYQKAFTPLPEGFRYVPFGDLKALEKAIGPHTCAIMVEPVQGEGGVNLAEPAFWEGLAKLAKEQNLLLIFDEVQSGLGRTGKLFAHEHYGITPHIMTLAKALGGGTPIGALLATDEVASAFEPGDHASTFGGNPLVTAAGVATMDVLVQGGLLAHCLEMGAYFRGHLNRLAEKYTFIQEVRGLGLILACELDRPGADIVAACLEKGLIINCTAVNVLRFLPPLIITKEDIDHAVAILEEVLASVEANAGGTPA

SEQ ID NO: 91843 - protein, 555 aa, Yersinia pseudotuberculosis IP 32953
MAQYVYTMHRVGKVVPPKRHILKNISLSFFPGAKIGVLGLNGSGKSTLLRIMAGLDTEIEGEARPQPGIKIGYLPQEPKLNLEQTVRESVEEAVGEVKRALTRLDEVYALYADPDADFDKLAKEQGELEAIIQSHDGHNLDNQLERAADALRLPPWDAKIANLSGGERRRVAICRLLLEKPDMLLLDEPTNHLDAESVAWLERFLHDYEGTVVAITHDRYFLDNVAGWILELDRGEGIPWEGNYSSWLEQKNARLAQEASSEAARRKSIEKELEWVRQNPKGRQAKGKARLARFEELNSVEYQKRNETSELFIPPGPRLGDKVLEVEHLSKSYGDRLLIDDLTFALPKGAIVGIIGPNGAGKSTLFRMLSGQEQPDSGTISLGDTVQLASVDQFRDNMDDSKTVWEEVSGGQDIMKIGNFELPSRAYVGRFNFKGVDQGKRIGELSGGERGRIHLAKLLQVGGNMLLLDEPTNDLDIETLRALENALLEFPGCAMVISHDRWFLDRIATHIIDYQDEGKVEFFEGNFTEYEEWKKRTLGAEALEPHRIKYKKMTK

SEQ ID NO: 91844 - protein, 192 aa, Bacillus cereus ATCC 10987
MNLPNKITISRICLIPIFMVIMLAPFDWGSYTIGDVDLPIQHLVGALIFIVASATDWIDGHYARKYNLVTNLGKFLDPLADKLLVSAALITLVEMQYVPAWIVIVIISREFAVTGLRLVLAGTGEVVAANQLGKIKTWTQIIAIAAYLLHDVPLNLIHIPVADIFIWIALIFTVISGWDYFWKNRAAFVNSK

SEQ ID NO: 91845 - protein, 190 aa, Candida glabrata CBS 138
MSIESYAKDLKAALHQYPNFPSEGILFEDFLPIFREPQLFQKLVDAFKMHLEETFTEKKVDYIVGLESRGFLFGPSLALAMGIGFVPVRKAGKLPGECVKAVYEKEYGSDEFEMQKHAIPAGANVVIVDDIIATGGSAGAAEELIKKIGANVLEYDFVMELDFLKGRDKLNAPVFTLLSSQKEALQKPSA

SEQ ID NO: 91846 - protein, 167 aa, Saccharomyces cerevisiae
KESCKMFIGGLNWDTTEDNLREYFGKYGTVTDLKIMKDPATGRSRGFGFLSFEKPSSVDEVVKTQHILDGKVIDPKRAIPRDEQDKTGKIFVGGIGPDVRPKEFEEFFSQWGTIIDAQLMLDKDTGQSRGFGFVTYDSADAVDRVCQNKFIDFKDRKIEIKRAEPRH

SEQ ID NO: 91847 - protein, 260 aa, Brassica napus
  misc_feature (212)..(212): Xaa can be any naturally occurring amino acid
GEGESSRSGGDESESEEERRYIIEEGKGDKMSGEYEKKRLTRIAENRARLEALGISKAAKALLPPSLRKPNSGEEDDDDYRPGDEIDESEYEEDEEEFLGHSSSKRMKKTTSPPQKRRRRKKHLCRSDPLGDDDDLDLNKAIALSLAGGGSHRNDQGSASSKKNKSDLIMSKMQMTADELILYFFHFDKAGKGFITLRDLATMANVHDFTWXDEGLQDMIRCFDFDKDGKLSLDESGKCYAMSHVNESDHAECPSKLDDL

SEQ ID NO: 91848 - protein, 296 aa, Physcomitrella patens subsp. patens
MELNGISSNRVTTSSVVEKTIVTEKKNVDVDELWLEIIAEARLESEKEPALASYFYSSVISHKSLERALAFHLSNKLSNPTLLSTQLFGLIVDIFNSDVAIRRAIREDLRAVRVKDPACSSYCHCLLYFKGFLACQAYRVSHWLWNNDRPSLAFLMQSRVSEVFHVDIHPAATIGSGVLFDHATGLVVGETAIIGSNVSILHNVTLGGTGLLGDRHPKIGDGVLIGAGAILLGNIVIGEGAKIGSGSLVLIDVPPHTTAVGNPARLIGGKQSPTKLKDIPSETMDHTIKGWSDYVI

SEQ ID NO: 91849 - protein, 640 aa, Ustilago maydis 521
MREWLGGNLRFAAIFIRIQSRPDHSLRFTVLDPLPVHYRLSPPSSTLARLHQPRLALTSFAHLALLPSSISPSPTTLRLVVCLVTNSHHSVSSSLKRQSPIMAAAAATAATEAGLQYTPIDDIPSIVSDLRAAFLTGKTRSVEYRKNQLKQLAYMIKDNQEAFVESLRKDLGRSRFESIFAELMGTTNEIVEAVTKIDKWAKPAKPWAGAAWAMHGATIRSEPKGTVLVLGAWNYPITVQIGPVIGAIAAGNTVILKPSEVASHTAKLIAELWNKYLDPECFRVVNGGIPETTALLDQRFEHIFYTGNGTVGRIIAEKAAKWLCPTTLELGGKSPVYVDKSADLSIAAHRILWGKSFNCGQTCIAPDYVLIQPDLQDKFVQELKKAYQRFYPELQGGVNNSESYARIINPGHWKRLNAMLSGTKGKVVLGGEGEEATKFLPPTVIADVKPDDAIMSGEIFGPLLPIVPVRDVEAAVDLINSRDQPLALYLFAGDNRVKNFFFDNTRSGACVQGDTLLHFAVDVLPFGGTGPSGYGNYHGKASFDQFSHQRASLDAPSTGLLGKLVELIMSSRYPPYTEANLKKLRALAAYSVSFKRPSNPHKSIASSSVSLCLSHSRPSPFLSMSQSLFPMVHYNMLPTQ

SEQ ID NO: 91850 - protein, 173 aa, Bordetella parapertussis 12822
MPIYQLDDLIPAIDPSAYLADSADIIGNVTLEAGVSIWSQVSIRGDNAPILVRSGTNIQEASVLHVDAGCPMTVGPNVTIGHQAMLHGCTIHEGALVGMQAIVLNNAVIGRNCLIGAGAIIPEGRIIPDNSLLIGIGKIVRELSAEEIAEMQANNRHYVERGQHYKTALKRIG

SEQ ID NO: 91851 - protein, 268 aa, Dioscorea polystachya
MSSSTLLHLLLLSSLLFSCLANVEDEFSYIEGNPNGPENWGNLKPEWETCGKGMEQSPIQLRDNRVIFDQTLGRLRRNYRAVDARLRNSGHDVLVEFKGNAGSLSINRVAYQLKRIHFHSPSEHEMNGERFDLEAQLVHESQDQKRAVVSILFIFGRADPFLSDLEDFIKQFSSSQKNEINAGVVDPNQLQIDDSAYYRYMGSFTAPPCTEGISWTVMRKVATVSPRQVLLLKQAVNENAINNARPLQPTNFRSVFYFEQLKSKVCAI

SEQ ID NO: 91852 - protein, 394 aa, Bacillus licheniformis ATCC 14580
MNLAKRVSALTPSATLAITAKAKELKAAGHDVIGLGAGEPDFNTPEHIIEAAVRSMNEGHTKYTPSGGLAALKDSIRDKFKRDQGIEYSQSEVIVCTGAKHALYTLFQVLLDEGDEVIIPTPYWVSYPEQVKLAGGKPVFVEGLEENSFKISPEQLEKAVTEKTKAVIINSPSNPTGMMYTEEELKALGEVCLRRNVLIVSDEIYEKLIYGGKKHVSIAQLSPELKNQTVIINGVSKSHSMTGWRIGYAAGSEPIIKAMTNLASHSTSNPTSVAQYGAIAAYNGPNEPVEEMRKAFEERLNKVYELLVDIPGLTCLKPEGAFYLFPNAKKAAESCGFSSVDEFAEALLEEEKVAIVPGSGFGAPDNIRLSYATSLSLLEEAVERIRRFVVNRSR

SEQ ID NO: 91853 - protein, 582 aa, Erythrobacter sp. SD-21
MSEERSGAAILIECLKRQGVEFVFGYPGGAVLPIYDELFADSDIRHILVRHEAGAAHAAEGYARSTGKPGVVLVTSGPGATNAVTGIADAYMDSIPMVVITGQVPTGLIGTDAFQEADTVGLTRHCSKHNYLVKDPERLRATIEEAFRIATTGRPGPVVVDIPKDVQIALANWSEQEEAPLPSHRYQPRLVGAADEIAEAVEMLGQAERPVFYTGGGVINAGPRASELLRKLQHATGAPVTSTLMGLGAFPADHTDWLGMLGMHGTFEANMAMNRADLIVAIGARFDDRVTGRLDAFAPEAKKIHIDIDRASINKIVPVDLGIVGDCGHVLEQLLEGWGSRKGRDLSEWQARILGWKARDCLAYPEKSEQIMPQKSIERLFALTKDRDPIITTEVGQHQMWAAQYFGFMGPNKWLTSGGLGTMGYGLPAAIGAQLGNPDSLVIDIAGEASIQMNIQELGTASQFRLPVKVFILNNEYMGMVRQWQELTYESRYSNSYSDSLPDFVKLAEAYGWKGIRIDDESQLDAGIEAMLAHDGPVIVDCQVAKEANCFPMIPSGAAHTDMLLYGDQVGGTMDDEAKALV

SEQ ID NO: 91854 - protein, 356 aa, Methanothermobacter thermautotrophicus str. Delta H
MFKEAKLALEDGTIIRGEAFGSETVKTGEVVFATGMTGYVESLTDPSYRGQILMPTYPLQGNYGVTEEWYQSDGIKAEGLIVREMCPAPSHSLSEKTLPEFLEEYGIPGIAGVDTRALTIKIRDKGTMKGALATEEIDDDELLEMAVKQPDITEIDLVDMVCVREPVILNEDASGRVVIVDCGIKRNSIDALLEKDLGVVIVPYTTSPAEIMDYEPDGLLISSGPGDPTRVRDAIDTVKALSERLPIFGICLGQQIIALAFGARIYKMKFGHRGVNQPVKDLRSGTVSITSQNHGFTVDPDSVKGTDIEITQLNLNDGTPEGIEHRELPVFSVQYHPEAGPGPHDTVNIFDRLWMF

SEQ ID NO: 91855 - protein, 441 aa, Triticum aestivum
MLPQMRPLPSRPAVHAVHRRTSPAPPSIGGLGQHGRVTFGRTTTPVVCRSVASPAANQGAKAVERPWKLSDARLVLEDGSVWNAKSFGASGTQVGEVVFNTSLTGYQEILTDPSYAGQFVLMTNPHIGNTGVNSGDEESIKCFLGGLIIRNLSICTSNWRCTETLDEYLRKRNIMGIYDVDTRAITRRLREDGSLIGVLSTDQSLKDEELLEMAKNWKIVGVDLISDVTCDAPYEWVDKTGSGWEFNDNQSSETFHVVVYDFGVKHNILRRLASYGCKITVVPASWPASDVLNLKPDGVLFSNGPGDPAAVPYAVKTVQEIVGKVPVFGICMGHQLIGQALGGKTFKMKFGHHGGNHPVRDNRTGRVDISAQNHNYAVDPESLPEGVQVTHINLNDQSCAGLVFPKMKLMSLQYHPESSPGPHDSDLAFGEFVELMKNNRL

SEQ ID NO: 91856 - protein, 495 aa, Rhodospirillum rubrum ATCC 11170
MPEGTTRIAALDIVREAGLLKDKAYIDGAWVGADDGGDFPVLDPATGREIGRVPNMGAAETRRAIDAAAAAWPAWRARTAKDRAAVLRRWYGLIMDNQEALAVLMTAEQGKPLGEARGEIAYGASFVEWFAEEGKRLYGEVVPAHGTDKRILTLREPIGVVAAITPWNFPSAMITRKVAPALAAGCPVVLKPAEDTPLSALALVELAERAGLPKGLINVVTTHEAKAVGGEMTANPIVRKLSFTGSTEVGKILMAQCAGTVKKVSLELGGNAPFIVFDDADLEAAVAGAIASKYRNAGQTCVCANRLYVQEGIYEAFTEKLKAKVEAMRVGPALEGDVQQGPLINKKGLDKVDGLVRDALDKGATAVLGGKVHALGGTFYEPTILTGVTAAMRMATEEIFGPVAPLYRFSTEAEAIALANATRFGLAAYFYTRDIGRVWRVAEGLEYGIVGINEGIISTESAPFGGVKESGIGREGSRHGIDDFVEIKYLCMGGI

SEQ ID NO: 91857 - protein, 171 aa, Erythrobacter sp. SD-21
MKIAEQASERHVLNVIVDNEAGILAKISGLFTARGYNIDSLTVADISEDHAISRITVVTRGPEPVIDQIRAQLERLVPVHRVIDLTESGAHVERELALVKVAGKGDARVEALRIAELFRANVVDTTTESFVFELTGSPDKVDSFIALMRELGLVEVGRSGIVGMMRGPSAE

SEQ ID NO: 91858 - protein, 235 aa, Chlamydomonas incerta
MAALQSASRSSAVAFSRQARVAPRVASSVARRNLVVRASHAEKPLVGSVAPDFKAQAVFDQEFQEITLSKYRGKYVVLFFYPLDFTFVCPTEITAFSDRYKEFKDINTEVLGVSVDSQFTHLAWIQTDRKEGGLGDLNYPLVADLKKEISKAYGVLTEDGISLRGLFIIDKEGVVQHATINNLAFGRSVDETKRVLQAIQYVQSNPDEVCPAGWKPGDKTMKPDPKGSKEYFAAV

SEQ ID NO: 91859 - protein, 532 aa, Physcomitrella patens subsp. patens
MGVTAEKDVPPAVEDAAPAVSDDPCEKPESDQPTKDKSIAGGCLSLIVLGASGDLAKKKTFPAIFNLYKQGFLPDEMHVFGYARSNMTNEELHEKLLRYLKAERTDPTTNPEDVRKQFLNKITYIHGAYDADEGFIKLNEEILRLEREESDDNSPTRRLFYLALPPSVYPLVSKQIRKHCMNQRGWTRVIVEKPFGKDLESSEVLSSELGSLFTEDQLYRIDHYLGKELVQNLLVMRFANRFFVPIWNRDNIANVQIVFKEDFGTQGRGGYFDEYGIIRDIIQNHLVQVLCLVAMEKPVSLSPEHVRDEKVKVLQCIEPINEEEVVIGQYEGYKDDPTVPNDSVTPTFASLVLRINNERWDGVPFIMKAGKSLDTRKAEIRVQFKDVPGDIFKCKKQGRNEFVMRLQPKEAMYMKLTVKEPGLDMRATQSELDMSYHQRYQDIVIPEAYERLLLDTIRGDQQHFVRRDELRVAWEIFTPLLHRIDAGKLKVIPYKEGSRGPAEADELNARMGYQRTEGYCWKPPTLQAGAAI

SEQ ID NO: 91860 - protein, 482 aa, Zea mays
MAKPTPVASAEEAAAMRRRLRRLVAAVAAGSADAEAFDEAAEALAKLRDAELGPRKDRTGDGRENKRSTEAAVPEHFLCPISSEIMRDPVVLASGQTYDRRFIQEWLSAGNRTCPQTQQVLSNTIITPNHLVRSMISQWCTDNGITLPPVENQDEDLVTNNERETFRKLFERIVSSSSDLSEQREAIKELRLRTKCNSSLRAAIGERPDSISQMISVASSPELENSAEVVEDTVTAILNLSIHESNKKIIGDDPLAVPFLIKALQSGTMEARSNAAAAIFSLSALDGNKARIGELGAMRPLVELLEHGSTAARKDAASAIFNLCTLHENKSRATKSGAVDVTLRAVACAGDGSGSGSLVDESLAVLALLSGDHEAVEEVGETGGVASMLHVVKDDPCKRNKENAAAVLFASACPGQIIGIEGIIAKCQHLGGEIANISATSPSLAFSVAWSLLFARWVFLFYQREIAVSQPVGNCDVCGSTS

SEQ ID NO: 91861 - protein, 374 aa, Zymomonas mobilis
MVLADGQMIWGRGFGATGAKVGEVCFHTAMTGYEEIMTDPSFASQIINFTFPHIGNVGANREDVEAKTLHALGCIVREDVTAPSNFRSLWRFDSWLKDHDRIGLAGVDTRALTGLLRKKGAQNAVIAHDPKGQFDIPALIETARSWAGLQGMDLARSVSTHQSYNWQEGIWSLQNGYSVVDNQKGPHVVAIDYGLKHNILRNLVEAGARVTVVKATASFDEVMAHKPDGVFLSNGPGDPAATAEYAVPVIRQLLDIKMPIFGICLGHQLLALAVGATTYKMHQGHRGANHPVKRLDDSKVEITSMNHGFAVATDSLPEQARPTHLSLFDGSLAGLELTDRPAFSVQYHPEASPGPQDSYYLFTKFIDLIAKERP

SEQ ID NO: 91862 - protein, 262 aa, Agrobacterium tumefaciens
MPPKRTLNRDSLSARHWPGDAQPPHSGRRNVGITVSVSAGIVGGLVNNRRVFPQIPADHLRQHPTILAKNSFVKGQPEHGAELADDLERLVALHGAETIAACIVEPVAGSTGVLVPPKGYLERLRAICDKHGILLIFDEVITGFGRMGSSFASNYFGVTPDIVTTAKGLTNGAIPMGASHSRKFHDALMHGPESQIELFHGYTYSGHPVPCAAGIATLDIYRDEGLFTRASELQDAWHDAIHSLKGSPNVIDIRNQSVSSPA

SEQ ID NO: 91863 - protein, 671 aa, Oryza sativa
MKRKQKLLFPSPPKQKHQNIPPKSKEKQSISNEPSLSILVPLLSPRIPPPETLVHRRAARLGDSITLRGIEVGPRVGKAKMAGSIDRPSGAGFEGIVHDDDKKEWKSDEDNSEGDKKAKAVSFKNRAISAGNKFRRSLRRKRRRRVGDHVASIEDIRDVKELEAVQRFHQCLHDEGLLPERHDDYHVMLRFLKARKFDIDKAKHMWSEMLRWRKEFGADNIEEFDYSELDDVLECYPQFYHGVDKEGRPVYIELIGKVDPNKLVQVTTIDRYVKYHVKESEKCLQMRFPACSIAAKRHIDSCSTILDVQGVGLKNFSKDARELIMRLQKINNDNYPETLHRLYIINAGQGFKMLWGTIKSFLDPQTASKIHVLGSKYQNKLLETIDESELPDFLGGKCRCEEHGGCIRSDKGPWKDPDIIKRVLNGEANYGRKILAISSVDGKKICYINPRHLTKKCSDASAESSSEMEDVSSPIASVNPIINPHLTPVDESKLPGNTSTSGAPPRVEDIPVVDKAVDTCAGPSTSSMAFNSDSFSLRNITMELGGLRNRITAWLIVLIVSFVAVLRSVPSRVTASLSSQAISRENSTHSSVLRRLGELEEKLQELEAKQSQMPPDREELLNGAIHRVDALEAELISTKKMLYDALMRLDELLAYADQQKNIQFRKKRFCF

SEQ ID NO: 91864 - protein, 514 aa, Arabidopsis thaliana
MGVATNFASLQDSGDQLTEEHVTKGESTLSITVVGASGDLAKKKIFPDLFALFYEGCLPQDFSVFGYARTKLTHEELRDMISSTLTCRIDQREKCGDKMEQFLKRCFYHSGQYNSEEDFAELNKKLKEKEAGKISNRLYYLSIPPNIFVDVVRCASLRASSENGWTRVIVEKPFGRDSESSGELTRCLKQYLTEEQIFRIDHYLGKELVENLSVLRFSNLVFEPLWSRNYIRNVELIFSEDFGTEGRGGYFDQYGIIRDIMQNHLLQILALFAMETPVSLDAEDIRSEKVKVLRSMKPLRLEDVVVGQYKGHNKGGKTYPAYTDDPTVPNHSLTPTFAAAAMFINNARWDGVPFLMKAGKALHTRGAEIRVQFRHVPGNLYKKSFATNLDNATNELVIRVQPDEGIYLRINNKVPGLGMRLDRSDLNLLYRSRYPREIPDAYERLLLDAIEGERRLFIRSDELDAAWDLFTPALKELEEKKIIPELYPYGSRGPVGAHYLASKYNVRWGDLGEA

SEQ ID NO: 91865 - protein, 137 aa, Zea mays
  misc_feature (19)..(19): Xaa can be any naturally occurring amino acid
  misc_feature (21)..(21): Xaa can be any naturally occurring amino acid
  misc_feature (25)..(25): Xaa can be any naturally occurring amino acid
  misc_feature (32)..(34): Xaa can be any naturally occurring amino acid
  misc_feature (37)..(37): Xaa can be any naturally occurring amino acid
  misc_feature (39)..(39): Xaa can be any naturally occurring amino acid
  misc_feature (41)..(41): Xaa can be any naturally occurring amino acid
  misc_feature (49)..(50): Xaa can be any naturally occurring amino acid
  misc_feature (52)..(52): Xaa can be any naturally occurring amino acid
  misc_feature (54)..(54): Xaa can be any naturally occurring amino acid
  misc_feature (73)..(73): Xaa can be any naturally occurring amino acid
  misc_feature (90)..(90): Xaa can be any naturally occurring amino acid
  misc_feature (98)..(98): Xaa can be any naturally occurring amino acid
  misc_feature (101)..(101): Xaa can be any naturally occurring amino acid
  misc_feature (103)..(103): Xaa can be any naturally occurring amino acid
  misc_feature (106)..(106): Xaa can be any naturally occurring amino acid
  misc_feature (117)..(118): Xaa can be any naturally occurring amino acid
  misc_feature (120)..(123): Xaa can be any naturally occurring amino acid
  misc_feature (125)..(125): Xaa can be any naturally occurring amino acid
  misc_feature (131)..(131): Xaa can be any naturally occurring amino acid
  misc_feature (133)..(133): Xaa can be any naturally occurring amino acid
NGSPGLGGHSPPPPPPKGXVXADLXVPLDDAXXXTDXTXIXASVPTIKXXLXKXAKVILASHLGRPKGVTPKXSLKPLVPRLSELLGVEXGMANDCIXEKXEXLVXALPKKGSSAPXXGXXXXGXKKNEPXFXKKTW

SEQ ID NO: 91866 - protein, 816 aa, Oryza sativa
MAAAAAVWFSAIAAVLLAASTIAVVVVAKMTGKRNGGAAAAAAAAAEAELPLPPVVSGVSLIIPVITRGPMAVADELYVKLGSVFTVSFLGVVKATFLVGPEVQGGFYSRPESEVHQGGTYRMTVPMFGRGVMYDVDVATRSEQIAVCFEALRPTKLRSSTVTMVRETEEYFAKWGEQGTVDLKRELDLLILTIASRVLLGKEVRETMFADVVASFHELMDNSMHLISLCFPNLPIPRHRRRDTASARLKELFSRAIQLRRGSGRAEDDVLQRFLESRYRDGRAMSDNEITGMLIALVVAGQHMSSSASTWTGAFLLRDPKHLAAAVDEQRRLIGDDRVDYDALTTGMSTLHRCIKEALRMHPPAPALVRTVRRGFAVWTREGKEYRMPAGHSVVSYAAFNHRLGYVYRDPDEYDPERFGPERKEDRVAGKFSFTAFGGGRHACLGEHYAFLKMKVIWSYLLRNFELELVSPFPEVELNNIMLGPRGEVMRVRFLHRKVTFLVGPEESSHFFTGLDSEISQDEFRFFGDTMKPTKLRSYVSHMVYEVEGRMQAYDSYDLSPRLVSKMMIVVTLIATRCLFGEVRSKMLGEVPTLLRELNDSMRLITIVFPYLPIPAHRRRDSARARLGEIFVEIVRSRRSSPGGGGRRDARIGALRGAVHELQHQHVDRRARLLTHPEHLRAAVREQEELVLVRHRHGGDVVDHDALQRMGHLHRCVKETLRLHPPSLMLLRHARRSFVVRARGSGDAEYEVPAGHTVASPMVIHNALPHVYEDAGSFDPGRFGPAREEYRAYAADHAYTVFGGGRHACVGEALSR

SEQ ID NO: 91867 - protein, 473 aa, Lactobacillus reuteri
MGLAKFKAKAWAWPVAVGLILWFCGPIRPDGVSMAAWHMFAIFVATIVGCITQPLPIAGTTLVGFTIMVLVGIVPMEEALKAFENSSSWLIAMAFLLSRGFIKTGLGRRIALVFVRSFGQHSLGLAYSIMGIDLVTSPAIPSNTARAGGVVYPIIKSLAETYGSDPKKGTRKKIGSFLVFTEFHSNLITSATFMTAMAPNLVVVALAKTLNINITWVGWFVAGVLPSVLCLIAVPYIIYKMYPPEIKETPNAKTWANSELEKMGSMKLSEKLMGLIFLLTLVLWMLTSFIPAINATFVAFLAIALLLITGVLETKDVLNESGAWNVLIWLSILVFMASELTKLGFIKWFSNSIEGALHGVSWIWVLVVLVVVYFYAHYFFASATAHVTAMYTAFVSVAIAAGAPAMLTAMLLAFTSAIMGSTTHYANGPASILSSSGYVTQSEWWKMNFILGIFYLLVYGIIGTFWMRLIGIW

SEQ ID NO: 91868 - protein, 258 aa, Chlamydomonas incerta
MAETLTLRATLKGHTNWVTAIATPLDPSSNTLLSASRDKSVLVWELERSESNYGYARKALRGHSHFVQDVVISSDGQFCLTGSWDGTLRLWDLNTGTTTRRFVGHTKDVLSVAFSVDNRQIVSGSRDKTIKLWNTLGECKYTIGEPEGHTEWVSCVRFSPMTTNPIIVSGGWDKMVKVWNLTNCKLKNNLVGHHGYVNTVTVSPDGSLCASGGKDGIAMLWDLAEGKRLYSLDAGDVIHCLCFSPNRYWLCAATQSSI

SEQ ID NO: 91869 - protein, 261 aa, Oryza sativa Japonica Group
MAACCSSLATAVSSSSAKPLAGIPPAAPHSLSLPRAPAARPLRLSASSSRSARASSFVARAGGVDDAPLVGNKAPDFDAEAVFDQEFINVKLSDYIGKKYVILFFYPLDFTFVCPTEITAFSDRYDEFEKLNTEILGVSIDSVFSHLAWVQTDRKSGGLGDLKYPLISDVTKSISKSFGVLIPDQGIALRGLFIIDKEGVIQHSTINNLAIGRSVDETMRTLQALQYVQDNPDEVCPAGWKPGDKSMKPDPKGSKEYFAAI

SEQ ID NO: 91870 - protein, 595 aa, Heliobacillus mobilis
  misc_feature (60)..(60): Xaa can be any naturally occurring amino acid
MGKISIHRVVWPDIRMEKLRKDLVAGITVGMVAIPLALAFAIASGATPEQGIYTAVIAGXLIAIFGGSHVQIGGPTGAFVPLLFSIMMTYGYDNLLIAGMLAGLFLIFMGLTGMGALIKFIPRPVTVGFTAGIAVIIFFGQVDTFLGLQGVVKHKDFIDNVIELSKHVDTVQWSSITVALVCLVCLLFSHKLVPAVPGPLVGIVVSTIFAHVVFGGNVETIGSKFGQLSGGLPSFHWPSVTLDQIQNMVGPALTIAALGSIESLLSCVVADGMTGKRHDSNRELIGQGIANMVTPLFGGIPATGAIARTATNIRSGGATPVAALVHSLTVFLLILVFAPFVAQVPLVSMSPILMRVAWNMSDRKEFVHLLRTTRSDMAVLIVTFALTVIFDLTIAVGIGMIIAAALFINGMSESLAIRKVLPEGPDEKLAPEAVTPIHDCPQIAIYTIDGALFFGAAAIFEKTLTESIQSKPKVLILRMGHVPMMDATGEMVLEDIVHNFRKRGGRILISGIMPQPEELLRKSGLYESIGEEHFFKRTGAAITSALNHIDRHRCVGCPHNAFYECSQLSRVGSIHIKGSIPTEQPANPSLVQEKA

SEQ ID NO: 91871 - protein, 237 aa, Bacillus cereus ATCC 10987
MKKYALVTGGSGGIGSAISKQLIQDGYTVYVHYNNSEEKVNELQKEWDEVIPVQANLASTDGAEQLWKQIEHPLDVIVYAAGKSIFGLVTDVTNDELNDMVELQVKSIYKLLSMALPSMIQRRSGNIVLVSSIWGQIGASCEVLYSMVKGAQNSYVKALAKEVSLSGIRVNAVAPGAIETEMLNVFSEEDKNEIAEEIPLGRLGLPEEVAKTVSFLVSPGASYITGQIIGVNGGWHC

SEQ ID NO: 91872 - protein, 799 aa, Oryza sativa Japonica Group
MMEADMENGRLYPERPRTFSTVRTKSSLPPIFRVLMRINPRAFIVLLLLVFSGVLYVGASTSPIVLFVFCICTLSLFFSLYLTKWVLAKDEGPPEMSEISDAIRDGAEGFFRTQYGTISKMACILALVILGIYLFRSTTPQQEASGVGRTTSAYITVASFLLGALCSGIAGFVGMWVSVRANVRVSSAARRSAREALQIAVRAGGFSAIVVVGMAVFGVAILYATFYVWLEVDSPGSMKVTDLPLLLVGYGFGASFVALFAQLGGGIYTKAADVGADLVGKVEQGIPEDDPRNPAVIADLVGDNVGDCAARGADLFESIAAEIISAMILGGTMAQRCKIEDPSGFILFPLVVHSFDLVISSVGILSIRGTRDSGLISPIEDPMAIMQKGYSITILLAVVTFGVSTRWLLYTEQAPSAWLNFALCGLVGIITAYAFVWISKYYTDYKHEPVRLLALSSSTGHGTNIIAGVSLGLESTALPVLVISVAIISAFWLGHTSGLVDESGNPTGGLFGTAVATMGMLSTAAYVLTMDMFGPIADNAGGIVEMSQQPESVREITDILDAVGNTTKATTKGFAIGSAALASFLLFSAYMDEVAAFAQLPFKEVDIAIPEVFVGGLLGSMLIFLFSAWACSAVGRTAQEVVNEVRRQFIERPGIMDYNEKPDYGRCVAIVASASLREMIRPGALAIISPMAVGIIFRMLGHATGRPLLGAKVVAAMLMFATVSGILMALFLNTAGGAWDNAKKYIETGALGGKGSESHKAAVTGDTVGDPFKDTAGPSIHVLIKMLATITLVMAPIFL

SEQ ID NO: 91873 - protein, 503 aa, Thermus thermophilus
  misc_feature (1)..(1): Xaa can be any naturally occurring amino acid
  misc_feature (81)..(81): Xaa can be any naturally occurring amino acid
  misc_feature (124)..(124): Xaa can be any naturally occurring amino acid
  misc_feature (174)..(174): Xaa can be any naturally occurring amino acid
  misc_feature (459)..(459): Xaa can be any naturally occurring amino acid
XVLVLDFGSQYTRLIARRLRELRAFSLILPGDAPLEEVLKHRPQALILSGGPRSVFDPDAPRPDPRLFSSGLPLLGICYGXQLLAQELGGRVERAGRAEYGKALLTRHEGPLFRGLEGEVQVWXSHQDAVTAPPPGWRVVAETEENPVAAIASPDGRAYGVQFHPEVAHTPKGXQILENFLELAGVKRDWTPEHVLEELLREVRERAGKDRVLLAVSGGVDSSTLALLLAKAGVDHLAVFVDHGLLRLGEREEVEGALRALGVNLLVVDAKERFLKALKGVEDPEEKRKIIGREFVAAFSQVARERGPFRFLAQGTLYPDVIESAGGHGAAKIKSHHNVGGLPEDLEFELLEPFRLLFKDEVRELALLLGLPDTLRLRHPFPGPGLAVRVLGEVTEERLEILRRADDIFTSLLREWGLYEKVAQALAVLTPVRSVGVAGDERKYGYVLALRAVTTEDFXTADWARLPLEFLDEAARRITRRVPEIGRVVYDLTSKPPATIEWE

SEQ ID NO: 91874 - protein, 263 aa, Populus trichocarpa x Populus deltoides
MAELFVEQAKQYAETRPIYPQELFESIASKTPSRDLVWDVGTGSGQAARSLAGIYKNVIGTDTSLKQLEFAPKLPNVNYQQTPPVMSMGELEQTVSTQSSVDLVTIAQAMHWFDLPSFYQQVKWVLKKPHGVIAAWCYTIPEVNDSVDSVFNPFYSIDSDPYWEPQRKLVDNKYMSIDFPFEPVEGTDNTGPFKFVTEKMMDLDEYFTYIRSWSAYQTAKAKGVELLRDDVIESFKRAWNEDGHGQKVVKFPVHLKIGKVGNV

SEQ ID NO: 91875 - protein, 545 aa, Zea mays
MSMGYQVVAAQLKVASSADHASVVIITLFVALLCACIVLGHLLEENRWLNESITALIIGLCTGGVILMTTKGKSSHVLVFSEVLFFIYLLPPIIFIAGFQVKKKQFFRNFMTITLFGAVGTMISFFTISLGAIAIFSRMNIGTLDVGDFLAIGAIFSATDSVCTLQVLHQDETPFLYSLVFGEGVVNDATSVVLFNAVQKIQITHINAEVALQVFGNFLYLFSTSTLLGIATGLITSFVLKKLYFARHSTTRELAIMMLMAYLSYMLAELFSLSGILTVFFCGVLMSHVTWHNVTESSRITSRHVFAMLSFIAETFIFLYVGTDALDFDKWKTSSLSFGGTLGVSALIMALVLLGRAAFVFPLSVLTNFSNKHENESITFKHQVIIWWAGLMRGAVSIALAFKQFTYSGVTLDPVNAAMVTNTTIVVLFTTLVFGLLTKPLIRLLMPHRHLTMLSDDSTPKSLHSPLLTSQLGSDLEEPTNIPRPSSIRGEFLTMTRTVHRYWRKFDDAFMRPMFGGRGFVPVVPGSPIERSVPQWSEEAHNKEP

SEQ ID NO: 91876 - protein, 438 aa, Alteromonadales bacterium TW-7
QRTDRNTDEVETKTNSPVANENQEKNENRNKRRRNSNSRKRPEHKADKDQTKAADAPAKANADTNAAEAPKEHKPKVRRQRRNVRKKVRIQDENAEQLQATEQTPIETAAVEEKPQVQAKPEAQEKPVAAEKPTPVKEEKVETVESKDETVATEEEQTRTRSRRSPRHLRASGQRRRRPEGESAETKSDEAPAFVPVADQAAAEYEAELKAKSEEKAVDASEQVEQAVAVEDLAKVEVAQEQVQAEETVQAEEQVKAEEQVQAEEPVKAEEPVHAEETVKAEESVKAEEPVKAEVPVKAEESVKVEEPVKVEEPVQAEESVKVEEPVQAEEPVKAEEPSLEAEAVPVTVAETPVEAKEAPVVEKATEATLNSKTVITKGHASAPMAQPAPAADSEVKHVPVAMAHDKRELIPDSGLRPGSIKPAGRASSAMTKTLSAD

SEQ ID NO: 91877 - protein, 195 aa, Brassica napus
MKTIFDLPENLVEDEIFSRLQISSVRSTCRKWNTLCNRIFLGEEAAAKKQFLMMNSSRINLMNFDLSKDDGDPSIEQVSVLDQIQISKVFQCDGLLLCVLEDSSRPLLVWNPYLGQTRWIEPRSSSFHSSYRFSLGYDNNLNHKILRISNEIHPVTSEHVSGFELYDFSSGSWKVLDVTPHWEIWSHLRGVSLKG

SEQ ID NO: 91878 - protein, 303 aa, Bacillus anthracis str. Ames
MKRWQMEWLLVSVALVWGANYTIGKYGVAYMSSIQFNSLRFLVASPVLLLITFLMERSLRIERKDWLRLVAVGIVGTTMYQTMFMLSVKYTSATNASLLIAMSPIFTGILAVLHKQERFSMKVQIGSIVAFIGAAFVLLTGHTGGATYEYAWLGNIIGLVAAIAWGWYPILAQPLITKYSAMRVTSWSTLIGIVPLVIYCLFNVNSLTWPVDTLSWGSLAYSIIFATIFGLAMWYVGISQIGSTKVMVYMYLVPLFAVIFAAVTIGEQINMMQLVGGLIIFVGLYVVKKGGIKKPALNLKKVS

SEQ ID NO: 91879 - protein, 332 aa, Salmonella typhimurium LT2
MQPETQSSALPAYRFSIAPMLDWTDRHCRYFLRLLSRQTQLYTEMVTTGAIIHGKGDYLAYSEEEHPVALQLGGSDPAQLAHCAKLAEARGYDEINLNVGCPSDRVQNGMFGACLMGNAQLVADCVKAMRDVVSIPVTVKTRIGIDDQDSYAFLCDFIDTVSGQGECEMFIIHARKAWLSGLSPKENREIPPLDYPRVYQLKRDFPHLTMSINGGIKSLEEAKEHLRHMDGVMVGREAYQNPGILAAVDREIFGADTTDADPVAVVRAMYPYIERELSQGAYLGHITRHMLGLFQGIPGARQWRRYLSENAHKAGADVAVLEQALKLVADKR

SEQ ID NO: 91880 - protein, 330 aa, Streptococcus agalactiae 2603V/R
MRSLFGGLREKVASDYVKIVFPEGSDERVLRAAARLKFEGLVDPVILGKADEVHDSLARLGFVDQDYSIIDPEQYEKFEEMKEAFVEIRKGKATMEDADRLLKDVNYFGVMLVKLGLADGMVSGAIHSTADTVRPALQIIKTKPGISRTSGVFLMNRENTQERYIFADCAINIDPNAQELAEIAVNTADTAKIFDIDPKIAMLSFSTKGSAKAPQAEKVQEAAKIAKDLSPELAVDGELQFDAAFVPETAEIKAPNSDVAGKANVFIFPDLQSGNIGYKIAQRLGMFEAIGPILQGLNAPVNDLSRGSSAEDIYKLAIITAAQAIDEKSK

SEQ ID NO: 91881 - protein, 279 aa, Pseudomonas syringae pv. phaseolicola 1448A
MIKKCLFPAAGYGTRFLPATKAMPKEMLPVVNKPLIQYGVEEALAAGLTEISIVTGRGKRALEDHFDISYELEHQIKGTDKEKYLVGIRKLIDECSFSYTRQTEMKGLGHAILSGRPLIGNEAFAVVLADDLCVNPDGDGVLAQMVKLHKHYGCSIIAIQEVDPQETNKYGVIAGEEIKPGLFRVTNMVEKPKPEDAPSNLAIIGRYILTPDIFEKIEQTEPGKGGEIQITDALMKQAAEGNVLAYKFKGERFDCGGAEGYIQATNFCFEHFYKTGKAH

SEQ ID NO: 91882 - protein, 327 aa, Salmonella typhimurium LT2
MATRIEFHKHGGPEVLQTVEFTPAEPAEHEIQVENKAIGINFIDTYIRSGLYPPPSLPAGLGTEAAGVVSKVGNGVEHIRVGDRVVYAQSTLGAYSSVHNVTADKAAILPDAISFEQAAASFLKGLTVFYLLRKTYEVKPDEPFLFHAAAGGVGLIACQWAKALGAKLIGTVGSAQKAQRALDAGAWQVINYREESIVERVKEITGGKKVRVVYDSVGKDTWEASLDCLQRRGLMVSFGNASGPVTGVNLGILNQKGSLYATRPSLQGYITTREELTEASNELFSLIASGVIKVDVAENQRYALKDARRAHEVLESRATQGSSLLIP

SEQ ID NO: 91883 - protein, 485 aa, Pseudomonas syringae pv. phaseolicola 1448A
MSTLIPCIIAGGSGTRLWPVSREAMPKPFMRLPDGQSLLQKTFLRAVGLPGVDRLLTVTNREVYFRTVDDYRQLNKGNARLDFILEPFGRNTAAAVAAAALHVSQLYGDDAQLLVLPADHLITNVEEFSRAVTAAQKLATEGWMVTFGIVPTAAETGFGYIEKGPALDADACQVARFVEKPDAVTAQGYVDGGLHFWNAGMFCMRADAVLQELRTHAPDVLNAVSSCLASSPRKEGNRELQVELDSESFALTPDISIDYALMERSEKVAVVPCQLGWSDIGSWQAVRELSPVDAQGNYCNGEAVLHDVSNCYIDSPKRLVGAIGLDNLIIIDTPDALLIADGRRSQDVKVIAQELKRQGHDAYRLHRTVTRPWGTYTVLEEGKRFKIKRIVVRPQASLSLQMHHHRSEHWIVVSGIATVTNGEREFMLDTNESTFIKPGFTHRLVNPGVIDLVMIEVQSGEYLGEDDIVRFTDIYGRVPDKTVKS

SEQ ID NO: 91884 - protein, 179 aa, Oxyrrhis marina
MGLAFSRLFSRLFSKQEMRILMVGLDAAGKTTILYKLKLGEVVTTIPTIGFNVETVEYKNISFTVWDVGGQDKIRALWRHYYQNTQGLIFVVDSNDRERVDDAREELHKILSEDEMKDAVLLVFANKQDLPQAMPAAEVTEKLKLTSMSNRQWYIQSTCATTGDGLYEGLDWLSRTLAK

SEQ ID NO: 91885 - protein, 324 aa, Streptococcus agalactiae 2603V/R
MAEQYADKQIKLFSLTANREIAEKISQASGIPLGKMSSRQFSDGEIMINIEETVRGDDIYIIQSTSFPVNDNLWELLIMIDACKRASANTVNIVVPYFGYSRQDRIAASREPITAKLVANMLVKAGVDRVLTLDLHAVQVQGFFDIPVDNLFTVPLFAEHYNQLGLSGEDVVVVSPKNSGIKRARSLAEYLDSPIAIIDYAQDDSEREEGYIIGEVEGKKAIIIDDILNTGKTFAEAAKILERGGATEIYAVASHGLFAGGAADILESAPIREIIVTDSVLSKERIPSNIKYLTASHLIADAIIRIHERKPLSPLFSYRSDKKD

SEQ ID NO: 91886 - protein, 195 aa, Candida glabrata CBS 138
MVAQVQKPAPTFKKTAVIDGVFDEVSLDKYKGKYVVLAFVPLAFTFVCPTEIVAFSEAAKRFEALDAQVLFASTDSEYSLLAWTNVPRQDGGLGPVDIPLLADTNHTLSRDYGVLIEEEGIALRGLFIIDPKGIVRHITINDLPVGRNVEEALRLVEGFQWTDKNGTVLPCNWTPGAATIKPTVEDSKEYFKNVK

SEQ ID NO: 91887 - protein, 212 aa, Halobacterium sp. NRC-1
MSYNDTWQPKTRLGGLVQDGEVEDMSEALDTGLPLKEPEIVDQLLPGLDDEVLDINMVQRMTDSGRRVKFRCVVAIGNRDGYVGYAEGRDDQVGGAIQKAIEVAKLNIIDVSRGCGSWECGCGRPHTVALKSTGKAGSVDVELMPAPRGLGLAGGETVQHVLELAGIDDVWTRSSGKTRTTVNFAKATFNALRETSEARVPQHAREEREVIE

SEQ ID NO: 91888 - protein, 257 aa, Lactobacillus plantarum WCFS1
MQTNVVKQLNQKMQVVMQTARAQVLAKMGTHLTVAEKTSRRDLVTNVDHSNEDFLVRQIRALDPVAKILAEEGTGDQVTDMNGHVWIVDPIDGTMNFVHQRNHFAMMVGLYVDGKPTLGYIFDVMANKLYAGGPEVGVTLNGELLAAPADVDLSAGLFGASAPLLIQDRFNMQTIIAKSLGPRIMGSAGIQISQVLAGELVGYLSYLRPWDFAAGRVLAESLGLVVSRVDGNPVNMLSSGAVLIATKRAQRSILAIV

SEQ ID NO: 91889 - protein, 470 aa, Lactobacillus plantarum WCFS1
MVVGDFAEERDTMIIGAGPGGYVAAIRAAELGQKVTVVEKEYIGGVCLNVGCIPSKALISAGHRLQEAKDSKIFGIKNIQDPVLDFKVTQDWKDHQVVDRLTGGVEMLLKKHKVEVVRGEAYMHDNHTLRVMNGDHTGQTYKFKHLIIATGSRPVEIPGFKFSGRVVDSTGGLNLPEVPKELVVIGGGYIGSELAGAYANLGAHVTILEGTPQILPNFEKDMVKLVLNSFKKKGVDVITNAMAKNSEQDDSGVTVTYAVDGKETEIHADYVMVTVGRRPNTDDMGLEYTDVKLTKRGLIEVDEQGRTAAEDIFAIGDIVAGAALAHKAFAEAKVAAGAISGKKTANDYVSIPAVCFTDPELATVGMTKAEAEEAGLQVKTSKFPFAGNGRAISLNAMDGFFRLVSTKDEGTIVGAQIAGPGASDLISELSVAVNGGMNVEDLALTIHPHPTLGEVVQEAADEAMGYPTHI

SEQ ID NO: 91890 - protein, 175 aa, Triticum aestivum
MAPTVMASSATSVAPFQGLKSTAGLPVSRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 91891 - protein, 265 aa, Bacillus anthracis str. A2012
MLQLKVMSMYFEYKNRKVFYNIEGSGPVILFLHGLGGNANNWLYQRQYFKKKWTVISLDLPGHGKSEGLEINFKEYVNVLYELCKYLKLQKVVICGLSKGARVGIDFAIQYPDFVSSLIIVNAFPYLEPEDRKKRLEVYDLLSLHDNGKKWADTLLEEMGVASNEVIVRGFYQSLQSINPVHIQRLFAELVDYDQRPLLLNISCSTLIIRGENDDFVPEKYVREFERRLKNTTFIEFKNSGHLPYLEQPSSFNMTVEKFLNHVIN

SEQ ID NO: 91892 - protein, 431 aa, Lactobacillus plantarum WCFS1
MAYEFKLPELGEGLEEGEIASWLVKPGDEVKEDDSLVEIQNDKSVEELPSPVSGKVIDILVPEGETAKIGDVIVTIDDGSGDAAPAATKTEAPASEAAETPAATSAQPTGTPAAGNPNKRVLAMPSVRQYARDKDIDITLVTPTGAHGQITKQDIDNYTGAPAATGAKPAATPATTAPAASEAPAPTPVKPYVSDTPELETREKMTPIRKAISKAMVNSKHTAPHVTLFDEVEVSALMAHRKKYKQVALDRDIHLTFLPYFVKALVAVLQQFPELNASIDDANKEIVYKHYFNIGVATDTDRGLLVPNIKHAEGKGLFAIAKEITDNTQKAYDGKLKASEMSGGSITISNIGSIGGGWFTPVINQPEVAILGVGRIGKEPYVNDDGEIVVGKMQKLSLSFDHRLIDGATAQRAMNLLKQLLHDPELLLMEG

SEQ ID NO: 91893 - protein, 377 aa, Neisseria gonorrhoeae
MNTPALLVLADGSVFHGTSIGYEGSASGEVVFNTSMTGYQEILTDPSYCKQIVTLTYPHIGNTGTNAEDEESRSVYAAGLIIRDLPLLHSNFRASESLHDYLVRNETVAIADIDTRRLTMLLREKGAQGGAILTGADATVEKAQELIAAFGSMVGKDLAKEVSCTETYEWTEGEWELGKGFVTPDKQPYHVVAYDFGVKTNILRMLASRGCRLTVVPAQTSAEDVLALNPDGVFLSNGPGDPEPCTYGIEAVQKLMESGKPIFGICLGHQLISLAIGAKTLKMRFSHHGANHPVQDLDSGKVVITSQNHGFAVDADTLPANARITHKSLFDNTLQGIELTDKPVSCFQGHPEASPGPQDVGYLSDKFIGNMKAAKQA

SEQ ID NO: 91894 - protein, 160 aa, Triticum aestivum
MQFLRGVSGGGGGGATLGSTAWEVLRRHFSRKRAVDIRRINPKVPKEEAVAISGRLLQILADHGPLTVGNTWNHAKDAAIDGLNSKTHMKILLKWMWGRRIIKLSCTQAGNTKKFLYSPFTAEDTEAAEEPSPAEEQPKKKGWKGKHPKYQTKKQPAAAA

SEQ ID NO: 91895 - protein, 342 aa, Chlamydomonas incerta
AVSSKSGVRAKAARAVVDVRAEKKIRVAINGFGRIGRNFLRCWHGRQNTLLDVVAINDSGGVKQASHLLKYDSTLGTFAADVKIVDDSHISVDGKQIKIVSSRDPLQLPWKEMDIDLVIEGTGVFIDKVGAGKHIQAGAHKVLITAPAKDKDIPTFVVGVNDADYKHEYPIISNASCTTNCLAPFVKVLEQKFGIVKGTMTTTHSYTGDQRLLDASHRDLRRARAAALNIVPTTTGAAKAVALVLPSLKGKLNGIALRVPTPTVSVVDLVVQVEKKTFAEEVNAAFREAANGPMKGVLHVEDAPLVSIDFKCTDQSTSIDASLTMVMGDDMVKVVAWYDNEW

SEQ ID NO: 91896 - protein, 412 aa, Oryza sativa
MAGLPFLLALHIALLLLLPCSCQVGDSCSSARDCGAGLYCGNCAATGKTRPSCIRDLAIQPTSIVKGLPFNRYSWLVTHNSFSIVGEPSHTGVERVTFYNQEDTVTNQLRNGVRGLMLDMYDFNDDIWLCHSLQGQCYNFTAFQPAIDTLKEVEAFLSENPTEIITIFIEDYVHSTMGLSKLFTAADLTKYWYPISEMPTNGKDWPSVTDMVAKNHRLLVFTSDSSKEASEGIAYQWSYLLENESGDPGITGSCPNRKESQPLNSRSASLFMQNYFPTIPVENEACKENSVGLPQMVQTCYTAAGNRIPNFIAVNYYMRSDGGGVFDVQDRINGVTLCGCNTIAACQAGAPAGACKDTGAPNRTSSSVNGNVYSGTIEFKSPASAASISNANIPSKFVGLLLLGLVLIIKPF

SEQ ID NO: 91897 - protein, 450 aa, Thermoplasma volcanium GSS1
METYDVITLGAGGAAYPAAFRLKKSGYSVLMIDKKGIMSGNCLAEGCVPSKAIIETVHNYSKLKKFGKYSIAYEDIVKHKDDVQNIRYKQHDEELHEAGLKILKGTAKLIDENTVEVETDTGKERYRAESIIIGTGSDTYVPKIPGAELAWTSRELYALNPKVRKLPKSIAIIGGGYIGLETASFMSLLGTDVTVIELLDRVLSTMDSGMVSKLVPLLPKMNLILSSPVKEIRRGGDMFEVSYDHEGKTEKIRVEAVLMAVGRMPMFPEGLDDLGIKYDKHGIKVNMAMQTNIKHIYATGDVNGLTPLFHAAKRQSLVAANNIMANHVPVDYFDPLSVPFTVYTVPQVAYVGILPDQAKKLGISYIETDYQMEKDAMAQVNSEMEGEIRLFFDSRMKIIGGYVIGNDAGNLINEIALGISKGLSARDFAEMAHQHPMSFEGLDSAARKLY

SEQ ID NO: 91898 - protein, 179 aa, Rhodospirillum rubrum ATCC 11170
MDIKKIPVGKNPPQDVNVIIEIPLLADPVKYEVDKESGAMFVDRFLHTAMHYPCNYGFVPHTLSDDGDPVDVMVVGRIPVAVGSVMRTRPVGVLYMEDEAGRDEKILGVPHSKLYPYHDNVNNFGDLRPIELRRIEHFFAHYKDLEEGKWVKILGWGNYKEAWDVIERGIAAEAAHKKV

SEQ ID NO: 91899 - protein, 381 aa, Halomonas eurihalina
MSKPAILALEDGSVFHGTAIGADGQTSGEVVFNTAMTGYQEILTDPSYSRQIVTLTYPHIGNTGVNSEDVESSSIAAAGLVIRDLPLLASSFRCEQSMSDYLAQQNVLGIADMHTRRLTRLLRDKGSQNGAILAGPDAEGEDAEARALEAARAFPGLKGMDLAKVVSCAEPYEWSEGEWTLGSGYADVSQGDRPYHVVAYDYGMKRNILRMLAARGCRLTVVPAQTPAEEVLAMNPDGIFLSNGPGDPEPCDYAISAIQAFLETEIPVFGICLGHQMLALASGAQTVKMNHGHHGANHPVQDLDSGRVMITSQNHGFAVEESTLPDNLRAIHRSLFDGTLQGIERTDRPAFSFQGHPEASPGPRDVAPMFDRFVEMMRHRR

SEQ ID NO: 91900 - protein, 395 aa, Staphylococcus simulans
ANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFVNVTNDEPATRRGIWQVKPIIQGWDHVDFIGVDFLDFKRKGAELANFYTGIINDLLRVEATESKGTQLKAS

SEQ ID NO: 91901 - protein, 266 aa, Xanthomonas campestris pv. vesicatoria str. 85-10
MIRIPMELRETVIAIARDAGAAIMEVYAQDFSVEIKDDASPLTQADLVANRVIVEGLRRVTPDVPVLSEESAHVAWEQRQYWTSYWLVDPLDGTREFVKRNGEFSVNIALIHMGAPVLGVVQAPVDGRVWYAARGENAFRRDGDRDEMLHTRTPAATPLRVAASRSHRDARTAAALERMGEIDVVAQGSSLKFCRIAEGDLDVYPRFGPTSEWDTAAGQCVLHAAGGVLLAGASGKPFRYNRRDTLLNGDFIALGDPNLPWRDWLA

SEQ ID NO: 91902 - protein, 108 aa, Chlamydomonas incerta
DRYKEFKDINTEVLGVSVDSQFTHLAWIQTDRKEGGLGDLNYPLVADLKKEISKAYGVLTEDGISLRGLFIIDKEGVVQHATINNLAFGRSVDETKRVLQAIQYVQSN

SEQ ID NO: 91903 - protein, 202 aa, Brassica napus
  misc_feature (174)..(174): Xaa can be any naturally occurring amino acid
  misc_feature (192)..(192): Xaa can be any naturally occurring amino acid
MERYEVLEQIGKGSFGSALLVRHKQERKKYVLKKIRLARQSDRARRSAHQEMELISTVRNPFVVEYKDSWVEKGCYVCIVIGYCEGGDMTETIKRACGVHFPEEKLCQWLVQLLMALDYLHSNHILHRDVKCSNIFLTKEQDIRLGDFGLAKILTSDDFTSSVVGTPSYMCPEXLADIPYGSKSDIWSLGCXMYEMFAHKPP

SEQ ID NO: 91904 - protein, 472 aa, Xanthomonas campestris pv. vesicatoria str. 85-10
MHRHVHEPEILADPAAAQTAEHWRQRDLGVVWHPCTQMREHPHTLPLVPIARGEGAWLVGHDGRRYLDAVSSWWTNLFGHTEPRIGAAIARQAGELEQVMLAGFTHTPAVQLAEQLLAIAPRQAGRAPLSKVFYADNGSAGVEVALKMAFHYFHNRGDHRRTRFIALENGYHGETIGALSVGDIPLYRRVYAPLLLEAMFTPSPDAYLAEPGQSAEDYALQAADALQALFERSPGEICALILEPRVQCAGGMRMYHPAYLRRARELCDAHGAFLIADEIATGFGRTGTLFACEQAGVMPDLLCLSKGLTGGFLPLSAVLATQQLYDAFLDDSRERAFLHSHSYTGNPLACAAALATLKIFADDDVIARNQPIAARMRELAAQIGAHPAVADVRQAGMIVAFELTQGGDKRTPFASAARVGLKAYRAALEKGVVLRPLGDVLYWMPPYCVDEAQLALLADTTGHAITEAVACA

SEQ ID NO: 91905 - protein, 399 aa, Pseudomonas putida
MAGNKSVVYHGTRDLRVETVPYPKLEHNNRKLEHAVILKVVSTNICGSDQHIYRGRFIVPKGHVLGHEITGEVVEKGSDVELMDIGDLVSVPFNVACGRCRNCKEARSDVCENNLVNPDADLGAFGFDLKGWSGGQAEYVLVPYADYMLLKFGDKEQAMEKIKDLTLISDILPTGFHGCVSAGVKPGSHVYIAGAGPVGRCAAAGARLLGAACVIVGDQNPERLKLLSDAGFETIDLRNSAPLRDQIDQILGKPEVDCGVDAVGFEAHGLGDEANTETPNGALNSLFDVVRAGGAIGIPGIYVGSDPDPVNKDAGSGRLHLDFGKMWTKSIRIMTGMAPVTNYNRHLTEAILWDQMPYLSKVMNIEVITLDQAPDGYAKFDKGSPAKFVIDPHGMLKNK

SEQ ID NO: 91906 - protein, 508 aa, Zea mays
LASSAEQQDDHHQESAAARRRSPPASPHPELYEPASASLAQLWDPPPLPHLAFAPAADESSSSSSLRRRASAPLPRADEDFVVPSSAYSRPTVGVAHTHSVSAPPLRAIETRAVPSRLVTAGGKRPRLERKYSKIVDQYRSLDEVIEALAQAGLESSNLIIGIDFTKSNEWTGKNCFNGISLHNISDNPNPYEQAISIIGKTLSAFDEDNLIPCFGFGDASTHDQDVFAFYPDERPCNGFQEALARYREIVPHLRLSGPTSFAPIIDMATTIVEQSGGQYHVLVIIADGQVTRSVDTEFGQLSTQEQMTVDAIVQASQFPLSIILVGVGDGPWDMMKEFDDNIPARSFDNFQFVNFTAIMSKKISQSKKETEFALSALMEIPLQYKATLELGILGRRIGESPERIPLPPPFASYSTVSRAEPSRANSYRSVPSHPREEPAVNSTITASVTSPSAAESRVLEPQMCPVCLSKPRDMAFGCGHQTCSECGPQVTDCPICRRPIDTRVKLY

SEQ ID NO: 91907 - protein, 237 aa, Nocardia farcinica IFM 10152
MARTEQRESFRASLDKQPHEVASMFDGVAERYDLTNTVISMGQDRYWRWATRKALALRPGERVLDLAAGTGVSTVEFAKSGAWCVAADFSKGMLAAGSFREVPMVAGDAMALPFADESFDAVAISYGLRNVADPDLAMREMLRVTKPGGRLVIAEFSTPVIPVFRTVYMEYLMKALPRVARAVSSNPDAYVYLAESVRAWPNQRQLAMRMAAAGWSSVQWRNLSGGVVALHRGYRLG

SEQ ID NO: 91908 - protein, 343 aa, Physcomitrella patens subsp. patens
KCDLSQGDWVPDHAPPVYNNETCRHIQATQDCLGNGRPDSHYLYWKWKPRGCEVLRSDAEAFLRTMRGQKMAFVGDSIARNQMQSLLCILNKVEKPTNTFHSSDDKTNHWFFPSYSFTLTIYWSSFLVKNSTYTIPDADNTFVQLDLDILDPAWVESMAGTDVIVISSGQWYFKAAVYREGGQFIGCHHCGAKAGLKQVGFFSAYRRAIRTVFRELLQSVPAFDGVAVFRTFAPDHFENGGWDTGGTCPRTVPGGVAITEMNWMMHEIETTELEKVRAEMGANRISLLDITELAQIRTDGHPGPYRNPYPYAKDAKEKFQIDCLHWCLPGPIDTWNEMLMETL

SEQ ID NO: 91909 - protein, 337 aa, Mycobacterium avium subsp. paratuberculosis K-10
MPTHQAVQIQSAGAALELVDTETRPPGRDEVRLTVGACGICGTDAHFVNGAFPGLSWPLTPGHEIAGRIAELGEGVEGFAVGQRVAVGWFGGCCYRCDPCRAGLFIHCVNGKVPSWHYPGGYAESVTVPTSALARIPEELTDAEAAPMGCAGVTTYNALRHTKALPGDRVAILGVGGLGHLGVQFAAAMGFETIAINRGTGKADDARKLGAHHYIDSTAEDPAEALRALGGAAVVLATAGNSQAMAATVGGLAPQGELVTIGVTPEPLPISPLQLITPGLSIVGHPSGTAKDVEDTMQFAVLSGVRAWIEELPLSRAADGYAALEGGRAHYRTVLTM

SEQ ID NO: 91910 - protein, 400 aa, Rhizobium leguminosarum bv. viciae 3841
MSVIADRLKNVSISASAAMTQRARELAAKGIKVVSLSSGEPDFPTPAHAIEAAHAAALAGDTKYPPMDGTPALKSAIIRKFKRDNNLDYDASQIVVSGGGKQVIFNAMLATCNPGDEVVIPTPSWVSYADIVKFAGGVPVAVPCHEQNGFKLRPEDLEAAITPRTKWLFLNFPNNPTGAACSRAEMAAIAEVMLRHPDVWIMTDDIYEHLVYDDFQFCTIAEVEPRLYERVLTMNGVSKAYAMTGWRLGFCAGPKELISAVSNVNGQNGGGIATLTQAAATAALDGPQDLLKERAAIYKERRDFVLDRLSEVEGLRCHRPEGAFYIYPNISGLIGKTSKGGRRIETDVDFVMALVEEHHVATVQGAAYGMSPFFRISYATSMEKLGEGCARIAQFCKDMR

SEQ ID NO: 91911 - protein, 157 aa, Sulfolobus tokodaii
GHMVEIGELAPDFELPDTELKKVKLSALKGKVVVLAFYPAAFTQVCTKEMCTFRDSMAKFNQVNAVVLGISVDPPFSNKAFKEHNKLNFTILSDYNREVVKKYNVAWEFPALPGYVLAKRAVFVIDKEGKVRYKWVSDDPTKEPPYDEIEKVVKSLS

SEQ ID NO: 91912 - protein, 242 aa, Halobacterium sp. NRC-1
MQAVVLAAGEGTRLRPLTEDKPKGMVEVDGKPILTHCFEQLVELGADGLVVVVGYRKQDIIEHYGDEFEGVPITYAHQREQKGLAHALLNVEEHVDEDFMLMLGDNIFQANLEDVVRRQQEERADAAFLVEEVDWDDASRYGVCDTNQYGEVTDVVEKPDDPPSNLVMTGFYTFSPAIFHACHLVQPSNRGEYEISEAIDLLIQSGRTIDAIGLEGWRVDVGYPEDREEAEERLAEAEDAVA

SEQ ID NO: 91913 - protein, 410 aa, Bacillus cereus ATCC 10987
MKIIVQKFGGTSVRDENGRKHALHHIKKSLDAGYKVVTVVSAMGRKGEPYATDTLLSLVNQEESHISNREQDLLLSCGELISAIVFSNMLNENGIKAAALNGAQAGFVTNDDFTNAKIIEMNCDRIHEELENVDVIVVTGFQGQTKKGDTTTLGRGGSDTSASALGVALHAEYIDIFTDVEGVMTADPRIVKDARHLQTVTYNEICNMAYQGAKVVHPRAVEIAMHAKVPLRVRSTYSDSEGTLISASDGATKGRDVEERPVTGIAHVSNVTQIKVLAKETAYDLQQHVFKEMANEGISVDLINISPTGVAYTVSDNVSNRAVELLQNLGYEPIVTEHCAKVSIVGAGMAGYPGVTAKIVTALAEKGIQILQSADSHTTIWVLVKETDLVEAVNALHSAFELSKEKQLEQ

SEQ ID NO: 91914 - protein, 341 aa, Mycobacterium avium subsp. paratuberculosis K-10
MRTVVVDGPRSIRVDTRPDPVLPGPDGAIVEVSAAGICGSDLHFYEADFPMPDPIALGHEAIGTVVEAGPQVRNVKVGDQVMVSSVAGCGSCAGCATRDPVLCHSGFQIFGGGVLGGAQADLLAVPAADFQLLKIPEGISTEQALLLTDNLATGWAAAQRADIPFGGTVAVIGLGAVGLCALRSALFQGAATVFAVDQVDGRLARAARWGATPVKAPALEAILAATGGRGADAVIDAVATDASLTEALNAVRPGGTVSVVGVHDMNPFPLNALGCLIRSITLRMTTAPVQRTWPELIPLLQSGRLDVDGIFTTTMPLDEAAIGYATAGSRSGDDVKILLKP

SEQ ID NO: 91915 - protein, 488 aa, Bacillus anthracis str. Ames
MNSATNQTTSQTETTKGKGELRRGLKSKHLTMISLGGTIGTGLFLASGGVIHSAGPGGALIAYAAIGIMVYFLMTSLAELAAYMPVTGSFSTYATKFVDPSLGFALGWNYWYNWAITIAAELAAVTLIMKFWFPDTPSLIWSGLCLAIIFLLNYLSVKGFGESEYWFALIKVATIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLNDLPYRAKWFPFGPIFAFALCVIVILGQNYGAFMGESIDWNGVLVSYIGLPLFLVLWLGYKFTKKTKVIPLDKCELK

SEQ ID NO: 91916 - protein, 282 aa, Staphylococcus aureus subsp. aureus MRSA252
MNHIEISKDVKIPVLGFGVFQIPQEQTAEAVKEAIKAGYRHIDTAQSYLNETEVGQGIEASGIDRSELFITTKVWIENVNYEDTIKSIERSLQRLNLDYIDLVLIHQPYNDVYGSWRALEELKETGKIKAIGVSNFGVDRIVDLGIHNQIQPQVNQIEINPFHQQEEQVAALQQENVVVEAWAPFAEGKNQLFQNQLLQAIADKYNKSIAQVILRWLVERDIVVLAKSVNPERMAQNLDIFDFELTEEDKQQIATLEESNSQFFSHADPEMIKALTSRELDV

SEQ ID NO: 91917 - protein, 510 aa, Oryza sativa
  misc_feature (462)..(462): Xaa can be any naturally occurring amino acid
  misc_feature (479)..(479): Xaa can be any naturally occurring amino acid
  misc_feature (488)..(488): Xaa can be any naturally occurring amino acid
MADSGDSSPHSAAATDDAHHEGSEAAAAQAAPPPPAPPAKVRLMVSYGGRIQPRPHDHQLSYVNGETKILSLERPLRFADFAARLAGLAGSPGDFCVKYQLPGEDLDALVSVTNDEDLEHLVLEYDRLHLLRPAPGSGGGSSRGGSTPRLRVFLFPVQSPTPPPPPQPSGLLEPKQEQRQWFVDALNSVHQPPPPSPPQPKQESVSVQSPPPAVVPMPQPPPVLPAPTGPDYLFGLDNGFVPPPAVKVKDPAGDPPTVKDNVPVEIPAKNDDRHTTNPVSDHVVVSPVVSPGEFQRQIQGLEKLQFADTAAQQPPPPPAPATAAPPPAALPRNGSDDSLTRAYPPATVTPTPPTATPEYYLPKYQEKPAAPPPSSAPPPTAFLPVPGRYTSVAPGSGADHAPVFFIPAPPHGYFTTAAGPGATSFPAVYAVAQHNGNANASGNGPSPAAASNAQAYAPQVAXYDSNGHAIYYTSVLPQXYASAVSGVXRRAATVLGTDPAKPVAVKPTVS

SEQ ID NO: 91918 - protein, 330 aa, Zea mays
MPLPIDGRRERAVCVRGAGAGAMEINIVDKYEKLEKVGEGTYGKVYKAQDKATGQLVALKKTRLEMDEEGIPPTALREISLLNLLSHSIYIVRLLAVEQAAKNGKPVLYLVFEFLDTDLKKYLDVYRRGPSARPLPATLIKNFLYQLCKGVAHCHSHGVLHRDLKPQNLLVDKEKGILKIADLGLGRAFTVPMKSYTHEIVTLWYRAPEVLLGATHYSTGVDMWSVGCIFAEMARRQALFPGDSELQQLLHIFRLLGTPTEEQWPGVSDLRDWHEFPQWKPQGLARVVPTLEPEGVDLLSKMLQLDPSNRISALAAMEHPYFNSLDKSQF

SEQ ID NO: 91919 - protein, 321 aa, Lactobacillus plantarum WCFS1
MSTDQSYAKLKLFALNSNLPLAEKIAQRVGIPLGKSSVKRFSDGEIQINIEESIRGAEVFVIQSISEPVNDTILELLIMIDALRRASASQINVVIPYYGYSRQDRKARSREPITAKLIATLLEKDRASRVLTVDLHAAQIQGFFDIPVDHLFAAPLLASYFKDRGITDNLVVVSPDHAGVSRARKMAELLGAPIAIIDNRHPDDDDLVPSSIIGDVKGRVAIVIDDMIDTGTRFDVSADALAQAGAATVYGCATHAIFSQDAVAKLQASKFEKVIVTDTIQIPADKHFDKLVQLSVGPLLGDAIKLVHEQQPVDRLFDPRI

SEQ ID NO: 91920 - protein, 184 aa, Thermoplasma volcanium GSS1
MSEREKITIENIVASTSLAEHLDLSRIALALDGSEYEPEQFPGLIYRLQDPKTAVLIFRSGKVNCTGAKNIEDVKRTIKIIIDKLKAANIEVYDDPDIIVQNIVAVYDLESELNLTDIAMSLGLENVEYEPEQFPGLVYRVEEPRVVLLLFGSGKVVCTGAKEESEIEQAVIKVKKELQKVGLI

SEQ ID NO: 91921 - protein, 284 aa, Solanum lycopersicum
MEGEVRRWWWWWTWRWLWWWERFWGRNARAGGGGAYAAGGHDGGYAGGGGSGSGAGGGHAGGGYAGGGGGGSGAGGAHAGGHDGGYASGGGEGGGAGGGHAGGGYAGGGGGGSGAGGAHAGGEHDGGYAAGGGEGGGSGYGGAGSADGGYAAGGGGGSGGGGGGAVAGGGAHGGGAYAGGSGGGTGGGYGAGGAPGGGYGGGGGHGGGGGSAYAGGEGGASGGGYGSGGGAGGGAGGAHGGAYGGGGGSGAGGGGAYAGGEHAGGYGGGAGGGEGGGHGGGYAP

SEQ ID NO: 91922 - protein, 253 aa, Desulfovibrio desulfuricans G20
MYKLVLVRHGQSTWNLENRFTGWTDVDLTPLGETEAREGARLIAAAGLTFDECHTSVLKRAIRTLNIIQEELDLLWLPVHRHWRLNERHYGALQGLNKKEMSEKYGEEQVFIWRRSFDTPPPALTADDPRHPAHDRRYASLTARQMPLCESLKDTVARVLPYWHETLAPAIQAGRRLLVAAHGNSLRALVMHLDGMSPDEVTGLNIPTGLPLVYELDSNLTPLRRAYLGDAEAAEAKARAVAEQAKAGTTERP

SEQ ID NO: 91923 - protein, 524 aa, Physcomitrella patens subsp. patens
MATILSTTTNESVRENCLAARAAERAIMDSTSSDQHHHHHKKKKKSASKVVEQDVRMDYVPSKEGRARPFVAYFPTGFDPLGEADHGDAAAALSSVKVYQGVDKLKAKQTQLVASTHGQVDFVGLNYAGEAAAWQPCSYALGVYDKEKGTLQLVPLAGEKGIVDVVRKVRFGLVSGFMVYVGGSKTIGFDILRMEPRVRGMSYEWTDEEERVEDTREQSLLKRRMLVETFGSQKSKMRAQRMERGIVKEDALGDTEDMESLFQEAGENEALLTNEQALQQANLSVVRNVPPHDVSANTPEGAYPLDKLIPAEEWENLDTRELKTAAKKAKDEELLRQQKYPNFVLSRLRRIRVEGDKEGNDRRAKILVYLRHLFTFHATPHYAVRKAASDPGRFSQETGIPGIIVSSFLERFAGESTTDSLNKSEIRIQSKQHKDLLTSYCLILGLAVDDFQADPYDMALELKQTVNTIRPYYRELGCKFEARSINERRELGDPDSAQGKWRVTLPVPLKFPEIVTAKGKGPRR

SEQ ID NO: 91924 - protein, 424 aa, Glycine max
SSTTLSVLLWTKSWEKTMDCHSPGQGLMPASFKVRTVPLDGDDSATEEVLDPDFGEAAIGRVAPVDSGLWWIILLRAYGKCSGDLSVQERVDVQTGIKMILRLCLADGFDMFPTLLVTDGSCMIDRRMGIHGHPLEIQALFYSALLCAREMLTPEDGSADLIRALNNRLVALSFHIREYYWIDMKKLNEIYRYKTEEYSYDAVNKFNIYPDQISPWLVEWMPNKGGYLIGNLQPAHMDFRFFSLGNLWSVVNSLATEEQSHAILDLIEAKWSDLVAEMPFKICYPALDGQEWQIITGSDPKNTPWSYHNAGSWPTLLWQLTVACIKMKRTHIAAKAVEIAERRILRDRWPEYYDTKRSRFVGKQSRLYQTWSIAGYLVAKLLLADPSKANTLITEEDSELVNALISANPRGKRGRKNLRQTYIV

SEQ ID NO: 91925 - protein, 389 aa, Zea mays
  misc_feature (48)..(48): Xaa can be any naturally occurring amino acid
  misc_feature (56)..(56): Xaa can be any naturally occurring amino acid
  misc_feature (65)..(65): Xaa can be any naturally occurring amino acid
GGGGGGVTENGTLYGTAIASSTPLAFGKQRLLFLTEGGAASLDLRSMXVPETPGGXLLNAIGTSXQAYSFDPSERFKAYGFTEAGDLVHVLLLGDVSSLKCRVRSGKKSEMDNPVAIQTSKGYLLVASHDKILVFNTSSQYYGRVGAPRPLFATSIKDIKSVFAGSGGVLPTEPAGKPVIAADREKLVILGLGDGHIAIYRSNFPVYKPESNAVVWSGPALLFLLFLIGIWQVYVKKKDSLGWTPEETFNTSVTAPTGSLLNHPTSDRAFADSTARSSDRGYVDGTSRASDRSYVDATTRTTDRGYSDATRAVDLRGGALRSAPRRYVSPTRYAGTSGIQYRPASAEPGLRGTPEIKYRGPGMEPPGFPKKREPLFSNNQAVVVDDHVD

SEQ ID NO: 91926 - protein, 351 aa, Magnaporthe grisea 70-15
MRPSTLRAINRALAGNEARTYSSSASPRHLMSIADLTPTELTTLVRSAATHKHAVKSGAGAPLHLAQSLTGKTVAMMFSKRSTRTRVSTEAAVAMMGGHPMFLGKDDIQLGVNESLLDTSTVISSMTSCMVARVGPHSDVTGLAKHSSVPVINALSDDFHPLQTIADFLTIHSHHPSSTPGSLGLEGLKIAWIGDSNNVLFDLALGAAKLGCHVAVASPTGYGIPENMRTLIQSASKASGSGGSLSETTVPEEAVKDADILVTDTWVSMGQEAEAKKRLAAFAGFQITNDLAKRGGAKKDWKFMHCLPRHPEEVHDEVFYSPRSLVFEEAENRLWAAVAALEAFVVNKGKI

SEQ ID NO: 91927 - protein, 90 aa, Populus trichocarpa x Populus deltoides
MALRKLYSEIKGLKVKELPDHVKPMLSIGYVKKAVQRGMDNYHAKYIETSSIDPLLHVCYGGMILSYLIALPEERRHLEHQQHAKEHGGH

SEQ ID NO: 91928 - protein, 472 aa, Aspergillus oryzae
MPPVEPQQYDYIVLGGGSGGSGSGRRAAGWYGAKTLIVESGRSGGTCVNVGCVPKKMTWNFATVNETLHIAEHYGYTIPKDVKIDYGHFKELRDATVKRLNGAYERNWGREGIDLVHGRARFVEPKVIEVANNDGTKARYNAPHILIATGGRPKLPNIKGAEHGITSDGFFEIEELPPKIAVVGAGYIAVELAGVMGAVGVDTHMFIRGQTFLRKFDPMIQKTMTERYEAAGITVHKGHPGLKEVQLVRDGKGKDKLLKLISNDGSEMEVNEILWAIGRAPEVEDLHLDVPGVKLNDAGFVDVDEYQNSSVDGIYALGDVTGHAELTPVAIAAGRQLGNRLFGPPELKDSKLSYDNIPTVVFSHPEVGTVGLTEPEARERYGDDQIKVYYTKFTAMYYDVVPPEEKKKNPTEFKLICAGPEEKVVGLHILGLGVGEMLQGFGVAVKMGATKRDFDSCVAIHPTSAEELVTLR

SEQ ID NO: 91929 - protein, 644 aa, Aspergillus oryzae
MASEIDPVAGVSPSRDLDNKSDTTDDDLSPSVTTPPASVPSLRPTDKIPGITASSTHLGQISAARRGAGTPPRPQASMSSMSGASQGGLNQDILAKMKAFSLSRQGAPPTLPHAASTGTVPKTPRPGMPPAGLSSPGGQSPPVVNGPLAGALAGRLPPVARPNTKNWVSSPSIPGSSPSPVSAKPGGLAAKRMKPGLKLSDATGTKGTAGNQSPANGTEGTGETAFSKYSEFIDTKSGTLNFKNKAVLHGGGIEFSSGHKFSISLDEVDRLDELGKGNYGTVYKVRHSRPHMRKPGMGLRGIVSRPTGPEASGSDGVTDNLTGVIMAMKEIRLELDENKFAQIIMELEILHRCVSPFIIDFYGAFFQEGAVYICVEYMDGGSIDKIYKDGVPENILRKMALSTVMGLKTLKDDHNIIHRDVKPTNILVNSRGQIKICDFGVSGNLVASIAKTNIGCQSYMAPERIAGGGVQQSGASGGGTYSVQSDIWSLGLTIIECAIGRYPYPPETFNNIFSQLHAIVHGEPPTLPESGYSDEAHSFVRACLDKNPKNRPSYSTLLRHPWIAPLMRPPEESGGDDTTSASAGVTHSSVTEDKEVADWVKEMLERRNNGLLHDSNKPALHAVALDAVPGSPLLDDPSSISVQP

SEQ ID NO: 91930 - protein, 351 aa, Alteromonadales bacterium TW-7
MNFRLLPEWAEQDAVMLTWPHKHTDWADNLARVEPVYVELAKHITHYQFLVVVAHDEALKAHITALLNQANINLERVHFVVTPTNDTWARDHGPLTCANISDETKLKVYDFTFNGWGNKFESTLDNQINKAVVEQLSHANNDYQALDMVLEGGGIEINEHGVLLTTSECLLNKNRNPDLSSQDIETLLKTHLGATDFLWVDHGYLAGDDTDSHIDTLVRFAPNNTLVYVQCDEENDEHFTALKAMENQLKSFKTAGNTPYTLVELPWPKAAYDDENSRLPATYANYLIINNAVLVPTYNDVNDDRALAQVQIAYPQHTIIGVNCQPIIEQFGSLHCITMQLPRGFLAGAAQ

SEQ ID NO: 91931 - protein, 383 aa, Thermus aquaticus
MRGLSQRVKSMKPSATVAVNARALELRRKGVDLVALTAGEPDFDTPEHVKEAGRRALAQGKTKYAPPAGIPELREAVAEKFRRENGLEVTPEETIVTVGGKQALFNLFQAILDPGDEVIVLAPYWVSYPEMVRFAGGVPVEVPTLPEEGFVPDPERVRRAITPRTKALVVNSPNNPTGVVYPEEVLRALAEMALQHDFYLVSDEIYEHLIYEGAHFSPGTLAPEHTITVNGAAKAFAMTGWRIGYACGPKAVIKAMADVSSQSTTSPDTIAQWATLEALTNREASMAFIAMAREAYRKRRDLLLEGLSRIGLEAVRPSGAFYVLMDTSPFAPNEVEAAERLLMAGVAVVPGTEFAAFGHVRLSYATGEENLKKALERFAQALQ

SEQ ID NO: 91932 - protein, 413 aa, Bacillus cereus ATCC 10987
MIKKYTCKNGVRIVMENIPTVRSVAIGIWIHAGSRNENEKNNGISHFLEHMFFKGTETRSAREIAESFDSIGGQVNAFTSKEYTCYYAKVLDEHAKYALDVLADMFFNSTFDEEELKKEKNVVCEEIKMYEDAPDDIVHDMLTKATYETHPLGYPILGTEETLNTFTGDTLRQYIKDHYTPENVVVSIAGNIDEAFLQTVEQYFGSYEGTTNREQVHSPIFHFNKVARKKETEQAHLCLGYKGLQMGHEDIYNLIVLNNVLGGSMSSRLFQEVREQRGLAYSVFSYHSSYEDTGMLTLYGGTGSQQLDTLYETMQETLETLKNTGITERELMNSKEQLKGNLMLSLESTNSRMSRNGKNELLLRKHRSLDEIIESVNTVTKENVDELIRNMFTDEFSAALISPDGKLPKGIKL

SEQ ID NO: 91933 - protein, 312 aa, Aspergillus oryzae
MERKPSRRKSRIFETPERNESDTGSQNAPARRTTKYWPCGIVICPLILCILSALLFLQQFTTPDPLRSVLSSPKVHHGETLHSQVHNPDLARPSIELHPEDHIYRGAVTQHLDWVVAEDYLRPDGVLKQVYLVNGIFPGPTIEACSGDTLLINVTNALQGEPISIHWHGLHVHNTMDGVPGVTQNAIPPGSTFMYNLTIPQDQSGTFWYHGHTGTSRADGLYGGFVVHAPSSRPTVRGLMARDSAESLQYGYEREFLLLIGDWYHQPGAQVLAWYMSIASFGNEEASTALWPCLLDPWIALNNRPTSRTYQT

SEQ ID NO: 91934 - protein, 420 aa, Zea mays
  misc_feature (204)..(204): Xaa can be any naturally occurring amino acid
  misc_feature (219)..(219): Xaa can be any naturally occurring amino acid
EALLRLTALHCTCCLLPSSVGPGPWPCPRRAPSSAAVGYHVAGGPSYMRGAVFWEPGRPLTLEEFHMPRPKAGELLIKTKACGVCHSDLHVLKGELPFSSPCVVGHEITGEVVDHGTHTPAEIISRFPVGSHVVGAFIMPCGNCFYCVKGQEDLCESFFAYNRAKGTLYDGETRLFLRGNGKPVYMYSMGGLAEYCVVPANALXVLPASLPYTESAILXGCAVFTAYGALRHAAEMRPGDSVAVIGVGGVGSSCLQIAKAFGASQVIAVDVLDEKLQNATTLGATHTVNAAKADAVERIKEITDGRGVDVAIEALGKALTFSQCAKSVRDGGKAVMIGLAATNVMGEVDITRLVRRQVKIIGSYGARARQDLPQIVKLAESGAFNLQNTISRKCKFEEANGAYEDLNQGKIVGRAVVEIM

SEQ ID NO: 91935 - protein, 328 aa, Arabidopsis thaliana
MEEEVLSRVPVKSLGKLRLTCKKWNTITKSESFLKKKQRNGIEVVMMMDYRVSLMSVDLLSPSIDPIGNLNADGIKISKIFHCQGDKDSSRVVVWNPYLGQTRYIELPRNSIYHKCVKYALGYEKKNHKILRFVNEYLETSRDRIRELQIYSLYSNSWEVIDDFTPDWYILYKHSGVSLKGNTYWYALEEIPFHAVFGDTVTLASVREEQLAVLFHRASVVEIWITNKIEPNAVSWSNLLFAVDMKPVAGFWFPNVGRSFFVDEEKKVAVVLDKEIIDKCHLPARNIAYIIGNNGILSKVDLGESRDKFCYPLVCSYVPSSVQIPNTP

SEQ ID NO: 91936 - protein, 763 aa, Chlamydomonas reinhardtii
MAAPDALIAAFIPASAVVAILFAVFLWKRVAAIQMTGGRVLSSQNGREYLLEEEQRGGEEEIVAKAADIQKSISEGASSFLATEYYYLGIFMVIMSVVICSLLSIVTPEEGRTSADELRNGVFSTIAFALGGATSILSGYLGMQIATFANARTAVEARKGIAPAFMCAFRSGAVMGFLLSGFGLLNLFLAITIFSKFFGDDWKGLFEAITGYGLGGSSIALFGRVGGGIYTKAADVGADLVGKVEKDIPEDDPRNPAVIADNVGDNVGDIAGMGADLFGSFAESTCAALVISAVSSLGKEHDYAGMMFPLLISATGIFVCLITTFLATDLKPAKVIAEIEHTLKMQLIISTLLMTPVALGVALWSLPPEFTLSVPSSSPDKPFDEKVVKSWYMFVCISTGLWGGLLVGLQTEYFTSNRYKPVQDVADACRTGAATDIIFGLALGYKSCIIPTIVIGVAIYVGTSLAGMFGIACCALGMLSTLATGLAIDAYGPISDNAGGIAEMAGMGEDIRERTDALDAAGNTTAAIGKGFAIGSAALVSLALFGAYVTRAKIDMIHSSILDPRVFAGLLLGAMLPYWFSAMTMKSVGKAALAMVHEVRRQFNTIAGLMEGTARPDYKRCVAISTQAAISEMIAPGALVIFTPVVVGALFGTQCLAGVLAGSLVSGVQLAVSMSNTGGAWDNAKKYIEAGATEHARELGGKGSDCHKAAVIGDTVGDPLKDTSGPSLNILIKLMAVESLVFAPFFYNCAHGQGLIFSFFGIA

SEQ ID NO: 91937 - protein, 311 aa, Aspergillus oryzae
MADAGGWSTIESDEGVFTSLIENLGVKGVQFEELISLDADTIRSLSPVYGVIFLFKYLRDQTPTTPEAPIDGTYDKTAPENLFFAAQTIQNACGTQAILSVILNQDSPSSTPYPIDIGNELRSFKDFTTGFPADLRGEALSNSETVRTAHNAFARASPFVDETVRTARDEEGDVYHFIGYTAVNGTLYELDGLQPYPISHGECDAEGFPEKVIGVLQRRIARYPEGETRFNLMAVVRDLRMRAREIGDVEMLEREERKRRAWDWENTLRRSNFVGFIGEVLKGVVGMKEKEGKFDEWVQKAKGETERRLRR

SEQ ID NO: 91938 - protein, 120 aa, Streptococcus agalactiae 2603V/R
MDKIYLNKCRFYGYHGAFSEEQTLGQVFQVDAVLSLDLAKASQTDDLIDTVHYGEVFDCIKNHVENEQYQLIEKLAGVIVEDIFLQFHPVQAITLKITKDNPPINGHYESVGIELERRRA

SEQ ID NO: 91939 - protein, 294 aa, Bordetella parapertussis 12822
MSERVLLAGCGDLGVRVARRLLARGDQVWALRRQPPPAEDGGLRWIAADLTQPATLAGLPDGLTQVVYLPAPGARDPARYREIFVDGLRHLRDALDTAALRRTLFVSSSAVYGEHDGQWVDEHTPPGPLGFNGRSLLEAERSLDAWPGQAVVLRLAGLYGPGRLQLLERLRAGQARAPVDPPHWANRIHIDDAAAAIAHLLRLPAPEKLYLGCDDTPLPLHELYAALATLAGAPPPGEGPAPAQVGSKRLCNARLRASGLQLQWPDSRAGYAALLDGKATLQATIHTTTKRSIP

SEQ ID NO: 91940 - protein, 445 aa, Yarrowia lipolytica CLIB122
MGKLIELLLHPSELSAAIHYKLWRQPLHPRDLSKESTELRRCYELLDVCSRSFAAVIRELHPEVRDAVMLFYLILRALDTIEDDMTLSRDIKIPILRDFTKCMKTPGWKFTDSDPNERDRVVLQEFPVVMTEFNKLKPKYQEVIYDITDRMGNGMADYVIDDDFNNNGVDTIAAYDLYCHHVAGIVGEGLTRITILAGFGTDVLHENPRLQESMGLFLQKVNIIRDYREDIDVNRAFWPREIWHKYAEEMRDFKDPKYSKKALHCTSDLVANALGHATDCLDYLDNVTDPSTFTFCAIPQVMAIATLDLVYRNPDVFQKNVKLRKGTTVSLILEASNVSGVCDIFTRYARKVYKKSDPNDPNYFRVSVLCGKIEQHAALIKRQRGPPAKTIAQLEGERKEMALSLIVCLAVIFSMSGLMAYIAYVSGFRWSPREIFDSKMFPLRD

SEQ ID NO: 91941 - protein, 277 aa, Oryza sativa Japonica Group
MAFRLSNNVIGALNLVTLLLSAPILSGGIWMATRGDGGECDRHLSSPAIALGAVLMAVSLAGLVGACCRVTWLLWVYLLAMFALIVALLGFTAFAFAVTNRGAGEAVSGRGYREYRLGDYSTWLRRHVGSSKNWDKIRSCLAGADVCRSLQDRNETWAQFVADDLSPVQSGCCKPPTSCNFTYGGGTRWGKTARLSSADPDCDEWSNDADEVCYGCRSCKAGVVAALKRDWKRVAIVNVVFLAFIVVVYSVGCCAFKNSRRDSVHRRSGGWKQAGYA

SEQ ID NO: 91942 - protein, 171 aa, Glycine max
SAVLQSPFLSSPFISSLTHAQFSPPDGLPYDEFFSQRSESLLKVLRSGARIKKEAFQAASIPVVLVENSGRCNKNDSDEKVLPNGTAWIPNLVQTITDIALNQSESIHVDKNLIEGPNPNQRGKLWTPLVFAIQYFLIMKPIKGLIERDIANERKPTWERRDAAFRKRDLY

SEQ ID NO: 91943 - protein, 112 aa, Triticum aestivum
  misc_feature (7)..(7): Xaa can be any naturally occurring amino acid
  misc_feature (26)..(26): Xaa can be any naturally occurring amino acid
  misc_feature (51)..(51): Xaa can be any naturally occurring amino acid
  misc_feature (93)..(93): Xaa can be any naturally occurring amino acid
MKDGTSXGGGAFAAGSDPRQPSTANXYAPPKLSPQDLPIDYAGFLAVAFGXLGVMLRYKVCSWIAIIFCAQSLANMKNFENDLKQLSMAFMFXVMGLVTNYFSPARPGSTKR

SEQ ID NO: 91944 - protein, 457 aa, Arabidopsis thaliana
MASLGQITLPRAPSSEIGLLRRRFERPIIRTRIGFNGRIASVLTNAGDQAVSVKASVSQKVIEEEAKVIVGTYARAPVVLSSGKGCKLFDPEGKEYLDCASGIAVNALGHGDPDWLRAVTEQAGVLAHVSNVYYTIPQIELAKRLVASSFADRVFFCNSGTEANEAAIKFSRKFQRFTHPEDKEVATGFIAFTNSFHGRTLGALALTSKEQYRTPFEPIMPGVTFLEYGNIQAATDLIRSGKIAAVFVEPIQGEGGIYSATKEFLQSLRSACDAAGSLLVFDEVQCGLGRTGLMWAYEAFGVTPDIMTVAKPLAGGLPIGAVLVTEKVAETINYGDHGSTFAGSPLVCSAAIAVMDKVSKPSFLSSVSNKGRYFRDLLVKKLGGNSYVKEVRGEGLIIGVELDVPASSLVDACRDSGLLILTAGKGNVVRIVPPLVISEEEIERAVEIMAQNLTALD

SEQ ID NO: 91945 - protein, 639 aa, Synechococcus sp. CC9311
MSLISLVDASKDFGIRTLFADLTLHIREGDRLGLIGPNGSGKSTLLKVLAGEEPLGGGERRCSSRLRVELVGQESTVDPGLTVLEQVLAGCGEKRDLLLRFSELSEAVADNPDNSVLLAELGVLSQRMDESEAWSLEQQCQEVLQRLGITDLHSPVEALSGGYRKRVGLASALVACPDVLLLDEPTNHLDAAAVEWLQSWLDRYPGAVVLVTHDRYVLDRVTRRIVEVELGEARSIDGNYSAYLQRKAEQNLADASAAAKFKSVLRRELAWLRQGPKARSTKQKARLQRIDEMRTAPTKQSRAQLEMASVSRRIGKVAIEAEHLSVSANGNKDGPFLLSDFSYSFSPEDRVGIIGPNGSGKSTLLDLIAGRRQPTCGSLQIGETVHLGYLDQHTDVLSDGKGLERKVIDFVEEAASTIDLGHEQLSASQLLERFLFPPAQQHSPLSKLSGGERRRLSLCRMLIQAPNVLLLDEPTNDLDVQTLSVLEDLLEDFRGCVVVVSHDRYFLDRTVDRLFCFENGRLQRFEGNYSEFLDFRRDLEKAHNETLAAQETAQRTAKSASKRVSLQDDKPKRRTFKESKELERLDSDLPALEERKQELEQAIAGGIGDLSSLSLELAALLDSLHASEERWLELSELEP

SEQ ID NO: 91946 - protein, 337 aa, Glycine max
  misc_feature (137)..(137): Xaa can be any naturally occurring amino acid
MYTKSAQSSFRDRTHEFQSIAERLKKTGSAPNGQSSSSSRSEEQRSAIANQSEFNRRASKIGLGIHQTSQKLAKLAKLAKRTSVFDDPTMEIQELTGVIKQDITALNSAVVDLQLLCNSRNESGNASTDTTSHSTTXVVDDLKTRLMSATKEFKDVLTMRTENLKVHENRRQLFSATASKDSANPFVRQRPLATRSAASTSNAPAAPWATGSSSSQLFPKKQVDGESQPLLQQQQQQQEVVPLQDSYMQNRAEALQNVESTIHELSNIFNQLATLVSQQGEIAIRIDENMDDTLANVEGAQGALLKYLNSISSNRWLMIKIFSVLIFFLMVFLFFVA

SEQ ID NO: 91947 - protein, 404 aa, Triticum aestivum
MPLPSSSSSAAAVAAGPAASPLAARSRDRLLRARSGHAAVRCQRVDPVRLRAVNGSPPCVPLSDRSPWTPATMPIFGDANIRKDDTRLRIFSGTANPSLAQEIASYMGLELGKINIKRFADGEIYVQLQESVRGCDVFLVQPSCPPANENLMELLIMIDACRRTSAKNITAVIPYFGYARPVWQSQGRESIAAKLVANMITEAGANRVLVCDLHSSQAMGYFDIPVDHVYGQPVILDYLASKTISSNDLVVVSPDVGGVARARAFAKKLSDAPLAIVDKRRHGHNVAEVMNLIGDVRGKVAVMMDDMIDTAGTIAKGAELLHQEGAREVYACCTHAVFSPPAIERLSSGLFQEVIITNTIPLKEEKNFPQLTILSVANLLGETIWRVHDDCSVGHAPYSTLDID

SEQ ID NO: 91948 - protein, 696 aa, Synechococcus sp. CC9311
MAASLSHLMHHPLGIFAQLVAISVLIPPLTRRLRLPDLVGLLAAGVLVGPHVLHWIDAKSETITLLSDIGAIYLLFTVGLEIDLEEFNRVKRRSVTFGALIFVLGVGTGFGIGQIFGFPLVPSLLLGALMATHTPLGYPIVRSYGAQRDESVIVSVGSTIFTDIAALLLLAVALGLGKGNLTPISFTSLLISIGVFACVVVWGIRMVGQHLWMRNVIDENRVFLAVLLTLFVASLGAELAGVEKIVGAFLAGLAVNSVLPEGKVKEQVIFVGGALFIPIFFIHLGLLLDLGSLADSIGNIEFTALMLTGALGCKALAAVIAGRWFRYSPNQMLLMWSLAMPKVAATLATAFIGFQAGLLNNTVLNSVLAVMVVTATLGPTLTTRSVVALMEPNERSTYGTTNLDGNQEVPGEVVRRPLKVLVPVANPDTELSLLKLAARLSQGEGEHNGQLLPLALVSPSLEEARGGLNRALSAARARLRQAGTNGESLTATTRCLLRVDDDIAAGMSRSALEEGADLLLIGAGRPDPLRKWLLGDLVDGVCRTAHCPVVVANLGQRELKDLNQILVPIKDLSASAREQFELALRLLSTAPDPTSTTISLLHIHDPRFNRHERSWMEHQLMSWCPRNIDSHQIQIKLIQGPGIDSKIHWFSKNQDLVILRSQRRRVAGLPIPASDRTSNLVHQLSCPALMISDPLH

SEQ ID NO: 91949 - protein, 128 aa, Triticum aestivum
MAMISPAAATVVAARPGQALGLPQLRVTRAERLRCGCSKDRKEAAAASPAVVKGVPLLAAASAAATAAAPALALVDERMSTEGTGLSLGLSNNLLGWILLGVFGLIWSLYTVYSSTLDDDDESGGLSL

SEQ ID NO: 91950 - protein, 396 aa, Halobacterium sp. NRC-1
MSYRVGLVGKPSVGKSTFFNAATNNDVPEGAYPFTTIDPAVGEAYVRVECAAPEFGEECTPATGFCEDGTRFVPTKLVDVAGLIPGAHEGAGLGNQFLTDLNEADVLIHVVDFSGTTDIEGEATEGHDPREDIDFLETELDQWYLDVLEKGIERYEGQHMADATLEVELAEQMSAFRTSPEEVKQVLLALDLAFDPDTWDDADRLELAREMRTRTKPMVVAANKMDTPEAQANWAAITDDDEYDHLEFVPVSAHAEQALTQADQGGVVDYRAGDDAFTIVGEPSDDQRAGLESIREFVTEYGGTGVQSAIEAALFDALGVKPVFPGSANGLGTADGRVLPDVFLLEPDATAEDFAYAVHSDVGDGFLHAVDCRANRQIAADQDLDSRAVIEIISTN

SEQ ID NO: 91951 - protein, 119 aa, Chlamydia trachomatis
KVGSWIGAQYDQEIIFTRGTTSSLNLLAIAANDSWLAGGTVVISEAEHHANLVSWELACQRSGATIKKVRVDDEGMVDCNHLEQLLKQGVQLVSLAHVSNVSGAVLPLPEIAHLVHRYE

SEQ ID NO: 91952 - protein, 119 aa, Chlamydia trachomatis
KVGSWIGAQYDQEIIFTRGTTSSLNLLAIAANDSWLAGGTVVISEAEHHANLVSWELACQRSGATIKKVRVDDEGMVNCNHLEQLLKQGVQLVSLAHVSNVSGAVLPLPEIAHLVHRYE

SEQ ID NO: 91953 - protein, 244 aa, Brassica napus
MPKTRRMSDLPQELVGEKILTKVPITSVKEVRSTCKKWEAITKSWVVLGKAAAAAAAAGPHEFLGFMTMNAKVYSLRFHLREEEEEDLVVDVSAKQVDLLNQLEISKVYHCDGLVLCVATDHSKLVVWNPYLCQTRLIGPRENFNIRDNYAIGYSSSSSERDHKILRFVDDYSAPGPTRVFRCEIYGIGSDSWRVLKPKPEWKIQINEHHRGVSVKGNTYFFAHERFVVIDDFGGRDCEVEDSY

SEQ ID NO: 91954 - protein, 737 aa, Saccharomyces cerevisiae
MSQNIQIGTRKRSRANMNNSTTTGPANNTSSNKTFLDNFEETRTNKLLDEMFARQNSFLTDNLRNSLDLNQADNPLRPRQHQHQLFLDNENAIELDEEPRIINTTINNSNNHNSSRVDEDADDDIIFIKEQPIQFSSPLILPSSSSINNNNNIVTSNNPGCGTAATSNSTYITTPKKFKKQRTISLPQLPLSKLSYQSNYFNVPDQTNAIVPRVTQTENELLHLTGSCAKTLEGNKAVNLTIAHSTSPFSNPPAQIASLPQSNLKKQIGSSLRKFTSNGSSESASSNKSNFKTDKDGHYVYQENDIFGSGGRFVVKDLLGQGTFGKVLKCIDNKYEPNYVAVKVIRAVDRYREAAKTELRILQTILNNDPQGQFQCLLLRECFDYKNHICLVTDLYGRSIYDFMCSNGIARFPGSHIQAIARQLIRSVCFLHDLGIIHTDLKPENILICDETHIAQKLPLKTVQSLSKRRREASKGKRKILKNPEIKIIDFGSAIFHYEYHPPVISTRHYRAPEIVLGLGWSFPCDIWSIACVLVELVIGESLYPIHENLEHMAMMQRINGTPFPTDIIDKMFYKSKHKLGNSPSDLNSTVIKHFDRKTLSLQWPEKNKRGDTITTEKSMKRVLQSCDRLDIYISKVLKQDYGDSLSINWNLPPEKNWSLINSKLAWKRQTHSSSSSTTDELDKETFLFWYWFIDLLRKMFEFDPTKRITAKDALDHEWFNLGILDDGIATYNNTQG

SEQ ID NO: 91955 - protein, 108 aa, Pyrus pyrifolia
IVYELMDTDLHQIIRSNQPLNDDHCRYFLYQLLRGLKYVHSAGVLHRDLKPSNLLMNANCDLKIGDFGLARTTSETDFMTEYVVTRWYRAPELLLNCSEYTAAIDIWS

SEQ ID NO: 91956 - protein, 318 aa, Zea mays
TGIYWGVNKFVIDNSSVPVVERKKKDKPKLSMGESMKVLLSSRYVRDLATLVVAYGISINLVEVTWKSKLKAQFPSPNEYSSFMGDFSTATGIATFTMMLLGRVILRKFGWGVAATITPAVLLLTGVGFFSLILFGEPLTPLMTKFGMTPLLAAVYVGAMQNIFSKSAKYSLFDPCKEMAYIPLDEDMKVKGKAAIDVVCNPLGKSGGALIQQFMILSFGSLANSTPYLGGILLVIVLAWLGAVRSLDLQFSSLAKQELGREKLLKTQAVETVAEVVGTGNGSLQETLASEPSANGAATKQSQEPESTAPEKSGQQSQ

SEQ ID NO: 91957 - protein, 336 aa, Pseudomonas fluorescens PfO-1
MAFNIHNRNLLSLEHHTPRELRYLLDLSRDLKRAKYTGTEQQHLKGNNIALIFEKTSTRTRCAFEVAAYDQGANVTYIDPNSSQIGHKESMKDTARVLGRMYDAIEYRGFKQEIVEELAKFAGVPVFNGLTDEYHPTQMIADVLTMREHADKPIHEISYAYLGDARNNMGNSLLLIGAKLGMDVRICAPKALWPHDDLVDRCKKYAEESGARITLTEDPKAAVKGVDFIHTDVWVSMGEPVEAWAERIQQLLPYQVNAELMKATGNPRTKFMHCLPAFHNSDTKVGKQIAEQYPHLKNGIEVTDDVFESPACIAFEQAENRMHTIKAILVSTLADL

SEQ ID NO: 91958 - protein, 625 aa, Cryptococcus neoformans var. neoformans JEC21
MAPSASKQKRLAEKAAKAASKTGSSKSSVTGASTPLTSVSDDPTDAAEQMKKLNLATDRSASGVLVSDPKGRDIKIDQYMLSFHGRLLIEGAEIALNYGQRYGLLGENGSGKSTFLQSIADRDIEIPDHIDIYLVSGAVDPSDVNALDYIVSSAREKVERLEKLAEDMSTADDVDELALDAIYEELEEMDPSTFEAKAGAILNGLGFSQQMMAKPTKDMSGGWRMRVALARALFIKPHVLLLDEPTSHLDLGAVVWLEAYLSTYNHILILTSHSADFMDTVCTNIMDLTTKKKLVYYGGNYTTYVRTKSENEVNQMKAYAKQQEEIAHIKKFIASAGTYANLVKQAKSKQKIIDKMEAAGLIEKVEQPRQLRFNFEDVKKLPPPIIAFSDVAFSYSGKKEDYLYQDLSFGIDMDSRIAIVGDNGTGKSTLLNLITGALQPVEGTINKHTQLKLAKYSQHSADQLPYDKSPVEHIASLYSEKFPDKDIQFWRQQIGRFGITGAHQTSPINQLSDGLRNRVVFAILAMEHPHIILLDEPTNHLDMASIDALAAAIKEFEGGVVIVSHDFRLISQVAEDLWEVKDKKVINLTKQDISIVDYKKALAKRSQAQIEKARLISKSATKGVA

SEQ ID NO: 91959 - protein, 623 aa, Melanocarpus albomyces
MKTFTSALALVVGMLAPGAVVAAPPSTPAQRDLVELREARQEGGKDLRPREPTCNTPSNRACWSDGFDINTDYEVSTPDTGVTQSYVFNLTEVDNWMGPDGVVKEKVMLINGNIMGPNIVANWGDTVEVTVINNLVTNGTSIHWHGIHQKDTNLHDGANGVTECPIPPKGGQRTYRWRARQYGTSWYHSHFSAQYGNGVVGTIQINGPASLPYDIDLGVFPITDYYYRAADDLVHFTQNNAPPFSDNVLINGTAVNPNTGEGQYANVTLTPGKRHRLRILNTSTENHFQVSLVNHTMTVIAADMVPVNAMTVDSLFLAVGQRYDVVIDASRAPDNYWFNVTFGGQAACGGSLNPHPAAIFHYAGAPGGLPTDEGTPPVDHQCLDTLDVRPVVPRSVPVNSFVKRPDNTLPVALDLTGTPLFVWKVNGSDINVDWGKPIIDYILTGNTSYPVSDNIVQVDAVDQWTYWLIENDPEGPFSLPHPMHLHGHDFLVLGRSPDVPAASQQRFVFDPAVDLARLNGDNPPRRDTTMLPAGGWLLLAFRTDNPGAWLFHCHIAWHVSGGLSVDFLERPADLRQRISQEDEDDFNRVCDEWRAYWPTNPYPKIDSGLKRRRWVEESEWLVR

SEQ ID NO: 91960 - protein, 524 aa, Zea mays
MDVALSTIVFVIAIFIPALLTLVQRSRSRHAGHNQPPPPEPRAIPLVGHLHQLLRKKPLHRTLAHLAERHGDVLGLRFGSSRVAVVSSASVAQQCLVALDTSFGNRPRLPSARILSYEWSTMGHSNCGPYWRQARRTTSTEFSSVERVQHFADVHEQAARAMARSLCRLALASGRGRALVDVKPRLFEMLMNGLLDMLFKGTASRSGSSDEKDEAVEVSEEARCFMAMAEETMELTLTVWDFLPPLARWLDVDAVGRRLQRLQANRTEFLQRLIEEHKEMEKGGQVTRRTLVGVMLELQDKDPEAYTDQLIRSMCVSALEAGTLSTGYTIEWVMSLLLNNPHIMKKARDEIDACVGEPKRLLDATDLPKLPYLRCIILETLRLYPVVPLLVPRESSTNCTVNGFNIAKGTMLLVNTFAIHRDPRTWDDPETFLPERFEDGSNQAGKTTMDLSFGMGRRRCPAENLGMQLAGIALGTMIQCFNWERVGTELVDMAEGSGLTMAKKVPLEAFCQPRASMVDLLANI

SEQ ID NO: 91961 - protein, 725 aa, Oryza sativa
MAGAIRVTMEVGADGVAVVTICNPPVNALHPIIIQGLKEKYAEAMDRDDVKAIVLTGAGGKFCGGFDINVFTEVHKTGNVSLMPDVSVELVSNLMEAGKKPSVAAIQGLALGGGLELTMGCHARISTPEAQLGLPELTLGIIPGFGGTQRLPRLVGLPKAIEMMLQSKFITAKEGKEGGLVDALCSPDELIKMSRLWALEIANYRKPWIRSLARTDRLGSLSEARSVLNSARQQAKKVAANLPQHQACLDVMEEGVLCGGHAGVLKEAKVFKELVLSPTSKALVHAFFAQRLTTKVPGVTDVQLKPRKIRKVAVIGGGLMGSGIATALLVSNTSVVLKEVNPQFRQRGQKMIAANLEGLVKRGSLTKDKMNKAMSLLKGALDYCDFKDVDMVIEAVIEKIPLKQSIFSDLEKVCPPHCILATNTSTIDLNVVGEKTNSQDRIIGAHFFSPAHIMPLLEIVRTEKTSPQAILDLITVGKMIKKVPVVVGNCTGFAVNRTFFPYTQGSHLLVSIGIDVFRIDRVISSFGMPMGPFQLQDLAGYGVHCSKGFYAAAFGTRNLDSNLVDLMVQNGRQGKSNGKGYYLYEKGGKPKPDPSVQVVIDEYRRCAKTMPGGKPVTLSDQDILEMIFFPVVNEACRVMDENVVIRASDLDIASILGMGFPKFRGGLVFWADTIGAPYIHSKLSKWTEIYGDFFKPSSYLEDRAKRSLPLSAPNATQQASSRSRM

SEQ ID NO: 91962 - protein, 698 aa, Robiginitalea biformata HTCC2501
MNKGIYVATIEANSGKSILSLGLMRLLLGKMARVGYFRPIIDDYPDGKQDNHIATILSHFNIPLNYEEAYACTRSQVVQKTSRNREDEVLDTIIQKYKDLESRFDFILVEGTDFTGEGAIIEWDFNVLLAKNLGIPTVILSTGVGKTLEEFVNSLALACDSFRDKGVEVLMVAANKIQPENRQLVLDQMHSDLPEGVLTAAIPLNPVLGNPSMREIADALGGEVLFGARHLDKQVAHFGVGAMQLRNYLTHLVEATLVITPGDRADIILGALQANLSTNYPSISGIILTGGLVPEETIIRLIEGLSEVVPIVSVQGGTFSVTNRIGSIQPRIYAGNTLKIEQSLKDFSAYVPEDALAERLVTFRAEGITPRMFQYNLLKKAQSDVKHIVLPEGADQRVLRAAVELARYQAVRLTLLGRPEEIREKARQLQLELPGEIQLLDPRNAPQFEEYANTLYELRKHKNMELTMAQDLMSDVSYFGTMMVHKGHADGMVSGAAHTTQHTIRPALQFIRTRPGVHLVSSVFFMCLPDRVTVFGDCAINPNPDAAELAEIAISSADTTASFGIEPRVAMLSYSSGSSGQGADVDRVREATRLVRERRPDLKVEGPIQYDAAVDLKVGRSKLPDSEVAGRATVFIFPDLNTGNNTYKAVQRETGALAIGPVLQGLNKPVNDLSRGCTEDDIFNTVVITAIQAQQIRK

SEQ ID NO: 91963 - protein, 254 aa, Geobacillus kaustophilus HTA426
MLHQFSRNELAIGPEGLERLKNATVAVLGVGGVGSFAVEALARSGIGRLVLVDRDNVDITNINRQIHALLSTIGRPKVELMKERIADINPACEVIALQMFYTEETYEQFFAYDLDFVIDASDTIVYKVHLMKQCLKRGIPIISSMGAANKMDPTRFRIADISKTHTDPIAKVIRAKLRKEGIHRGIPVVFSDEKPVKIREDVRQVVGNDASPIRKAKMPPSSNAFVPSVAGLIMASYVIHRLLEGIPIRRVGDD

SEQ ID NO: 91964 - protein, 254 aa, Rhizobium leguminosarum bv. viciae 3841
MIFDRFRLNGQVALVTGGTRGIGLAIAEALGEAGAKVIITGRTRNAAAEDRLSRAGVDCDFVAADLMKESAADELVTETLSRAGRLDILVNNAGIAIHGDSGEFSDAIWREIMTVNVDTVFRACRAALAPMRRQGGGAILNIGSISGIVSNIPQNQVAYNTSKAAVHMMTKSLASEVAAENIRVNAIAPGYIETDLSRGGIDNPDWFPTWRSMTPMGRVGQPEEVASAALFLCSAAASYVTGEVLVIDGGYTTR

SEQ ID NO: 91965 - protein, 148 aa, Bacillus licheniformis ATCC 14580
MEKTFVMVKPDGVQRQLIGEILLRFERKGLQLIGAKLMKVSEETAGEHYKEHNGKPFFGELVDFITSGPVFAMVWEGEDAIAVARQLIGKTNPKEALPGTIRGDFGMFVGKNIIHGSDSPESAAREINLFFKEDELVEDEKLMNQWIY

SEQ ID NO: 91966 - protein, 183 aa, Glycine max
VCLFRLLGSLGNKRSSPDYDDEDYDNDPFAPKKSKTKAEEASGVTTGMILSLRESLQNCKDTLATCQNELEAAKSEIQSWHSTLKNQPSILAGITPEPKMLINYLQALKSSEESLREQLEKAKKKEAAFIVTFAKREQEIAELKSAVRDLKVQLKPPSMQARRLLLDPAVHEEFTRLKVCYST

SEQ ID NO: 91967 - protein, 232 aa, Bacillus licheniformis ATCC 14580
MVQSKEQRVHGVFEKIYKNYDQMNSVISFKQHKKWRDKTMQLMNVPKGATALDVCCGTGDWTIALADAAGETGEIKGLDFSKNMLSIAEQKTESYSQIELIHGNAMELPFPDNTFDYVTIGFGLRNVPDYLTVLKEMARVVKPGGQVVCLETSQPEMFGFKQLYFLYFRFIMPMFGKLFAKSFKEYSWLQESAREFPGMKELAALFEEAGLKNVQYHPFTGGVAATHVGWKR

SEQ ID NO: 91968 - protein, 572 aa, Robiginitalea biformata HTCC2501
MAEIIKMPRLSDTMEEGTVAKWLKQVGDKIEEGDILAEIETDKATMEFESFYEGTLLHIGIEEGDGAPVDALLAIVGEEGEDISGLIDGAGSGDAGAGEDTKETVAEEAATGDGSEDAETASGDDAGGQAEVPEGVEIIRMPRLSDTMEEGTVASWIKKKGDAVEEGDILAEIETDKATMEFESFYSGTLLHIGIEEGESAPVDAVLAVIGPEGTDVEAVLSAGSGSGKPAATEEKGAEAKKESSEEKAASTDGAAAGREEARSGGSSSGDGRIFISPLARKMAEEKGIDLSDVEGTGDNGRIVKRDIENYTPSAKPAASVGEGAAKAPAEQAVPASAASMAPAGEESVEEVKNSQMRKVIAKRLSESKFTAPHYYLTIEVDMSQAMASRARINELPDTKVSFNDMVVKACAMALRKHPQVNTTWNGDTTKYNGHVHIGVAVAVEEGLVVPVLKFTDQMSLTAIGASVKDLAGRARNKKLTPAEMEGSTFTVSNLGMFGIREFTSIINQPNSAILSVGAIVEKPVVRDGQIVVGHTMTITLACDHRTVDGATGAQFLQTLRAYLEHPVTMLA

SEQ ID NO: 91969 - protein, 525 aa, Hordeum vulgare subsp. vulgare
  misc_feature (297)..(297): Xaa can be any naturally occurring amino acid
  misc_feature (331)..(331): Xaa can be any naturally occurring amino acid
MDMDQLCLMAVATILLTLILRQVLGGKGTGAKLPPGPWNLPVIGSLHHLVATKPPPHRALLSLSRRYGPVMLLRLGEVPNVIVSTPEAAVLVLKTNDLTFATRTSGPTLDVVGSASEGIIFAPYGEHWRQMRKVCVVELLSAMQVRRIQSIMQAEIAHLLESVAAASSASPFRSAVVDVGKGLARLTNNVIARAVFGGKSRQQEAYLRELGVMAILGGGFSLVDLFPSSRLVRWLSSSGRAMRRLHSRMQRILGDIIQDRKETRAPNGASDAATARDNEDLLDVLLRLGKQDALSFXLTSEIISAVIFDIFSAATDTTAATLEWAMAELVXNPQAMARAKLEVRQMLRHRRSSTITSADLAGLHYLRMVIKETLRLHPSAPLIHRASQENCRVMGYDIPKGTAVMINAFAVGRDPAHWGADAAEFRPERFQGTSVEYSSQGPHMEFVPFGAGRRQCPGALFATTMLELVLANLLYHFDWAIPGGESPEAMDMGEVFGIIVHTRSSLHLQASEACHLQDQTTGVVS

SEQ ID NO: 91970 - protein, 106 aa, Fagus sylvatica
TNPSNPLGTVMDRTTLRTVVNFINQKRIHLISDEIYAATVFSHPSFISVAEIIEQDTDIECDRDLIHIIYSLSKDMGFPGFRVGIIYSYNDSVVNCARKMSSFGLG

SEQ ID NO: 91971 - protein, 384 aa, Rubrivivax gelatinosus
MLPVLPPALLALADGTTFLGTSIGAPGRTVGEVVFNTALTGYQEILTDPSYCRQIVTLTYPHIGNVGVNEEDVEAAKVHAAGLVIKDLPLRVSNFRAAMPLSQYLEREGTVAIAGIDTRRLTRVLRTTGAQNGCIVSFAPGTVVGEAEIAAAVAAAKAAPSMAGLDLAQVVSADAPYEWTETSWQLGRGHGTLADAEFHVVAYDFGVKRNILRLLADRGCRVTVVPARTPAAEVFKLKPDGVFLSNGPGDPEPCDYAIAAAREIIDAGVPTFGICLGHQIMALASGAKTFKMKFGHHGANHPVKDLDSGRVSITSQNHGFAVDEKTLGANLRPTHVSLFDGTLQGLARTDRPAFCFQGHPEASPGPHDIGYLFDRFVALMQERA

SEQ ID NO: 91972 - protein, 105 aa, Fagus sylvatica
TNPSNPLGTILDKETLRMVVSFINEKSIHLVCDEIYAATVFSTQPDFISIAEIIQEEIECNHDLIHIVYSLSKDLGFPGFRVGIVYSYNDAVVNCCRKMSSFGLV

SEQ ID NO: 91973 - protein, 578 aa, Hordeum vulgare subsp. vulgare
MGGGNGIVDGFRRLFHRRTPSGSVLGSSNQSSAGEDSSELEAVEDLDLVGLRPIRVPKRKMPLPVESHKKNIMEKEFFTEYGEASQYQIQEVVGKGSYGVVAAAIDTRTGERVAIKKINDVFEHVSDATRILREVKLLRLLRHPDVVEIKHIMLPPSRREFQDIYVVFELMESDLHQVIRANDDLTAEHYQFFLYQLLRALKYIHGANVFHRDLKPKNILANADCKLKICDFGLARVSFNDAPSAIFWTDYVATRWYRAPELCGSFFSKYTPAIEIWSIGCIFAELLTGRPLFPGKNVVHQLDIITDLLGTPSSETLSRIRNEKARRYLRYMRKKHPVPLTQKFPNADPLAVRLLGRLLAFDPKDRPSAEEALADPYFASLANVEREPSRHPISKLEFEFERRKVTKDDVRELIYREILEYRPQMLEEYMKGGDQISFLYPSGVDRFKRQFAHLEEHYSKGERGSPLQRKHASLPRQRVGASNDSNNEQHISDQEMSAEPDAHGAVSPQKPQDAPGVGQNGLSPTSLSSRTYLKSASISASKCVVVNPNKQPEYDDAISEETEGAVDGLSEKVSKMHA

SEQ ID NO: 91974 - protein, 155 aa, Zea mays
GQGAPGVVFPLVKAYGVFHEDFLDHSAPGAAGVFWNRGLLKRVGISPGVRGKAFAFFSLSGLTGNVGSLSRAKVFPCFFLGKADQLLAGGALHGGVPPFSLFEGKGGMSSLFLARVDPFESRFPGYEFWDIFFPWALGGCWMILQSRKLCLFFFF

SEQ ID NO: 91975 - protein, 241 aa, Fagus sylvatica
RAESARGIAEIIQEEIECNHDLIHIVYSLSKDLGFPGFRVGIVYSYNDAVVNCCRKMSSFGLVSSQTQYLIASMLSDDEFVNKFIAENAISLANRHKVFTEGLAQVDIGCLKSNAGLFVWMDLRHLLKEQTFKAEMELWKVIINKVKLNVSPGSSFHCSAPGWFRVCFANMDDKTMDVALTRIVAFVHQNKETTVPMKKKCWQTNLRLSFSSRRVDDIMMAQCMMSPHSPLPQSPLVRARN

SEQ ID NO: 91976 - protein, 138 aa, Zea mays
PAGPGDPGGPRQFTHLARTQTQADSAITVSPRSRTRSLAHTRPAVRILFRCRHPLRRPLRPAAATRPVSIAMTTSRRLADRKISRFEKNITKRGSVPETAKKANDYPVGPILLGFFVFVVVGSSLFQIIKTASNAGLF

SEQ ID NO: 91977 - protein, 217 aa, Helicobacter pylori J99
MKVAPSLLSADFMHLAKEIESVSNADFLHVDVMDGHYVPNLTMGPVILENVTQMSQVPLDVHLMVENASFFVELFAPLNPQIISIHAENEKHPHRVLQLIKSSGITPGIVLNPHTHEESIKYLLESVGLVLLMSVNPGFGGQKFLDLVLEKCLKVKELIKRYNPSCLLEVDGGVNDKNIFELQQAGVDVVVSGSYIFESKDRKLAIEGLQNVRQPLA

SEQ ID NO: 91978 - protein, 55 aa, Glycine max
MFDNNIAKRVFVPSTAPKKGKDYPVGPVVPGFSAFVVIGSTLIQIIRPAKSGGMA

SEQ ID NO: 91979 - protein, 356 aa, Gaeumannomyces graminis
MSRAANPPSNSGSRKISFNVSEQYDIQDVVGEGAYGVVCSAIHKPSGQKVAIKKITPFDHSMFCLRTLREMKLLRYFNHENIISILDIQKPRSYETFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPQDVGSRLDLLEKLLAFNPVKRITVEEALKHPYLEPYHDPDDEPTAPPIPEEFFDFDKHKDNLSKEQLKQFIYQEIMR

SEQ ID NO: 91980 - protein, 243 aa, Oryza sativa
MVVGAGGGDELKLLGVWDSPYVNRVQIVLNLKGLSYEYVEEDLMNKSDLLLGSNPVHKKVPVLIHNGKPIAESRVIVEYLDEAFAAGAGGSTGASVLPSDPYERAVARFWAAYVDDKVGSPWYTILFARERGGKGGAAARAISALETVEAGAFRDRSSEGKTTNAAAAPFFGGDSIGFVDVVLGSYLGWFRVIEKMIGVRIMDAARTPRLAAWAERFEAADAVRGVLPDDVDKVIDFLQAFLH

SEQ ID NO: 91981 - protein, 403 aa, Halobacterium sp. NRC-1
MTHQTDVLVVGGGATGVGVARDLALRGVDVTLVDRGGLGSGTTGRSHGLLHSGARYADSTPADARECIRENEVLRDIAGACIRDTDGFFVQHARDDPAYFDTKVAACRDADIPVSVIDGATARAREPALTPAAERVAVVPDGVVLPSRLVAATAADARDHGATIRLHEPITALTTDAGRVTGARTADGTTLSATHVVNAAGAWAGDLAATAGVDVDMHPASGVMVTVETPETDTVFNRCRPAADGDIVVPHGSTAVLGTTSVDVDDADEFATPDAAVERVIDECSALLPAASDAPIRTTYWGVRPLYSPSDYGDDARAISRGFYVLDHADRDDTAGLTTVVGGKLTTHRLMAEATADLVADRLGVTEPSRTANEPLPGHDDPERLDALVDTFDAASPADADAR

SEQ ID NO: 91982 - protein, 488 aa, Oryza sativa Japonica Group
MPKPKAKRPTPPRAHRRSTAAGAGAGGLGLAAAAYVGVDYARRHLPPAWWRWHGRLQPALWGALALAAAARAPFYRRWDAELRAAPRFLAAMALMLAAFLCEAVSVRFVSTVLGLHWHRSTAPLPDTGQWLLLALNEKLPQIVVDLLRAPIISLHHYLMLFIMLGFSALFDCIKGPGLGIAARYMFTMAVGRSLRTVTFLATILPSARPWCAEARYQIPDHPHPWAQKYYAPYASDPDAIRRVIQEDMPYAFVKEYPREYRPKWGHMSFLVDILRPTVEEGSSWYHFLKKASGGCSDLMYSGHMLVAVLTAMAWTEAYGGWISVVIWFLVLHSAQREIRERHHYSVDCIVAIYVGILLWRMTGFIWSAIDNSHARRLAKLDKAETSGVFFWTINPRTCARRAFRPLTAPQSENENQGRDGQMISTTPSESKSLKKSRNRVQPTLSCRAVSIRADKNRGSVTKPNWPIRVLITFPNPWSTLTTIVHVDA

SEQ ID NO: 91983 - protein, 385 aa, Alteromonadales bacterium TW-7
MTNDVLNTLRHDINEIDSDLLVLLAKRRRISHGVVEYKIANNKPIRDEARELALLEKLIGYGKSLGLDAYYVNNVFQTILEDSVLHQQAMLQKNLNPDALSETHRVTYLGGQGSYSQLACHKYFSRRPGKLVEIGCSSFEEITSKVESGQADFGLLPIENTSSGSINEVFDLLQHAQVSIVGEVTHSVEHCLLAKPDTQLEQLTKVFAHPQPFAQCSRFLQGLGDLQHETCDSTSSALQSALSTPNSAAIGSAQAGKNVGLEVIKSNLANQSENHSRFIVVARKPLHVSNQIPTKTSLIMSTKQQAGSLADALMIFKQHKINLVKLESRPTPGNPWEEVFYVDLEANLADTKVKEALEELKEHTQYVRILGCYQSETLQAVSVNT

SEQ ID NO: 91984 - protein, 187 aa, Geobacillus kaustophilus HTA426
MSLVGKKVQPFRAQAYHNGEFIEVTEQDFMGKWSIVCFYPADFTFVCPTELEDLQDHYATFKELGVEVYSVSTDTHFTHKAWHDTSPAISKIEYVMIGDPSHQLSRMFDVLDEEQGLAQRGTFIIDPDGVIQAVEINADGIGRNASTLIDKIKAAQYVRNHPGEVCPAKWKEGAETLKPSLDLVGKI

SEQ ID NO: 91985 - protein, 406 aa, Oryza sativa Japonica Group
MAATIQSVKARQIFDSRGNPTVEVDICCSDGTFARAAVPSGASTGVYEALELRDGGSDYLGKGVLKAVDNVNSIIGPALIGKDPTEQTVIDNFMVQQLDGTKNEWGWCKQKLGANAILAVSLALCKAGAIIKKIPLYQEFMILPTGASSFKEAMKMGVEVYHNLKSVIKKKYGQDATNVGDEGGFAPNIQENKEGLELLKTAIEKAGYTGKVVIGMDVAASEFYTEDQTYDLNFKEENNDGSQKISGDSLKNVYKSFVSEYPIVSIEDPFDQDDWVHYAKMTEEIGDQVQIVGDDLLVTNPTFPCWLQYSNQFDLQRVAKAIKDKACNALLLKVNQIGSVTESIEAVKMSKRAGWGVMTSHRSGETEDTFIADLAVGLSTLLRIEEELGAAAVYAGAKFRAPVEPY

SEQ ID NO: 91986 - protein, 214 aa, Zea mays
  misc_feature (84)..(84): Xaa can be any naturally occurring amino acid
  misc_feature (117)..(117): Xaa can be any naturally occurring amino acid
  misc_feature (122)..(122): Xaa can be any naturally occurring amino acid
  misc_feature (142)..(142): Xaa can be any naturally occurring amino acid
  misc_feature (172)..(172): Xaa can be any naturally occurring amino acid
  misc_feature (180)..(180): Xaa can be any naturally occurring amino acid
  misc_feature (187)..(187): Xaa can be any naturally occurring amino acid
MSAYCGKYKDELIKNAAYIGTPGKGILAADESTGTIGKRLSSINVENVEENRRALRELLFCCPGALQYISGVILFEETLYQRTXDGKPFCDVPPGREAPSLGIRLTRGTIEVLCTDXGNTTXGHDDLGKRCAQYYEAGARFXAKGGAVLKMGPMNHQSLHRPDVQGLVPFAXICQENGLXPIVDPEXLWGGPQELDRGLNTMKTPLCAGKRGSK

SEQ ID NO: 91987 - protein, 170 aa, Geobacillus kaustophilus HTA426
MDLKQYITIVPDFPKPGIMFKDITTLMDNGPAYKYATDQIVQYAREKQIEIVVGPEARGFIIGCPVAYALGVGFAPVRKEGKLPREVVRVEYGLEYGTDVLTMHKDAIKPGQRVLITDDLLATGGTMRATIDLVEQLGGVVAGLAFLIELTELGGRKKLEGYDILTLMQF

SEQ ID NO: 91988 - protein, 184 aa, Brassica napus
MAVQPTRIGLAGLAVMGQNLALNIASKGFPISVYNRTTSKVDETVERAKKEGNLPVYGFHDPESFVNSIQKPRVIIMLVKAGAPVDQTIKTLSAYLEKGDCIVDGGNEWYENTERREKAVAENGFLYLGMGVSGGEEGARNGPSMMPGGSFEAYKNIEDILLKVAAQVRDRGPCVTYIGKGGSG

SEQ ID NO: 91989 - protein, 362 aa, Robiginitalea biformata HTCC2501
MNSSNYYAVLMAGGVGSRFWPVSTRQFPKQFHDMLGTGQSLLQRTFSRLARFIPEEQILILTNTRYNDLVLEQLPGLSPEQIIGEPAMRNTAPCILYAAMKIRKMNPEALMLVAPSDHWIEDEAAFERDVTACFSQCADHQTLCTLGIQPTFPNTGFGYIEFDAGGNAPRELRDVVQFREKPDYQTAKGFLQQGNFLWNAGIFAWSAKGILEAFRHYQPGLFELFEKGLESFNTEGESEFIERYYPTAENISIDYAIMERSDSVKVLPASFDWNDLGTWGSLYDKMEKDRQDNAVAQGRVLSRDSSGNMVRLPGEKVAVLEGLKDYIVIDKPEVLMIIPRDREQEIKQWVAEVGDTFGDEYI

SEQ ID NO: 91990 - protein, 353 aa, Daucus carota
MHMYYSQHAYDKFFLLGFIYFRYNMAHNKEKQSTEEFKDTSKTKAKWTLNTTHIFCDVCISAINKGLRPSTHFNSEGWKFVVSNFQKLSGLNYEKPKLKNKWDLMRSEWKLWKELIGKETGLGWDPRLETVDASPDWWKAKIQMNKEYARFQKKGIDPDIVSKNDFMFGSTVATGEFAWAPSSDADVLGKKDQNEDDIISLNDSADDPLQKSMDRFLQEDDIISDDNSNIGKKRKTRKRNIESGQGTSTNAKDKGKKQRMSGASKLRSDISKLVETVEKRSGISEVGYTIKEIMDDLHAIPDVPKNTELYYFAVTMFEQKAKRELWKHLETTEAKVGWLKYQKEQQDMRNSKY

SEQ ID NO: 91991 - protein, 346 aa, Bacillus licheniformis ATCC 14580
MTKVSILGAGSWGTALALVLADNQYDVCIWGHREELIQQINEHHENKDYLPGVKLSENVRATTDLEAAVADVKTIIVAVPTKAIREVLAQAVSFINQKAIFVHVSKGIEPDTLLRISEMMKEEIPAELREDIVVLSGPSHAEEVGLRHPTTVTVSADSSIESAQAIQDMFMNQNFRVYTNPDMIGVEIGGALKNVIALAAGITDGLGYGDNAKAALITRGLAEIARLGTKMGGNPLTFSGLTGIGDLIVTCTSVHSRNWRAGNMLGKGFKLDEVLEEMGMVVEGVRTTKAAYQLSKKFDVKMPITEALHKVLFDGEKVETAVESLMARVKTHEMEDLVNTFENQMK

SEQ ID NO: 91992 - protein, 456 aa, Candida albicans SC5314
MGEIIKYKGFDHVWQYSGPWLYCLIGIYISLPVLAYHILPWIFHKNRSNKRKTISIFVLGDLGHSPRMCYHASSFSKLDYYVNLCGYVETEPSHQIVDDVNIDIIPIEAIKNTNNLPYIMFAILKVVRQCGKIWSILWDTRGSDYIMIQNPPSIPILLIVILFKTVFSRETKLIIDWHNLNYTILNLRYNNLNHPFVKLVKLYEKILGQFANLNITVTKSMKKYLVKEFGFQKSKIVTLYDRPGVQFQPLSNKREFMSEHKLFEDIDIEKYKVLISSTSFTPDEDFNILLDALKNYENTPNTPPILLIVTGKGPLKGKFLETVDKLEFTNKVCVKSAWLSSEDYPKVLACADLGISLHTSSSGIDLPMKIVDFFGCGVPVVSLDFPAIDELVKNKVNGLITNSKSDQTKEVARLVTEVFTDDALLRSIKEGALEESNSRWDENWMQTFSSIFENKS

SEQ ID NO: 91993 - protein, 436 aa, Halobacterium sp. NRC-1
MNGNTGVVSGVRVSHETASLDELAAASAASTEAALDALLEQPPVEEAFVLQTCHRVEAYVVTADQASGRRALGGAGFNPAGGGAISMGHEDSLRHLLRVAAGLESLVVGEDQILGQLRDAYDAAKDAGGIDHVLREAVTKAMHVGERARTETAINEGATSLGTAAVRLAERKTQLADARAVVVGAGEMGALAAKAFASATVAEIVIANRTPARAVRVADMVSVPAEATTLADARGRLDAADVVVTATGSPEHVLPASAFADAGDTVVVDLAQPRDVAPGAGGHDGVAVHDLDDLEAVTAATRERREDAAREVEAMIETEFERLLTQYKRKRADEVIARMYESADRLKSREVQTAVHRLEAESGSLSADEREVVESMADALVSQLLAAPTKSLRDAAAEDDWSTIATALELFNPEFEDGMPFDASRGGDAASAESED

SEQ ID NO: 91994 - protein, 387 aa, Physcomitrella patens subsp. patens
MESNGKAQERKQRWILVTGGAGYIGAHTVLQLLVEGYSVLIIDNLDNSCEEAVHRVRKLAGECGENLKFFEVCSLALRPRLVVCHEREMFSQLIIGRFEAVIHFAGLKAVGESVSKPLRYYSNNLVSTINLMEVMSKNNCKNLVFSSSATVYGQPESVPCTEDYPLHVTNPYGRTKLINEDIMRDVHHADPEWKIVLLRYFNPVGSHPSGEIGEDPMDYPNNLMPFVQQVAVGRKEVLTVFGQDYPTRDGTGIRDYIHVMDLASGHTKALDKLFTTPDIGCAVYNLGTGKGTTVLEMVAAFVKASGKEIPLKYAGRRPGDCREVYAATEKAEKELGWRAKFGIADMCRDQWNWAKKNPYGYRGHQELEVHAQKFIKSEPLSNRHWAL

SEQ ID NO: 91995 - protein, 226 aa, Hordeum vulgare subsp. vulgare
SLQAFIVHHPNGVAFYGVVLDGPGGSVATVTEYMANGSLRQALQRHEKIFDRRRRLLIVMDVAFGMEYLHGKNIVHFDLKSNNLLVNLRDPQRPICKVGDLGLSKVKCQTLISGGVRGTLPLMAPELLNGSSNLVSEKVDVFSFGIVMWELLTGEEPYADLHYGAIIGGIVNNTLRPLVPESCDPQWRSLMEQCWSAEPTERPSFTEVVKRLRAMATSPTKPLLQK

SEQ ID NO: 91996 - protein, 268 aa, Solanum lycopersicum
GYLMATLFYEPSTRTRLSFESSMKRLGGEVLTTENAREFSSAAKGETLEDTIRTVEGYSDIIVMRHFESGAARRAALSASIPIINAGDGPGQHPTQALLDVYTIGREIGKLDGINIALVGDLAYGRTVRSLAHLLALYKDVKIYFVSPDVVKMKDDIKDYLTSMGVRWEESADLIEVASKCDVVYQTRIQRERFGERVALYEEARGKYIVDMSAVNAMQKHAVVMHPLPRLDEITVDVDGDPRAAYFRQAKNGLYIRMALLKLLLLGW

SEQ ID NO: 91997 - protein, 404 aa, Oenococcus oeni PSU-1
MTKLTVKDLDLKGKKVLMRVDFNVPIKDGVIGNDNRVVAALPTIKYVLEQGGKAILFSHLGRIKKAEDKPGLSLAPVAKHLSDLLNQEVVFPGKTEGKELEDAIDKLKDGQVLMVENTRYEDVDANGEYVKRESGNDPELGKYWADLGDDLFVNDAFGTAHRSHASNVGIASNVSKTAAGFLMEKEIKYLDEAVNNPKRPFVAVLGGAKVSDKIEVIKNLLSKADKVIVGGGMSYTFSNAKGVKIGNSLFEADKVSLAKEIMKEAGDKLVLPEDSVAAESFANDVPTKVFENGIPDGWMGLDIGPKTIEKFKNTLKGAKTVVWNGPMGVFEMSNFANGTLELGKFIGSLTSEGAATIVGGGDSTAAVSQLGIADQFTHISTGGGASLEYLEGKTLPGIAAISDK

SEQ ID NO: 91998 - protein, 810 aa, Magnaporthe grisea 70-15
MPSAVAGHRPTTKVGNKPFKSRKATKGAIRTLAKGKVPTEKGQRKTQHQQVMSKLDRRNQSRQKLLNKQREHRSDNQVFAGRDGAPRNVAVIPLCADGDAADAIRSLNLSLDIETEVSPGCTRVSVDRFKQKLAYFPVVRDLATCLDAARVADFVVLVLSAEVEVDQLGELILRSVESQGVSTVFTVVQGLNKVEPVKQRLSIVDSLKSYIKYYHPDQDKIYSLDNRQECSNLMRSVCSTTPKGVVWRDERSWMLVEDVQFPASESDLTVVTGVVRGKGLKADRLVQVGDWGTFQIEKIMAAPLSTKKAKEGSMAVDDAPSQEPLDVPTDDRDDLDELAPEEIVMEDDDEMDDAQTSASAPTKKGVLLDDHHYFSDDEEGQPQIRKRLPKGTSKYQSAWYLDDGVSDSGSDLEDLDMEDDAQSEAAPRPEDGVEGMAMDAQTEYGASEYPQSEMFVEPNEDEDAKQLEAYRASRRDEAEDDKEFPDEIELHPNVLARERLARYRGLKSLRTSKWEEEEDRAHEPEDWRRLLQVPDYNGSKSRCTREALVGGVAPGTRVAVHLKGVPASVAASYDGRKPITMFSLLRHENKQSVVNFLINLSSEFPRSLKAKEELVIQYGPRRLVINPLFSQGGNTPNDVHKYGRFLHPGQSAVATFVGPVIWGPVPALFFKKQEGSDDLSLTLVGTGTALPPSTGRVVAKRVILTGHPYHIHKKIVTIRYMFFNREDVEWFKALPLWTRRGRSGYFKEALGTHGYFKATFDGRINPQDSVGVSLYKRVWPRKSVPFRGELVGAEEAPKLVEAGAMDEDIA

SEQ ID NO: 91999 - protein, 250 aa, Medicago truncatula
MPIRNIAVGTPQEATHPDTLKAGLAEFISTFIFVFAGSGSGIAYNKLTNDGAATPAGLISASIAHAFALFVAVSVGANISGGHVNPAVTFGAFVGGNITLLRGIVYIIAQLLGSIVASALLVFVTASSVPAFGLSEGVGVGPALVLEIVMTFGLVYTVYATAVDPKKGNIGIIAPIAIGFIVGANILVGGAFTGASMNPAVSFGPAVVSWSWSNHWVYWAGPLIGGGIAGLVYEVLFINSTHEQLPTTDY

SEQ ID NO: 92000 - protein, 396 aa, Alteromonadales bacterium TW-7
MFSVLKPLPTDPILGLMAAYKKDTNPNKIDLGVGVYKDEHGNTPVLNAVKKAEAFRLENETSKSYIGLAGNLDYCQKMEQLLLGEHQALLANRVRTAQAPGGTGALRVAAEFIKRCNTDATVWVTTPTWANHISLFEAAGLTVKEYPYYDYENKDLLFDEMINTLKQVPKGDVVLLHACCHNPSGMDLNEAQWNTVAELAKEVGFTPLVDIAYQGFGSSLEEDARGLRILADAVEELIICSSCSKNFGLYRERIGACSLIAKDSATADVSNSVMLSVVRSIYSMPPAHGADIVNTILSSTELTQMWHAELDEMRTRINGLRSLIKESLASKDIAQDFSFIERQHGMFSFLGINKEQIERLQKEYGIYIVGSSRVNVAGVSKANLDYFANAVADVCK

SEQ ID NO: 92001 - protein, 477 aa, Nocardia farcinica IFM 10152
MSVLLVGVSHRSAPVSVLEKVAITDADRPKLIDKMLASSHISEAMIVSTCNRVEVYAVVDAFHGGLAEVGELLTRHSGLAMPDLTKHAYVRYSEAAAEHLFAVASGLDSMVVGEQQVLSQIRGAYATADAQQAVGRTLHELAQHALRVGKRVHSETGIDRAGASVVSVALDRAAQVLGDLAGRTAVVVGAGAMGGLSVAHLARAGIGRIIVVNRTIERARRLAETAASYGVESSALELDRLHEAMSAADVVLSCTGAVGAVVTLADTHRALADRDRAEFPAGDRPLVFCDLGLPRDVEPAVAGLPGVAVIDIESLQRDPAAGAAADDTAAARSIVAEELAKYLAGQRMAEVTPTVAALRQRAAEVVEAELLRLDSRLPGLAEPERDEVARTVRRVVDKLLHAPTVRVKQLASTPGGDSYAEALRELFELKPGAAQAVAAPMEITAIGPDRTAGLADDFTPGHRLDFEQHLGEEGKPA

SEQ ID NO: 92002 - protein, 225 aa, Brassica napus
  misc_feature (197)..(197): Xaa can be any naturally occurring amino acid
  misc_feature (206)..(206): Xaa can be any naturally occurring amino acid
  misc_feature (212)..(212): Xaa can be any naturally occurring amino acid
FVCGLSVFADKIYSKMGEGTFGQVLECWDRERKEMVAVKIVRGVKKYREAAMIEIEMLQQLGKHDKGGNRCVQIRNWFDYRNHICIVFEKLGSSLYDFLRKNNYRSFPIDLVREIGWQLLECVAFMHDLRMIHTDLKPENILLVSSDYVKIPEYKGSRLQRDVSHKRVPKSSAIKVIDFGSTTYERQEQSYIVSTRXHYRAPEVIXGLGWSXPCDVWNIGCIIVE

SEQ ID NO: 92003 - protein, 501 aa, Pseudomonas putida GB-1
MTKQTIPAAPPCTLFLFGANGDLVKRLLMPALYNLSRDGLLDRNLRIVGVDHNAASAANFAERLQAFMRERDKGREGGDQCLDDKLWARLAKRLDYQTGDFLDPATYQAIAKRIEKTSHGNAIFYLATSPRFFPEVAQRLGQAGLLDESAGGFRRVVVEKPFGTDLASAEALNACLLKVMGERQIYRIDHYLGKETVQNILVSRFSNGLFESFWNNHYIDHVQITAAETVGVETRGAFYDSTGALRDMVPNHLFQLLAMVAMEPPAAFGADAVRGEKAKVVGAIRPWSAKMALKNSVRGQYSAGKQGRKQLPGYRQEANVAPESQTETYVALKVMIDNWRWAGVPFYLRTGKRMSVRDTEIAICFKPAPYAQFRESELERPKPNYLKIQIQPNEGMWFDLQAKRPGPELVMENVELGFAYKDFFKMTPATGYETLIYDCLTGDQTLFQRADNIENGWRAVQPFLDAWAQGGDVHGYPAGEDGPEAGNELLARDKREWHRLG

SEQ ID NO: 92004 - protein, 336 aa, Magnaporthe grisea 70-15
MVKCGINGFGRIGRIVFRNAIEHPDCEIVAVNDPFIEPKYAKYMLEYDSTHGRFKGTVEVSGSDLVVNGKKVKFYTERDPANIPWSETGAEYVVESTGVFTTTDKASAHLKGGAKKVIISAPSADAPMYVMGVNEKSYDGSASVISNASCTTNCLAPLAKVINDKFGIVEGLMTTVHSYTATQKTVDGPSAKDWRGGRGAAQNIIPSSTGAAKAVGKVIPALNGKLTGMSMRVPTANVSVVDLTCRLEKGASYEEIKAAIKEAADGPLKGILEYTEDDVVSSDMIGNNASSIFDAQAGIALNDKFVKLVSWYDNEWGYSRRVIDLVTYISKVDGGK

SEQ ID NO: 92005 - protein, 520 aa, Zea mays
MERFYYVAVATFVLVFLLHHLLTRKKQQRLPPGPRFAYPILGHLPLLKKPLQTSFADLVSRHGPIIHLRLGRRHAVVVGSAAVAKECFSGELDVAIANRPHFPSAREVTFDYSVLTAVNYGALWRTMRRVSTVHLLSAHRVNVMSDTVIARELRVMVRRLARASASAPGDAARVELKRRLFDLSHSVLMEIMAQTRNTYSDDPEEDMSREARDMKDIIEEIIPLVGAANLWNYVPLLRWLDLYGAKRKLADVVNRRDLIFDNMIGAERQKLRQLERKKGEAHASESDKMGMIGVMLSLQKTEPDVYTDTFINALVSNLLAAGTETTSTTLEWAMSLLLNHPDVLKRAQEEIESNVGRDRLLDKNDLPRLPYLHCIISETLRLYPPTPMLLPHEASTDCKIHGYDVPAGSMVLVNAYAIHRDPAMWEDPEEFRPERFELGRAEGKFMMPFGMGRRRCPGENLAMRTMGLVLGALLQCFDWTRVGDREVDMATATGTIMSKAVPLEAQCKPRANMSAVLQKI

SEQ ID NO: 92006 - protein, 575 aa, Oenococcus oeni PSU-1
MAETKKLTGIAASDGVGIAKSYLLVDPSLAFPYNEKIKDVAAEESRLDKALSASKDDLKKIEAKAEKNLGKEEAEVFQAHITILSDPELVSGIKAQIEHKQINAESALKNVTDNYIATFETMTDNAYMQERAADIRDIAKRVTSHLLGIDLPNPALIDEEVIIVAHDLTPSDTAQLDPTFVKGIVTDIGGRTAHASIMARSLEIPAVVGIGNAISEIKNHVNIIVDGGAGQVLIDPNEEEEVVYARKVGEYFARKREQAKLKNQTTESADGKHFDINANIGSPKDLDSVIESGAEGIGLFRTEFLFIDSDHLPTEDEQFSAYKAALQAVDGKPVTIRTMDIGGDKQLSYWKLPKEDNPFLGYRAIRISLKQDDIFRTQLRALLRASVYGNLWIMFPMIATLPEFRQAKKIYEEEKDKLLSKGTKIADDIKLGIMVEIPASAVLADKFAKEVDFFSIGTNDLIQYTMAADRGNDSVSYLYQPYNPAILRLVHNVIDAAHKENKVVAMCGEMAGDPVAVPVLVGLGLDEFSMSASSVLPTRSLIKHLKFSDMKKLAIESLDKDTNQEVIDLVKNSIK

SEQ ID NO: 92007 - protein, 278 aa, Daucus carota
MHMYYSQHAYDKFFLLGFIYFRYNMAHNEEKQSTEEFKDTSKTKAKWTLNTTHIFCDVCISAINKGLRPSTHFNSEGWKFVVSNFQKLSGLNYEKPKLKNKWDLMRSEWKLWKELIGKETGLGWDPRLETVDASPDWWKAKIQMNKEYARFQKKGIDPDIVSKNDFMFGSTVATGEFAWAPSSDADVLGKKDQNEDDIISLNDSADDPLQKSMDRFLQEDDIISDDNSNIGKKRKTRKRNIESGQGTSTNAKDKGKKQRMSGASKLRSDISKLVETVE

SEQ ID NO: 92008 - protein, 664 aa, Vibrio cholerae O1 biovar eltor str. N16961
MYNDRHLSLFHLLFRAKIQRAINYFFMITFSEIQLLRGGKPLLEQASATIHPGDKVGLVGKNGCGKSTLFALLKDELTIDAGSFSKPAHWELAWVAQETPALDRTALEYVIDGDREYRELERQLMDAEAADNGTKVADLHGKIEMVGGYSIRARASELLDGLGFTQEQMSWSLTQFSGGWRMRLNLAQALICRSDLLLLDEPTNHLDLDAVMWLERWLQSYPGTLILISHDRDFLDPIVNRIVHIENQTLNEYTGNYSSFETQRAQKMLQQQAIYQKQQKQMAHMQSYIDRFRYKASKARQAQSRIKALERMEKVLPAQFDNPFSFEFREPAALPNPILMMDQVAAGYGDHLILEKIRLNLVPGSRIGLLGRNGAGKSTLIKLLSGELKPQSGDCTYSQGVKIGYFAQHQLETLHPEETPLQHMMQIAPDKNELELRNYLGSFGFHGEKALEKVAPFSGGEKARLVLALIVWQKPNLLLLDEPTNHLDLDMRQALTLALQSYEGAMVIVSHDRYLLRATTDDLYLVHDHQVGPFDGDLNDYYKWLTDQQKAERKETQPTNTANSANSAAAKKEQKRREADFRKLTAPIRKKLTQLEEKLDKLNHVVSEMEAQLSDTSLYEAQNKATLTEVLAKQAAAKSELEQVELEWMAEQETLEEMERKFNG

SEQ ID NO: 92009 - protein, 512 aa, Mycobacterium avium subsp. paratuberculosis K-10
MLSKCSALSAVGAGHDGSPEDSPEERDQMTVQAVLDDIRKRPGTGDVIAVIDPATEEKITEFTDCGAEAVDEAAARAKASFESGVWSQLPGRERAKILWRIGDLIDEHAEEFAQLDSLNTGMPLLQAQLQMSTCSEFFRYYAGWCSKINGTAYDVKTDGIATDTFVNMHAYTLKEPYSVVGLIFPWNGPIFNANAKLAPALAAGCSLLVKPAEETPLSALLLDRLVHEAGVPEGVVNLLTGYGHTAGAAITAHPDVEKVAFTGSTEVGKEIVRASAGNLKKVTLELGGKSPVLIFDDADLDKAILMASLGIFVHSGQGCVCGSRIFVQRGVYDRVVEGIAMMANTFKLGAPSEEGCVSGPLISQKQLNRVMGFIDEGKNDGVEVVTGGYRLDRKGYFVHPTVLTNVDPGMRLYQQEIFGPVVAILPFDDEDEAVAMANDTTYGLAATAWTENLGRAHRIVKRLQAGSVQVNCQLVFDHDVPFGGYKQSGWGHEFGKEGLEIYLKTKSVWAQL

SEQ ID NO: 92010 - protein, 289 aa, Vibrio cholerae O1 biovar eltor str. N16961
MSAKHPIIAVTGSSGAGTTTTSEAFRKMFNMMSIKPAWVEGDSFHRFTRPEMDVEIRKAREQGRHISYFGPQANDFPTLEEFFRQYGKVGTGQVRRYLHTFDEAVPYNQMPGTFTPWQSLPENSDVLFYEGLHGGVVDGDVNVAQHVDFLIGMVPIVNLEWIQKYVRDTRDRGHSREAVMDSIVRSMDDYLKFITPQFSRTHINFQRVPTVDTSNPLNAKGIPTLDESFVVIRFRGIKNVDFPYLLAMIDGSFMSRHNTIVVPGGKMSFAMDLIVRPLLQQLIETGKIG

SEQ ID NO: 92011 - protein, 434 aa, Geobacter metallireducens GS-15
MNIVVVGLSHKTASVDIREKVAFAPTQMEKPLRALLAIEDIAEAVIVSTCNRVEVYISTRDIAGGMARIKRFLADYHGISPEILEPHLYAHHGEAAIRHVFRVASSLDSMVVGEPQILGQIKTAYGYAAEFKTSGIILNRFLHKAFSVAKRVRTETKIASSAVSVSFAAVELARKIFGNLSDKTVMLIGAGEMCELAAKHFINNGVRGVMVTNRTYERAVKLAEEFEGKPVSFDDLFDQLHKADIVLSSTGATQFIIKPKDVEEVIRRRKLKPMFFIDIAVPRDIDPKVNDVENVYLYDMDDLQGVVASNLQQRAEEAKKAEAIIDEEIGQFHKWLSNLEVTPTIVALRSKFEETRKAELEKTLASWKDLPPDGAKRLEALTTAIVNKLLHPPTATLKRVGQGGRTDLYVDALRTLFELQTGESEAEELGELEE

SEQ ID NO: 92012 - protein, 131 aa, Glycine max
MVSRVHKRIAMYRNLQLLRSIRYSNSRLKALLLLELSDYIQGLKQKLEELNQLLTVATARKIADYDPMPKLEVETQEEAFVIKVLSESSCQGLLVFILEAFEEMGLDVLQARVSCADSFSLEAIGNNKVIM

SEQ ID NO: 92013 - protein, 483 aa, Neisseria meningitidis FAM18
MLIHYISPSYRFPVSDDIRSERKTTIMSNPFSSLGLGTELVSALTAQGYENPTPIQAAAIPKALAGHDLLAAAQTGTGKTAAFMLPSLERLKRYATASTSPAMHPVRMLVLTPTRELADQIDQNVQSYIKNLPLRHTVLFGGMNMDKQTADLRAGCEIVVATVGRLLDHVKQKNISLNKVEIVVLDEADRMLDMGFIDDIRKIMQMLPKQRQTLLFSATFSAPIRKLAQDFMNAPETVEVAAQNTTNANVEQHIIAVDTIQKRNLLERLIVDLHMNQVIVFCKTKQSVDRVTRELVRRNLSAQAIHGDRSQQSRLETLNAFKDGSLRVLVATDIAARGLDIAELPFVINYEMPAQPEDYVHRIGRTGRAGADGVAISLMDESEQKMFESIKELTGNKLLIERIEGFEPQWWEQGGAKPEKTEMREPRQRNRYESARAQREKNTRPETTANDAGAACGKIAGRSRRSRREHRTCALLQPRYGVK

SEQ ID NO: 92014 - protein, 715 aa, Marinobacter sp. ELB17
MIYEGKAITVKEIEGGIAQLNFDLQGESVNKFNRLTLEELRNATKILTSRTDLKGLVVTSSKDSFIVGADITEFKDLFSGPEDELVANNLSANEIFSAIEDLPFPTVTAINGIALGGGFEMCLATDYRVMAPKAKVGLPETKLGIFPGFGGTVRLSRLIGVDNAVEWISGATENRADVALKVGAVDAIVEPDKLVDAALSIIHQVNNGKLDNLARREEKKGKIKLNVMESMMAFEISKAFVGAKAGKNYPAPVEAIKVMQKHAGMTRDKAIEVEAKGFAKMAKTDVSASLIGLFLNDQELKHKAKRWAKDAADVKLAAVLGAGIMGGGVAYQSALKGTPIIMKDINPEGIALGLKEAKKLLLKRIDKGRMKPDQMADVLNSITPALNYGDFKNVDLVVEAVVENPKVKDTVLREVEGQVREDTILTSNTSTISIDLLAKNLKRPENFCGMHFFNPVHMMPLVEVIRGKKTSDRAIATTVAYATAMGKTPVVVNDCPGFLVNRVLFPYFGGFIGLVRDGADFQKVDKVMEKFGWPMGPAYLLDVVGMDTGKHAGEVMAEGFPDRMKHEGTTAIDVMFDNKRYGQKNEKGFYRYELDRKGKQQKVVDEESYKLLKPVVQGDKEFEDDEIIARMMIPLCLETVRCLEDGIVESPADADMGLIYGIGFPPFRGGALRYIDQIGVDKFVELADKYADLGPLYQPTDKLREMAKNGQTFFA

SEQ ID NO: 92015 - protein, 255 aa, Geobacter metallireducens GS-15
MSPLHRFSRTEILIGPEKLQRLRESTVAIFGLGGVGSFAAEALCRAGVGRLVLVDFDDICLTNVNRQLHAMDGTVGKAKVQVMAERLRLINPDADIVPHKDFYEAGNSDFLLSGGYNYVVDAIDHITSKLHLIRSCRERELRIISSMGAANKLDPTKIRVADISKTSVCGLARVVRKQLRRQGIKSGVTVVYSTEEPREQAIADAGCRSNCICPNKEEQRFSCEHRRNILGSISFIPSIFGLTMAGVVVNDLAKD

SEQ ID NO: 92016 - protein, 453 aa, Atriplex hortensis
MSSYDPENAATNGVPPVKNDNSNHQQQHQQTVVVPETAHQISTDSWLQVGFVLTTGINSAYVLGYSGAIMVPLGWIPAVLGLIAATLISLYANSLVAKLHEYGGKRHIRYRDLAGFIYGPKAYSLTWALQYINLFMINTGFIILAGSSIKAAYHLFTDDPALKLPYCIIISGFVCALFAIGIPHLSALRIWLGVSTFFGLIYIIIAIALSLKDGINSPPRDYSVPTERGKVFTTIGAAANLVFAFNTGMLPEIQATVRKPVVGNMMKGLYFQFTAGVVPMYAIVFIGYWAYGNKTDSYLLNNVHGPVWLKALANISTFLQTVIALHIFASPMYEYLDTRFGITGSALNPKNLGSRVLIRGGYLAVNTFVAALLPFLGDFMSLTGAISTFPLTFILANHMYFKAKRNKLSMAMKIWLWINIVFFSCMAVASFIAALRLIATDSKQYHVFADLEG

SEQ ID NO: 92017 - protein, 267 aa, Triticum aestivum
SSRRAMSSPASRWTRAPSSLLEPTVRTTTQGFDDLGKRCAKYYEAGARFAKWRAVLKIGATEPSQLSIDQNAQGLARYAIICQENGLVPIVEPEILVDGPHDIDRCAYVTEIVLAACYKALNDQHVLLEGTLLKPNMVTPGSDSKKVAPEVIAEYTARTLQRTVPAAVPAIVFLSGGQSEEEATLNLNAMNKLQTKKPWNLSFSFGRALQQSTLKAWSGKTENEEKARAAFLVRCKANSEATLGTYKGDATLAEGASESLHVKDYKY

SEQ ID NO: 92018 - protein, 339 aa, Saccharophagus degradans 2-40
MNSALKPEWSAVRAIVIAWPYEDSDWQDNYAQAEQCYWAMLIAFSTYSDVWVLLHSSISKAQWLEDLDKEFGRSAANARRCAVSVIDSIDYDDTWIRDYGPLTTHSDYVSFCFNGWGGKYPAALDTLVGKKLQPWLGDVVRESEYFFEGGALEINDSGVLLANKDCVIDTHRNPGLNQAAVEAILAKELGVKAFAWLEGIQLTGDDTDGHIDTIARYVANDSVVYSGPNPSHPDAAALLALKSQISALAAVHNWQLAELPTPIVYSQVEEGQLLPATYANFLICNDVAFVPVYGVSEDQIAVDVLTTAMPNKTIVTVRCEALLEQHGSLHCATMQIGAI

SEQ ID NO: 92019 - protein, 331 aa, Triticum turgidum
MTQNLGISVPIMSSSPMFANAPPEKKGVKNFAIDFLMGGVSAAVSKTAAAPIERVKLLIQNQDEMIKAGRLSEPYKGIGDCFGRTIKDEGFGSLWRGNTANVIRYFPTQALNFAFKDYFKRMFNFKKDKDGYWKWFGGNLASGGAAGASSLFFVYSLDYARTRLANDAKASKGGGDRQFNGLVDVYRKTLKSDGIAGLYRGFNISCVGIIVYRGLYFGLYDSLKPVLLTGTLQDNFFASFALGWLITNGAGLASYPIDTVRRRMMMTSGEAVKYKSSLDAFQQILAKEGAKSLFKGAGAKLLRAIAGAGVLSGYDQLQILFFGKKYGSGGA

SEQ ID NO: 92020 - protein, 224 aa, Brassica napus
MESLGLRAVGSHCSLSEMDDLDLNRALDRPRLKIERKRSFDERSMSELSRHDSPRGRSVLDTPLSSARNSFEPHPMMAEAWEALRRSMVFFRGLPVGTLAAVDNTTDEVLNYDQVFVRDFVPSALAFLMNGESDIVKHFLPKTLQLQDSEKRVDRFKLGKGVMPASFKVSHDPIRETDHLVADFGETAIGRVDPVDSGFWWIILLRAYTKSTGEFESLGRTPEV

SEQ ID NO: 92021 - protein, 304 aa, Shewanella sp. MR-4
MPEQALLEEVVDKVRPLLGQGKVANYIPALANVDAGKLGIAVTTIDGETIGAGDYLEPFSIQSISKVFSLTLALTLYEETEIWSRVGKEPSGHSFNSLVQVELERGKPRNPFINAGALVIADLLQSRLGAPKHRMLELVRALSQNDKVCFDKQVADSEYQHSARNAAIAYLMKSFGNFQGDVDTVLRTYFHYCALKMNCADLSRAMLYLANRGKTLDGTELISQVQTRQLNALLATSGLYDGAGEFAYRVGMPGKSGVGGGIIAVIPGELSVCVWSPELDNQGNSLAGTAMLEHLSQRLGRSIF

SEQ ID NO: 92022 - protein, 273 aa, Nocardia farcinica IFM 10152
MTRIAVIGGGRIGEALIAGLLESGRASKDLVVVETHQDRAELVASRFGVRVTAEVADAAIGADLLVIAVKPGDVDTVLTQLGKAELNAGDVDQVLVSLAAGVPTARLEAKMPAGFPVVRVMPNTPMLVGQGMIVLAPGRYTKPSQLELVTEVLGTVGKVVTVAESQMDAVTAVSGSGPAYFFLVVEAMIDAAVSLGLSRDIATDLVVQTMVGSAALLDEAEQSAVELRAAVTSPAGTTAAALRELERAGVRSAFLEALHAAKERSAEQGASAE

SEQ ID NO: 92023 - protein, 263 aa, Vibrio cholerae O1 biovar eltor str. N16961
MTPTALFQSLWNDYIERLCPSADRVHQLLQEDEPLINDHIALRTFNLAPLGLETLAKPFLALGYQACGEYEFKSKKLFAKHFEHPDPLQPKVFISELKVEECSPELQAIVEKLVAQVQPQALASEAFLYGGRLWSLSHADYLTLAKESEYAAWLAAHGYGANHFTVSVNQLNALHEVKQVNDHLRQHGFSINESGGEVKGSPEVLLEQSSTMADKVLVRFNEGAEMIPGGFYEFAKRYPMANGQLYPGFVEASADKIFESTNR

SEQ ID NO: 92024 - protein, 403 aa, Vibrio cholerae O1 biovar eltor str. N16961
MTVEMSVDRSSFDEVMVPCYNPMEFIPVKGFGSRIWDQQGHEYIDFAGGIAVSCLGHCHPVMVQALTTQANKLWHLSNVMTNEPALRLAKKLTQVSFAEKVFFANSGAEANEAALKLARRYAADVYGPEKSEIIAFNQGFHGRTFFTVSVGGQATYSDGFGPKPGDIVHLPYNDLAALQAQISDRTCAVMMEPLQGEGGIVSPSAEFVQAVRELCDKHNALLIFDEVQTGNGRTGDFYAYQGIGVTPDILATAKSLGGGFPIGAMLTTAKIAEHMKVGVHGSTYGGNPLACAVAEAVVDFVAQPEILAGVKQREQWMRAELEKINQKYQLFKEIRGKGLLLGAALNDEWQGRARDILVAAGKQGLMVLVAGASVVRFTPSLIISQQEIEEGMARLDKAIATLM

SEQ ID NO: 92025 - protein, 289 aa, Salmonella enterica subsp. enterica serovar Typhi str. CT18
MEYSILSNNLKMPMVGFGVFKVTDKEECQQSVLSAIRSGYRLIDTAAVYGNEDAVGDAVREAIATGLCTREELFITSKLWVQDMANYDLAKAGIEASLKKSGLDYFDLYLLHQAMGDYFSAWRALEDAYEAGKLKAIGVSNFYAHVLANFCETVRITPMVNQVELHPYFAQPAALETMKHYNVQPEAWAPLGGGRHKPYENVMLQRIADAHQKTIAQVVLRWNVQRGVTVIPKSTRQERIEENFAIWDFSLTDNEMAQINALDLGYVGEAVKHFNPEFVRGCLGVKIHD

SEQ ID NO: 92026 - protein, 168 aa, Zea mays
VQRGLVFGIVNRFERKGSKLVSLKLIVPSKGFVEKPYPDFKERPFFNGLWDFFSFGPVLAMVWEGGGVLKFGGKLIGAPAPQKFEPGTLRGVFGVVVGRNIIHGREGPGTAKDEIPFWFEPKGVVFFSPNGGKGVFGGNYPGAKFFGVCFFFFSFPIIAAGPRRGVIK

SEQ ID NO: 92027 - protein, 377 aa, Bacillus anthracis str. Ames
MKAVTYQGPNQVQVKQVDDAKLEKKDDIIVKITSTAICGSDLHLYQGNMPLPQGYIIGHEPMGIVEEVGPDVTKVKKGDRVVIPFNVACGHCFYCQHEMESQCDNSNPHYDSGGYFGYTEKFGNHPGGQVEYLKVPFGNFTPFVIPESCELEDESLLFLSDVLPTAYWSVINAGVKPGDTVIVLGCGPVGLMTQKFAWMHGAKRVIAVDYLDYRINYAKKINNVEVFEFTKFPDMGEHLKEITHGGADVVIDCVGMDGKKSPLEFLEQKLKLQGGTLGPIQIATKAVRKYGTVQMTGVYGGNYNAFPLGAFWVRNINLKMGQAPVIHFMPELFEKITNKEFDPKEIITHKIPLEEASYGYQIFNNREDDCIKVILKP

SEQ ID NO: 92028 - protein, 375 aa, Oryza sativa
  misc_feature (314)..(314): Xaa can be any naturally occurring amino acid
PQLSILMQCANFPFSVNSATSSVAAFVVFSFIMATALYLSLKSRYDEEVHLKVEMFLRTYGTSKPTRYSFSDVKKITRRFKEQLGQGGFGSVYKGRLPNGVPVAVKMIEHSTGNGEEFINEVATIGQIHHINIARLLGFCSEGTRHILIYEFMPNESLEKCIFLHDPNTSQELLAPKKMLDVALGIARGMEYLHQGCNQRILHFDIKPNNILLDYNFNPKISDFGLAKLCARDQSIVTLTKARGTMGYIAPELYSRNFGEISYKSDVYSFGMLVLEMVSGRRNSDPSIENQNEVYFPEWIYEKVITEQDFVLSXGNDRRSRLKVRQMALVALWCIQWNPRNRPTMTKVVNMLTGRLQNIEVPPKPFVSYESHVVP

SEQ ID NO: 92029 - protein, 684 aa, Geobacter metallireducens GS-15
MEQYAVYFALACAVAAVAYGLVSAQWILGLPQGNDRMRQIAAAIQEGAGAYMKRQYTIIAVVGVIMFIALFATLGMKTAIGFAIGALFSGLTGFIGMFVSVRANIRTTEAAKSGIHKALNVAFKGGAITGMLVVGLGLLGVAGYYFILQQVMPGAPVKEVVSQLVGLGFGGSLISIFARLGGGIFTKGADVGADLVGKVEAGIPEDDPRNPAVIADNVGDNVGDCAGMAADLFETYAVTLIAAMLLGAIAFTGNVAAVNYPLILGGISIVASIIGTFFVKLGGNQKIMPALYKGLIASGVLACIAFYVVTAQMFPQGLTTAAGVTYSATNLFISAIVGLVVTGAIFWITEYYTATEYGPVKHIAQASTTGHATNIIAGLGVSMKSTAMPVIVIAAGIIVAFQCAGVYGIAIAAVSMLSLTGIVVAMDAYGPITDNAGGIAEMAELDDSVRAVTDPLDAVGNTTKAVTKGYAIGSAGLAAVILFTSYVDELKLAGKIIDFNLADPYIIVGLFLGGMLPYYFAALCMEAVGKAGGSVVEEVRRQFREIKGIMEGTGKPDYASCVDIVTRTALKEMVIPGIIPIAAPIIIGFTLGPKALGGVIVGTIVTGIFVAISMTTGGGAWDNAKKYIEDGYHGGKGGDAHKAAVTGDTVGDPYKDTAGPAVNPMIKIINIVSLLIVPLLAKLG

SEQ ID NO: 92030 - protein, 636 aa, Yarrowia lipolytica CLIB122
MAILHKPSFHFQKATFENPFHRSPEEKNETWIKYIFDPHVTVVTTKTHDHSNNKADGAKEIETIKQFMDKKMLFFAWISLMLVSTVVALERGTTSTYAAVATSHFNELGLLSAVGVVRSVLYAVTRPTIAKLADVLGRVEALVLAIIFYIIGFAMLAGGSNIATYFAAHIFYVSGEVGIQFMEAVFATDTSNLRNRTFFLALPNFAYVWASWVSAPIASGVLKNSTYRWGYGMWCIIMPVVSIPVCIILLRLKFKARAMGLEYGKAVRNFRGTFSQFDMVGLILFTAGLCLLFLAVTLATSPTSWGQAHILVMIIIGPILLFIFPFWEIFGPKYPFMPSYVITNRTMFTTCLLIFCYALAYFLYGTYYLPWLMVCKNLSVKAATNTVNVFVVGSTVSSFFAAAYAKYFKRMKPVIIAGAAIYMLGIGLTYNYRKPTHRLSQFIVSQCVEAVGAGFLQTPMISMIHAVVPHHNVVTATAIYQSIMTVGSIVAEAIAGTLYRQSYPKQLAKHAPFLSPREAHQVVNNLMAPIKLYPWGTPEREAIVTAFNDIYRKLLYPPIIIAGFIFVAAFTLPNVYLGDTDEPTQSDSEVDSSSIDEKIHPHDEEAQYEQHHDMEASTSPENIPQISEGMEEEKKM

SEQ ID NO: 92031 - protein, 177 aa, Triticum aestivum
MLRAGGSRLVAPGLRRLLGPDAGERAAPGLAAAGAGARAYHERVVDHYNNPRNVGSFDKDDPNVGTGLVGAPACGDVMKLQIRVDEGTGKIVDACFKTFGCGSAIASSSVATEWVKGKQMEEVVSIKNTEIAKHLSLPPVKLHCSMLAEDAIKAAVKDYESKKAKLGDSPAEKAAEA

SEQ ID NO: 92032 - protein, 282 aa, Geobacillus kaustophilus HTA426
MKIGYLGPKATFTEAAAALLFPSQPREPYDTIPDCIDAAAAGEIEAAVVPLENALEGSVNLTLDYLIHEQPLPIIGEIVVPIEQHLMVHPYFTPHWREVKEVYSHSHAIAQCRKFLHTVLKGAKQVPMTSTSAAAKFVSEHPHLPAAAIANRLAAEKYGLVIVQENVHDYDYNHTRFIVVSRRKEPLSPASPLYAGDKTTVVVMLPQDRPGALHQVLSAFAWRRLNLTKIESRPAKTGLGNYFFIIDIDAPMDDVLIPGAIAEIEALGCTVQLLGSYPYYFA

SEQ ID NO: 92033 - protein, 521 aa, Oryza sativa Japonica Group
MGNFVWMVAAAAAAVASWAFIAVVVKLVWRPRAISRRLRAQAVGGPGYRFFSGNLGEIRRLRAEGAGVVLDVSSHDFVPIVQPHFRKWVSLYGKTFLFWFGAQPNICLADINIVRQVLSDRTGMYPKDLTNPYFAHLLGKGLVLIDGDEWKRHYKVVHPAFDMDKLKMMTVTISDCTGSMMSEWESELGMKGGSAEIELSQRFQELTADVISRTAFGSSYSEGKQVFLAQRKLQFLAFSMFLTIQIPGFRYLPTKKNLKIWSLDKKVRSMLRNIIKIRLANKDTMGYGNDLLGLMLETCAPEHDESQQLSMDEIIAECKTFFFGGHDTTSHLLTWTMFLLSTHPEWMRKIRKEVTTMCGDEVPTGDMLNKMNLLNMFLLETLRLYSPVSLISRRTGTNAKFGGIKVPEGTILRIPIATIHRDKEVWGEDADEFKPARFENGVSKAAKHPNALLSFSNGPRSCIGQNFAMIEAKAVITMILQRFSFTLSPKYVHTPISVITLRPKYGLPMILRSLKLYKIGM

SEQ ID NO: 92034 - protein, 516 aa, Oryza sativa Japonica Group
MGFEWTVATAAAAVAASWAFIAVVVKLGVAGPGYRFFSGNLSEIRRLRAEGANLVLDVSSHDFVPIVQPHIRKWIPLYGKTFLYWFGTRPNICLADMNMVRQVLSDRTGMFPKYIDNMQFARLLGKGLVLTDDDEWKRHYKVVHPAFDMDKLKMMTETISDYAQSMMFEWESELGMKGGSTEIELSRWFEELTADVISRTAFGSSYREGKQVFLAQRKLQFLAFSVFLTIQIPGFSYLLTKKNLKTWSLDKKVRSMLMNIIKSRLTNKETMGYGNDLLGLMLEACVPEHGGSQPQLSMDDIIAECKTFFFAGHDTTSQLLTWTMFLLSTHQHWMEKLRKEVRMVCNDEVPTGDMLNKLKLVNMFLLETLRLYGPVSLVTRRAGTDVKLGSIKVPKGTILTIPIATIHRDKEVWGEDADEFKPERSENGVLNAAKHPSALLSFSIGLRSCIGQNFAMIEARTIIAMILQRFSFTLSPKYVHTPISVITLRPKYGLPMILRSLKNWDVNFSSLLVDWR

SEQ ID NO: 92035 - protein, 410 aa, Marinobacter sp. ELB17
MSTEIKAPVFPESVAEGTVATWHKQPGEACARDELIVDIETDKVVLEIVAPADGVIEEILKNDGDTVESGEVIGRFKAGAASESKDSGSKDAVESKDQGADAASSSDAILSPAARKLADENNVEPSALKGTGKDGRISKEDVQSHIDNAKASIESPAAKAAAEPAHAAAPVAEISAGERIEKRVPMTRLRASIAKRLVNAQQSAAMLTTFNEVNMGPIMELRKQYKESFEKRHGIKLGFMSFFTKAATEALKRFPAVNASIDGNDMVYHGYQDIGVAVSTERGLVVPVLRDVDALSLADIEKKIVEYGTKAKTGKLGIDEMTGGTFTITNGGTFGSLLSTPILNPPQTAILGMHKIQPRPMAVNGQVVIQPMMYLALSYDHRMIDGKEAVQFLVAIKEMLEDPARILLDV

SEQ ID NO: 92036 - protein, 574 aa, Geobacter metallireducens GS-15
MSKNAIKPQLKNPFDPPEKVEFTIPGEISRTTGPYEEAIQEGYDLIQRPIKSVKIDQIEKQHFKKRMTVWERLKVLSDQAPNVLYQNWGKNLDGASLVTAIMNIGGRDVAVYGHDFTVRAGSIDATNGSKLAKLFNLAGEKGIPLIGMNDSAGAFVPAGVGGLDGYAEAFTALRKISGVVPSIMCMFGFNAGGGSYLPRQGSFVIQPNETFFGLTGPGVVKSVLGEDITPDELGGPKVHGRSGVADLTVSDELAALRTAVRLLSYIPDNNSVGAPFQKTSDPLDRKTWEINTLLKKAFNSPTGFNTPFDVSIIIQQICDHGDYFELQPERAKEAVTAFGRLGGQVVGFVANNSAVASGQIDCDSAVKIARFVRFCNIYNIPIIFMEDTTGFLPGREQESRGIVQAGRSMLDAIVDVRTPRILLILRNAFGGAYASYNNYPTGADLVLALPTTRLAVMGPAGKEFVYKDELRKIRGTVAEMVKKGTEERICAGTEAAAAKRDAEKEAAEWLKGQEATLNQRYEKELMNPKEGLALGSISSIVMPTDLRQVLGENIAFLMRHYKPSPMCGPQREFH

SEQ ID NO: 92037 - protein, 479 aa, Marinobacter sp. ELB17
MADKFDVIVIGAGPGGYVAAIKAAQLGLNVACVESWSSDEGKQVLGGTCLNVGCIPSKALLEISHKYEEAQHGFAEQGIIANDISIDIAKMMERKTGIVKQLTGGIAGLFKSNGVTSIYGHGKLLANRQVEVTDNDGKTKTYEADNVILATGSRPIEIPPAPKTEGYITDSEGALEFTEVPKRLGVIGAGIIGLELGSVWARLGSEVTLLEAQDTFLPGVDQQIAKATLKEFQKQGLNIVMGGRVTGAEVKRKLVYVSYEDSKGKQELMVDKLIVAVGRRPFTDNLLAADSGVNMDERGFVFVDDHCKTDAPGVWAVGDVVRGQMLAHKASEEGVMVAERIAGHKPQVNYDCIPNVIYTSPEVAWVGKNEEQLKADGAAYKVGTFPFAANGRAMAANSAVGMVKIIADEKTDRILGFHVLGPAASEIVAQGVIAMEFGSSAEDLALTCFAHPTLSESVHEAALAVNGGAIHMANRRKKK

SEQ ID NO: 92038 - protein, 320 aa, Melittangium lichenicola
MKVLVTGAAGFIGYHVCERLLARGDTVIGVDNLDTSGDVTLKATRLSRLRAAPNFGFHRMDIRDAKACRELFDGARPERVVHLAARVGVRTLDSESPEYAETNVTGFLQVLELCRRSRVEHLVFASSSSVYGAGSDMPFSEDSAADRPLSLYAATKRANEMMAHAYSHQYAMPITGLRLFSVYGPWGRPDMAPMMFLRAMLEGRSLELHGEGKAQRDFTYIDDVVEALVRVLDAAPTGLPLYRVLNVGRGTPVSMSRLVDLLEEHLGTTAWVEMRSSRSEEMDATCADVTALERETGFRPSVTLEQGLARLVAWYRGREG

SEQ ID NO: 92039 - protein, 388 aa, Marinobacter sp. ELB17
MNLHEYQGKQLFAEYGLPVSQGIACSTPDEAVAAAEKIGGDSWVVKAQVHAGGRGKAGGVKLVKNTDDIRAFAEQWLGKKLVTFQTDEHGQPVSKILVESLTDIDQELYLGAVVDRGTRRIVFMASTEGGVEIETVAEETPEKILKAEIDPLVGAQPYQGRELAFKLGLEGKQIGQFTKIFMGLAKLFEDYDLALLEINPLVITPAGDLHCLDAKIGVDGNALYRQKRLQAMRDPSQEDSREAEAAAWELNYVALDGNIGCMVNGAGLAMGTMDIIKLAGGRPANFLDVGGGATKERVTEAFKIILSDDAVQAVLVNIFGGIVRCDMIAEGIIGAVKEVGVKVPVVVRLEGNNAELGSKVLAESGLNIIAASSLADAAEQVVKVAGGK

SEQ ID NO: 92040 - protein, 293 aa, Bacillus subtilis subsp. subtilis str. 168
MKEAEVLKYEAFTSSPGKGNPAGVVLQGDDYTEDEMQIIAERAGYSETSFIRKSESADLELRYFTPGHEMNLCGHATVASLYALCEKGMLESGKTYSIQTKAGILPVKISEKDGRIHITLEQASPQFKPFTGDRKKLADALGITDEDFHEDLPIVFGSTGIWTAIVPLKSLEASKKMVPDNKQFPEVLVDLPKASVHPFTFETVHPDSDLHGRHFSSPYSGTIEDPVTGTASGVMGAYMKHYGNAEQHKFIIEQGQEIGKDGKVEIEMNEAGGHVKVNMTGTAVYSETRILKI

SEQ ID NO: 92041 - protein, 198 aa, Helicobacter pylori J99
MLVTKLAPDFKAPAVLGNNEVDEHFELSKNLGKNGVILFFWPKDFTFVCPTEIIAFDKRVKDFHEKGFNVIGVSIDSEQVHFAWKNTPVEKGGIGQVSFPMVADITKSISRDYDVLFEEAIALRGAFLIDKNMKVRHAVINDLPLGRNADEMLRMVDALLHFEEHGEVCPAGWRKGDKGMKATHQGVAEYLKENSIKL

SEQ ID NO: 92042 - protein, 272 aa, Shewanella sp. MR-4
MSQQKICFIGAGNMTRSIISGLIRSGYPAALVQATNPSQGKLDALAADFGVRVSQDNVSAAQDADVIVLSVKPQLMEQVCQALQGIDMSNKLVITIAAGIKAERYSQYLAQPITLVRTMPNTPMQIGVGMTGLYAPQPLSDAQQAITERLMSSGGEIVWVNEESEINQVIALAGSSPAYFFLLMESMIDAGKQMGMDEAKARSLVQQAALGAAMMAKQNPELTLGNLRENVTSKGGTTAQAIATFEAADLRGVVKNAMENCIKRAEEMANTF

SEQ ID NO: 92043 - protein, 238 aa, Shewanella sp. MR-4
MTTIADRLAVAQSRIAQAAQKCARLPHSIRLLAVSKTKPIEDIIAAYDAGQRCFGENYVQEGVTKIESLKGTHPDIEWHFIGPLQSNKTALVAQHFDWMHTLSREKIAQRLNEQRPAHLAPLNVCIQINISDEDTKSGIDAEQMLPLADSISQLPHLQLRGLMAIPSATNDIAQQSRELSELKQLFDTLKQHYPAVDTLSMGMSNDLDVAIECGSTMVRIGSAIFGERDYGAKETTSN

SEQ ID NO: 92044 - protein, 504 aa, Oenococcus oeni PSU-1
MAEKKTTKATASSTSKVAKRTRGSKSTQTKASVSNEKDLAEGTVLQVIGPIVDVQFPDNKKLPDINNALKVQRIDGSELTIEVSIDLGDSVVRTIAMDSTDGLTRGMKVLDTGAPIEVPVGEATLGRVFNVLGEPVDGGDPIPNSVDRHPIHRSAPKYDELATSTEVLETGIKVIDLLEPYLRGGKTGLFGGAGVGKTVLIQELIHNIAQGHNGISVFTGVGERTREGNDMYYEMKASGVLKNTAMVYGQMNEPPGARMRVGLTGLTMAEDFRDQEGKDVLLFIDNIFRFTQAGSEVSALLGRIPSAVGYQPTLATEMGQLQERITSTKKGSVTSIQAVYVPADDYTDPAPATTFAHLDATTNLERSLTQQGIYPAVDPLESTSSALTPDIVGEDHYEVATQVQHFLQRYKELQDIISILGMDELSDEEKTIVNRARRIQFFLSQPFSVAEQFTGVPGQYVPVEDTVRGFKEILDGKHDDLPEEAFRNVGTIEQAVEKAKKLES

SEQ ID NO: 92045 - protein, 544 aa, Oryza sativa Japonica Group
MVAGGGNGGAAVLVGITVLLFVVVVVVVVLVRWWSGGEGGAAPSPPALPVLGHLHLLKKPLHRSLAAVAAGVGAPVVSLRLGARRALVVSTHAAAEECFTACDAALAGRPRTLAGEILGYDHTIVLWTPHGDHWRALRRFLAVELLSAPRLAALAADRHAEAASLVDAILRDAAGGAKVTLRPRLFELVLNVMLRAATTRRRHASVDARKLQEIIEETFSVNGTPSVGDFFPALRWVDRLRGKVGSLKKLQARRDAMVTGLIDDHRQWRSGSAGDGDQDKEKKGVIDALLALQETDPDHYTDNVVKGIILFSITVPLLHFYSIVINMYNGFDHGVQSLLFAGTDTSALTIEWAMAQLVTHPETMKKARAEIDANVGTARLVEEADMANLPYIQCVIKETLRLRTAGPVIPAHEAMEDTTVGGFRVARGTKVLVNAWAIHRDGDVWDAPEEFRPERFVDSDAGGAVTAPMMPFGLGRRRCPGEGLAVRVVGVSVAALVQCFDWEVGDDDVVDMTEGGGLTMPMATPLAAVCRPREFVKTILSTSM

SEQ ID NO: 92046 - protein, 141 aa, Clostridium perfringens SM101
MLNAISIWRVSNWFYKRNIKILAKILKFIIFLLYNSSIPYECHIGKGTKLGYSGIAVVIHKKAIIGENCMIAQCVTIGGQGGGKEGVPKIGNNVYIGAGAKVLGDIKIGDNVIIGANSVVTKSFGDNVIIAGIPAKIIRKN

SEQ ID NO: 92047 - protein, 167 aa, Clostridium perfringens SM101
MLIEIRGKKPEIGEKTFIAHSSDIIGDVTIGRDCGVWFGSVIRGDYNLIKIGNETNVQDNAVLHGDKEYKVEIGHGVTIGHGAIIHGCKIEDECLIGMGAIILNGAKIGKNTMIAAGTLVSQNKEIPEGVLVMGVPGKVVRKLTEDEIESIKNSRREYVKMKNLYIK

SEQ ID NO: 92048 - protein, 573 aa, Geobacillus kaustophilus HTA426
MAKVELKAPDGPPSDVERIKQESRYLRGTLAETMEDPLSAGIPDDDNRLMKFHGSYLQDDRDVRTERQKQKLEPTYQFMIRVRTPGGVATPEQWLVMDELARKYANGTLKLTTRQAFQLHGVLKWNVKKTMQAINGALMTTLAACGDVNRNVMCNPNPYQSEVHAEVYEWAKLISDHLLPRTRAYYEIWLDDEKVAGTPPVDGEEEPIYGPTYLPRKFKIGIAVPPSNDVDVFSQDIGFIAIVEDGKLAGFNVAIGGGMGMTHGDKTTYPQLAKVIGFCKPDQVVEVAEKIMTVQRDYGNRSSRKHARFKYTIDRLGLEAVKEEIERRLGWRLGEARPYHFEHSGDRYGWVEGVNGTWHFTLFVEGGRVKDYDDYKLMTGLREIAKVHTGDFRLTPNQNLIIANVTSEKKPEIEALIAKYGLTDGRRYTALRRNALACVALPTCGLAMAEAERYLPKLLDKIEEIIDENGLRDEEITIRMTGCPNGCARHVLAEIAFVGKAVGKYNMYLGAAFNGTRLGKLYRENIGEEEILRELRMLLSRYAKERLDGEHFGDFVIRAGIVKEVTDGTNFHD

SEQ ID NO: 92049 - protein, 345 aa, Triticum aestivum
MDLTSLTAMWWAIALLFITVLATKITRARITNIDPQRTTGQLPPMVNGLALLGLLPTLLKKGLPPMVNYLYVNYGSVFTVSCFGVIKVTLLIGPEATTHFFQGLESEISHGNLLEFTVPMFGKAVGYGRDTATRMEQMRFHSEALRASRLRSHVSPMLQEVEDFFAKWGEEGVVDLKLEFEQLLMLISGRCLLGKEVRENMFDEVYTLFREIEKGVTLISFLFPYLPTPANRQRDRARIRLTEILSNVVESRKSSGRVEEDTLQKLIDSKYKDGRPTTVEEVAGLIIGLLFAGKHTSSHTSGWSWFPTIHLLKRPGGNSAPKKKGGQKTLLKETRNDKGAGKLKP

SEQ ID NO: 92050 - protein, 245 aa, Nocardia farcinica IFM 10152
MTYTLVLLRHGESEWNALNLFTGWVDVHLTDKGVAEGKRAGELLAEHGILPDIVYTSLLRRAISTANIALDAADRHWIPVVRDWRLNERHYGELQGKNKAQIRDKYGEEQFMLWRRSYDTPPPPIEAGNEYSQEGDARYAGIDIPKTECLLDVVNRMVPYWESTISKDLLAGKTVLIAAHGNSLRALVKHLDQISDEEIAGLNIPTGIPLRYELDENLRPVRPREYLDPEAAAAGAAAVASQGGK

SEQ ID NO: 92051 - protein, 488 aa, Geobacillus kaustophilus HTA426
MKMGTEKQTYLNYINGEWIHSSTGKIEASLNPANIDDIVGYVQESGVEDVNVAVEAARRAQAAWRKLSGPKRGEYLFRAADVLEKRLDEIAETMTREMGKTLPEAKGEVQRGVNILRYYAGEGMRSIGEVIPSMDSEALMFTTRVPLGVVGVITPWNFPVAIPIWKIAPAIVYGNTVVFKPAQETAVTAAKIVECFDQAGLPAGVVNLVTGKGSVIGNAIAEHPHIHGITFTGSNEVGKTIAQKAVARGAKYQLEMGGKNPVIVLEDADLDRAVEATISGGLRSTGQKCTATSRVFVQSSIYESFKEQLLAKIKQLKIGDGLKEGVWMGPCASRKQLETILSYIEKGIEEGATLLCGGRRLVDGELGNGFYIEPTVFENVSPNMTIAREEIFGPVLSLIKVDTFEEALALANDTPFGLSASIFTQNIGKMLAFIQDIEAGLVRINEESAGVELQAPFGGMKQSSSHSREQGRAAIEFFTAIKTVFVKG

SEQ ID NO: 92052 - protein, 369 aa, Cryptococcus neoformans var. neoformans JEC21
MSDDAADVDACAIDNSESHFGLRIGSIFIILVTSVIGTVLPIILRQSSFVPRPVFDFAKYFGSGVIIATAFIHLLAPAWEELTSECLSGAWEDYDWAPAIVMAAVYFIFFAEVAAYRAGTRRLQRLGINYSSHAHDETDAHAHTHDHEPPLGVDVTAPAPDHHIHPDHSNITSHPHGHHRTSSGEKGKDAESASDVSTVNQLPSQAEAAAQLIAVAVLEFGVVLHSVIIGLTLAVDESFVTLFIVIIFHQMFEGLGLGSRLSILTLPENLWWTRYAAAIFYSLCTPVGVAIGLGVRSTYNGNGAKANIISGVLDATSAGILLYTGLVELLAHEVLLNPRMMKSSNSKLAYVFCCMLLGSGLMALLGRWA

SEQ ID NO: 92053 - protein, 171 aa, Streptococcus pyogenes M49 591
MTYTFYKAQGIEIGNSLVEEDKLDVAKDLLEKSNGKLILPVDSKEANAFAGYTEVRDTEGEAVSEGFLGLDIGPKSIAEFDQALTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 92054 - protein, 236 aa, Vibrio cholerae O1 biovar eltor str. N16961
MFSLHSIPNEVGMKDFLIAPSILSADFARLGEDVAKVLAAGADVVHFDVMDNHYVPNLTFGAPICKALRDYGITAPIDVHLMVKPVDRIIPDFAKAGASMITFHVEASEHVDRTLQLIKECGCQAGVVLNPATPLHHLDYIMDKVDLILLMSVNPGFGGQSFIPHTLDKLRAVRERIKQSGRPIRLEIDGGVKVENIREIAEAGADMFVAGSAIFGQPDYQAVIEQMRAELAKAKI

SEQ ID NO: 92055 - protein, 288 aa, Brassica napus
RHEGERERERERERERERERERERERERERERFITTDDFTNADILEATYPAVSKTLLNNWSKDKAVPVVTGFLGKGWRSCAITTLGRGGSDLTATTIGKALGLREIQVWKDVDGVLTCDPNIYSGAQSVPYLTFDEAAELAYFGAQVLHPLSMRPARDGDIPVRVKNSYNPNAPGTVITRSRDMSKAVLTSIVLKRNVTMLDIASTRMLGQYGFLAKVFTTFEDLGISVDVVATSEVSISLTLDPAKLWGRELVQRANELDHVVEELEKIAVVKLLQRRSIISLIGNV

SEQ ID NO: 92056 - protein, 83 aa, Arabidopsis thaliana
  misc_feature (20)..(20): Xaa can be any naturally occurring amino acid
PRESRKLPLAGAFAGAAHLXGVALKYSKAPHGVVLATGFGAITGAVLGSEVAEHWYQLYKMDKQGANLRFIYWWEDKVSGQKS

SEQ ID NO: 92057 - protein, 276 aa, Bacillus anthracis str. Ames
MNKQIGFIGCGNMGIAMIGGMINKNIVSPNQIICSDLNVSNLKNASDKYGITITTNNNEVANSADILILSIKPDLYTSVINQIKNQIKNQIKNDVIVVTIAAGKSIKSTENEFDRKLKVIRVMPNTPVLVGEGMSALSFNEMVTEKDIKEVLNIFNSFGQTEVVNEKLMDVVTSISGSSPAYVYMFIEAMADAAVLDGMPRKQAYKFAAQAVLGSAKMVLETGIHPGELKDMVCSPGGTTIEAVATLEEKGLRTAIISAMKRCTKKSMEMSRLTSK

SEQ ID NO: 92058 - protein, 315 aa, Oryza sativa
  misc_feature (152)..(152): Xaa can be any naturally occurring amino acid
  misc_feature (192)..(192): Xaa can be any naturally occurring amino acid
  misc_feature (203)..(203): Xaa can be any naturally occurring amino acid
MASIHGKEGGNVASATEQREKARVVGDAEAKPNSSNMSTSARRLLLLAGAAAAIALLLSATAPVAGAEDDGYSYIPGSPRGPQNWGSLKPEWATCSSGKMQSPINLGLLDLTLAPGLGNLNYTYQNANASVVNRGHDIMVRFDGDAGSLTIXNGTAYQLRQMHWHTPSEHTIDGRRYDMELHMVHLNAQNQXAASIGILHTIXGTRDEFLQKLEPYIIEISKQEGKERVIIGGADPNVAKGQDTVYYRYMGSFTTPPCTEGVIWTVVRKVRTVSLSQITLLKAAVLTGNENNARPLQGVNNREIDLFLPLPLINN

SEQ ID NO: 92059 - protein, 414 aa, Bacillus anthracis str. Ames
MSLLRDEALKMHKEKQGKIGVYSKVKVQNSTDLSLAYSPGVAEPCLEIYKDESKVYDYTMKGNLVGVISDGTAVLGLGNIGPKAAMPVMEGKALLFKSFAEIDAFPICLNTNNPDKIVEVVKLLEPNFGGINLEDIAAPQCFEIEERLRKSCDIPVFHDDQHGTAIVTIAGLINALKLTNKKIEDVQIVVNGAGAAGIAIVKLLLHMHVKNVILCDTKGIIYEQRPIGMNALKEEIARITNIEQKRGTLAEALIDADVFIGVSAADVVDEDMIRSMNHNPIIFALANPTPEIMPNKAKIAGALVVGTGRSDFPNQVNNVLAFPGVFRGALDVQAKEINEEMKLAAVYAIAELISEEELHVNYVIPNPFDPRVVPHVAYAVARAAVETGVSRKNISMSEIKNNLFRLTKEVNILK

SEQ ID NO: 92060 - protein, 302 aa, Yarrowia lipolytica CLIB122
MSDFLVDFMMGGISAAVSKTAAAPIERVKLLIQNQEEMIKQGRLSRPYAGIIDCFKRTAAEEGVVSFWRGNTANVIRYFPTQALNFAFKDKFKKMFGFKKSEGYWMWMMGNLASGGLAGATSLAFVYSLDFARTRLANDAKSVAKDGKAAGERQFNGLIDVYRKTIASDGIAGLYRGFGVSVVGIIVYRGLYFGLYDSLKPVVLVGPLEGNFLAAFLLGWTVTTGASTASYPLDTIRRRMMMTSGTGVKYSSAFDCGVQIVKAEGVASLFRGCGANILRGVAGAGVISMYDQMQMILFGKKF

SEQ ID NO: 92061 - protein, 593 aa, Photobacterium sp. SKA34
MQQKSTQKISLSQAYVKSAGINLDRRFMIALTDGSMITSRRYPQLLLITTTIESNGLLFNYPNKTPLSLSFEQLALLATSTAVWNDNCEAYTTSNDADQWVSEIIGQPAQLLYNGVESQRMGGKAQVKVSFADNFPVMIVSEASLNELNDRTQEIHSMDKFRANLVVSGVNAFAEDSWKRIRIGEVELEIKAPCSRCVLVNYDPNSSKKADNNEPLATLMTFRSDKVIPTNVNFGMNAIVVKEGIVRQGDQVEVLEHRTPETYPDQRVALTCVKREIIAKDFVSFSFKAQKDTALAPYLPGQYLPIRIAINGNVVERCYTLSSSPLEQEYTISVKRIEQGTVSNWLHDNLQVGDTIWSEKPSGQFYLEPHKQQNTLLLSAGSGVTPMMSMLRSLISERNTQGLTFYHYCKTQADIPFADELAEIQRHHPEISIHICLTQDNDTSHAYHGRICAEHFANIDVKDNCHVYVCGSSGFNQIAQELFSNQGLPTDRFHQEQFNKALTKPEQEQSLNIQYKQQQFTGNNQTSLLDQIEAAELPIKSGCRAGLCGRCKVKVTEGNVLQQDSAALSEEEKQQGVILACCSIPTSNITIEQ

SEQ ID NO: 92062 - protein, 522 aa, Xylella fastidiosa Dixon
MTPNIHHDKILILDFGAQYTQLIARRIREIGVYCEVWPWDHSPEEILSFGAKGIILSGGPESTTSPGAPAAPQHVFDSDLPIFGICYGMQTMAVHLGGATEAADKREFGHASVQVIYPDTLFSGLSDHPSEFRLDVWMSHGDHVSRVPPGFTITAATDRIPIAAMSREDKRWYGVQFHPEVTHTLQGQALLRRFVVDICGCQTLWTAANIIEDQIARVRERVGRDEVILGLSGGVDSSVVAALLHKAIGSQLTCVFVDTGLLRWGEGDQVMAMFEEHMGVNVVRINAASRYFDALQGVYDPEAKRKIIGNLFIQIFEEEASKRKQAKWLAQGTIYPDVIESAGSKTGKAHVIKSHHNVGGLPEQMTLGMVEPLRELFKDEVRRLGVALGLPHAMVYRHPFPGPGLGVRILGEVKPEYAELLAKADSIFIDELHQADLYDKVSQAFAVFLPVKSVGVVGDARAYEWVIALRAVETVDFMTAHWAPLPYDFLSTVSNRIINELRGVSRVVYDISGKPPATIEWE

SEQ ID NO: 92063 - protein, 709 aa, Neisseria meningitidis FAM18
MAYQVLARKWRPKTFSDLVGQEHVVKALQNALDEGRLHHAYLLTGTRGVGKTTIARILAKSLNCENAQHGEPCGVCESCTQIDAGRYVDLLEIDAASNTGIDNIREVLENAQYAPTAGKYKVYIIDEVHMLSKSAFNAMLKTLEEPPEHVKFILATTDPHKVPVTVLSRCLQFVLHNMTSQQVADHLAHVLDSEKIAYEPPALQLLGRAAAGSMRDALSLLDQAIAMGSGSVAEQDVRQMIGAVDKQYLYELLTGIINQDGAALTAKAQEMAACAVGFDNALGELAILLQHLALIQAVPSALAHDDPDSDILHRLAQTISGEQIQLYYQIAVHGKRDLSLAPDEYAGFMMTLLRMLAFAPLAAASCDTNAVIENTELKSPSAQTAEKETAVKKPQPRPEAETAQTPVQTASAAAMPSEGKTAGPVSNQENNDVPPWEDAPDEAQAAAGTAQTSAKSIQTASEAETPPENQVSKNKAADNVTDAPLSEVPSENPIQATPNDEAVETETFAHEAPAEPFYGYGFPDNDCPVEDGAEIPPPDWEHAAPADTAGGGADEEAEAGGIGGNNTPSAPPPEFSTENWAAIVRHFARKLGAAQMPAQHSAWTEYHPDTGLMVLAMTAEARATADKKRLDKIRDTLAQAYGLQLTLQTQDWRDEAGRETPAMQDKRVQAEDRQKAQALLEADPAAQKILQAFGAQWQPESLELAANRP

SEQ ID NO: 92064 - protein, 296 aa, Xylella fastidiosa Dixon
MIKRIRKAVFPVAGLGTRFLPATKTIPKEMLPIIDKPLIQYAVDEAIQAGCDTLVFVTNRYKHAVADYFDKAYELEQKLERAGKYEQLELVRHVLPDGVRTVFVTQTEALGLGHAVLCAKPVVGDEPFAVLLPDDLMWSRNGGALKQMADVAEVSGSSVIAVEDVPVDKTVNYGIVGTDVFDGSKGRITQIVEKPKPDDAPSNLAVVGRYVLSGKIFEMLENTSIGTGGEIQLTDAIAELLKYERVDAYRFQGRRFDCGAHIGLIEATLHLALEHKKHGQAVREILRDTLLTVDKR

SEQ ID NO: 92065 - protein, 340 aa, Saccharomyces cerevisiae
MNIKDRTSEFQQSVLSYKKRNKNFREQQRERLQEKESENFANNTTGNGKSVSEFQKKASGIAHEISSTAQLLSKLAVLAKRKPMFNDNPVEIAELSFLIKRKIYAIEQSLVQLSQLKKTDVNGNTSNQSSKQPSAVQHSKNVVNLLNTQMKNISGSFKDVLEERQRLEMANKDRWQKLTTDTGHAPADDQTQSNHAADLTTYNNSNPFMTSLLDESSEKNNNSSNQGELSFPQNDSQLMLMEEGQLSNNVYLQERNRAVETIESTIQEVGNLFQQLASMVQEQGEVIQRIDANVDDIDLNISGAQRELLKYFDRIKSNRWLAAKVFFIIFVFFVIWVLVN

SEQ ID NO: 92066 - protein, 159 aa, Staphylococcus epidermidis ATCC 12228
MKITILSVGKLKEKYWKQAIAEYEKRLGPYTKIELIEVPDEKAPENMSDKEIEQVKEKEGQRLLNKIKPQSTVITLEIKGKMLSSEGLAKELQTRMTQGQSDFTFVIGGSNGLHQDVLQRSNYALSFSNMTFPHQMMRVILIEQIYRAFKIMRGEAYHK

SEQ ID NO: 92067 - protein, 208 aa, Helicobacter pylori J99
MIVIKDAHFLTSSNNLSQCPASLTSEMVILGRSNVGKSTFINTLLGKNLAKSSATPGKTRLANFFSTTWEDKENALTTTFNVIDLPGFGYAKVSKSLKKEWEGFLWELLSVRVSIKLFIHLIDARHLDLEIDKNAKENIQALLRPDQAYLSLFTKFDKLNKNEQHRLFLNAPKPFLINTIHFNALSSKYPTLEIVRQTLLKYLLTNPL

SEQ ID NO: 92068 - protein, 227 aa, Streptococcus pyogenes M49 591
MAKLTVKDVDLKGKKVLVRVDFNVPLKDGVITNDNRITAALPTIKYIIEQGGRAILFSHLGRVKEEADKEGKSLAPVAADLAAKLGQDVVFPGVTRGAKLEEAINALEDGQVLLVENTRFEDVDGKKESKNDEELGKYWASLGDGIFVNDAFGTAHRAHASNVGISANVEKAVAGFLLENEIAYIQEAVETPERPFVAILGGSKVSDKIGVIENLLEKLIKFLSVVV

SEQ ID NO: 92069 - protein, 588 aa, Lactobacillus casei
MKKTKIVSTLGPASNTTDIIVKLIEAGANVFRFNFSHGDHEEHLARMNMVHEAEKITGKTVGIMLDTKGAEIRTTLEDTPNGKIDFHTGDKVRISMDASLKGTKEKVAVTYPGLYDDTHVGGHVLFDDGLIDMKITEKDEKNRELVTVVQNDGVLGGKKGVNAPGVAINLPGITEKDSDDIRFGLDNGINFIAASFVRKPQDVLDIRELLEEKNALNVQIFPKIESQEGIDNIDDILKVSDGLMVARGDMGVEIPFEHVPIVQKRLIKKCNSLGKPVITATQMLDSMQENPRPTRAEVNDVANAVFDGTDATMLSGESANGDYPVESVAAMARIDEYTEAAMMDQDAFALKEYSNKNVTEAVGQSVAHTARNLGVKTIVAATESGYTARMISKYRPKADILAITFSEKTQRGLMVNWGVYPIIAEKPANTDAMFDLATKKAQDLGFAKEGDLILITAGVPVGESGTTNVMKVQLIGSKLVQGSGVGDESTIGKAVIASNAQEAAAKMQKGDILVVKTTDKDYLPAIEKAAALVVETGGLTSHAAVVGIAMGIPVVVGAENATSVISDGQIITVDSRRGIIYKGATNAL

SEQ ID NO: 92070 - protein, 323 aa, Lactococcus lactis subsp. lactis Il1403
MMKKILILHTGGTISMAEDENGHVSPNAVNPMNAVSMQFDEVNLVTEDIFNLPSPHVTLSDMLVLKNRIKTAFIAEDFDGVVITHGTDTLEETAFFLDTTLSRGKPIVLTGAMRSSNELGTDGIYNLLTAIRVAADSNSSDRGVLVVMNDEIHSARYVTKTHTTNVSTFQTPTHGPVGLLTKNKIIYFHKDSENQHLDVATVHGKVPIVKAFAGMTGEILDLLNLEQLDGLVIEALGAGNLPPIASQSLQRLLDAKVPVVLVSRCFNGIAEPVYSYQGGGSQLYEAGVMFADEVNSQKARIKLIIALNAGLKDLSELRPFLEN

SEQ ID NO: 92071 - protein, 235 aa, Triticum aestivum
SSSPSSSSVSSSPEHAAGRASLAKRPAGRTKFRETRHPVYRGVRRRGNAERWVCEVRVPGKRGARLWLGTYDTAELAARANDAAMLALGGRSAACLNFADSAWLLAVPSALSDLGDVRRAAVEAVANLQRRKAGNGSLTATVTEEASCDAPEESSSESDSAGSSETSEPSADREFEVPVAVDTDMFGLDLFPEMDLCSYYASLAEALLVDPPARVTTTDTYWDNGDGGADVALWS

SEQ ID NO: 92072 - protein, 363 aa, Magnaporthe grisea 70-15
MAANFWESTQRRNWLFTKEELAARRQQLENEDPSLVTMYPLPEWRHLYNYFNYQMLRLAKNLSIRQQAIATAQVYMKRFYTRVEIRSTNPTLVLVTAVYLACKMEEMPLHIRNVSLEAKKVWPMETPSLEIAKIGECEFWLISEMSAQLIVHQPYRTLTALQQDFQLANDDHVLAVSFLNDHFMTDLPLLYAPHTIALAAIMLALVLRLSKASSSNNAAAGQQGGAQAGPLGITLASGLSMFQQAVAAKAMTPGGSGSPAMSSPIQQNPPNQAYQLTPQQQEMFRQQQMQQQNRQPETQAKDSPQKEKSKLQRFAAWLSESGVDIEAMIDCTQELIAFYECQESYNEQITRDQINRFVKARGL

SEQ ID NO: 92073 - protein, 449 aa, Geobacillus kaustophilus HTA426
MEQSRLEKNFEEVEPGLTDREAMEEANRCLYCYDAPCIRACPTGIDIPAFIKKIASGNVKGSAKTIMLSNPVGASCARVCPTEELCEGACVLNHSTKPIMIGKLQRYATDWAIRNKEVLFQAGRKNGKTVAVVGGGPAGLSSARELARLGYEVTIFEAENQAGGLNTYGIVSFRLPQNISLWEVNQIKSLGVQIRTNTRVGKDIEVNELLENYDAVVLAVGMGKVPKLGIPGEDLDGVYDAIELIKETKTKPLTDRLVGKRVVVIGAGNTAIDAATCSVRLGAENVKILYRRTKEEMTAYEFEYEFAKQDGVEFRWLTAPKRIIGDSKGKVTHVECVRMELGEPDADGRRRPLPVEGSEFIMPVDVVIKAIGQERHIELIEAFGLEHDHGVVKVNPETYQTSNPKVFACGDVIFERGKGEAMVVVAAQQGKEAAYGIHRYLTKAVSETA

SEQ ID NO: 92074 - protein, 644 aa, Chlamydophila abortus S26/3
MTSYTSSILSQISSPEDLKKLSCSELSLLAEQIRHKIISVLIKTGGHLASNLGIIELTIALHYVFSSPEDKFIFDVGHQTYTHKLLTGRNIEEFERIRHDGGLSGFTSPLESAHDLFFSGHAGNALSLALGMAKATEKSRTHVLPILGDAAFSCGLTFEALNNIHTDLSKFIVILNDNNMSISKNVGVMSKSLSQWIHHPKFSLLSRKLERSLSKIPRYGKSIAKCSHKISTCLRSLVCPIPIFEQFNLAYMGPVDGHDIKALVSLFQKVRDLPFPILIHVCTKKGKGLEIAQENPTKYHGVKANFKLTAEDKLLPTIQPQLTYPDIFGKTVCKLGEISPNLHVVTPAMSLGSRLETFKGTFPERFIDVGIAEGHAVTFSAGIAKANTPVICSIYSTFLHRAMDNVFHDVCLQNLPVIFGIDRAGLAYGDGCSHHGIYDLSFLRAMPNMIICQPRSSIVFQQLLQSSLHWQRPSAIRYPNIPALQGDPIATDINLYRDPGLGEILSQGEDVLIVGLGHMCSAALSIKLQLLSHGISATVVDPIFIKPFDNNLFSILLMHHSKVIIIEEHSIRGGLASEFNDFLATYNFKVDVLHFGIPDSIFSHGDKENLLQRVGLDVDSMVKRILTYFNFRTKKAPSNKLSIV

SEQ ID NO: 92075 - protein, 299 aa, Alteromonadales bacterium TW-7
MTTQSVPQAVSDVKSDYIVAKFGGTSVANFDAMSRCSEIIVADKSVRIVAVSASAGVTNHLVALCKSSITPQQRQEHINGVLAIQQAILDELSLDADLAVGFNETLKAFQTLALETLTTDQQHDELLSFGERLSSYLFAQVLRLKGLNADRFDVRQVLKTDSQFGKATPNVSATAQAAKEYLIPLLDDQVIVTQGFVGSDEFGQTTTLGRGGSDYSAALLAEAINAKSVHIWTDVVGIFSTDPRLCVKASPIARLSFDEAAEMATFGAKVLHPATILPASRSHINVFVGSAASLNVVVR

SEQ ID NO: 92076 - protein, 331 aa, Clostridium difficile 630
MYKVTLIPGDGIGPEVAKAMKKVVEATGVEIEWEEVNAGEAVIEEYGTPLPEYIIDSIKKNKIAIKGPITTPVGKGFRSVNVTLRQALDLYVNLRPIKSFKGIKSRYEDVDLVVVRENTEDLYAGIEHKIGDYAAESIKIITRSASERIVDFACNYVKDNKRKKVTAIHKANIMKMSDGLFLDVFREVASKHGVEYDDLIVDAAAMNLVLNPENYDVMVMPNLYGDILSDLGAGLVGGLGIIPSANIGKDCAIFEAVHGSAPQIAGQNKANPTALIQSSVMMLRYLGEYENAQKIETALEKVFLEGSKLTVDLGGSASTTEFADEVCKYIV

SEQ ID NO: 92077 - protein, 254 aa, Chlamydophila abortus S26/3
MERKRYIFGNWKMHKTAKEAKDYLSVFCPLLEEVAPVSCVGITPAFTALHACCESIKFFHSPLWLGAQNVHQDTSGAFTGEISLPMLKEFDVNFVLLGHSECRHIFHEEDTTIALKVGAAAREGIIPVLCIGETLEVREKGATEAMLSNQLMLGLAQLPETASVIIAYEPVWAIGTGKVASAVDVQEAHAFCREVLANIFSKEKAEEISILYGGSVKADNAEGFARCPDVDGLLVGGASLDPKVFADVVANFHR

SEQ ID NO: 92078 - protein, 399 aa, Bacillus cereus ATCC 14579
MLANQINERSLLLHKELVGKIEITSKVEVNSADDLSLTYTPGVAESCKAIAADEETVYDYTARGNMVAVVSDGTAVLGLGNIGPKAAMPVMEGKSILFKKFANVDAFPLCLGTTDVDEIVTLVKNLEPTFAGINLEDIAAPRCFEIEKRLKEETNIPVFHDDQHGTAIVVLAAVINALKVVSKQMDNVKIVINGAGSAGIAIGKLLLKAGAKHITLVSLEGIVCEGETWMNEAQIEVSKKTNREHVRGTLKEAIHQADIFIGVSAPNVLTKELVQTMNEKAIVFAMANPIPEIFPEDALEAGAAVVGTGRSDYANQVNNVLAFPGIFRGALDVRATDITEEMKLAAAYGIANIITDEERNANYVIPNPLDKRVVPSVAEAVAKAAIDSGVAQITKIPRY

SEQ ID NO: 92079 - protein, 817 aa, Mycobacterium avium subsp. paratuberculosis K-10
MATQKPQTISYPAPEARPRRHHTDPLDPHVIVLFGATGDLAKRKLIPGLAYLDQSELAPDIQIVATSLEDLSNDEFRELAKNAIDSFGTHKLTPDQWRNFADIITYIPQSAGSDALAAAVAEAEAKLGPNVRRLHYLSVPPKAARAVITMLRDAKLVERSRVVMEKPFGTDLASAVALNDFVHQTFEESQIFRIDHFLGKEAAQNILAFRFANGLFEPIWNRNFIDHIQIDIPEALGLDQRASFYEETGAYKDMVVTHLFQVMAFVVMEPPTALEPFAISEEKNKVFRSMLPVKPSNVVRGQYIGYREEDGVAKDSDTETFIALKVGIDNWRWAGVPVYLRTGKRMAEGIRHHLDRVQGGTADHVPARVGGGHAGARPPDVRSCGQFAGVAVVLRQAARPRHETGQAVHAILHPGDRNRGGRAGGLRTAHPGRDARRPHPVHHRRRHRITVGAFRRAAQRPATGQAVPAGDVGPQRNSPVDRAQRVAAAVRARVARSPDPTPEWAAEKCCGSAQFGAEITDGLAEFPEDFVVGQLEAVVGVHPLGGQAGDAPAGGLQVVAGRAALAEPDQFGHVDVQSVLAPGAAHRPGAFVGEHPHVGDVLGGQPAARRAERGDVVQQPVLGVRRQVGQQPLGDPGGTGAAVKAVVAQRCWPVIAQIDGDGAALGGRLRAQPGQGVGLEGDDLGLVDLEHHGARRPGQPVGPRVEPGGQDDGLANAGSGRGAEEIVEKPRPHRDLLAPLLQRHRHVVGVERDLAVQHPDEEGMPDRAHQRFGEPVVEQRVRTARGQRPGGRDHGRGRPHAGGQIPAVALGTCRTGR

SEQ ID NO: 92080 - protein, 326 aa, Bacillus anthracis str. Ames
MIKDSSVQVEGQEKVCLDQWVAHYRTYAAKGRSASYIPALGEINVSQLGICIVKPDGTMIKSGDWEIPFTLQSISKVIGFIAACLSRGISYVLERVDVEPTGDAFNSIIRLEIHKPGKPFNPMINAGAITIASLLPGTSVQEKLESIYVLIEKMIEKRPAINEIVFQSEWETAHRNRALAYYLKENGFLESDVEETLEVYLKQCSIEINTEDIALIGLILAHDGYHPIRKEQVLPKEVARLTKALMLTCGMYNASGKFAAFIGLPAKSGVSGGIMTLVPSKSRKDLSFQDGCGIGIYGPAIDEYGNSLPGIMLLEHIAKEWDLSIF

SEQ ID NO: 92081 - protein, 247 aa, Vibrio cholerae O1 biovar eltor str. N16961
MRNTMFTSKEGQTIPQVTFPTRQGDAWVNVTSDELFKGKTVIVFSLPGAFTPTCSSTHLPRYNELFPVFKEHGVDSILCVSVNDTFVMNAWKDDQNADNITFIPDGNGEFTDGMGMLVDKNDLGFGKRSWRYSMLVKDGVVEKMFIEPNEPGDPFKVSDADTMLKYIAPQYKVQESVTIFTKPGCPYCAKAKQALIDAGLQYEELILGKDATTVSLRAVSGRTTVPQVFIGGKHIGGSDDLEVYLNQ

SEQ ID NO: 92082 - protein, 416 aa, Shewanella oneidensis MR-1
MSLVAIGINHKTATVDLREKVAFSPDKIHDAMKSLASRTRSGEAVIVSTCNRTELYCNNGDETDIIEWLEEYHGLEHQDVAPCLYNYHGQEAVRHLMRVASGLDSLILGEPQILGQVKQAFVKAKEAGTVALTIDRLFQNTFSVAKKVRTETEIGAAAVSVAFAAVSMAKHIFSSLSTTKVLLIGAGETIELVAKHLKDNGVASMVVANRTLERAQSMCEEFNATAITLAQIPDFLPKADIVISSTASPLPILGKGMVEKALKQRRHQPMLLVDIAVPRDIEPEVADLDDAFLYTVDDLHSIIEQNKASRKEAAEQAELITEEQSHLFMEWVRSLESVDSIREYRSQSMAIKDELVERALNKLAQGGDTEQVLVELANRLTNRLIHAPTQALTVASRQGDLNTLGQLRTALGLDKN

SEQ ID NO: 92083 - protein, 448 aa, Aspergillus oryzae
MSRRSMHYLRGCYPRALRTTSAQHASSILPSRCRLPSTVRPIVFTQKKNWQSLQLRQFSASALHAAETKIICVPSMAESISEGVLSTFNRQVGDYVEQDEEVASIETDKIDVAVNAPQSGMITKLIVNEGDTVTVGQAVIEISLEERDTTSQSPLPPQAEQTSKTPQEATQKQQIPTREITPSQEPKKGTTPTPTPKTTPQPVPNSQGPVSAFQGSRSETKVKMSRMRLRTAERLKESQNTAAFLTTFNEADMSKIMALRSQNKDDVLQKHGVKLGFMGPVARASALALREIPAINASIENDDTIVFHDYIDLSVAVATPKGLVTPVLRNMERQGIVEIEQGIAELGKKARDGKLTMDDLVGGSFTISNSGIWGSLFGTPIINIPQTAVLGIYGIQQRPVAIDGQVEIRPMMYTALTYDHRLVDGREAVTFLTLVKKYLEDPASMLIA

SEQ ID NO: 92084 - protein, 315 aa, Shewanella oneidensis MR-1
MPDIKLFAGNATPSLAKKIADRLFCKLGDAVVGRFSDGEISVQINENVRGADVFIIQSTCAPTNDNLMELIVMVDALRRASAGRITAVIPYFGYARQDRRVRSARVPITAKVVADFLSSVGVDRVLTCDLHAEQIQGFFDVPVDNVFGSPVLLEDMLAKKLDNPVVVSPDIGGVVRARAVAKLLDDSDLAIIDKRRPQANVAQVMHIIGDVQGRDCIIVDDMIDTGGTLCKAAEALKEHGANRVFAYATHPVFSGKAAENITNSVIDEVIVTDTVPLSPEMLKVAKVTQLTMSAVLAEAIRRVSNEESISAMFSH

SEQ ID NO: 92085 - protein, 328 aa, Oryza sativa
  misc_feature (294)..(294): Xaa can be any naturally occurring amino acid
  misc_feature (302)..(302): Xaa can be any naturally occurring amino acid
TLSLRTPQPLVPLPPPTFSAFQPPRALPRPPPMASAAAPTTSSLSLAARRAAAVGPAAASPLRRGGLAAGCQPARSLAFAAAADPRLATHVASRCRQAASSSARGTRAVATMAKKSVGDLTAADLEGKRVFVRADLNVPLDDNQNITDDTRVRAAIPTIQYLIKNGAKVILSSHLGRPKGVTPKFSLAPLVPRLSELLGIQVTKAEDVIGPDVEKLVSELPNGSVLLLENVRFYKEEEKNDPEFAKKLASLADLYVNDAFGTGHRAHASTEGVTKFLKPSVAGFLLQKELDYLXVGAVSSPXRPFAAIVRGSKVSSKIGGYEIPFGKM

SEQ ID NO: 92086 - protein, 292 aa, Chlamydomonas reinhardtii
MGKGERPEHMAPPDIFYNEDEARKYTTNSRMINIQSTLTERALELLALPQDGLPRLLLDLGCGSGLSGEALSEAGQVWVGLDISAAMLDVAHEREVEGDLVLGDLGHGLPLRPGSFDGAISISAVQWLCNADRAGHDPRKRMKRFFETLYMSLRRGARAVLQIYPENHKQAEMLVAAAMKVSGLGGFAGRWRGPFQRGAQVFQVVTRDGVGTSISVPTAKGLDGGEPEDEEEEAAAEHVAGRDRNKRRRTGSGKGDGKGREWVLRKKEQMRKKGYDIAPDSKYTARKRKRVV

SEQ ID NO: 92087 - protein, 185 aa, Buchnera aphidicola str. Bp (Baizongia pistaciae)
MLQENLGLSFEVEILSNIGRNVSGDLKEKLISVNRVSKTVKGGRIFSFSALTVVGDGHGKVGFGYGKAREVPSAIQKAMEKARRNMIQVPLNNGTLQYSVTGSYTGSYIFMKPASNGTGIIAGGAMRSVLEVAGVHNVLAKTYGSTNPINVVRATMLVLESMKSPEMIALKRNKLVKEILENSYL

SEQ ID NO: 92088 - protein, 262 aa, Vibrio cholerae O1 biovar eltor str. N16961
MSDLKLSPLVIKLGGAALDCAETLSKLFGAIAQYQNQAQRRIVIVHGGGYLVDDLMAKLQLKSVKKDGLRVTPYDQIPIIAGALAGTANKMLQGQAIKDGINAVGLSLADGGLCHVEELDPELGAVGKATPGDSTLLQAILATGAMPIISSIGLTAQGQMMNVNADQAAVAVAGALDAELVLLSDVSGVLDGKGHLIATLDAKQADALIAGKVITDGMIVKVKAALEAAQDLGRPIEVATWRYPEKLAKLFGGESIGTRFLP

SEQ ID NO: 92089 - protein, 276 aa, Oryza sativa Japonica Group
MLVMNDGSKNLLRAINNRLSALSFHIREYYWVDMKKINEIYRYKTEEYSHDATNKFNIYPEQIPSWLVDWIPEKGGYLIGNLQPAHMDFRFFSLGNLWAITSSLTTPKQAEGILSLIDEKWDDLIANMPLKICYPAMEDDEWRIITGSDPKNTPWSYHNGGSWPTLLWQFTLACIKMGRPELARRAIAVAEEKLAADKWPEYYDTRSGRFIGKQSRSYQTWTIAGFLTSKMLLENPELASILTCDEDLELLEGCACCLSKKRTRCSRRAAKSHVVE

SEQ ID NO: 92090 - protein, 302 aa, Chlamydomonas reinhardtii
MMLSTKALAARPSRRALSVRASSVQGKNVFITGGNTGIGYETALTLAREGAKVTIAARDANKAANALAQIRAAVPSAAVDSLPLDLSDLVSVSDCAKRVADSGVAYDVWINNAGVMATPKMSTAQGFEYQLGVNHLGHFALTTAVLPALQAANKPVRVINVASAAHMFGKIDFDDLMRDRNYDAWEAYGQSKLANVMFTYEMARRVGPTSPITVNALHPGVLMKLFMLEPIEGAATSLYLASSPEAEGITGKYWVKSKRAVSSNDSYNRQVAQRLWEVSEELVETALAKARWCCKAAFKLIV

SEQ ID NO: 92091 - protein, 334 aa, Staphylococcus aureus subsp. aureus MRSA252
MSQERYSRQILFKQIGEIGQNKINQKCALIIGMGALGTHVAEGLVRAGIAKLIIVDRDYIEFSNLQRQTLFTEEDALKMMPKVVAAKKHLLALRSDVDIDDYIDHVDYYFLETHGQDVDVIIDATDNFETRQLINDFAYKHRIPWIYGGVVQSTYTEAAFIPGKTPCFNCLVPQLPALNLTCDTVGVIQPAVTMATSLQLRDAMKVLTEQPIDTKITYGDIWEGSHYSFGFSKMQRTACTTCGDVPSYPYLNKNEQRYATLCGRDTVQYENTSITHDILVQFLKQHQLNYRSNSYMVMFEFKGHRIVAFKGGRFLIHGMTRTSDATHLMNLLFG

SEQ ID NO: 92092 - protein, 423 aa, Candidatus Paracaedibacter symbiosus
EETRFYRLRAIFWPIHNFEIKKFLPMGLMMFCILFNYTVLRDTKDSIVANAPGSGAEALAFIKLYGTTPAAILFMILYAKLSNVLSARAILCSFGAILVLLCCVCDVYLSKREALHMTEASIHALQGEYKYLHWIIPVIGNWSYSLFYIPSELWGSVVISLLFWQFANEITRVGEAKRFYGMFGLIGNFGLMLSGYTVYYFSSIRDSVPEGVDPWGMTLNYLMTFVVISGICVVAIYSWMNKAVLTDKRFYDSEEGAVEKKKDKPKLSLAESFKYLLQSPYLGLIATIVLAYGVSINLVEGVWKGQIKIRFPNPNDYNAFMGQFSFITGVVTVILMIVGNNILRRLSWVAAALITPVMILITSLIFFGVIMYGNSVNDPLYPIMGTTMVMIAVLAGLAQNVLTKSTKYSLFDPTKEMAYIPLD

SEQ ID NO: 92093 - protein, 946 aa, Gibberella zeae PH-1
MTTFDYFSHVELPTPTLSPEEACALLHQQFGIAANLRPLGSQQDQNFLVLTAAHTEPLGVLKISNPAFSGSEIEMQDAAAIAVARAEPSLRIPHVIEGPRGAMSGWWQTSQGRLHCRIISFVSGTTLTGSHYLSPAVVQRLGELSAAVSLALATETHPAAGRTLQWDLQHAERVIVTITATEPDVDVRALTAQASQHALSLLRPISDRLPRQLGHFDVTDDNVLRPDGNALSLPDAVIDFGDVVESWAVAEIAITVSSMLHHADACYRTVLPAIVAFNRRRRLSDDEITALWPLVVLRGVVLVLSGRQQVRLDVNNEYAKRALDRESTILRRATEVPLEVVTAQIRHTLGLPVGIAPRWSGKSILAAPRSVEVLDGSTLSTLADDGAWLQNDAVERAAQHLLAQGADMVVLPALRPVLLGAPARTQQLPSTVPTSAAAWFASAATLEIPANLCVRQAGTALPVGVATVAAGSRIDVLLTALDQANVPTAIPAVDLPGWSVVIGDATEALGVTPPTNDVDDKGLLERREAVVAEVQEHYYARPPQIERGWREYLMDVDGRVYLDMVNNVASVGHAHPRISAAIARQTRLLNTNSRFHYAAITRYAERLAAQLPDPLDTVFFVNSGSEAVDLAIRLALAATQRQHVVAMAEAYHGWTYASDAVSTSIADNPHALQTRPDWVHTVEAANAYRGRYRGAEASKNYAADAVARLQSLAAEGHAPAAFLSETYYGNAGGIALPDGYLREVYAAVRNMGGVTIADEVQVGFGRLGSWFWGFQQQAVVPDIVAVAKSIGGGFPLGAVITSRTIADQYRSQGYFFSSTGGSPLSSVVGLTVLDIIQEEQLQENARVIGACLKTRLQALGKRHPLIGTVHGDGLYLGLEFVRDRTSLEPATKETRAICNRLLELGVIMQPTGDHQNVLKIKPPLCITQQSVDYFVNMLDYVLLKGF

SEQ ID NO: 92094 - protein, 277 aa, Candidatus Caedibacter acanthamoebae
FYTFWELWGSVMISLLFWQFANDITRTEEAKRFYAMFGLIANVALIFSGTTVEYFSEIKDKLPPEIDAWGYSLNYMMGAVVLCGVAAIALYWWVTEYVLTDPRFYDASAPKNKKEKKDKPKLSVGESFKLIFSSPYIGYIAILVLAYGVSINLIEVVWKDQLKQAFPNPNDYGAFMGKFSRATGIVTMLLIWFTKGIVRKFGWFTGAIVTPAVLIITGALFFAFVLFKDELTPLVAGFGLTATLMATYIGAIQNILSKGTKYSNFDPTKEMAYIPLD

SEQ ID NO: 92095 - protein, 470 aa, endosymbiont of Acanthamoeba sp. TUME1
IASTDTPASGAETLPFLKVWGVVPGAIIFMLLYAKLSNILSKEALFYTVLAPFLVFFALFAFVLYPNREILHPTTSADYLRSILPAGLSGLVACYRDWTFSLFYILAELWGSAVLSLMFWGFANDIMRVTEAKRFYTLLGLGANVALLVSGPTIVYFSNIQSRIPAGVDPWQVSLNYLMTFVVLAGVSVLAIYYWMNRNVLTDPRFYNPEEEKKGKKSKPKMGILESFAFLAKSKYILCIALLVISYGICINLVEVTWKGQLKLQYKNPNDYNAFMGMFSTITGLVTIIMMFLGGWITRKKGWGFAAMATPIVLLITGIGFFSFVIFKDHLAGFISYFGTHSIMLAVIFGMIQNIMSKSTKYSLFDPTKEMAYIPLDQESKVKGKAAIDVVGARLGKSGGSFIQQGLLVALGSLAAITPYVAIIMTFFILIWLAAVRSLNRQFIALTQEKTDTSEGSTLVETEGTAKISG

SEQ ID NO: 92096 - protein, 473 aa, Saccharomyces cerevisiae
MRSYMQILQKFAKFIGPGILVSVAYMDPGNYATSVSGGAQYKYTLLFSIFISNIFAVLLQCLCVKLGTITGYDLAENCRHNLPKKLNYTLYLFAEVAIIATDLAEVVGTAIALQILFKIPLTWGVLLTVLDVLVILMFYTPNGQSLKKVRVFEFGVGILVIGTCICFVLELFKVSIPDKAELFKGFLPSNIIFKEQQALYISLGILGATVMPHSLYLGSSIVKPRLHDYDLKKYGKVNARPSLSAIKYTLNYAYAELIISLFLIATFVNSAILIVAGATLSGQPEAEDADLLSIYKLLVHYISPAAGLIFALAMLCSGQSAGIICTLAGQIVSEGFLQWSLPPWATRLCTRLIAIVPCLFVTLTMGEKGISDILNFSQVVLSLILPIVSAPLIYFTANRKLMVVHDENGVVRAPADVNAIADETTPLNSKHSKIVDFTNSRLLTYTSVFVWALIGSLNCYLVISYLLGADIHF

SEQ ID NO: 92097 - protein, 363 aa, Xylella fastidiosa Dixon
MAAIITTARQPFKSETPLTTFPFRFPAEWEPQSAILIAWPHANTDWSAHLADVEETYIALVAAITRFQMVIICVLDDDLQTYTEARLRSASVAMQQVRFTVASYNDTWLRDSGPITLIGTNGDFRLLDFRFTGWGGKFEAKADDQLVSALHAKGLFKNTQMHSINFALEGGAIETDGAGTLLTTWRCLHERHPQRTRTTLDANLTAWLAQNRVLWLEHGYLEGDDTDAHIDTLARFASTDSIVYQSCDNTTDSHYAELQAMANELTALRTTEGRPYRLFPLPWTKPILDQDRRLPASYANFLIIEGAVLMPTYNDPADTIAQSVLAEAFPTREIVPVPCRPLIWQNGSLHCITMQIPAGLLAT

SEQ ID NO: 92098 - protein, 513 aa, Candidatus Protochlamydia amoebophila UWE25
MSQDAKQDFGKWRAFFWPVHGYELKKLLPMFFMFFFISFNYTILRDTKDTLIVTSAGAEAIPFLKSFGVVPAAILFMIIYAKLSNTLSRENLFYVTLLPFIIFFGLFAFVMYPAREVLMPHASAEALKAYLPGGWTGLAAAYENWMYSIFYILAELWGSVVLSLLFWGFANQITRVNEAKRFYSLFGLGANLALLVSGPAIVYVSDIRKHLPANVDAWQISLNYLMGMVVIAGLAILAIYWWINRAVLTDPRFYDLNQEKAPGKKKKAKMSLGESFKFLFTSKYILCLAILVIAYGISINLVEITWKSLVKLQYPNPNDYSTFMGWFSTMTGAVTILMMLFVGGNVIRHKGWGFAALITPVVLLVTGIAFFSFVIFKDHLAGYIAALGTTPLFLAVIFGAAQNIMSKSAKYSLFDPTKEMAYIPLDDESKVKGKAAVDVVGARLGKSGGSIIQMGLLAFGTLATITPYIGAILMVIIAAWIVAARSLSKQFTQLTAEQNIEKNIDKTSEIATS

SEQ ID NO: 92099 - protein, 590 aa, Saccharophagus degradans 2-40
MANGLTFFASALYTANTFALDRACIFMTDTPLGSAETEAGNDKPLNFLEQIIKKDIDEGRCNGLVTRFPPEPNGYLHIGHAKSICLNFGLAERFGGVCNLRFDDTNPAKEEMEYVEAIKADVEWLGFTWGGDIKYASNYFDQFYGWAQHLIKNGKAYVCDLNAEQAREYRGTLKEGGKPSPYRERSVEENLDLLERMKNGEFDEGAKTLRAKIDMSHGNINMRDPILYRIRKQSHHQTGDKWCIYPSYDFAHGQEDAIEGVTHSICTLEFADHRPLYEWFIENLPVPSKPKQYEFGRLNLNYTVTSKRKLKQLVDEGVVTGWDDPRMPTIAGYRRRGYTPAAIRKFCEMIGVTKSDGVVDVAMLEHAIRDDLDKNAPRAMCVLNPLKVTLTNYPSDKTEVFTAAGHPNRDDLQSRELPFGQVVYIDKEDFREEANKKYKRLVIGKRVRLRNAYVIEADEAIKNDAGEIIEVKARIIENTVGNDPEDGVKPKGVIHWVAAHDCVDAEVRLYDRLFVDEAPDAGNKDFMETINPESLTVLTNCKLEKSLAMATAGQGFQFEREGYFCRDAKEPGLVFNRTIGLRDSWGKKDA

SEQ ID NO: 92100 - protein, 313 aa, Staphylococcus aureus subsp. aureus MRSA252
MTKKVYFNHDGGVDDLVSLFLLLQMENVQLIGVSTIGADCYLEPSLSASVKIINRFSKEDIQVAPSYERGKNPFPKEWRMHAFFMDALPILNEPVKHVASNVRDKEAFEDIIQTLKRQSEKVTLLFTGPLTDLAKALQKDSSIVQYIEKLVWMGGTFLPKGNVEEPEHDGSAEWNAYWDPEAVKIVFDSDIEIDMVALESTNQVPLTLDVRQRWANERQYTGIDFLGVSYAAVPPLTHFITNSTYFLWDVLTTAYIGNKDLVHSIEKKVDVISYGPSQGKTFECKDGRKINVINHVDNNAFFDYITALAKKVN

SEQ ID NO: 92101 - protein, 450 aa, Lactococcus lactis subsp. lactis Il1403
MKVAKFGGSSLASASQIKKVFDIVQADKQRKFIVVSAPGKRSGADTKVTDALIAYYKAYKSADEKGIHYYQNWIIERFREIYDELGLKSPVINQIAENINHLAQLDLDNVFTYDTFLAAGENNNAKLVADFFNHSGLPSRYVHPSDAGIMVSSDPGNARLLGGAYEHIKYLNELEETLIIPGFFGITKEGEVCTFSRGGSDITGSIIAAGVRAELYENFTDVNGIFAAHPGIVKNPAYISELTYREMRELAYSGFSVLHDEALVPAYRAHVPLVIKNTNNPDHPGTKIVVQRETKGSPVVGIASSSAFSSLYVSKYLMNREVGFGRKVLSVLENLGVRFEHMPTGIDDMSIIIRSRYLTQPISKALISNLTESLHPDEVYIDRDFSIITIVGEDMKEHVGVTARATAALSKQGISIAMLSQGSSEVSVMFIVKEKYEKEALKAIYSAFFD

SEQ ID NO: 92102 - protein, 265 aa, Neochlamydia hartmannellae
FWGFANQITRVTEAKRFYTLLGLGANVALLVSGPTIVYFSDIQSRIPAGVDPWQVSLNYLMTFVVLAGLSVVGIYYWMNRKVLTDTRFYNPDEEKKVKKSKPKMGIFESFAYLAKSKYILCIAILVIAYGICINLVEVTWKGQLKLQYKNPNDYNAFMGLFSTITGAVTIAMMVIGGWITRKKGWGFAAMMTPIVLLVTGVAFFSFVIFRDNLTGFISYLGTTPLMLAVIFGMMQNIMSKSTKYSLFDPTKEMAYIPLDKGEFQH

SEQ ID NO: 92103 - protein, 497 aa, Oryza sativa Japonica Group
MNLIKHAAFAASFQGETDCTSHASARKFSTSGSSPLLDSTEGNGFKGHSMLAPFTAGWHSTDLEPLIIERSEGSYVYDSKGNKYLDTLAGLWCTALGGSEPRLVKAATDQLNKLPFYHSFWNSTAKPPLDLAEELISMFTAKEMGKVFFTNSGSEANDSQVKLVWYYNNALGRPNKKKIIAQSQAYHGSTLISASLSGLPAMHLKFDLPAPFVLHTDCPHYWRFGLPGEAEEEFATRLADNLENLILKEGPETVAAFIAEPVIGAGGVIPPPKTYFEKIQAVLQKYDVLFIADEVITGFGRLGTMFGSDLYNIKPDLVSLAKALSSAYVPIGATLVSPEISDVVHSQSNKIGFFAHGFTYSGHPVSCAVALEALKIYRERNIPAHVKQISPRFQEGIKAFAGSSIIGETRGVGLLLATEFANNKSPNDPFPVEWGVAQIFGAECKKRGMLVKVVGDEIAMSPPLIMSQREVDGLVSIYGEALKATEERVAELRSKKK

SEQ ID NO: 92104 - protein, 487 aa, Marinobacter sp. ELB17
MGKITGFMEFQRQKESYLPAASRVKNYKEFILPLKDVQAKTEGARCMDCGTPFCMTGCPVNNIIPDWNQLVYSGNYREALETLHSTNNFPEFTGRICPAPCESACVLAINNDAVGIKSIEHFIIDKGWENGWVTPQPAAFKTGKKIAVVGSGPAGLAAAQQLARVGHDVTVFEKNDRIGGLLRYGIPGFKMEKSHIDRRIEQMQAEGVQFRTSVLIGEDFPSNIINWTKETISPKQLNQKFDAIILAGGAELPRDLPVPGRELKGVHFAMEFLPQQNQVDAGDKLNDQIMASGKHVVVIGGGDTGSDCVGTCNRHSAASLAQFELMPQPPEQEDKPLVWPYWPIKLRTSSSQEEGCDRDWAVATKRFEGKGGKVEKLIAVRVEWIDGKMQEVPNSEFEMKADLVLLAMGFVSPVTQVLEAFAVEKDTRGNVKATTDGDGCYQTSVDKVFAAGDMRRGQSLVVWAIREGRQAARAADEFLMGVSNLPR

SEQ ID NO: 92105 - protein, 497 aa, Aspergillus nidulans FGSC A4
MSDLFTTIETPVIKYEQPLGLFINNEFVKGVEGKTFQVINPSNEKVITSVHEATEKDVDVAVAAARAAFEGPWRQVTPSERGILINKLADLMERDIDTLAAIESLDNGKAFTMAKVDLANSIGCLRYYAGWADKIHGQTIDTNPETLTYTRHEPVGVCGQIIPWNFPLLMWSWKIGPAVAAGNTVVLKTAEQTPLSALYAAKLIKEAGFPAGVINVISGFGRTAGAAISSHMDIDKVAFTGSTLVGRTILQAAAKSNLKKVTLELGGKSPNIVFDDADIDNAISWANFGIFFNHGQCCCAGSRILVQEGIYDKFVARFKERAQKNKVGNPFEQDTFQGPQVSQLQFDRIMEYINHGKKAGATVATGGDRHGNEGYFIQPTVFTDVTSDMKIAQEEIFGPVVTIQKFKDEAEAIKIGNSTDYGLAAAVHTKNVNTAIRVSNALKAGTVWINNYNMISYQAPFGGFKQSGLGRELGSYALENYTQIKTVHYRLGDALFA

SEQ ID NO: 92106 - protein, 170 aa, Mycobacterium sp. MCS
MPEPLIVAVGEHAPELHDTAWVAPNAAVIGRVKLSAKASVWYGATLRAEAEPIEIGAGSNIQDGVTMHVDPGFPASVGANVSVGHNAVLHGCTIEDDCLIGMGAVVLNGARIGRGSLVAAGAVVAQGVEVPPGSLVAGVPGKVRRELSEAEVDGNRTNATLYQHLVDMHR

SEQ ID NO: 92107 - protein, 488 aa, Geobacillus kaustophilus HTA426
MSITKPETTVLKNYIGGQWVASSGTETLEVPNPATGEVLARVPISTKEDVDQAVQAAKKAFATWKDVPVPKRARIMFSFHHLLNQHHEELAELVVQENGKAYKEAYGEIQRGIECVEFAAGAPTLLMGESLSNIAEEIDSEMFRYPLGVVAGITPFNFPMMVPLWMFPLAIVCGNTFVLKPSERTPILANKLAELFTEAGAPPGVLNVVHGAHEVVNALIDHEDIRAISFVGSQPVAKYVYERTAAQGKRVQALSGAKNHHIVMPDADVETAVQHVISSAFGSAGQRCMACSAVVIVGENETFVRRLKQKADELIIGNGMDPEVLLTPVIRQSHREKVLGYIQKGIEEGAVLLRDGRKEMDDRPEGNFLGPTIFDYVTPDMTIAKEEIFAPVLSLLRANDLDEALSYIRKSRYGNGATIYTKDAKAVRKFREEADAGMLGINVGVPATMAFFPFSGWKDSFYGDLHVNGKDGVNFYTRKKMITSRFDF

SEQ ID NO: 92108 - protein, 282 aa, Sulfitobacter sp. EE-36
MTSKTAPRIAFQGALGAYSHEACLQARPDMIPVPCMTFEGVIRAVREGRADLAMLPVENSTYGRVADIHRLLPQSGLRIIAEAFVRVRISLMAHDGVKLEDIKHVRAHMVLIPQARSWLDAHGITSEAAADSAGAAADLAVSEERDVGVLASEVAADIHGLKVLARDIEDLDHNTTRFLLMSPELDRTRRAENMLTTFVFQVRNIPAALYKAMGGFATNGVNMTKLESYMAGGSFTATQFYADIEGHPEDPAVARALEELAHFTNFIDILGVYPAHPDRHGQ

SEQ ID NO: 92109 - protein, 450 aa, Geobacillus kaustophilus HTA426
MQTEQTHQLWLDKDDRYIWHSMKPYNPQATLIAAEAKGCWVTDAAGHQYLDAMAGLWCVNVGYGREELAEAAYEQLKTLAYFPLTQSHLSAIQLGEKLNELLGDEYVIFFSNSGSEANETAFKIARQYHQQRGEHHRYKIISRYRAYHGNSMGALSATGQAQRKYKYEPLAPGFIHVPPPDVYRDPDAADDPRRLRAVKAIDDVMTWELSETIAAVIMEPIITGGGVLIPPDGYMKAVKEVCEKHGALLIVDEVICGFGRTGKAFGFQHYGVKPDIITMAKGITSAYLPLAATAVRKEIYEAFKGTGEYDYFRHVNTFGGHPAACAVALKNIEIMEEERLFDRSREAGEWLLSALKTKLADHPYVGDVRGKGLLVGIELVADRATKEPLDVSLVNQVIHRCKENGLIIGKNGTTVAGYNNVLTLSPPLCITDDELSFVVRVLTGALAAIQ

SEQ ID NO: 92110 - protein, 208 aa, Triticum aestivum
  misc_feature (164)..(164): Xaa can be any naturally occurring amino acid
  misc_feature (171)..(171): Xaa can be any naturally occurring amino acid
MESSSPSVPFPLLQAPVESTYRACTIPYRFPSDNPRKATPVEIQWIDLFLKSVPSFRQRAENDPTVPDAPAKAEKFAQRYTDMLEELKKNPESHGGPPDCILLCRLRELILRELGFHDISQKVKDEENAKGMSLFEGVVHRNDEIKDGEKRAENLIGGILAGNXFDLRAAXQFEKVFAKKGMSFLGGGGKNPFTLRPWGCLKDLEMHF

SEQ ID NO: 92111 - protein, 576 aa, Glycine max
  misc_feature (212)..(212): Xaa can be any naturally occurring amino acid
MADGSSSNTKRNSLILHHPTNLKGGWNAAIFIIFVEFAERFAYQGLASNLIQYLTNVLNEPITQAAKDVNTWVGASSLFPLLGGFIADSYLGRFNTILLSSVIYFAGMVFLTLSVSALKHKFLFFLALYVLAIGDGGHKPCVQTFAADQFDEDTPEEKDAKSSFFNWWYLGIVAGSTASVFVVIYLHDNVGWGVGLGVLAGVLALALALFLXGIKRYRKEGPAGSPFTRLAQVFVAASRKWRVQATHGHHNYCYDEDEEHHEPHNHLHVQPKIHTLLHTHQYRFLDKAAIIDEIDAKTKTRDPWRLCSVTQVEEVKLVLRLIPIWLSCLMFTVVQAQVHTFFIKQGATMVRSIGPHFQVPPASLQGLVGVTILFAVPFYDRVFVPLARKITGKPTGITVLQRIGVGLFLSILNMVVSALVEAKRVGVAKESGLIDDPKAVLPISIWWLLPQYMITGISDAFTIVGLQELFYDQMPEALRSLGAAAYISIVGVGSFVGNIVIVVVEGVTSRAGEKWLGNNLNRAHLDYFYWVLAGLSAVNLCVYVWLAIVYVYKKVDEGHQTSDQQGSSHKKYKPGV

SEQ ID NO: 92112 - protein, 587 aa, Aspergillus oryzae
MTLYHSWLGLLYLLCLVQWVSCKVVQFELNLTWENHEVAGATRKTILSNGQFPSPTLRLKQGDTVEFLVNNSMPFEATVHFHGIEQRDTPWSDGVPGLSQKPIAPGDQFFYTWTATHYGTYIYHAHTRSQIEDGLYGAIYIQPDESVEKPFHLIADDAKELQAMGEAELETKPIILSDWRHLTSEEIWQAQVASGVENFCANAVLINGKGSVLCLPQDRINALTTPAQRRALGNKTLTDMGCLPPSDPRKANLTPNGFLRGCTPSQGPAEVFEVESASQYRSWDLINIAGSLELAFSIDQHPLYVYAVDGRYIEPIRVDAITIPIGSRYSVLVKLDQPAGEYMVRAANTGANQIINGTGIMRYRASTHNRNRLSQPWITEVGTNATENTVFLDETRVVPFPVEVPSLHVDRTYILNVDHIGNSYSWTLGNHSYPQSNEEAIPLLFNRSSISTKYTITTLNNTWVDLIVNVTTGGQPPHPIHKHSNKYFVIGSGSGAFRYHSVAEAVKDIPESFNLRNPQMRDTFFSPPADAGPSWLAIRYHVANPGPFLLHCHIQPHLSGGMALAIMDGVDSWPHVPEEYELPAVSH

SEQ ID NO: 92113 - protein, 328 aa, Populus trichocarpa
MASNGVNDKSLIVSFGEMLIDFVPTVSGVSLAEAPGFVKAPGGAPANVAIAVARLGGKAAFVGKLGDDEFGNMLAGILKENGVIATGINFDTGARTALAFVTLRADGEREFMFYRNPSADMLLRPEELNLELIRSAKVFHYGSISLIVEPCRSAHLQAMRVAKDAGALLSYDPNLRLPLWPSEEEAREQILSIWDEADVVKVSDNELEFLTGSDKIDDETAMSLWRPNFKLLLVTLGEKGCNYYTKNFHGSVEAFHVDTVDTTGAGDSFVGALLCKIVDDHSVLEDEPRLREILRFANACGAITTTKKGAIPALPTPADALKLVKEGK

SEQ ID NO: 92114 - protein, 494 aa, Geobacillus kaustophilus HTA426
MGKATGFMEYAREEEKKRDPLSRLDDWKEYTQPFSEEVLARQGARCMDCGTPFCHMGLELNGLTSGCPVHNLIPEWNDLVYRGRWKEALDRLLKTNNFPEFTGRVCPAPCEGSCTVAISDPAVAIKGIERAIIDKGFAEGWVKPRIPKTRTGKKVAIVGSGPAGLACADQLNQAGHSVTVYERADRIGGLLMYGIPNMKLEKEVVERRVRLLEEEGITFITNTEVGKDIMADELRAQYDAVVLCIGAQKQRDLAIEGRELEGVHFAMDYLTGVTKSLLDSNFADGQFIDAKGKRVIVIGGGDTGADCVATALRQGCKSVVQFGKHPALPDKRPDNNPWPQYPLVFTLDYAYEEAKAKFGADPRQYCIQTKKIVGDEHGRVKELHTIQMEKIIDENGKAIFKEIPGTEQVWPCDLVFIAIGFEGPEQPLLKQFGVETINNKVKAPYGKYTTNIEGVFAAGDARRGQSLIVWAIHEGRGAAREVDRFLMGETKLPS

SEQ ID NO: 92115 - protein, 533 aa, Chlamydophila abortus S26/3
MLCAMSIVLDKIGKTLGTRVLFDDVSVVFNPGNRYGLTGPNGAGKSTLLKIITGSVEPTRGSISLPKKVGILRQNIDSFGDVSVLDCVIMGNARLWDALQKRDALYLEEFTDAIGIKLGEMEEIIGEENGYRAESEAEELLTGIGIPEALFNSKMSAMPIDLQFRVLLCQSLFGHPEALLLDEPTNHLDIHSINWLGNFLKDYDGTVIVVSHDRHFLNTITTHIADIDYDTVIIYPGNYDAMVEMKTASRDQEKADIKSKEKKIAQLKEFVAKFGAGSRASQVQSRLREIKKLQPQELKKSNIQRPYIRFPLSEKASGKIVFSLEGITKSYNDETPLFQPFSLEIYQGDKLGIIGNNGLGKTTLMKLLAGVESPTQGSIKTGHQVAYSYFPQNHSDVLKDCGDETLFEWLRNRKTGINDQEIRSVLGKMLFGGDDAFKQIKALSGGETARLLMAGMMLENHNTLILDEANNHLDLESVSALAWAINDYKGTAIFVSHDRTLIEECATKLLIFEKGKITFFDGTMADYTSSSKL

SEQ ID NO: 92116 - protein, 466 aa, Streptococcus pyogenes M49 591
MNAKLKYKAKKIKMVFFDIDDTLRVKDTGYMPESIQRVFKALKAKGILVGIASGRARYGVPQEVQDLHADYCVKLNGAYVKDDAKTIIFQAPIPADVVVAYKKWADDMGIFYGMAGRHEAVLSARNDMISNAIDNVYAQLEVCPDYNEYHDVYQMWTFEDKGDGLQLPAELAEHLRLVRWHDNSSDVVLKGTSKALGVSKVVDHLGLKPENILVFGDELNDLELFDYAGISIAMGVSHPLLQEKADFITKKVEEDGILYALEELGLIDKELQFPQLDLPNHKGPKATIKTNHGDMTLVLFPDHAPKTVANFLGLAKEGYYDGIIFHRIIPEFMIQGGDPTGTGMGGQSIYGESFEDEFSDELYNLRGALSMANAGPNTNGSQFFIVQNSKIPYAKKELERGGWPAPIAASYAANGGTPHLDRRHTVFGQLVDETSFQVLDLIAGVETGAQDKPKEDVIIETIEVFD

SEQ ID NO: 92117 - protein, 219 aa, Oryza sativa Indica Group
KKVVISAPSKDAPMFVVGVNEKEYKPDIDIVSNASCTTNCLAPLAKVINDRFGIVEGLMTTVHAITATQKTVDGPSSKDWRGGRAASFNIIPSSTGAAKAVGKVLPALNGKLTGMAFRVPTVDVSVVDLTVRLEKPASYDQIKAAIKEESEGKLKGILGYVEEDLVSTDFQGDNRSSIFDAKAGIALNDNFVKLVSWYDNEWGYSSRVVDLIRHMYNTQ

SEQ ID NO: 92118 - protein, 495 aa, Pseudomonas fluorescens PfO-1
MAIQEKRSRKMAGAQTHMHTALLIDGELVAGQGFVEPILNPATGEVLTQIAEASTEQVEAAILAAHRAFAEWSRTTPQQRSNLLLEIANAVEKHADHLARLEALNCGKPLHLARQDDLTATIDVFRFFAGAVRCQTGQLSGEYVPGYTSMVRRDPIGVVASIAPWNYPIMMAAWKIAPALAAGNTLVFKPSEHTPLSILALAPALAEILPRGVINIVCGGGEGVGSHLVGHPKVRMVSLTGDIVTGQKILQAAAKTLKRTHLELGGKAPVIVCNDADLKAVVEGVRTYGYYNAGQDCTAACRIYAQAGIHDKLVAELGAAVSSLRFAGKRDADNEIGPLISTRQRDRVASFVERALGQPHIERVTGAAVHSGAGFFYQPTLLAGCKQSDEIVQREVFGPVVTVTRFDELAQAVDWANDSEYGLASSVWTQNLDKAMQVAARLQYGCTWINSHFMLASEMPHGGLKRSGYGKDLSSDSLQDYSVVRHIMARHGQHL

SEQ ID NO: 92119 - protein, 483 aa, Pseudomonas fluorescens PfO-1
MSVRRTKIVATLGPASNSPEVLEQLILAGLDVARLNFSHGTPDEHKARAKLVRDLAAKHGRFVALLGDLQGPKIRIAKFANKRIELKIGDQFTFSTSHPLTEGNQQVVGIDYPDLVKDCGVGDELLLDDGRVVMRVETATATELNCVVTIGGPLSDHKGINRRGGGLTAPALTEKDKADIKLAAEMEVDYLAVSFPRDAADMNYARQLRDEAGGTAWLVAKIERAEAVADDETLDGLIKASDAVMVARGDLGVEIGDAELVGIQKKIILHARRHNKAVIVATQMMESMIQNPMPTRAEVSDVANAVLDYTDAVMLSAESAAGAYPLEAVQAMARICVGAEKHPTSKTSSHRIGKEFERCDESIALATMYTANHFPGVKAIIALTESGYTPLIMSRIRSSVPIYCFTPHREAQARAAMFRGVYTVPFDPASLAPNEVSQKAIDELVKRGVVEKGDWVILTKGDSYHTTGGTNGMKILHVGDPQV

SEQ ID NO: 92120 - protein, 162 aa, Yarrowia lipolytica CLIB122
MVTLVSSDGVSFNVDQKVASRSALIKNMMEDIGEDAGEIPVPNVSSNVLKKVIEYCTYHKDDPLPQSGEDEGTSAADKKKSTVIDDWDYNFLQVDQEMLFEIILTANYLDIKPLLDVGCKTVANMIKGKTPEEIRRTFNIANDFTPEEEAQIRRENEWAEDR

SEQ ID NO: 92121 - protein, 485 aa, Pseudomonas putida GB-1
MMIPVILSGGSGSRLWPLSRKQFPKQFLALTGEHTLFQQTIERLAFEGMDTPIVVCNKDHKFIVQEQLAALKLETQGILMEPFGRNTAPAVAMAAMKLVNEGRDELMLVLPADHVIDDQKALQRALALATIAAERGEMVLFGVPATKPETGYGYIRSSQDALLPEGVARVAQFVEKPDEKRAAEFVQAGGYFWNSGMFLFRASRFLEELKKHDGDIYDTCVLALERSEEDGDVLSIDEATFACCPDNSIDYAVMEKTQRACVVPMSAGWSDVGCWSSLWEVHEKDDNGNVTKGDVVVQDSRNCMIHGNGKLVSVIGLENIVVVETKDAMMIAHKDKVQGVKQMVKTLDEQGRTETQNHLEVYRPWGSYDSVDMGGRFQVKHITVKPGASLSLQMHHHRAEHWIVVSGTAEVTCDENVFLLTENQSTYIPIASVHRLRNPGKIPLEIIEVQSGSYLGEDDIERFEDVYGRTSTPVERGVSVKTIAQ

SEQ ID NO: 92122 - protein, 273 aa, Vibrio cholerae O1 biovar eltor str. N16961
MKQCAHTKVWQTIVAEAREQAEQEPMLASFYHATIIKHDSLKAALSYILANRLNTASMPAMAVREVIEEAFAADPSISEAAACDICATVNRDPAVSMYSMPLLYLKGYHALQGYRVANWLWRQGRKALATYFQNQISVACQVDIHPAARIGRGIMLDHATGIVIGETAVVEDDVSILQDVTLGGTGKECGDRHPKIREGVMIGAGAKILGNIEVGEGAKIGSGSVVLQAVPPHTTVAGVPARIVGRPQSDKPSLDMDQQFNGRSQTFIGGDGI

SEQ ID NO: 92123 - protein, 338 aa, Zea mays
  misc_feature (110)..(110): Xaa can be any naturally occurring amino acid
MGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKXAAAHLKGGAKKVVISAPSKDAPMFVVGVNEDKYTSDVNIVSNASCTTNCLAPLAKVIHDNFGIVEGLMTTVHAITATQKTVDGPSAKDWRGGRAASFNIIPSSTGAAKAVGKVLPDLNGKLTGMSFRVPTVDVSVVDLTVRIEKGASYEDIKKAIKAASEGPLKGIMGYAEEDLVSTDFLGDSRSSIFDAKAGIALNDHFVKLVSWYDNEWGYSNRVVDLIRHMFKTQ

SEQ ID NO: 92124 - protein, 342 aa, Rhodopirellula baltica SH 1
MKALQLSAPKQWEQIEIDEPSPPGPGEALVRIHRVGVCGTDLGGYLGKFPFFSYPRIPGHELGVEVVAVGEGVENVKVGDRCSVEPYINCQKCYSCERGLTNCCESHQTLGVMCDGGLTEKMILPARKLHPANNLSYEQSALVETLAIGCHAIDRAHVTEKDTVLVIGSGPIGLSAIEFARVAGARVIVADLSQTRLDFVTEKMGMTDTIQFDGSEADIEKLEAMTDGRRADVVVDATGNHHSMRRAMEMAAFGGRVVYVGITQQDLQFPHAPFLHRRELTILASRNALTGDFARIIQLIESGVIDTDPWITHHAKFEEVIESFPAWTDPESGVVKAVIHIS

SEQ ID NO: 92125 - protein, 344 aa, Vibrio cholerae O1 biovar eltor str. N16961
MSETQNHNSYGKPVEMTVIGAGSYGTSLAISLARNGANIVLWGHDAEHMARLDADRANHEFLPGIAFPDTLIVETDLQKAVQASRDLLVVVPSHVFGIVLKSLQPHLRADSRICWATKGLEPETGRLLQDVAHDVLGDSYPLAVLSGPTFAKELAMGMPTAISVASPDAQFVRDLQEKIHCSKTFRVYANSDFIGMQLGGAVKNVIAIGAGMSDGIGFGANARTALITRGLAEMSRLGAALGAQPETFMGMAGLGDLVLTCTDNQSRNRRFGLALGQGKDVDTAQTDIGQVVEGYRNTKEVWMLAKRMGVEMPIVEQIYQVLYQGKDARLAAQDLLARDKKMER

SEQ ID NO: 92126 - protein, 149 aa, Salmonella enterica subsp. enterica serovar Typhi str. CT18
MTSEKLSAACHCGSVVFTVQLSDGFHTARRCNCSFCRMRGAVAVSAPLSGIKVLKGQDKLTEYRFNTGKAVHFFCSVCGIYTFHQRRSNPDQYGVNVACIENVSPFDFACVEVNDGVTHPSDGGSSGVVGYLRYEPKKSPPVETGGKNI

SEQ ID NO: 92127 - protein, 400 aa, Bacteroides thetaiotaomicron VPI-5482
MKKVVFLGLGYIGLPTAAVAAAHGFEVIGVDVNPSVVETINQGKIHIVEPELGQVVRDVVQSGKLRAVCKPEAADAFFIVVPTPFKQNHRADITYVEAATRSVIPYLQEGNLFVIESTSPVYTTERMAEVIYKERPELKGKIHIAYCPERVLPGNTLYELVHNDRVIGGIDPASTAKAIEFYSAFVQGKLHGTNARTAEMCKLTENSSRDSQIAFANELSMICDKAGINVWELIELANKHPRVNILQPGCGVGGHCIAVDPWFIVSDYPEQAQLIKRARETNDYKADWCANKVLETCQKFVEQNEREPVVACMGLAFKPNIDDLRESPAKYIASRIISESRADVLIIEPNISTHKSFHLTDYREAYEKADIIVWLVRHDVFLALPREEGKIELDFCGVRR

SEQ ID NO: 92128 - protein, 335 aa, Parachlamydia sp. P9
FWGFANEITKITEAKRFYTLLGLGANVALLVSGPAIMYFSDIRKHLPAGVDAWQVSLNYLMGSVVLAGVCVVAVYWWMQRNVMTDPRYYDPSDVKQPKKAKAKMSIMETFAFLGKSKYILCIAILVICYGISINLVEVTWKNQLKLQYPNPNEYNTFMGAFSTFTGAITIIMMFVGGYIVRKKGWGFAAMTTPTVLLLTGLGFFSFVIFRDSLQGYIAMLGTTPLMLAVVIGMIQNIMSKSTKYSLFDPTKEMAYIPLDQESKVKGKAAIDVVGARLGKSGGSFIQQGLLVFFGTISAITPYVAVATIAVIVVWMIAVRSLNKQFVALTGETIAT

SEQ ID NO: 92129 - protein, 571 aa, Marinobacter sp. ELB17
MTKELSRNERIKEASEYLRGTLAEGLREEITGAIIEDDAQLVKFHGMYLQDDRDLRAERGRKKMEKAFSFMIRVRVPGGVCTPGQWLTMDHIARTYGNGTMRLTTRQTFQLHGIIKSNLKATMREMDEVLLTTMAACGDVNRNVMCNPNPYQSHAHAASLVLARALSDHLLPRTTAYREIWLDGERIAGGEDENEIVEPIYGKTYLPRKFKIVIAVPPSNDVDIYAHDLGFIAILDSKHEIDGYNVTVGGGMAMTHGEPQTYPRTADVMGYCRADQVIAVAEAVVTVQRDWGDRVNRKHARLKYTIEDRGLDAFRAEVEQRSGVKLDAAKPFTFTSTGDRYGWTESDNGCAHLTLFIENGRVKDVPGGPQWLTGLRRIAEVHDGDFRLTANQNLIIANVPKEKRQAIEALVAEYGPTTGASALRRNAMACVALPTCGLAVAESERYLPDLITALEERLAAHGLAEAEIVIRMTGCPNGCSRPYIAEIGLVGKGPGRYNLYLGAAFDGSRLSKLYAENLDHGAIIENLDPIFAAYKSERQNAEHFGDYTIRAGFIAATVNGTDFHEDTGARR

SEQ ID NO: 92130 - protein, 103 aa, Saccharomyces cerevisiae
MVTQFKTASEFDSAIAQDKLVVVDFYATWCGPCKMIAPMIEKFSEQYPQADFYKLDVDELGDVAQKNEVSAMPTLLLFKNGKEVAKVVGANPAAIKQAIAANA

SEQ ID NO: 92131 - protein, 563 aa, Saccharomyces cerevisiae
MSEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISAQAKQLLLHHTLGNGDFTVFHRMSANISETTAMITDIATAPAEIDRCIRTTYVTQRPVYLGLPANLVDLNVPAKLLQTPIDMSLKPNDAESEKEVIDTILALVKDAKNPVILADACCSRHDVKAETKKLIDLTQFPAFVTPMGKGSIDEQHPRYGGVYVGTLSKPEVKEAVESADLILSVGALLSDFNTGSFSYSYKTKNIVEFHSDHMKIRNATFPGVQMKFVLQKLLTTIADAAKGYKPVAVPARTPANAAVPASTPLKQEWMWNQLGNFLQEGDVVIAETGTSAFGINQTTFPNNTYGISQVLWGSIGFTTGATLGAAFAAEEIDPKKRVILFIGDGSLQLTVQEISTMIRWGLKPYLFVLNNDGYTIEKLIHGPKAQYNEIQGWDHLSLLPTFGAKDYETHRVATTGEWDKLTQDKSFNDNSKIRMIEIMLPVFDAPQNLVEQAKLTAATNAKQ

SEQ ID NO: 92132 - protein, 146 aa, Zea mays
MAAYMRVTHRDEEGKKVTEKMPVPETRRPDTAKHFERKLEEQGLHRFERHPANAPRGVGIGAPPPKSGRGGKYTWEGPGGLVEDQLDPAPPAIDPNDPNYEEAEEDEAAREVVVGEVEVAKVAESRDGVARVDVAPGLLQDQNQKQ

SEQ ID NO: 92133 - protein, 516 aa, Candidatus Kuenenia stuttgartiensis
MLENNIEKVLILDFGSQYAQLIARRVRENHVYSEIVSHLITAEQIKKIKPKGIILSGGPASVYSKNAPGCDEEIMKLGVPVLGICYGMQLGCMMLGSKVSPSAAREYGRTLCAISGENRFLKTLPQEITVWMSHGDIVTELPAEFESLAHTKNCPYTAVKHKNRDFYGVQFHPEVTHTPNGSQIIRNFLYEICHCSGNWKMDSFIEKSVNDINRQVGNGRVVCGLSGGVDSAVTAALIHKAIGNRLSCIFVDNGLLRNFEAEEVVKTFKENFSADLHVVRAQDRFLGKLKGVSDPEKKRKIIGHEFIKVFKNEAQKISDVQFLAQGTLYPDVIESIPAHGGPTVTIKSHHNVGGLPEELGFELVEPLRFLFKDEVRKIGEELGLPKELVGRHPFPGPGLAIRIIGEISGQRLEVLRKADKIVIEEICKAGLYNKIAQCFAVLLPLSTVGVMGDERSYENVIAVRAVETTDFMTADWYRIPNETLGSISHRIINEVKGVNRVVYDISTKPPSTIEWE

SEQ ID NO: 92134 - protein, 444 aa, Gluconobacter oxydans 621H
MSIADRLERLSFSGFHYRLLFLGGAGYCFDGLDGAILAFVMPALQHLWGLSMAQLGLLGSGAFFGYFIGALSAGLVADRWGRRSVMMWALACYCVGSLVSALCMNWHGFVLARVVAGLGTGAESAIIAPYLSEFVPRRYRGVFTGALAGFFSFGFVGASLLGYALVPGSANGWRWAVGLTACPVVMLLWWRRALPESPRWLESMGRSKAAHSVLCGIEKSVGVVSPAYEPGAVTLERPSVGGQFARLWGSGLRRVTAMSWVLWLSVTFSYYAFFSWLPTLLIARGFTITHSFGFSIAICVAQIPGYFSAGFCNEYFGRKATVVTYLAAAMLSAVAMALVSSSGGILAAGMLLSFFMNGAFAGLYAYTPEIFPTVLRATGMGSASAVGRTGAIAAPLLIGALYPRAGFAGVFGLTALILLAGALSILIFGPSTVNRSLEEIGDAY

SEQ ID NO: 92135 - protein, 404 aa, Neisseria meningitidis FAM18
MDKFPKSAKLDHVCYDIRGPVHKKALQLEEEGNKILKLNIGNPAPFGFEAPDEILVDVIRNLPTSQGYCDSKGLYSARKAIVHYYQTKGLRDITVDDVYIGNGVSELITMSMQALLNDGDEILIPAPDYPLWTAAATLAGGTVRHYLCDEENGWFPNLADMEAKITPKTKAIVVINPNNPTGAVYSREILLEIAELARKHGLIIFADEIYDKILYDGAVHHHIAALAPDLLTVTFNGLSKSYRVAGFRQGWMVLNGPKHHAKGYIEGLDMLSSMRLCANTPMQHAIQTALGGYQSINEFILPGGRLLEQRNRAWELVSQIPGVSCVKPMGAMYMFPKIDTEMYRIHDDMKFVYDLLVREKVLLVQGTGFNWIKPDHFRIVTLPYVHQIEEAMGRLARFLQTYRQ

SEQ ID NO: 92136 - protein, 506 aa, Marinobacter sp. ELB17
MGALTRHQEESLVPSRMMTGMCFDNSYARLPAAFYQHCEPLPVAAPELLVLNKPLAGELGMDDSGLMANSDHLTQLFAGNRLPMDAQPLAMAYAGHQFGQFVPQLGDDRAILLGEVIDRCQQRRDLQLKGAGRTPFARSGDGRSPLGPALREYLVSEAMHALGVPTTRALALTTTGEKIYRQGTEAAAVLARVASCHIRVGTFEYFARRQQWQPLRQLADYSIARMAPELMVDPDPYLALLRLMVARQAKLVAHWVSLGFVHGVMNTDNMSLAGETLNYSSCAFLDHYDPDAVFSSIDITGRYAYNSQGFAAQWNLARLAEALLALFEGPESQAVARTSRAVQEFWPMYEEHLLNLMRARLGLEAVMPTDRQLVQDLRQLLALQKVDYHTFFLKLAEDVEGGGITAGLFGADAGDYLNWYRRWHLRLTLTGRSSRQCADAMATANPVVIPRNHLVEHAIRRAHEGDFSEFHQLLEAVTRPFEMPADARYLQPPKPEEVLRSTLCGT

SEQ ID NO: 92137 - protein, 582 aa, Sulfitobacter sp. EE-36
MTAPSAYRVLARKYRPETFADLVGQDAMVRTLKNAFEADRIAQAFIMTGIRGTGKTTTARIIAKGMNCIGPDGNGGPTTEPCGVCEHCVAIMEGRHVDVMEMDAASNTGVGNIREIIDSVHYRAASARYKVYIIDEVHMLSTGAFNALLKTLEEPPEHVKFIFATTEIRKVPVTVLSRCQRFDLRRIEPEVMIALMRKIATAEGAEIAEDALALITRAAEGSARDATSLLDQAISHGAGETTAVQVRAMLGLADRGRVLDLFDMILRGDAAGALDELGNQYSDGADPMAVLRDLAEITHWVSVVKITPDAAEDPTVSPEERSRGVTMAETLPMRVLTRLWQMLLKALDEVASAPNAMMAAEMAVIRLTHVADLPSPEELARKLANTTPPPAPPQGPGGGAAVPAGGGSTSAMGSQQMSGGPAGGATMAALAPAVAQALAHYPTFEHVVELIRSNRDVKLLVEVETSVRLAAYQPGRIEFTPTDSAPRDLAQRLGTRLQLWTGNRWAVTIVGDSSAKTIAEIRDAKENALKSQAENHPLMQAVMASFPGAKILSIRTPEEIAAAAVSEALPEVEDEWDPFEDD

SEQ ID NO: 92138 - protein, 410 aa, Xylella fastidiosa Dixon
MLRSMGRYSDAHSVDFAFFYVLTRDKSFMQVTSKLPQVGSTIFSVMSQLADVYGAVNLGQGFPDFPVPLRLQEALAGAVREGHNQYPPMIGVAGLRQGIAAKVLRCYGAQVDVDVEITVTSGATEAIFNAIHAVVGAGDEVIVLDPAYDCYEPGIVLAGARAVHVPLDAVSFTVDWERVGAAITSRTRLLIVNSPHNPSGALFSADDMRALAALLDGTDILLISDEVYEHIVFDGCGHESVLRWPQLRARAFVISSFGKTYHCTGWKIGYAIAPPALSAEFRKVHQYNTFTSFGPAQYAFAAMLREEPEYVEQVGLFYQARRDCFREQLLTTKLVPLPVSGGYFQLVDYGAVSDLSDVEFSRWLAVEKGVVSIPLSPFYETAPAGQRLVRLCFAKNDMTLGAAIERLQRL

SEQ ID NO: 92139 - protein, 421 aa, Neisseria meningitidis FAM18
MSEALAKETLNPFEIARKQVKTACDRLKTDPAVYEILKSPTRVLEVNFPVKLDDGTVKTFTGYRSQHNNAVGPYKGGVRFHPGVNLDEVKALSIWMTIKCCVAGIPYGGGKGGVTLNPRDYSEAELERIARAYSEAISPLIGEKIDIPAPDVNTNGKIMSWMVDAYENVVKHSAPGVFTGKPVEFGGSLARTEATGYGVNLAAVQALEKLGKDVKGATYAIQGFGNVGYHTGYYAHQSGAKVVAVSTVDVAIYNENGLDMEAIIKEFQTKGFITNEAGYGKEITNAELLALEVDVLAPCALENQLTSENAGKVRATIVVEGANGPTTPEADVILRQNGVLVVPDILANCGGVVVSYFEWVQNLQGYYWEFDEVQEKETVVLRRAFRDIWNLAQEYDVDLRTASYMMSIRRVEKAMKLRGWY

SEQ ID NO: 92140 - protein, 228 aa, Zea mays
CLLRYYFQAVTAPMSTLNAIAVEAYKKYILVSLIVNGQVPSFPKYTSISAQRSMKNHAQIYFELSTSYSNGRYTDLETFVESNSAAFQSDNNLGLVKQVLSSMYKRNIQRLTQTYLTLSLEDIARSVQLETPEDAEMHVLRMIEDGEIHATINQKDGMVSFHEDPEQYKSVEMVEHIDSSIQRLTALSKKLASIDENMSCDPSYLLKTGRDRGRFDYDDFDSVPHKYF

SEQ ID NO: 92141 - protein, 290 aa, Geobacillus kaustophilus HTA426
MTKETMLQMALESIGDHSRIRHWRRVSGGDINDVYRVQSGKQTYFIKMQRFPPSGFFAAEQMGLELIRQARAINVPHTFGFGEADGWGWLVLEWIEGTETEQTAEQLGRGLARLHQCRGPAFGLDRDTYIGMLPQRNGWYGRWTDYYRDARLRPQITRAAERGLLPVKRRKRLEWLLERLDQWLPDDCFPSLLHGDLWSGNWIPGPDGVPYLIDPSVLYGHHEFEIAFTELFGGFPVRFYESYRELMPLSADYHGRKPLYQLFYLLVHLNLFGETYGSAVDRVLDRYAGE

SEQ ID NO: 92142 - protein, 313 aa, Streptococcus pyogenes M49 591
MTKIYKTITELVGQTPIIKLNRLIPNEAADVYVKLEAFNPGSSVKDRIALSMIEAAEAEGMISPGDVIIEPTSGNTGIGLAWVGAAKGYRVIIVMPETMSLERRQIIQAYGAELVLTPGAEGMKGAIAKAETLAIELGAWMPMQFNNPANPSIHEKTTAQEILEAFKEISLDAFVSGVGTGGTLSGVSHVLKKASPETVIYAVEAEESAVLSGQEPGPHKIQGISAGFIPNTLDTKAYDQIIRVKSKDALETARLTGAKEGFLVGISSGAALYAAIEVAKQLGKGKHVLTILPDNGERYLSTELYDVPVIKTK

SEQ ID NO: 92143 - protein, 391 aa, Chlamydophila abortus S26/3
MDYYDVLGVSKTASPEEIKKSYRKLAVKYHPDKNPGDAEAEKRFKEVSEAYEVLSDPQKRESYDRYGKDGPFAGAGGFGGAGMSNMEDALRTFMGAFGGELGGSGSFFEGLFGGLGEAFGMRGDPAGARQGASKKVHITLTFEEAARGVKKELLVSGYKTCETCSGSGASSKQGIKCCDRCKGSGQVVQSRGFFSMASTCPECGGEGRMITDPCSSCRGQGRIKDKRSVHVQIPAGVDSGMRLKMEGYGDAGQNGAPAGDLYVFIDVEAHPVFERRGDDLILELPIGFVDAALGMKKEVPTLLKEGACRLTVPEGIQSGTILKIKNQGFPNVHGRGRGDLLVRVSVETPQNLSEEQKELLRKFAATEKAENFPKKRSFLDKIKGFFSDLTV

SEQ ID NO: 92144 - protein, 478 aa, Geobacillus kaustophilus HTA426
MALPGGAAMNITIRLQFEKDIVSFSDIAAAIGKAGGDIVGIDVISSSKVHTVRDITVSALDTKQCDLIIEALKKIQGVKIINVSDRTFLMHIGGKIETNSKIPVKTRDDLSRVYTPGVARVCTAIAEDPRKAYSLTIKRNTVAVVSDGTAVLGLGDIGPYAAMPVMEGKAMLFKEFAGVDAFPICLNTKDTEEIIQIVKAIAPAFGGINLEDISAPRCFEIEKRLKEELDIPVFHDDQHGTAVVLLAGLLNALKIVDKKLEDIKVVLTGIGAAGIACTKILLAAGVRNIIGVDRHGAIHRDETYENPYWQEYAQITNPDNLKGSLSDVIAGADVFIGVSAPGILKVEDVKKMARDPIVFAMANPIPEIDPELAEPYVRVMATGRSDYPNQINNVLCFPGIFRGALDCRAREINEEMKLAAAKAIASVVTEDELNETYIIPSVFNSKVVERVRQAVIEAAYRTGVARKDNIPVGGYTGQ

SEQ ID NO: 92145 - protein, 981 aa, Mycobacterium sp. MCS
MTAGRRTAGFDFLEQPALPAPRVSEAEAQRILATHYGIEGDAVSLGSQQDKNFLVRRTGTGEVAGVLKVANPAFTAVELAAQDAAATLIAEAEPGLRIAVPLPNADGAEVTTVDGLLVRLLRYLPGGTLIDADHLGPAAVAGLGEVAARVSRALTGFEHAGLDRVLQWDLRYGADVVAALIGHVADPVQRERLSTATRDAAERIGRVADALPRQAVHLDITDANVVVSRAADGTRRPDGVIDFGDLTDTWAVSELAIAASSVLGHSGTEPVSILPAVRAFHGIRPLTVEEIDALWPMVVLRTAVLIVSGAQQAELDPDNAYVTDQSDGEWRMFEQATSVPIDVMTAVIRADLGFAAPPADVTATVPMIAGVTAEDVVTLDLSPTSDAYDFAFTPGGWLPPDVDDRLARRAVGDGAAVVVTRFGEPRLGLAPALSQRSGDVVPTGVRLWPAQPLTLVAPWDGEVGSDGAGDTVTVRGDAHEVTLTGVRPVGGASAVRAGDPIAQADAAQWADVAVRPVGGVTAPPLVRPEVATGWLAQARDPRPVLGLPPDAVTSPAADLVERRDRSFAPVQEHYYRRPPQIERGWRHYLMSTAGRCYLDMVNNVTVLGHAHPRVADTAARQLRKLNTNSRFNYAAVVEYSERLAAELPDPLDTVFLVNSGSEASDLAIRLALAATGRRDVVAMCEAYHGWTYGTDAVSTSTADNPNALATRPDWVHTVESPNSFRGKYRGADVGRYATEAVAQIERLVADGRAPAGFICESVYGNAGGMALPDGYLQQVYAAVRGAGGLAIADEVQVGYGRLGHWFWGFEQQGVVPDIVSMAKSTGNGYPLGAVITSREVAEAFRSQGYFFSSTGGSPLSCAIGLTVLDVLRAEDLQGNAVRVGGHLKARLEALADRHPIIGTVHGVGLYLGVEMVRDRQTLEPATEETAAICERMLELGVVIQPTGDHSNILKTKPPLCIDTESADFYVDALDRVLTEGW

SEQ ID NO: 92146 - protein, 74 aa, Clostridium difficile 630
MREKVEKVLEEKIKPVLQRDGGDVELIDVNENGVVLVRLQGACSGCPGATMTIKAIIENVLVSEVPGVTQVLGV

SEQ ID NO: 92147 - protein, 357 aa, Magnaporthe grisea 70-15
MPSTTAETLSLVTRNVSVAPLVLLSVVDHYNRESANQTKNKRVVGVLLGQNDGKNVRVSNSFAVPFEEDEKNPSVWFLDHNYVESMNDMFKKVNAREKLIGWYHSGPKLRASDLEINELFKRYTPNPLLVIIDVQPKEAGVPTDAYFAVDEIKDDGTATSRTFVHTPSIIEAEEAEEIGVEHLLRDIRDVAVGTLSTRLTNQLQSLQGLHLRLRDIQAYLQKVLDGDLPVNHAILGNLQDVFNLLPNLSTPSGGKGSGDGGLEHAMAVKTNDQLMSIYLSSLIRAITAFHDLIENKIQNRQQQEEKEAAKKEGEKDAKDGDKKEDGKGAVNGVNGDGPAKEGASDKDKEAGSKDKKK

SEQ ID NO: 92148 - protein, 530 aa, Physcomitrella patens subsp. patens
MARGKARTLLSTALRATSAGPARLHRNFCAAAAAEELENPTIAPVEVKLTKLLIDGEFVDAASGKTFPTIDPRSEQVIAHVAEGDVEDVNRAVRAARKAFDHGPWPKMPPFQRQRILLKYADLLDQHADELAALETMDSGKPYEQARYAELPLMSRQFRYFAGWADKIFGTTGPSDGIHAVQTLHEPIGVVGQIIPWNFPLVMYCWKVAPALAAGNTIVLKTAEQTPLSAILAGKLALEAGIPPGVLNIVSGYGPTAGASIAEHMDIDKVAFTGSTEVGKLVMAAAARSNLKPVTLELGGKSPMIICEDANVDEAVELAHFALFFNMGQCCCAGSRTFVHESIYDEFVEKSKARALKRVVGDPFRKGVEQGPQVDKDQFHKVLGYVESGMEQGANLITGGGRLGSKGYYIKPTIFTDVKEGMKIFDEEIFGPVQSIAKFKTLDEVVQRANNTVYGLAAGIFSNNINTVNTLSRALRAGTIWVNCFDVFDATIPFGGYKQSGIGREKGKYVLESYTQVKAVVTPLHNPAWL

SEQ ID NO: 92149 - protein, 120 aa, Zea mays
  misc_feature (57)..(57): Xaa can be any naturally occurring amino acid
  misc_feature (88)..(88): Xaa can be any naturally occurring amino acid
  misc_feature (106)..(106): Xaa can be any naturally occurring amino acid
  misc_feature (108)..(108): Xaa can be any naturally occurring amino acid
  misc_feature (114)..(114): Xaa can be any naturally occurring amino acid
MATKRSVGTLKEADLKGKSVFVRVDLNVPLDDNSNITDDTRIRAAVPTIKYLMGNGXSRVVLCSHLGRPKGVTPKYSLKPLVPRLSNXLGVEGVMANDSIWVRKVXKXVAGLPXKGGCSW

SEQ ID NO: 92150 - protein, 562 aa, Shewanella oneidensis MR-1
MDDNKRPLYLPFAGPAILEAPLINKGSAFSEEERIFFNLEGLVPYAIETIEEQASRAYDQFRSFNNDLDKHIYLRNIQDTNETLFYRLVQNHISEMMPIIYTPTVGLACERFSKNYRRNRGLFISYPNKDRIDDILNNSTRQKVKIIVVTDGERILGLGDQGIGGMGIPIGKLSLYTSCGGISPAYTLPITLDVGTDNPQLLEDPMYMGWRHPRIGGEEYAEFIEAFMQAVHVRWPDTLIQFEDFAQKNAMPILERYKERYCCFNDDIQGTAAVTVGSLLAACKAAGTELNKQRVAFLGAGSAGCGIAEAIVAQMVSEGISDEQARSQVCMVDRWGLLLDNMPNLLPFQQKLAQKCADISHWNNFSDNISLLDVVNNAKPTVLIGVSGAPGLFTEEIVRAMHSHCPRPIIFPLSNPTSRVEATPKDILHWTSGQALVATGSPFEPVVVDGETYEIAQCNNSFIFPGIGLGVLASGARHVSDAMLMASSRALAECSPLAINGSGPLLPKLEDIHSVSKHIAFAVGKVAIEQGLSLPASDELLMQSIEDNFWKPEYRRYKRTSF

SEQ ID NO: 92151 - protein, 313 aa, Thermotoga sp. RQ2
MSVNLKGRSLLTLLDFSPEEIRYLLDISEQVKMESRSRLRTERFKGMTLAMIFEKRSTRTRLAFETAFAEEGGHPVFLSPNDIHLGAKESLEDTARVLGRMVDAIMFRGYKQETVEKLAEYSGVPVYNGLTDEFHPTQALADLMTIEENFGRLKGVKVVFMGDTRNNVATSLMIACAKMGMNFVACGPEELKPRSDIFEKCQEIAKETDGSISFTSNLEEALAGADVVYTDVWASMGEEDKEKERISLLKPYQVNERVMEMTGKSETIFMHCLPAVKGQEVTYEVIEGKQSRVWDEAENRKHTIKAVMIATLL

SEQ ID NO: 92152 - protein, 593 aa, Physcomitrella patens subsp. patens
GLLLQSFKQRLTDPSGVLSNWNASDETPCNWKGVVCRNSTNAVAFIDLPYANLTGTISSQLAGLKQLKRLSLLNNQFRGKIPESFSNLTSLEVLNMRSNAISGNIPATLGSLKDLRLMDLSNNELEGPIPESFSAMIGLLYLNLSNNLLVGRVPEGALRRFNTSSFVGNTDLCGGDIQGLSSCDSSSPLAPALGPSRSASSSKSSFSAAQIVLLSVGLFLSFKFVIAVLIIVRWMRKDSNIEIDLGSGGKLVMFQGATMDLPSSKEMLRAVRLIRKKHIIGEGGYGVVYKLQVNDHPTLAIKKLKTCLESERSFENELSTLGTVKHRNLVRLRGFCSSPSVKLLIFDYLPGGNVDQLLHGEKEENVVVDWSIRYRIALGVARGLAYLHHACEPRIIHGDISSSNILLDTGYEPYLSDFGLAKLVTTTDTHVTLNVGGTFGYVAPEFAKSGRATEKVDSYSYGVILLELLSGRRAVDESLANEYANLAGWVRELHIAGKAKEIVDQNLRDTVPSVDLDLVLEVACHCVSLDPEERPHMSKVVEMLELLSVSGLSPGCASIRTSLEALERSASCKPLVSDVPGFRPVGSYFIFDT

SEQ ID NO: 92153 - protein, 473 aa, Burkholderia mallei ATCC 23344
MAYRNDSLLTSAQQDTRHLLHPWADLSALGRETPTVIVEAQGTRVTDAEGRTYLDAIGGMWCVTLGYGRREIADAIRDQALRMPFYTPFGAMTNEPAAALGARLAELAPGDLKRVHLTTCGSTAVESALRFAHYYFGATGRPRKRHIVTRGDAYHGSTYLAASISGKAWDRTCFHYDSTIVHHLSSPNPYRRPAGMSVDAFCASLVDEFDALIAKLGAEQIACFIAEPILASGGVIVPPPGYLAAMRERCRRHDILYISDEVVTGFGRVGHFFASHAHFGIEPDMIVVAKGLTSGYQPLGAVLISERLVDAVSGEHAYGNGVFTNGFTYSGHPVACAAALANIELMERERICEHVRDVGPYFIRRLDALRRLPIVGDVRGDHLMACIECTSGAGATGALPTPADIAIAQRVDRHCEEMGLLVRPYESMCILSPPLTVTRADIDEICAILAAALERTQRELAQHAPVREENETC

SEQ ID NO: 92154 - protein, 525 aa, Coccidioides immitis RS
MAAAASPVLQDIIFKDDFGEHTLDVDRHGGDQAPAAPVPKPEVRGNFDLDDAVVDALPIPGTKVISAYNYGMSLWGQTAKIYTVLPTGERKEYFLKAVSLGDDGRVMIEGEYESLKAIHAVSPDFGPEPYAWGKFRKDEEGTYFLLAEYREVGEQPPNPLRFTARLAELHQTSVSPPGKFVCHITTCHAKLPQITDCWEESWEVLYRKQLGHMVKLDEQKHGEWPEFQAVARLVLEKVIPRLLRPLQSEGRSIKPCLVHGDMWDENAATNMDTGEPFVFDAGSFYAHNEYEIGNWRAPRHRLSDKVYVKNYRRFYPVSEPEDDWDDRNLLYSLRYDLGAAILIPGCNLRQIVKDGMATLCKKFCPKELIAATEQMPLPSSLDFPIDDDWAELEEYNEKAGNSYQVDLLISPVEAGLIDRFKDEECEKESSEKTTIETMEHNLESSNRSNQPRSHGRDEENVKVMLGGTMDQKVDERSGESVLLNTDQITTSKDNEEKKKQKKKKKKKQKQKKRKQGPTDKRAAGE

SEQ ID NO: 92155 - protein, 375 aa, Robiginitalea biformata HTCC2501
MKYQSKRKALILLADGTVFYGKAVGDKEGTAFGEVCFNTGTTGYQEIFTDPSYFGQLMVTTNAHIGNYGAREEEVESDGVKIAGLICKNFSYSYSRPDADYSLQEFLDKNGLFSISDVDTRALVSYIRDNGAMNAVISTRVDELDALREELAKVPSMEGLELASSVSTREPYFVGEADAEIRIAALDIGIKKNILRNLAKRGAYIQVFPHDTTYETMEAWSPDGYFISNGPGDPQPLKAAVELAKKIIAADKPLFGICLGHQVIALANGVSTYKMHHGHRGINHPVINLQTGKGEITSQNHGFAVNRQETESHPDLEITHLHLNDDTVAGIRMKDKNVFSVQYHPEASPGPHDAEYLFDQFFETIRKTTTKTTAV

SEQ ID NO: 92156 - protein, 335 aa, Desulfovibrio vulgaris subsp. vulgaris str. Hildenborough
MHVLVTGAAGFIGFHLSRRLLAEGHTVVGLDNLNDYYSIQLKRDRLALLEDHRGFSFAEIDMAHDDDMDQLFEREGFTHVVNLAAQAGVRYSIKNPRSYVQSNLVGFGNILEGCRHNQVKHLVYASSSSVYGLNTTMPFSVHDNVDHPISLYAASKKANELMAHTYSHLYRLPTTGLRFFTVYGPWGRPDMALFLFTKAILEGRPIDVFNHGQMRRDFTYIDDIVEGVLRVMKLNPTPNPAWTGSAPDPSTSTAPYRIYNIGNNNTVELGRFIEVLEECLGKKAVKNMLPMQPGDVAATYADVDDLIADTGFRPATTVEEGVAAFVAWYREYYGA

SEQ ID NO: 92157 - protein, 477 aa, Neisseria meningitidis FAM18
MNEYSQLIKHPDISLSPISDSIGIGNPATGEILAYVRNTGSDKLKNLIQKAAAAQKLWAAKTALERADILWRWYFLVKENKEALARLMTMEQGKSLTEARGEIDYAASFVRWFAEEARRIDGDVLTSVKASQKLVVLKQPVGVTAAITPWNFPSAMIARKAAPALAVGCAMIVKPASLTPLSAYALASLAYEAGIPQDLLPVVSGSASEIGHEFATNPIIRKISFTGSTEVGAKIFADSAADIKKLSLELGGNAPFIVFDDADLDKAVEGALASKFRNSGQTCVCTNRVYAQSAIYDEFCRKLSEKAAALKLGNGLEDGVNQGPLIEEKAVEKVEQHIADALAKGASCLTGGKRSALGGTFFEPTVLSGVTAQMAVAREETFGPLCPVFRFETEAEVIEAANNTEYGLAAYLFTADTARQWRVGEALEYGMVGINTGLISNEAAPFGGVKRSGLGREGSKYGADEYLELKYLCMDVG

SEQ ID NO: 92158 - protein, 582 aa, Marinobacter sp. ELB17
MIKRPPQKTAPIVSTLDDLATLANYSLMDSLNCDPDAKVNGRDHAPRQVFTGHYVPVNPTPIENPEYVAHSKNLFRELGFADRMAQSADFIRVFSGNIAFVPEPMRQVGWACGYALSIFGTEYNQQCPFQTGNGYGDGRAISVLEAVINGHRWEMQLKGGGRTPYCRGADGRAVLRSSVREFLAQEHMHALGVPTSRSLSLYVSKTEKVKRPWYSEGSRSKDPDTLVSEAVAISTRVAPSFIRVGQLELFGRRARKKEHPQAMEELEKIVLHLIDREYGDVIDQNLATTEKVVSLAREFRGRLTSLVANWIRVGYCQGNFNSDNCAAGGFTLDYGPFGFCDVFNPQYQPWTGGGHHFSFLNQPEAAERNFHMFCSALRPLLTAHQDCLLELDQIQSDFSKAMQTQMKKMWAAKLGLATFHEALFSELATLMVQTPVDYTIFFRQLSTVPDDIGLLKKSFYKGSAFETDLEGMDKRWAEWLKKWKTLAGIVSTTDATATAPRAREELSQQMKLVNPKYSLREWFVVPAYQQAAAGNYSLVRDLQEVMTQPYAEQSKDVEEKYYRLKPLELFEVGGSSYYSCSS

SEQ ID NO: 92159 - protein, 473 aa, Sulfitobacter sp. EE-36
MMHAILLCGGSGTRLWPLSRKCYPKQFAKLMGDESLFQISAKRLTGPGFAPPIVVTGDPFRFIVTEQLAQVERAAQAILIEPEGRNTAPAILAAALYIGRTDAQALMLVAPSDHVIPDGDAFAQTVQAAVPRAQAGDLVTFGITPTRAETGYGYLELAKGADASAKTPQPLARFVEKPDGATAAKMLQAGNFLWNAGIFLFTAQTIIAAYQAHAPDMLRTVKASLDGAESDLGFTRLAPEPWGQADDISIDYAIMEKADNLAVMPFAAGWSDLGGWDAVWLESGPDAAGNVCSDNATAIDCAGTLLRSETDGLQLVGIGLDNIIAVAMGDAVLVADKSQAQRVKEAVEALKRRDASQAVQLPRDYRPWGWYESLVIGGRFQVKRIVVNPGAALSLQSHHHRSEHWIVVEGTAKVTVDDTVKLISENQSVYIPLGSVHRMENPGKLPMVLIEVQTGSYFGEDDIIRYEDVYARG

SEQ ID NO: 92160 - protein, 211 aa, Marinobacter sp. ELB17
MSDFLLADQPVSIRAESSLADPDTCKFIVSRTLHPGGPFFFGNKERAVGSPLGEQLFALPGVANLLIADSVVTVCKEPAASWSGLKAGIGMAIRTQLRSGVPAILEMPAHNRRQGKTDAELTTAVQELLDKEVNRSIANHGGKISIVGVRQGKLSITMSGGCQGCASSQVTLRQGFEVMLKRVAPEIEEIIDVTDHAAGTQPFYPRHKEPL

SEQ ID NO: 92161 - protein, 468 aa, Methanosarcina barkeri str. Fusaro
MISKKVNLETLDESKKYRVGAYSARYIPQVKEKGIPKYEFPEEGMSPRAAYQLVHDEQSLDGNPFLNLASFVNTWMEPEADKLVMENINKNIIDIFEYPQTDKVIQSNIVNMLGRLFNGHHTKFMGTATAGSSEAIMLGLLAHKWSWKNSGRGTGKPNIIFGNDAHVCWDKFAKYFDVEARKIPIDKDERKISAAAVSEQIDENTICVGCVLGTTFTGEIDPVKDINDLLLRYKKEKGWDIPIHIDAASGGFILPFTEPDFEWDFRLESVKSINVSGHKYGLTYPGLGWLIFRDENDLPEDLIFHVNYLGEMEDSYTLNFSGGSAMVVAQYYNILRFGRAGYTRIMKNILEVSQDLAEKVDRLGRFEMLNKGERLPIIAFKQKEETDYSLQQLSYKLRERGWIIPAYCLPENAADIEIMRIVVRENFTSDMAAILVNDIENACQFFENGRKSETKKPCPPDDGMVHIC

SEQ ID NO: 92162 - protein, 2275 aa, Aspergillus nidulans FGSC A4
MPETVGHEEPALPSSPQAGGAVAYNAISKELQPLPPTETANGGIIPPASSRIEGSTGRLCALELEDGTVYQGYNFGAEKSVAGELVFQTGMVGYPESITDPSYRGQILVITFPLVGNYGVPSRETMDELLKTLPKHFESTEIHIAALVVATYAGENYSHFLAESSLGQWLKEQGVPAIHGVDTRALTKRIRQKGSMLGRLLLHKADVAETDAALAQDTWKSSFEQIDWVDPNTKNLVSEVSIREPKLFSPPENVALKHPSSRPIRVLCLDVGLKFNQLRCLVARGVEVLVVPWDYDFPTLAGKDYDGLFVSNGPGDPATMTTTVNNLAKTMQEARTPIFGICLGHQLIARSVGAQTLKMKFGNRGHNIPCTSLVTGKCHITSQNHGYAVDSSTLPSDWQELFVNANDGSNEGIRHVSRPYFSVQFHPESTPGPRDTEYLFDVFINAIKDTIASPEALQKPVNFPGGAVAENIKASPRVSVKKVLILGSGGLSIGQAGEFDYSGSQAIKALKEEGIYTILINPNIATIQTSKGLADKVYFLPVNADFVRKVIKHERPDAIYVTFGGQTALQVGIQLKDEFESLGVKVLGTPIDTIITTEDRELFARSMDSIGEKCAKSASASSLEEALQVVESIGFPVIVRAAYALGGLGSGFADNLDELKDLCAKAFAASPQVLIERSMKGWKEIEYEVVRDARDNCITVCNMENFDPLGIHTGDSIVVAPSQTLSDEDYNMLRTTAVNVIRHLGVVGECNIQYALNPYSKEYCIIEVNARLSRSSALASKATGYPLAFIAAKLGLNIPLNEIKNSVTKVTCACFEPSLDYCVVKIPRWDLKKFTRVSTQLGSSMKSVGEVMAIGRTFEEAIQKAIRSVDFHNLGFNETNALMSIKTELQTPSDQRLFAIANAMAAGYSVDDIWKLTNIDKWFLTRLKGLSDFGKLMTNYNASTVTAPLLRQAKQLGFSDRQLAKFLSSNELAIRRLRVEAGIIPIVKQIDTVAAEFPSVTNYLYLTYNASEHDVRFDDNGIMVLGSGVYRIGSSVEFDWCSVRTIRTLREQGHKTVMVNYNPETVSTDYDEADRLYFENINLETVLDIYQLESSSGVIMSMGGQTPNNIALPLHRLNVRILGTSPEMIDGAENRYKFSRMLDRIGVDQPAWKELTSIEEAREFCDKVGYPVLVRPSYVLSGAAMNTVYSEHDLASYLNQAADVSREHPVVITKYIENAKEIEMDAVARNGVMVGHFISEHVENAGVHSGDATLILPPQDLDPETVRRIEEATRKIGNALNVTGPFNIQFIAKDNDIKVIECNVRASRSFPFVSKVMGVDLIEMATKAMIGAPFAEYPPVTIPKDYVGVKVPQFSFSRLAGADPVLGVEMASTGEVASFGRDKYEAYLKALLSTGFKLPKRNILLSIGSYKEKMEMLPSIIKLRDVGFELFATSGTADFLKENGVPVKYLEILPGEDEDIKSEYSLTQHLANNLIDLYINLPSSNRFRRPANYMSKGYRTRRMAVDYQTPLVTNVKNAKILIEAIARHYALNVQTIDYQTSHRSIILPGLINVGAFVPGLGSADSKDFEAVTKASIAAGFSMIRVMPVGVDSSITDARTLKLVQQNAGKASFCDYNFSVVATSSNSAEVGQLTGEVGSLFIPFNHLSGNISKVAAVTSHFGAWPSSKPIITDAKSTDLASVLLLASLHSRNIHVMSVTSKEDIGLIALSKEKGLKVTCDVSIYCLFLSRDDYPEAAFLPTAEDQKALWEHLSTIDIFSIGSIPYQLAGEKGSPAAGIAEALPLLFTAVSEGRLTVEDIIARLYENPKKIFELHDQSDSSVEVEIDRPYLFQSAQAWSPFSGKSVKGLVQRVIFQGKTSCLDSEITPDAPKGSDMSGHRIVPASPSLKAMSPRVDGALDRRQSISIAGTPARLGRKPVDHFPAATGAELGPPLYTPVPRASSPLLQMLSRSPFKQKHVLSVNQFNRADLHLLFTVAQEMRLGVQREGVLDILKGRLLCTLFYEPSTRTSASFDAAMQRLGGRTIAISTEHSSTKKGETLQDTLRTLGCYGDAVVLRHPEPSSTEVAAKFSPVPVINGGNGSVEHPTQAFLDLFTIREELGTVGGLTITFTGDLKYGRPVHSLIKLLQFYDVRVQLVAPKDLSLPADIRQQLLATGQLLTESEELTPEIVARSDVLYSTRVQKERFADLEQYERLKNSFIIDNALLKHAKSHMVVMHPLPRNAEVSEEVDFDQRAAYFRQVSLQSRGPSSEFDMLMWMQMRYGLYCRMALLALIMAP

SEQ ID NO: 92163 - protein, 178 aa, Zea mays
  misc_feature (93)..(93): Xaa can be any naturally occurring amino acid
AMPQPSSYAVLPRREGELVSAEELLLVPPLNFAMVDHGVYRSGFPDASNLPFLETLRLRSVLCLCPEPYPEANLEFLRAHGIKLFQFGIDGSXEDRIREALEVILDASNHPVLIHCKRGKHRTGCVVGCFRKLQRWCLTSIFDEYQRFAAAKTRVSDLRFMELFDVSSIKHLAFESSV

SEQ ID NO: 92164 - protein, 439 aa, Pseudomonas fluorescens PfO-1
MDNSNALPLGSAAVPAKERTTASRIKSIFSGSVGNMVEWYDWYVYAAFSLYFAKAFFPKGDTTAQLLNTAAIFAVGFLMRPIGGWLMGLYADKVGRKKALMASVYLMCFGSLIIALSPGYETIGVGAPILLVFARLLQGLSVGGEYGTSATYLSEMATKDRRGFFSSFQYVTLISGQLIALGVLIVLQQFLTTEELYAWGWRIPFAIGALCAIVALYLRRGMEETESFTKKEKSKESAMRTLLRHPKELLTVVGLTMGGTLAFYTYTTYMQKYLVNTVGMSISDSTTISAATLFLFMCLQPIIGGLSDKIGRRPILIAFGVLGTIFTVPILMTLHTIQTWWGAFFLIMAALIIVSGYTSINAVVKAELFPTEIRALGVGLPYALTVSIFGGTAEYIALWFKSIGMETGYYWYVTACIAVSLLVYITMKDTQKHSRIVTD

SEQ ID NO: 92165 - protein, 525 aa, Shewanella sp. MR-4
MSDIHEHKILILDFGSQYTQLIARRIREIGVYCELWAWDVTEAQIREFAPNGIILAGGPESVTADNSPRAPEYVFNAGVPVLGICYGMQTMSEQLGGKVIQGVGEGEFGYAQIEMLAQSALFKDIEDAVSADGKSLLDVWMSHGDKVSAIPEGFVAVAKTDTCPFAAMSCEEKRFYGVQFHPEVTHTRQGMRMLSHFALDICGCAANWKPSSIIEDAIERLKKQVGDDEVILGLSGGVDSSVVAMLLHRAIGKKLTCVFVDNGLLRLNEAKQVMEMFGDHFGLNIVHVDAENRFLDALKGEADPEAKRKIIGRVFVEIFDEEAKKCVNAKWLAQGTIYPDVIESAGSATGKAHVIKSHHNVGGLPDDMELGLVEPLRELFKDEVRKIGLELGLPYNMLYRHPFPGPGLGVRVLGEVKKEYCDLLRRADAIFIEELHKADLYNKVSQAFTVFLPVRSVGVMGDGRKYDWVVSLRAVETIDFMTAHWAHLPYDFLGRVSNRIINEIDGISRVVYDISGKPPATIEWE

SEQ ID NO: 92166 - protein, 671 aa, Yersinia pseudotuberculosis
MNPFIVADAESCIGCRSCEVACVVAHHEGQFPDKPEYFTPRVKVFKGDQCATAVFCHHCEDAPCASTCPNGAIVELNNSIQVIQEKCIGCKTCMIACPFGMMTVVTETVQPASHRLADVYRRTEAQKCDLCLDQPDGPACIKTCPTQALTLVDQQYLLHQQQQKRQHMALNEHNGRLFSRAVVQAASTSSNKSIRDATPVNLLQRPRAPRLEPKKIPLAERKTGFAEIYLPFTESQIHEQAERCLECGDKTICQWTCPLHNAIPKWISLAHQGRIHEAAELSHQTSSLPEVCGRVCPQDRLCEQSCTLNDHDGAVTIGQIERHITETALATGWRPDLSQVKPSGKRVAIIGAGPAGLGCADILVRNGITPVVFDRYPEIGGLLTFGIPAFKLEKSVMTRRREIFTEMGVEFCLNTEIGRDITMENLLHDFDALFLGVGTYRSMRSGLENEDAQGVYDALPFLIGNTQHLMGYTANGAHPYVSMQDQRVVVLGGGDTAMDCVRTSLRQGASRVVCAYRRDEKNMPGSKREVKNAREEGAEFMFNLQPMSIVVDESGQVTGIKMVRTEMGQADAQGRRQALPIAGSEHLIPADAVIMAFGFSPHRMSWLAEHNVVLDKQGRVVAPTISGYPYQTSNPKIFAGGDIVRGADLIVTAIAEGRKAAESIAYYLNVL

SEQ ID NO: 92167 - protein, 295 aa, Alkalilimnicola ehrlichei MLHE-1
MKAGVIGLGAMGAGMAANLARQGLLAAVWNRTYDKAVDFAGRHGVAAAADAPTVAAQCDVIITCVSADADVLEVVDAMLPELGEGKVVVDTSTVSADTAREAARRVAETGARFLDAPVSGGKEGAEKATMVMMVGGDEATLEQVRPVLSAISRSATHMGPSGAGQVTKAVNQIMVAGIIQGVTEGLAFGQAQGLDMDKVIEVLSGGAGGSWLLQHRGPTLVRDSYQPGFKMALHYKDLEICRSMLESMGVALPVVEMTLKQYRPLIEQGYGEEDISALYRGKRAMFENGGNKKGL

SEQ ID NO: 92168 - protein, 376 aa, Mycobacterium sp. MCS
MPAGLWQTVIPVGLNLGIVGLPNVGKSTLFNALTRNNVLAANYPFATIEPNEGVVALPDPRLEALAKIFHSEKIVPAPVTFVDIAGIVKGASEGAGLGNKFLANIRECDAICQVVRVFADDDVVHVDGKVDPKSDIEVIETELILADMQTLERAVPRLEKEARTHKDRKPVLDAALAAQEVLNSGKTLFAAGTDVSLLRELNLMTTKPFLYVFNADESVLTDEARKAELRELVAPADCVFLDAKIEAELQELDDESAAELLESIGQTERGLDALARAGFHTLRLQTYLTAGPKEARAWTIHQGDTAPKAAGVIHSDFEKGFIKAEIVSFDDLAEAGSMAAAKAAGKVRMEGKDYVMADGDVVEFRHGQPSTSKAKA

SEQ ID NO: 92169 - protein, 438 aa, Pseudomonas putida GB-1
MRISIFGLGYVGAVCAGCLTARGHEVIGVDVSSTKIDLINQGKSPIVEPGLEALLQQGIANGRLRGTTDFAEAIRASDVSMICVGTPSKKNGDLGLEYIESVCREIGYVLRDTTRRHTIVVRSTVLPGTVKNVVIPILEDCSGKKAGVDFGVAVNPEFLRESTAIKDYDQPPMTVIGELDSASGDILQALYEELDAPVIRKPIEVAEMIKYTCNVWHATKVTFANEIGNIAKAVGVDGREVMDVVCQDTVLNLSQYYMRPGFAFGGSCLPKDVRALTYRAASLDVRAPLLDSLMRSNESQVQNAFELIEAHDKRKVALLGLSFKAGTDDLRESPLVELAERLIGKGYQLDIYDENVQYARVHGANKDYIESKIPHVSSLLNANFQQVIDNADIIVLGNRDEQFRALAQQAPAGKQVIDLVGFMSKPTCTTSRTEGICW

SEQ ID NO: 92170 - protein, 535 aa, Oryza sativa Japonica Group
MALELSLVSASPPGGLAASPPPPAAIPGKEQQVAGVGILLQISMLVLSFVLGHVLRRHRFYYLPEASASLLIGLVVGGLANISNTETNTRMWFNFHDEFFFLFLLPPIITQSGFSLSPKPFFANFGAIVTFAILGTFIASVVTGVLVYLGGLTFLMYKLPFVECLMFGALISATDPVTVLSIFQELGTDVNLYALVFGESVLNDAMAISLYRTMSLVRSQAAAGENFFMMVFQFLETFVGSLSSGVGVGFISALLFKYAGLDIDNLQNLECCLFVLFPYFSYMLAEGLGLSGIVSILFTGMVMKHYTFSNLSNNSQRFVSAFFHLLSSLAETFVFIYMGFDIAMEEHSWSHVGFIFFSIIFIIIARAVNVFSCAYLVNMSRPEHRRIPLKHQKALWFSGLRGAMAFALALQSANELPGGHGKTIFTTTTAIVVLTVLLIGGSTGTMLEALDVIGDENRSIENYDDNNGYIPPTYEEGSSSGGGLRMKLKEFHKSTTSFTALDRNYLTPFFTSQTDEDDDVFGEQPQNQRRGFYDQ

SEQ ID NO: 92171 - protein, 332 aa, Alkalilimnicola ehrlichei MLHE-1
MNRPLGIIGAGAWGTALAIAAGHAGHPVRLWGRDTAAVQAMARDRVNRRNLPDCPLPDPVQPQPDLTALVAECDDLLLVVPSRAFESMLHTLAPLIERRHRLGWATKGLDAASGGLLSQVVQRVLKPLPPLAVLSGPSFAAEVGRGLPTAVTVAATDQGFASDLADAFRYERFRVYTSTDLVGVQLGGAVKNVLAIATGVADGLGFGANARAALITRGLAETRRLSEALGADPDTLTGLAGMGDLILTCTDDQSRNRRLGLALGRGEDLDEAVEAIGTVEGVRTADELHRLATQAGVEMPICEQVHLRLAGRVSTREAVENLLLRPGGRQEQ

SEQ ID NO: 92172 - protein, 454 aa, Geobacillus kaustophilus HTA426
MQIVVVGVDYKTAPVEIREKLAFAEAELGAAMKQLAKQKSVLENVIVSTCNRTEVYAVVDQLHTGRYYMKAFLAEWFGVKVEAIAPYLRVLEGEAAIKHLFRVAAGLDSMVLGETQILGQVKDSYLLAQEVGTSGTIFNHLFKQAVTFAKRAHSETGIGAHAVSVSYAAVELAKKIFGRLAGKHVLIIGAGKMGTLAAQNLYGSGVGKVTVVNRTLEKAKQLAKQFAGEAKPLGELSCALLEADIVISSTGAKGYILTKEMVAPLEKMRKGRPLFMVDIAVPRDLDPALADLETVFLYDIDDLQDVVAANLAERQKAAARIETMIEAELMAFSQWLQTLGVVPVIAALREKALAIQAETMKSLERKLPHLSERDWKVLNKHTKSIINQLLRDPILQAKELAAGPNAEEALLLFMKIFNIEDAVKAERHIEQAKSVQCDEQDAEAVRAARPSWQL

SEQ ID NO: 92173 - protein, 265 aa, Vibrio cholerae O1 biovar eltor str. N16961
MIRYGDIPMRRPVVMGNWKLNGSKAMVTDLLNGLNAELEGVEGVDVVVAPPAMYLDLAERLIKEGGNKLILGAQNTDTHNSGAYTGDMSPAMLKDFGASHIIIGHSERRDYHKESDEFVAKKFAFLKENGLTPVFCIGETEAQNEAGETEAVCARQINAVIDAYGVEALNGAIIAYEPIWAIGTGKAATADDAQRIHASIRALIAAKDAAVAEQVIIQYGGSVKPENAASYFAQPDIDGALVGGASLDAKGFAAIAKAAAEAKKA

SEQ ID NO: 92174 - protein, 379 aa, Zea mays
MATAGKVIKCRAAVAWEAGKPLSIEEVEVAPPQAMEVRIKILYTALCHTDVYFWEAKGQTPVFPRILGHEAGGIVESVGEGVTELAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQAKKFGCTEFVNPKDHDKPVQEVLIELTNGGVDRSVECTGNINAMISAFECVHDGWGVAVLVGVPHKDDQFKTHPMNFLSEKTLKGTFFGNYKPRTDLPNVVEMYMKKELELEKFITHSVPFSEINTAFDLMLKGESLRCIMRMED

SEQ ID NO: 92175 - protein, 385 aa, Arabidopsis thaliana
MTMRSLPFSSSSYSLASTSLSNRLETIFKKASELCTLCDIEACVIYYGPDGELKTWPKEKEKVRDIALRYSQLNEALRSKKSVNLHGFLNKKKKKKKKGLKNPNNKRKTCLKKNVNVLKYPLADHYPPDQVSQLTQSLKLHVSKFQERLRFLESQKQTKPDHQSLTPSSLNHQTQSLNPRQFSLFMYNHGDNTLSQISVSASNFNQNYFSALLEQSELKNQLMKQDGYDQNQNMRMGDITNNNFQLPYFSKKEAVQESVNYFGMNQLMLKELYGCDQNMCMGNINSNSFQHPCVSKAQHYSAVEGSVNNQRQSELMQQELCGYEQNMCFTNNNFQVSNKEAVQESVTNFGLMQHELYGCDQNMSMGNIINNSFQQRLKHRTRICE

SEQ ID NO: 92176 - protein, 195 aa, Geobacillus kaustophilus HTA426
MNVKKAELVTSAVKPEQYPDGGRPEVALAGRSNVGKSSFINKMINRKNLARTSSKPGKTQTLNFYLINDSFYFVDVPGYGFARVSKQERQKWGNMMETYFTTREALKAAVLLVDLRHPPTKDDVMMYEFLKHYEIPVIVIATKADKVPRGKHQKHAKIARETLRMADGDPLILFSAETGQGKDEAWAALLPFVAS

SEQ ID NO: 92177 - protein, 210 aa, Salmonella enterica subsp. enterica serovar Typhi str. CT18
MILHPSLASADPLRYAEALTALHDAPLGSLHLDIEDTSFINNITFGMKTIQAVAQYSRHPLSFHLMVSSPQRWLPWLAAIRPGWIFIHAESVQNPSEILADIRAIGAKAGLALNPATPLLPYRYLALQLDALMIMTSEPDGRGQQFIAAMCEKVSQSREHFPAVECWADGGITLRAARLLAAAGAQHLVIGRALFTTANYDVTLSQFTAL

SEQ ID NO: 92178 - protein, 228 aa, Buchnera aphidicola str. Bp (Baizongia pistaciae)
MKKFLLSSSVLSANFSRLGEDIFDVLKSGSDMIHYDVMDNHYVKNLTFGPIVLESLRSVEKIKSMVIDVHLMTCPVDDLIIKFAKLDVNIISFHPESTNNVEKTIKLIKSYGCKVGLALNPLTPLCVLDNVLDKIDLILLMSVNPGFPGQKFIPSILNKIRIVRELIDKSKKNILLEVDGGINLSNIFKIASFGTDIFVIGSAIFNSINYDLTIRSFRDVLKNINCKK

SEQ ID NO: 92179 - protein, 430 aa, Robiginitalea biformata HTCC2501
MSIIIDVHARQILDSRGNPTVEVDVVTENGVLGRAAVPSGASTGEHEAVELRDGGKTYMGKGVSQAVKNVNTEIAEKVRGMLVYEQNKIDQAMIELDGTPNKGRLGANAILGVSLAVAKAAANEMGQSLYRYVGGVSANTLPVPMMNIINGGSHSDAPIAFQEFMVMPVKAKNFTHAMQMGTEIFHNLKKVLHDRNLSTAVGDEGGFAPTLDGTEDALDTIAKAVEQAGYKMGDEVMIALDCAAAEFFVDGKYDYTKFEGDSGAVRNSAEQAQYLADLCAKYPIISIEDGMDENDWEGWKMLTDKVGDTVQLVGDDLFVTNVERLSRGIDEGIANSILIKVNQIGTLSETIDAVNMAKNAGYTSVMSHRSGETEDNTIADLAVALNTGQIKTGSASRSDRMAKYNQLLRIEEELGSVAYYPGSDAFKVRS

SEQ ID NO: 92180 - protein, 269 aa, Debaryomyces hansenii CBS767
MSRPEQLAPPEVFYNDTESFKYTTSTRVQHIQAKMTLRALELLNLARDEPHFILDLGCGSGLSGEILTEEGYNWVGMDISPNMLATGLDRGLEGDVFLSDLGNGVPFRAGTFDAAISISAIQWLCNADVANADPKKRMLRFFNSLYASLRRGGKFVAQFYPMNDSQTESILDAAKLAGFGGGLIIDEPESKRHKKYYLVLTAGQSERSINLSGAQMDAPQANKKVNKKLMKKLESKKEFINRKKETMRRRGRDVAHDSKFTARKRRPRF

SEQ ID NO: 92181 - protein, 207 aa, Brassica napus
PDRVLIGGRGNAAGEKAVQALRDVYAHWVPVERIICTNLWSAELSKLAANAFLAQRISSINAMSALCEATGADVTQVAHAVGADTRIGPKFLNASVGFGGSCFQKDILNLIYICECNGLPEAANYWKQVIKVNDYQKTRFANRVVSSMFNTVSGKKVAILGFAFKKDTGDTRETPAIDVCNRLVVDKAKLSIYDPQALEEQIRKDLF

SEQ ID NO: 92182 - protein, 535 aa, Geobacter metallireducens GS-15
MSVLKSSINTTTEEFRTNADVMRGLVADLEDKVAQIKLGGGEKARAKHVERGKLLPRERIRQLLDVGSPFLELSQLAAWGMYSGDVASGGVITGIGRVSGRECMIVANDATVKGGSYFPSTVKKHLRAQEIAEANHLPCIYLVDSGGANLPQQDEVFPDRDHFGRIFYNQANMSGKGIPQIAVVMGSCTAGGAYVPAMSDESVIVRCQGTIFLGGPPLVKAATGEVVSAEDLGGADVHCRTSGVTDHYAANDGHALEVARRIVSNLNRVKRPELALREPAGPLYNPAELYGVIPTDTRKPYDVREVIARIVDGSEFDEFKQLYGTTLVCGFAHIFGYPVGIVANNGILFSESALKGAHFVELCSQRGIPLIFLQNITGFMVGSKYESGGIAKDGAKMVTAVACAKVPKFTVIIGGSYGAGNYGMCGRAYSPRFLWMWPNARISVMGGEQAASVLAQVKRDGIEAQGKTWPADEEEEFRRPIREQYETQGHPYYASARLWDDGIIDPADTRMVLGLGISATLNAPPMKTDFGVFRM

SEQ ID NO: 92183 - protein, 383 aa, Ostreococcus tauri
MPRGRSTRARTSLTHRIVALIVLVCAHAIGIHADHYATLGVSRHADESQIKRAYRKLALKYHPDKNPNDETAKKKFTEIGHAYETLSDQEKRKIYDRYGEEGVKQHEASGGRGGGHAAQDIFSQFFGGGGFGGFGGFGGMGGEEEQETPKAPTIKIDLRATCEEIYLGASVPVSRAKLVTKSAKGTRKCNCRQKLVTRQVGPGMYQQYTEQTCEDCPNVKLVREDVDLTVEIEAGAPEGHEILFFEEGDAMIDGDPGDLLFVIHTVEDAKNGIKRVGKSDLHMTYEITLVEALNGFSKVFKHYDGHDVVIARTGVTRPFDKMTVKGEGLPKHNQFKQFGDMHITFQVQFPDELDQKQRDATSKAFAKSSFVKVGKVDPGHVFA

SEQ ID NO: 92184 - protein, 542 aa, Ipomoea tricolor
MAFGLSSLLQNSELFTSDHASVVSMNLFVALLCACIVLGHLLEENRWVNESITALIIGLCTGVVILLLSRGKSSHLLVFSEDLFFIYLLPPIIFNAGFQVKKKQFFVNFMTIMLFGAIGTLISCSIISFGAVKIFKHLDIDFLDFGDYLAIGAIFAATDSVCTLQVLSQDETPLLYSLVFGEGVVNDATSVVLFNAIQSFDMTSFDPKIGLHFIGNFLYLFLSSTFLGVGIGLLCAYIIKKLYFGRHSTDREVALMMLMSYLSYIMAELFYLSGILTVFFCGIVMSHYTWHNVTESSWVTTRHSFATLSFVAETFIFLYVGMDALDIEKWKFVKNSQGLSVAVSSILVGLILVGRAAFVFPLSFLSNLAKKNSSDKISFRQQIIIWWAGLMRGAVSIALAYNKFTTSGHTSLHENAIMITSTVTVVLFSTVVFGLMTKPLINLLLPPHKQIASGHSSMTTSEPSSPKHFAVPLLDNQHDSESDMITGPEVARPTALRMLLRTPTHTVHRYWRKFDDSFMRPVFGGRGFVPFVAGSPAEQSPR

SEQ ID NO: 92185 - protein, 186 aa, Streptomyces avermitilis MA-4680
MAEQLYATLKTSQGDIAVRLLPNHAPKTVRNFVELATGEREWTNPATGEKSKDKLYDGTVFHRVISGFMIQGGDPLGNGTGDPGYQFQDEFHPDLRFDKPYLLAMANAGPGTNGSQFFITVAPTAWLNRKHTIFGEVTDVASQKVVDAIAGTRTNPGTKRPVSDIVIESVVIETREGRGAVEFRKG

SEQ ID NO: 92186 - protein, 405 aa, Neisseria meningitidis FAM18
MALIVHKYGGTSVGSPERIKNVAKRVAKARAEGHDIVVVVSAMSGETNRLVALAHEMQEHPDPRELDVVLSTGEQVTIGLLAMALKDIGVEAKSYTGWQVALKTDTAHTKARIESIDDEKMRADLAAGKVVIVAGFQGISSEGDISTLGRGGSDTSAVALAAALKADECQIYTDVDGVYTTDPRVVPEARRMDTVTFEEMIELASLGSKVLQIRSVEFAGKYKVRLRVLSSLQDGGNGTLITFEEDDNMERAAVTGIAFDKNQARINVRGVPDKPGVAYQILGAVADANIEVDMIIQNVGSEGTTDFSFTVPRGDYKQTLEILSERQDSIGAASIDGDDTVCKVSAVGLGMRSHVGVAAKIFRTLAEEGINIQMISTSEIKVSVLIDEKYMELATRVLHKAFNLG

SEQ ID NO: 92187 - protein, 275 aa, Xylella fastidiosa Dixon
MQKPAVNIMVKAARSAGNVLLRHINKLETLHVIQKSRMDYASDVDEMAEKVIVKELKRAYPDYGILGEEGGLQGNHRIMWVIDPLDGTSNYLRGFPHYCVSIALVENGEPTDAVIFDPLRNELFTASRGAGAVLNERKIRVANRKDLNGTMLNTGFSPRERSRAHAQLKCVDALLMQAEDIRRSGSAALDLAYVACGRADAYFEAGIKVWDVAAGMLLVREAGGYVCDFKGADAPRMDDKGPESCQLVAGNIKVAHALQQVIVSSGYGREFDPKR

SEQ ID NO: 92188 - protein, 253 aa, Oryza sativa
MTAHHLPHQSEQPLNKRGSAKRRKGIHAYSQKSAIAGEAAGGGGAIFFSVSTRFHLRILLAPFSLSSTSFASPRVSSRSPLATTQHAMGAADDANHRHEEASPLLPPGGGGGGGKKLHQSPPPSPPEAAKCCADGVPVVMGEPLGAPAPPRESWNSGVLSCLGRNDEFCSSDVEGSFEAFTKQCGCCHGLVEDEGNREHLEVACDLATHYFCHPCALCQEGRELRRRVPHPGFNGRSVLVMTPPKEQTMGRGM

SEQ ID NO: 92189 - protein, 258 aa, Neisseria meningitidis FAM18
MSDNALTSSRRFGGIARLYGDSALAHFSQAHVCVVGVGGVGSWAVEALARTGIGRLTLIDLDNVAESNVNRQLHALTGDFGKAKVTALRERVAQINPGCQVFEIEDFVTEDNLPEYFGKGFDFVIDAIDQVRVKAAMAAYFVERKQPFVLSGGAGGQKNPALIQTADLSRVTHDPLLANLRYTLRKRYGFSRDTKANMRVPCVYSTENIVPPQSREACSADAAPQGLSCAGYGASMLVTASFGLYCAQAAVEHIADKK

SEQ ID NO: 92190 - protein, 437 aa, Saccharophagus degradans 2-40
MQHSHSPHYQKNSLTLAGAVAMGTGVMIGAGIFALTGQVAEMAREWFPLAFLLAAVISGFSAYSYVKMSSAYPSAGGIAMFLEKAYGKGTTTAVCALLMYFSMVINESLVARTFATYTLQIFDATAVDWLVPALGSALLLFAFIVNILGNRFIQTFSFVMGFIKIGGLALLAIGGLWVSGFNFESISVKPEDTTISGFLGAIALGILAYKGFTTITNSGGEIKDPHKNIGRAIILSISICLVVYMLVAFAVGGNLSINEIVQAKDYVLAEAARPAFGQYGVWITVGFAIVATVSGVIASVFAVSRMLAMLTDMKLVPHSHFGMPGSIQQHTLVYTIVVAMFLTIFFDLSRIASLGAIFYIVMDIAIHWGVLKNLRKDVKASPTILTLAIGLDVLVLIAFIWVKIQTDMLVIWASLIGFIGIFLGEYFFLKHYRTQDK

SEQ ID NO: 92191 - protein, 286 aa, Triticum aestivum
ADHYGPAEDLYGMFINKVRRERPPEMLEEVRGLTKWVPPPVKMTRSPRVENINRSRKRMDVAALDMLQFHWWDYANPGYLDALKHITDLKEEGKIKTVALTNFDTERLQIILENGIPIVSNQVQHSIVDMRPQKKMAELCELTGVKLITYGTVMGGLLSEKFLDTNINIPFAGPPLNTPSLQKYKRMIDAWGGWSLFQALLQTLKKVSLKHGVPISTVAVRYILNQTSVAGSMVGVRLGLSEHIRDTNAILSLLLDEEDMGSITEASQRGRNLMEVIGDCGDEYRA

SEQ ID NO: 92192 - protein, 182 aa, Zea mays
LFSFFLGGGGLALLAAAPAAPPKDTERQLSKKELKKKELAELDAVLAELGLSANSSSTAQDAEKKGTNQIGDAEKKEDAPAPPESKASKKKKKKDKSSKEGKETQEALDGSEETASAGPDEDTSAVDVKERLKKMASMKKKKSSRETDTAAKIAAAEAAARSARLAAAKKKEKSHYNQQPVR

SEQ ID NO: 92193 - protein, 305 aa, Bifidobacterium longum
MHTDLRADQKAEVLIEALPWLEEFAGQRIVVKYGGNAMVDDHLKQCFAEDMVFLRQVGLHPIVVHGGGPQISHMLKALGIKSEFKGGLRVTTPEAMDVVRMVLTGKVSRELVGLINAHGPLAVGMSGEDGGLFSAMQRRPVIDGKPTDIGLVGDVVSVDASAVEDLVAAGRIPVVSSVAPNEEDATEVLNVNADSAAAALAAAVGAHKLVILTDVDGLYADWPDKNSLIGRIGVENLRDMLPDLESGMRPKMEACVRAIDGGVPQAHVIDGRKPHSILNEIFTSAGIGTMVMPDEGLEMRSSYGY

SEQ ID NO: 92194 - protein, 502 aa, Coccidioides immitis RS
MSDLFTELTAPNGRKYTQPLGLFINNEFVAAKSGQKITSINPTNEAEIASVHAAGAEDVDIAVKAAKKALKDPSWKELPPTDRGKLMVKLAELVEQHIETLATIEAWDNGKPYSVAVSEDCVEVAETLRFYGGFADKVYGSTISTSPAKFAYTLRQPIGVVGQIIPWNYPLAMAAWKLGPALACGNTVVLKPAEQTPLSILYFANLIKEAGFPPGVVNILNGFGKDAGAAIASHLDIDKIAFTGSTATGRQIMKMAAVNMKNITLETGGKSPLLVFGDADLEQAAKWAHIGIMSNMGQICTATSRILVQDTVYDKFVAQFKEVVASTSKVGDPFADDTFQGPQVTKAQYDRVLSYIESGKSEGAKLESGGVPHKNVGDGKGFFIEPTIFTNVNDNMKIYREEVFGPFVVIAKFSTEEEALSKANDTTYGLGAAVFTRDIERAHRVAAEIEAGMVWINSSNDSDFRVPFGGVKQSGIGRELGEAGLEAYSQTKAVHVNMGTKL

SEQ ID NO: 92195 - protein, 243 aa, Lactococcus lactis subsp. lactis Il1403
MEIKNKNVFVTGSTRGIGKAIALQFAKAGSNLIINGRSAISEELLAEFTAYGVKAVGISGDISKSEDAKQMVAEAIETLGSVDILVNNAGITRDGLSLKMSEEDFESVLKINLTGAFNMTQAVLKPMTRARSGAIINISSVVGLMGNAGQANYAASKAGLIGLTKSIAREVAARNVRVNAVAPGFIESDMTEVLSDKVKDAMKGQIPMKRFGMPEEIATATQFLAEQEYMTGQVLTIDGGVSM

SEQ ID NO: 92196 - protein, 798 aa, Arabidopsis thaliana
  misc_feature (395)..(395): Xaa can be any naturally occurring amino acid
MPCTTYLPLLLLLFLLPPPSVQSKVIIKGNQTILSFKAIFRLGFFSTTNGSSNWYLGISYASMPTPTHVWVANRIRPVSDPDSSTLELTSTGYLIVSNLRDGVVWQTDNKQPGTDFRFSETGNLILINDDGSPVWQSFDNPTDTWLPGMNVTGLTAMTSWRSLFDPSPGFYSLRLSPSFNEFQLVYKGTTPYWSTGNWTGEAFVGVPEMTIPYIYRFHFVNPYTPTASFWYIVPPLDSVSEPRLTRFMVGANGQLKQYTWDPQTQSWNMFWLQPEDPCRVYNLCGQLGFCSSELLKPCACIRGFRPRNDAAWRSDDYSDGCRRENGDSGEKSDTFEAVGDLRYDGDVKMSRLQVSKSSCAKTCLGNSSCVGFYHKEKSNLCKILLESPNNLKNSXLGNISKSIIILCSVVGSISVLGFTLLVPLILLKRSRKRKKTRKQDEDGFAVLNLKVFSFKELQSATNGFSDKVGHGGFGAVFKGTLPGSSTFVAVKRLERPGSGESEFRAEVCTIGNIQHVNLVRLRGFCSENLHRLLVYDYMPQGSLSSYLSRTSPKLLSWETRFRIALGTAKGIAYLHEGCRDCIIHCDIKPENILLDSDYNAKVSDFGLAKLLGRDFSRVLATMRGTWGYVAPEWISGLPITTKADVYSFGMTLLELIGGRRNVIVNSDTLGEKETEPEKWFFPPWAAREIIQGNVDSVVDSRLNGEYNTEEVTRMATVAIWCIQDNEEIRPAMGTVVKMLEGVVEVTVPPPPKLIQALVSGDSYRGVSGTSCSEGHGCSDLNTGLSSPGSRSSFGRPSP

SEQ ID NO: 92197 - protein, 263 aa, Aspergillus nidulans FGSC A4
MSPQCTLPCSRHFHLHTETTSAKNYSSSCIAHRTTILAEHSVPGSSSTAASSLASIILPKISHEQSQKLTYTHERLFVHYISDSPSGPADTTTSEPSSYAPLSYIVVATAEQGRRIPFAYLLEMKRRFLSTYPPSNTDFASLPAYGCAAFNNELRGLLQTFNTAPPADSLASAKKEIDSVRDIMTENIERVLERGERIDLLVDKTDRLGGSAHDFRMRSRGLRRRMWWKNAKLMVLLGVVVVFLIYLFVGMGCGLPAWGRCVG

SEQ ID NO: 92198 - protein, 149 aa, Streptococcus pyogenes M49 591
MGWHIFAAVIFAIASFTDYLDGYLARKWHVASNFGKFADPLADKMLVMSAFIMLVGLGLVPAWVSAVIICRELAVTGLRLLLVETGGKVLAAAMPGKIKTATQMLSIILLLCHWIFLGNVLLYIALFFTIYSGYDYFKGASFLFKDTFK

SEQ ID NO: 92199 - protein, 483 aa, Pseudomonas fluorescens PfO-1
MMNFPTTLDGLYINGQWSAGREHLRVINPATEALLTTVNGGDESAVHQAVTAATEAFKAWSKTTGAERASILRNIANGVRNGREHLMNLQSSNNGKPQFEAGIDVDDVIATFEYYAELAEGLDAKLDSNVPLPSDDFSARLRREPCGVVGLIVPWNFPMVTTAWKLAPALAAGCCVVLKPSEVTPLPELELATIIAESGLPKGVFNLVCGTGLAVGAPLSADPRIAKVSFTGSNAVGVQVMQRAAETVKGVSLELGGKSSLLILEDADLDLAVELACGGGFFNAGQMCSATSRVLVADELADEFLIRLKAHAEKIRVADPFDPEVEMGALVNQAQYQRVLGHIDRGLSAGAKLICGGNRPADLPRGYFLQPTIFTEVPLDSALWCEEIFGPVICVRSFATEAEAIALANDSQFGLVASVVTRNAETADRVANALQAGLVWLNAPQVIFPQTAWGGYKQSSIGRELGPWGLAAFQEIKHVIRAL

SEQ ID NO: 92200 - protein, 234 aa, Zea mays
FTDQEKAAAHLKGGAKKVVISAPSKDAPMFVVGVNEKEYKSDINIVSNASCTTNCLAPLAKVINDKFGIVEGLMTTVHAITATQKTVDGPSSKDWRGGRAASFNIIPSSTGAAKAVGKVLPVLNGKLTGMSFRVPTVDVSVVDLTVRLEKSATYDEIKAAVKAEAEGSLKGILGYVEEDLVSTDFQGDSRSSIFDAKAGIALNGNFVKLVSWYDNEWGYSTRVVDLIRHMNSTK

SEQ ID NO: 92201 - protein, 247 aa, Zea mays
EAGAEYVVESTGVFTDKDKAAAHLKGGAKKVVISAPSKDAPMFVVGVNEDKYTSDVNIVSNASCTTNCLAPLAKVIHDNFGIIEGLMTTVHAITATQKTVDGPSAKDWRGGRAASFNIIPSSTGAAKAVGKVLPELNGKLTGMSFRVPTVDVSVVDLTVRIEKGASYEEIKKAIKAASEGPLKGIMGYVEEDLVSTDFTGDSRSSIFDAKAGIALNDHFIKLVSWYDNEWGYSNRVVDLIRHMFKTQ

SEQ ID NO: 92202 - protein, 3121 aa, Arabidopsis thaliana
MVNYSSISCIFFVALFSIFTIVSISSAASSHGEVEDEREFNYKKNDEKGPERWGELKPEWEMCGKGEMQSPIDLMNERVNIVSHLGRLNRDYNPSNATLKNRGHDIMLKFEDGAGTIKINGFEYELQQLHWHSPSEHTINGRRFALELHMVHEGRNRRMAVVTVLYKIGRADTFIRSKELEGIAEMEEAEKNVGMIDPTKIKIGSRKYYRYTGSLTTPPCTQNVTWSVVRKVRTVTRKQVKLLRVAVHDMMLSCSPLTVPSSSYPFHFLPSSSDPPYDSIRNHPSLSLLHNCKTLQSLRIIHAQMIKIGLHNTNYALSKLIEFCILSPHFEGLPYAISVFKTIQEPNLLIWNTMFRGHALSSDPVSALKLYVCMISLGLLPNSYTFPFVLKSCAKSKAFKEGQQIHGHVLKLGCDLDLYVHTSLISMYVQNGRLEDAHKVFDKSPHRDVVSYTALIKGYASRGYIENAQKLFDEIPVKDVVSWNAMISGYAETGNYKEALELFKDMMKTNVRPDESTMVTVVSACAQSGSIELGRQVHLWIDDHGFGSNLKIVNALIDLYSKCGELETACGLFERLPYKDVISWNTLIGGYTHMNLYKEALLLFQEMLRSGETPNDVTMLSILPACAHLGAIDIGRWIHVYIDKRLKGVTNASSLRTSLIDMYAKCGDIEAAHQVFNSILHKSLSSWNAMIFGFAMHGRADASFDLFSRMRKIGIQPDDITFVGLLSACSHSGMLDLGRHIFRTMTQDYKMTPKLEHYGCMIDLLGHSGLFKEAEEMINMMEMEPDGVIWCSLLKACKMHGNVELGESFAENLIKIEPENPGSYVLLSNIYASAGRWNEVAKTRALLNDKGMKKVPGCSSIEIDSVVHEFIIGDKFHPRNREIYGMLEEMEVLLEKAGFVPDTSEVLQEMEEEWKEGALRHHSEKLAIAFGLISTKPGTKLTIVKNLRFNYEKKGEKGPENWGRLKPEWAMCGKGNMQSPIDLTDKRVLIDHNLGYLRSQYLPSNATIKNRGHDIMMKFEGGNAGLGITINGTEYKLQQIHWHSPSEHTLNGKRITDTHESQEFVEMVHPRTFGFESKHYYRFIGSLTTPPCSENVIWTISKEMRTVTLKQLIMLRVTVHDQSNSNARPLQRKNERPVALYIPTWHSPFRCVLSVNMKKDEKIGLTGRTIYTRSLAASIPASVEQETPGLRRSSRGTPSTKVITPASATRKSERLAPSPASVSKKSGGIVKNSTPSSLRRSNRGKTEVSLQSSKGSDNSIRKGDTSPDIEQRKDSVEESTDKIKPIMSARSYRALFRGKLKESEALVDASPNEEELVVVGCSRRIPAGNDDVQGKTDCPPPADAGSKRLPVDETSLDKGTDFPLKSVTETEKIVLDASPIVETGDDSVIGSPSENLETQKLQDGKTDCSPPANAESKTLPVGETSLEKEYPQKFQDDNTDCLPPANAESKRLPVGETSLEKDTDFPLKSTTETGKMVLYASPIVETRDDSVICSPSTNLETQKLLVSKTGLETDIVLPLKRKRDTAEIELDACATVANGDDHVMSSDGVIPSPSGCKNDNRPEMCNTCKKRQKVNGDCQNRSVCSCIVQPVEESDNVTQDMKETGPVTSREYEENGQIQHGKSSDPKFYSSVYPEYWVPVQLSDVQLEQYCQTLFSKSLSLSSLSKIDLGALEETLNSVRKTCDHPYVMDASLKQLLTKNLELHEILDVEIKASGKLHLLDKMLTHIKKNGLKAVVFYQATQTPEGLLLGNILEDFVGQRFGPKSYEHGIYSSKKNSAINNFNKESQCCVLLLETRACSQTIKLLRADAFILFGSSLNPSHDVKHVEKIKIESCSERTKIFRLYSVCTVEEKALILARQNKRQNKAVENLNRSLTHALLMWGASYLFDKLDHFHSSETPDSGVSFEQSIMDGVIHEFSSILSSKGGEENEVKLCLLLEAKHAQGTYSSDSTLFGEDHIKLSDEESPNIFWSKLLGGKNPMWKYPSDTPQRNRKRVQYFEGSEASPKTGDGGNAKKRKKASDDVTDPRVTDPPVDDDERKASGKDHMGALESPKVITLQSSCKSSGTDGTLDGNDAFGLYSMGSHISGIPEDMLASQDWGKIPDESQRRLHTVLKPKMAKLCQVLHLSDACTSMVGNFLEYVIENHRIYEEPATTFQAFQIALSWIAALLVKQILSHKESLVRANSELAFKCSRVESVVSTKLVNESLSGATVRDEKINTKSMRNSSEDEECMTEKRCSHYSTATRDIEKTISGIKKKYKKQVQKLVQEHEEKKMELLNMYADKKQKLETSKSVEAAVIRITCSRTSTQVGDLKLLDHNYERKFDEIKSEKNECLKSLEQMHDVAKKKLAEDEACWINRIKSWAAKLKVCVPIQSGNNKHFSGSSNISQNAPDVQICNNANVEATYADTNCMASKVNQVPEAENTLGTMSGGSTQQVHEMVDVRNDETMDVSALSREQLTKSQSNEHASITVPEILIPADCQEEFAALNVHLSEDQNCDRITSAASDEDVSSRVPEVSQSLENLSASPEFSLNREEALVTTENRRTSHVGFDTDNILDQQNREDCSLDQEIPDELAMPVQHLASVVETRGAAESDQYGQDICPMPSSLAGKQPDPAANTESENLEEAIEPQSAGSETVETTDFAASHQGDQVTCPLLSSPTGNQPAPEANIEGQNINTSAEPHVAGPDAVESGDYAVIDQETMGAQDACSLPSGSVGTQSDLGANIEGQNVTTVAQLPTDGSDAVVTGGSPVSDQDASPMPLSSPGNHPDTAVNIEGLDNTSVAEPHISGSDACEMEISEPGPQVERSTFANLFHEGGVEHSAGVTALVPSLLNNGTEQIAVQPVPQIPFPVFNDPFLHELEKLRRESENSKKTFEEKKSILKAELERKMAEVQAEFRRKFHEVEAEHNTRTTKIEKDKNLVIMNKLLANAFLSKCTDKKVSPSGAPRGKIQQLAQRAAQVSALRNYIAPQQLQASSFPAPALVSAPLQLQQSSFPAPGPAPLQPQASSFPSSVSRPSALLLNFAVCPMPQPRQPLISNIAPTPSVTPATNPGLRSPAPHLNSYRPSSSTPVATATPTSSVPPQALTYSAVSIQQQQEQQPQQSLSSGLQSNNEVVCLSDDE

SEQ ID NO: 92203 - protein, 371 aa, Geobacillus kaustophilus HTA426
MGNYRIAVLPGDGIGKEVTSGAVEVLKAVGIRFGHEFTFEYGLIGGAAIDEAGTPLPEETLRLCRESDAVLLGAVGGPKWDDNPPHLRPEKGLLAIRKQLDLYANLRPVVCYDSLVSASPLKPDLVQGVDFVIVRELTGGIYFGQPSGRVVENGEEKAVDTLLYKKEEIERIVRMAFILARGRKKKVTSVDKANVLSSSRLWREVAEEVAKQFPDVTLEHMLVDNAAMQLIRAPKQFDVIVTENMFGDILSDEASMLSGSLGMLPSASLSASGPSLYEPVHGSAPDIAGMNKANPIAAILSAAMMLRLSFGLTAEAEAVEHAVRQALDQGLRTADLAPSGGRIVSTNEMVEEIKTAVLDYTAIAQIMTVYA

SEQ ID NO: 92204 - protein, 166 aa, Buchnera aphidicola str. Bp (Baizongia pistaciae)
MASRGINKVILIGYLGQDPDVRYMQNGSAVTNITLATSETWKDKNNGEIKEKTEWHRIVFFNKLAEIAGEYLKKGSQVYIEGSLQTRKWKDQNGIERYITEIIVSVGGTMQMLGSRNSSSLTASSGLSKNNDNLSKQLLSEKKQESFNDSKLQNNNLDFDDEDIPF

SEQ ID NO: 92205 - protein, 425 aa, Vibrio cholerae O1 biovar eltor str. N16961
MSDDNRLNPTPEEQFRQRALDYHAYPTAGKIGIALTKPADSAADLALAYSPGVAEPVREIAQNVDNVYKYTAKGNTVAVISNGTAILGLGNLGPMASKPVMEGKALLFKRFAGLDSIDIEVKHRTIDEFIDTVANIADTFGGINLEDIKAPDCFEIERRLIERCDVPVFHDDQHGTAIVTAAGMLNALELQGKQLKDCIIVCLGAGAAAVACMELLIKCGAMREKIYMLDRKGVIHTRRDDLNEYKALFANNTDKRTLEDVIAGADLFLGVSGPNLLPADALKLMADKPVVFACSNPDPEIKPEIAHQVRNDMIMGTGRSDYPNQVNNVLCFPFIFRGALDVRASEINDQMKLAAVEAIRQLAKEPVPAEVLAAAGVDKLSFGIDYIIPKPMDPRLLPRVARAVAEAAVESGVARIPMPENYMQA

SEQ ID NO: 92206 - protein, 386 aa, Clostridium difficile 630
MKKEMLAMILAGGQGSRLGVFTKRIAKPAVSFGGKYRIIDFVLSNCSNSGIDTVGVLTQYRPLILNSHIGMGSHWDLDRINGGVYVLQPFMNEKEGNWYNGTAHAIYQNMDFVDTYNPEYVLILSGDHIYKMDYSKMLKFHKEKGSKATIAVIEVPWDEASRFGIMNTNEDSSIYEFEEKPSEPKSNLASMGVYIFDWKMLRNYFKEAEKNPEINYDDFGKNLIPKMLEDNVGMYAYPFKGYWRDVGTIQSLWDANMDIIKSPETLDLADPKWKIYTNTMAMPPQYIGKNANVHRSMIADGCRILGEVGNSVLSHGVVVGKGSKVIDSVIMPNVVIGENVTIEKAMIGECATINDNVQIKNVNNEINVVSEYENIEPRCVLIEGGL

SEQ ID NO: 92207 - protein, 172 aa, Geobacillus kaustophilus HTA426
MRRIITMTVNNRPGVLNRITGLFTKRHYNIESITVGHTEIEGISRMTFVVNVDDERTAEQIIKQLNKQIDVLKVNDITDQAIVARELALIKVAAPPAVRQEIYTLIEPFRASIVDVSKDSLVIQVTGEPEKVEALIELLRPYGIKEVARTGTTAFTRGAQKATTNQKTAFII

SEQ ID NO: 92208 - protein, 304 aa, Ostreococcus tauri
MNVFLSLRSTTNHGTVLSPRRAFAPTFSMPYAQLVVGPAGSGKSTYCHNVHQHCASLGRTLSVINLDPAADEFRYPVTADVRELISLEDVMEEEELGPNGALMFCMEYLEDNMDDWLAEQLEGYMEDDMVIFDCPGQLELYSHHSAFKSMTEKMTGWGWKMVCVYILDAQFISDGTKFIAGCLQAQSAMLHLALPHVNILSKVDMLQDKSVLEPYLCPDHQRLANELDERMDPKYRKLNHAIASVMEDFALISFAPLDISDEESLQFVLYQCDCAIGYGEDADVRTSRDVEYGDEPDMSNLSLE

SEQ ID NO: 92209 - protein, 209 aa, Ostreococcus tauri
  misc_feature (40)..(46): Xaa can be any naturally occurring amino acid
MSRPELTEPADVFYSHTEARKYTQSSRVIEIQERLTSARXXXXXXXDFPVQWLCNADNSAHIPQRRLKTFFTQLYKCLKRGAKAVLQIYPDGPRQAEMITTAALRVGFSGGLVVDYPNSTRAKKYFLVLAAGPPESLPRAKGEDDDEDDYERRGMRMDGRKSDKGAKYRKSNNHKGKAWVMKKKEQYRNRGVHVANDSKFTGRKRKDRL

SEQ ID NO: 92210 - protein, 223 aa, Neisseria meningitidis FAM18
MTTQDELKRIAAEKAVEFVPENEYIGIGTGSTINFFIEALGKSGKKIKGAVSTSKKSSELLAQYDIPVVSLNEVSGLAVYIDGADEVNHALQMIKGGGGAHLNEKIVASASEKFVCIADESKYVSRLGKFPLPVEVVESARSLVSRKLLAMGGQPELRIGYTTFYGNQIVDVHGLNIDKPLMMEDEINKITGVLENGIFARDAADVLILGTEEGAKVIYPCQG

SEQ ID NO: 92211 - protein, 184 aa, Glycine max
MSSPSKRREMDVMKLMMSDYAVETINDGLNEFNVEFHGPKESLYEGGVWKIRVELPDAYPYKSPSIGFVNKIFHPNVDELSGSVCLDVINQSWSPMFDLLNVFEVFLPQLLLYPNASDPLNGDAASLMMKDKKLYDQKVKEYCERYAKKENISNSTAEESGDEEDISEEESGSSDDEIPGRADP

SEQ ID NO: 92212 - protein, 201 aa, Vitis vinifera
MAAESMMAKLYPWHQVAAVSGAVGIGLGAFGAHVFKPQNPIYKEVWKTASLYHLVHTAALLATPVTKHPNIFGGLVTAGILAFSGSYWLIQYSIKFLVMILKIRALTLLSVLLNVFGVSLEGEDFAGVTLWHILKTESTVSWHHSAALRLLPLGGACFSKDFNFLIQWYKFWFLGCEFNKTTMVGSWGIVPRMLVFFGFEI

SEQ ID NO: 92213 - protein, 441 aa, Oryza sativa Japonica Group
MATITIVRITIGEEKKTCRLLEVKAAHVKAKERNDGGSWRKSSDGVGHHDCSPGLSDNSMSKEDAMSTGDSTESLDIDCLDDGDSEVVSSLQHLADDKLHISDNRDVAGVASKWTKHGCNSVEIDYIVDIDNNHEDPQLCATLAFDIYKHLRVAEQTKKRPSTDFVETIQKNIDTSMRAVLIDWLVEVTEEYRLVPETLYLTVNYIDRKYEEICPPQVEELCYISDNTYTKDEVLKMEASVLKYLKFEMTAPTTKCFLRRFLRAAQVCHEAPVLHLEFLANYIAELSLLEYSLICYVPSLIAASSIFLAKFILKPTENPWNSTLSFYTQYKPSDLCNCAKGLHRLFLVGPGGNLRAVREKYSQHKAQLPRANLMAKAHGSSSTFQFEKWRLRNLSLRKMENERRCARFCHQDGTRQLTPWDVLKAHDNEKLRASRKIVKIE

SEQ ID NO: 92214 - protein, 306 aa, Lactococcus lactis subsp. lactis Il1403
MVKIVENITELVGNSPIIKLKNGPENGAEIYLKLEYFNPGGSVKDRIALQMIRQAEADGRLKKGGTIVEPTSGNTGIGLAMAGAALGYNVVIIMPDSYSKERRQIIQAYGAELILTPAADGIKAAIDLGQKLVEENGWFMPMQFENPANLKAHELTTGPEIIEAFGENGLDAFVACAGTGGTISGVSHYLKSQNSKIKTFVVEPAESPILTGGESGPHRIQGIGIPFMSPNLDTKAYDGVIDVTSDEALETARKIGKSEGFLVGISSGAAIWAAYELAKKLGKGQKVLALCADNGERYLSTELYDY

SEQ ID NO: 92215 - protein, 504 aa, Staphylococcus epidermidis ATCC 12228
MKIRKRLDTYYTTIFLSTNSNYSYLSKEESRMTGEVKKYVDLLVIGAGSGGYVAAIRAAQLGKKVVLVDKAELGGVCLNRGCIPSKALISASERVKHIKHANTMGLKVSGEVQVDMPEVVKWKDGIVNKLTDGIRTLLKGNGVEVISGEAYLTEAHIAKIKIEDEEQIFSYKDLILAIGSLPVELKSMPFDQKRIISSTEALQLQEVPNHLVVVGGGYIGLELGTAYAKFGAKVTILEGSDTILSGTDPILTKTVKRHLKEIGITVITDALVQGGENTGDEVNVHVQVDGKEEIIQCDYCLVSIGRKPNTGKIGLENIGVVLDDQGFIKINNKCQTNIEHVYAIGDCAGGDLLAHKASYEAKIAAEVISGQNSVIDFQAMPFVIFSDPEVAYTGLTEKEAKEKGYETVSSRFPFQANARALSVSDADGFVQVVAEKNTKRVLGVQMVGPEVSSLIAEAVFAIEAGANAEDLSLTIHAHPTLPEPLMEAAEGVMGHATHMLNKKQ

SEQ ID NO: 92216 - protein, 325 aa, Agrobacterium tumefaciens
IAGWKAINESDMVLMPDPATAHIDPFFAQSTLVVLCDILDPVSGEAYNRDPRGTAKKAEAYLKASGIGDTVFVGPEPEFFVFDDVKYKADPYNTGFKLDSSELPSNDDTDYETGNLGHRPRVKGGYFPVPPIDSLQDMRSEMLTVLAEMGVVVEKHHHEVAAAQHELGVKFDTLVSSADKMQIYKYVVHQVANAYGKTATFMPKPIFGDNGSGMHVHQSIWKGGKPTFAGDEYAGLSENCLYYIGGIIKHAKAINAFTNPTTNSYKRLVPGYEAPVLLAYSARNRSASCRIPFGSNPKAKRVEVRFPDPTQNPYLGFAAMLMAGL

SEQ ID NO: 92217 - protein, 325 aa, Agrobacterium rubi
IAGWKAINESDMVLMPDTGTVHMDPFFAQSTMVIICDILDPISGESYNRDPRGTAKKAEAYLKASGIGDTVFVGPEPEFFVFDDVKYKADPYNTGFKLDSSELPSNDDTDYETGNLGHRPRVKGGYFPVPPVDSLQDMRSEMLTVLGEMGVVVEKHHHEVASAQHELGVKFDTMVSSADKMQIYKYVVHQVANAYGKTATFMPKPIFGDNGSGMHVHQSIWKGGKPTFAGDEYAGLSETCLYYIGGIIKHAKAINAFTNPTTNSYKRLVPGYEAPVLLAYSARNRSASCRIPFGSNPKAKRVEVRFPDPAQNPYLGFAAMLMAGL

SEQ ID NO: 92218 - protein, 189 aa, Coccidioides immitis RS
MALPVQISARCCRNALRQSSLAMRAVAPAYITSQHAGRARWQSTEAAAAPENPKIAQIVDQISQLTLLETADLVSSLKTRLNIPDLPVGGFAMAAGGAAPGAAAPAAEEDEPAPAAQEKTLFNLKLESFDASAKAKVIKEVKSLLGLSLVDSKKFVESVPKVMKESVPKEEAEKIVETLKALGAKAVME

SEQ ID NO: 92219 - protein, 257 aa, Candida albicans
IIFRKRLDSDRNIDASLYFGNIDPQVTELLMYELFIQFGPVKSINMPKDRILKTHQGYGFVEFKNSADAKYTMEILRGIRLYGKALKLKRIDAKSQSSTNNPNNQTIGTFVQSDLINPNYIDVGAKLFINNLNPLVDESFLMDTFSKFGTLIRNPIIRRDSEGHSLGYGFLTYDDFESSDLCIQKMNNTILMNNKIAISYAFKDSSVDGKKSRHGDQVERKLAESAKKNNLLVTKTSKAGTTKGNKRKNKPHKVTKP

SEQ ID NO: 92220 - protein, 182 aa, Glycine max
MQQRKTTAAAAGRPSGTDGSDFSYRMVVDSRYTKVTKGRSRLRLLILVQATIYLIGLSCAFMTSTKNEERNTLGIASASIGLLFAFIGDFGCRRSRVNLLRLYTAASTVVMVLSVFSAVRSRLTMEERNSSGTAANLELLGFISAQLGAVVQILAIIVTGSLVHNMSPPTKTIDRQESLWYW

SEQ ID NO: 92221 - protein, 453 aa, Staphylococcus epidermidis ATCC 12228
MRRIMMTKKYDLIVIGTGSAGSITAAKCNKAGWNVAMVDDRPFGGTCALRGCDPKKVLHGAAELIDWNKRMVKNGVPSEVSINWKDLMNFKRTFTDDVPEKKEEALNKQGIDTYHGNASFVSEDKLEVNKEVLEGSHFLIASGAKPTPLPIKGEEHLTYSDEFLELDELPQRIVFVGGGYISFEFAHIAARAGSEVHIIHRGQRPLENFDIDLVDILLEKSKEIGIQVHLQHSVESIEKEQGKFHVYARKKEDITRFEADIVIHGAGRVPALDMNLEKGNIERKKHGVHVNEYLQSVSNPNVYAAGDAAATDGLPLTPVASADSHVVASNLLKGNSKKIEYPVIPSAVFTVPKMASVGMSEEEAKNSGRNIKVKQKNISDWFTYKRTNEDFAAFKVLIDEDSDQVVGAHLISNEADELINHFATAIRFGISTKELKQMIFAYPTAASDIAHML

SEQ ID NO: 92222 - protein, 325 aa, Rhizobium giardinii
IGGWKAINESDMVLMPDPATVHMDPFFAQSTMVIVCDILDPVSGEAYNRDPRGIAKKAEAYLKASGIGDTVFVGPEPEFFVFDDVKYKADPYNTGFKLDSSELPSNDDTDYETGNLGHRPRVKGGYFPVPPVDSCQDMRSEMLTVLTEMGVTVEKQHHEVAAAQHELGVKFDTLVRNADKIQIYKYVVHQVANAYGKTATFMPKPIFGDNGSGMHVHQSIWKDGKPTFAGDEYAGLSETCLFYIGGIIKHAKAINAFTNPTTNSYKRLVPGYEAPVLLAYSARNRSASCRIPFGTGPKSKRVEVRFPDPLANPYLGFAAMLMAGL

SEQ ID NO: 92223 - protein, 248 aa, Candida albicans
MARQFFVGGNFKANGTKQQITSIIDNLNKADLPKDVEVVICPPALYLGLAVEQNKQPTVAIGAQNVFDKSCGAFTGETCASQILDVGASWTLTGHSERRTIIKESDEFIAEKTKFALDTGVKVILCIGETLEERKGGVTLDVCARQLDAVSKIVSDWSNIVVAYEPVWAIGTGLAATPEDAEETHKGIRAHLAKTIGAEQAEKTRILYGGSVNGKNAKDFKDKANVDGFLVGGASLKPEFVDIIKSRL

SEQ ID NO: 92224 - protein, 102 aa, Lavatera thuringiaca
MAISKALIASLLISLLIIQIVEADHQLVTSAGKGNSSPKKIDCGGACAARCQLSSRPHLCKRACGTCCARCACVPPGTAGNQEMCPKCYASLTTHGGKRKCP

SEQ ID NO: 92225 - protein, 325 aa, Rhizobium gallicum
IGGWKAINESDMVLMPDTETVHMDPFFAQSTMVIVCDILDPVSGEAYNRDPRGTAKKAEAYLKASGIGDTIFVGPEAEFFVFDDVKYKADPYNTGFKLDSSELPSNDDTDYETGNLGHRPRVKGGYFPVPPVDSAQDMRSEMLTVLAEMGVVVEKHHHEVAAAQHELGIKFDTLVRNADKMQIYKYVVHQVANAYGKTATFMPKPIFGDNGSGMHVHQSIWKGGKPTFAGDEYAGLSETCLYYIGGIIKHAKAINAFTNPSTNSYKRLVPGYEAPVLLAYSARNRSASCRIPFGSNPKAKRVEVRFPDPTANPYLAFAAMLMAGL

SEQ ID NO: 92226 - protein, 260 aa, Glycine max
MACSATSASLFSANPTPLFSPKPSLSLHLNPLPTRPSPSLTRPSLSLTRPSHSRRSFVVKASSSELPLVGNTAPDFEAEAVFDQEFINVKLSDYIGKKYVVLFFYPLDFTFVCPTEITAFSDRHAEFEALNTEILGVSVDSVFSHLAWIQTDRKSGGLGDLNYPLISDVTKSISKSYGVLIPDQGIALRGLFIIDKEGVIQHSTINNLAIGRSVDETKRTLQALQYVQENPDEVCPAGWKPGEKSMKPDPKLSKDYFAAV

SEQ ID NO: 92227 - protein, 325 aa, Rhizobium leguminosarum
IGGWKAINESDMVLMPDTETVHMDPFFAQSTMVIVCDILDPVSGEAYNRDPRGTAKKAEAYLKASGIGDTVFVGPEAEFFVFDDVKYKADPYNTGFKLDSTELPSNDDTDYETGNLGHRPRVKGGYFPVPPVDSAQDMRSEMLTVLSEMGVVVEKHHHEVAAAQHELGIKFDTLVRNADKMQIYKYVVHQVANAYGKTATFMPKPIFGDNGSGMHVHQSIWKGGKPTFAGDEYAGLSESCLFYIGGIIKHAKAINAFTNPSTNSYKRLVPGYEAPVLLAYSARNRSASCRIPFGSNPKAKRVEVRFPDPTANPYLAFAAMLMAGL

SEQ ID NO: 92228 - protein, 130 aa, Brassica napus
  misc_feature (123)..(123): Xaa can be any naturally occurring amino acid
IYHDLNAYRILFDDEGDPRLSTFGLMKNSSNGKSYSTNLAYTPPEFLRTGRVIPESVVYSYGTILIDLLSGKHIPPNHALDMIRGRNALLLMDSSLEGQFDNEDATKLVDLASKCLQNEAKDXPDTKFLQ

SEQ ID NO: 92229 - protein, 330 aa, Legionella pneumophila str. Lens
MTIRVAINGYGRIGRCILRSIFEYNRQNEFEVVAINDLSGIDVTAHLTRYDSTHGPFRSDVSIEGNMLIVDGHGIQVIAERDPAKLPWKQLDIDIVFECTGFFTSRDAAMGHINAGAKKVLISAPAKGVDTTVVYGVNHSVIKASDVIVSNASCTTNCLAPVVKVLHDAIGIESGLVNTVHAYTKDQMLLDGSHKDLRRARSATQSIIPTKTGAAAAVGLVLPELAGKLDGFAMRVPVLNVSVVDLTFQAKRATSVEEVNDILRKAKSRILQINEDPLVSCDFNHNPASAIFDTTETKVIGNLVKVVAWYDNEWGFSNRMIDTAHQMMNC

SEQ ID NO: 92230 - protein, 162 aa, Oryza sativa Indica Group
ISYDPNLRLPLWSSADDARDGILSIWETADVIKISEEEVSFLTKGEDPYDDSVIKKLMHPNLKLLLVTEGPEGCRYYSKEFNGRVGGLKVNAVDTTGAGDAFVAGILSQLSVDFSLLQDEGRLKEALKFANVCGALTVTERGAIPALPTRQQVVDALTKVVA

SEQ ID NO: 92231 - protein, 534 aa, Ostreococcus tauri
MSVAGVEDTLEVDALDVVKIVLQWARESGLENTAEALSRETATTLNCVDDLETFRHDITRGRWDVVLPSLAKLSMPKNVLEDAYEHVTLEMCELGERDTARAILRQSNVMKTMREEQSRRHARLEHYVSAIDFNASDAYGGTTKEKRREKIAEALCREVCVVPPSRLLALIGQALKWQRSTGALPPGTAFDLFRGQAPAEDEEEEQCPTTSHKRIKFSKKSFPECASFSACGGMLATGSADGFIEIWDPYSGKLRKDLKYQADDALLMHDDAVLAISFSKDSEMVASGSQDGKIKVWRVSTGSCLRKFEKAHQEGVTSVVFSKDGSQVLSGSFDGLIRVHGLKSGKLLKEFRGHTSYVNSVAFTEDEAHVLSASSDGSVRVWDAKTGECKHTFRPPPPVNPNKDDDVEDTYQTGTIPAVTSAVPNPKNDAQIIVTSKTNAVVVCTLAGDVVETYWTNKTALPHTIIASTTSPRGEWIYAVSDIGEMYCFSTETKKLESTVFNLHESSTLGVSHHPRRNLVATFSSIGELKTWKP

SEQ ID NO: 92232 - protein, 366 aa, Buchnera aphidicola str. Bp (Baizongia pistaciae)
MKRNYKIAVLPGDGIGPEIMREGYKILRILKSKLSLNIMTQEFDVGGVAIDKYGVALPKKTLQGCRDSHAILFGSIGGPKWEDLPSHLQPERGALLPLRKYFNLFSNLRLARIYSGLEKLSPLKSRISNLGCDILCVRELTGGIYFGDPKGSKVSKSLNCAFDTEVYYQFEIERIAHMAFDLALTRRCKVTSIDKANVLESSMFWRKIVNRISTQYSQVKLSHLYVDNAAMQIIKNPSQFDVLLCSNLFGDILSDECAAITGSIGLLPSASLNDKNFGLYEPAGGSAPDIKGKNIANPIALILSIGMMMRYSFKLYDVADLIDWAVNKTLKLGYRTQDISENNKFINTSSMGDIIAEILANRIHKI

SEQ ID NO: 92233 - protein, 223 aa, Buchnera aphidicola str. Bp (Baizongia pistaciae)
MKNIQKNIKKLKQKITNISKKFKINTQKIKLLAVSKNRSVNDIKKAILCGQNSFGENYVQESQPKIKLFNNIEWHYIGQIQSNKAHIIAKNFSWCHTITNKKTAVLLNKYRPYSLPKLNTLIQINIRDNTINIDDDIETIKQLAKTINSLDNLNLRGIMAMPYFKNTYLEQIQSYKYIHLYFDILKKKYTYIDTVSLGTSHDIQAALYSGSTLLRIGSSIFDV

SEQ ID NO: 92234 - protein, 339 aa, Neisseria meningitidis
MKKILVTGGTGFIGSHTVVSLLKSGHQVVILDNLCNSSINILPRLKTITGQEIPFYQGDIRDREILRRIFAENRIDSVIHFAGLKAVGESVAEPMKYYDNNVSGSLVLAEEMARAGVFSIVFSSSATVYGDPGKVPYTEDMPLGDTTSPYGTSKSMVERILTDIQKADPRWSVILLRYFNPIGAHESGLIGEQPNGIPNNLLPYICQVAAGKLPQLAVFGDDYPTPDGTGMRDYIHVMDLAEGHVAAMQAKGGVAGVHLFNLGSGRAYSVLEIIRAFEAASGLNIPYQIQPRRAGDLACSFADPSHTKQETGWETKRSLAQMMEDSWRWVSRNPDGYGD

SEQ ID NO: 92235 - protein, 358 aa, Oryza sativa Japonica Group
MNNHAAGGSTSNGGSGVDGDGGGGGGAARRNTKMPKYSKFTQQELPACKPILTPKWVVSVFFLVGVIFVPVGVVSLLAAQNVVEIVDRYDDACVPANMTDNKLAYIQNPNISKECTRTLTITEDMNQPIFVYYQLDNFYQNHRRYVKSRNDGQLRDAAKANQTSACEPEKTTADGKPIVPCGLIAWSLFNDTYSFTRGNENLTVDKKDISWKSDREHKFGKNVYPSNFQNGLLKGGGTLDPAIPLSEQEDLIVWMRTAALPTFRKLYGRIYVDLKKNDTITVKLSNNYNTYNFGGKKKLVLSTATWLGGKNDFLGFAYVIVGGVCFFLAFAFTLLYLIKPRKLGDHNYLSWNRHPGGR

SEQ ID NO: 92236 - protein, 571 aa, Pisum sativum
MKILMLWLTWALALSFSSMVSAAIVERTFTIQNKTIKRLCHEQVIVTVNGLYPGPNMEVREGDSVIVHVINNSPYNITIHWHGVFQLLSAWADGPEYITQCSIRPENKYTYKFKVTQQEGTVWWHAHASALRATVHGAFIIQPRSGRFPFPKPYKEVPIILGDWYDGNVEDIVRKELETGDKISSDAFTINGFPGDLFNCSKNDVYNLRVKQGKTYLFRMVNAALNNNLFFKIANHNFTVVALDAAYTEPYNTDIIVLAAGQTADVLFTADQRKGPYFMAASPYVLGEPAPLFDNTTTRGIVVYDGYKKSKSSQLKPLMPALPLHNNTPIAHKFFSNITSLVKAPHWVPVPLEVDEHMYITINMALQPCPKNAKCTGPLGQKFSASMNNESFLLPVGKGFSIMEAYFYNVSGLYTTDFPNNPPKIFDFTNPKIFFDANVTFAPKSTKVKKFKFNSTVEIVFQNTAILNAQSHPMHLHGMNFHVLAQGFGSFDPKRDKLKYNLVNPLIHNTVAVPVGGWAAIRFRTNNPGVWFLHCHVDDHNLWGLVTAFIVENGPTPSTSLPPPPADLPKC

SEQ ID NO: 92237 - protein, 375 aa, Haloarcula marismortui ATCC 43049
MALGNVDHPYEEDIEEFKGDITLLVLSFVFIALAAQLEPASLIDVGLAGIIVVLAVALFIRPLLVFVSTVGDRFTTNEKLFVSFVGPRGIIPASVATLFAVELNAAAEEVTGAQAELLGTQADILLGTVFLVIFATALFEGGLARFIAEKLDVIPMRVIIVGGGQVGRALAARLEDRGENVVIIEQEEESVERARNEGYAVEIGDGTDTDTLRSAGAENAKTVVAATGDDDANLLVSQLASSKFGVERVIARANNPDNVEAFEDLGVRTISSAMATAWAIDNQIERPAIAHWMTDVGRSGDVQEVEVKNQELIGKPIRDVGPMLPDACLVALVSGELHENAEVPTADYILEEGDMVTLLGRRESVRDGMKMVSGD

SEQ ID NO: 92238 - protein, 627 aa, Saccharophagus degradans 2-40
MNRPFSPLVGSLSRRRFVQGLAVGGVLATTPAALLARESVQTALGSAPVLSGTDINLEIGQSLVNFTGVTRMATTINGSIPAPTLRLREGDDVTIRVTNRLSVPTSIHWHGILLPFEMDGVPGISFKGIAPGETFVYRFKLRQSGTYWYHSHSGFQEMTGMYGALIIEPRSGERHEADQDFVVQLSDWTDEDPMQVFSKLKVQGDTYNFNQPTFFDFTRDVSDKGLKAALSKRQMWNQMRMNPTDLADLSTATLTYLMNGTAPAGNWTGVFKKGERLRLRFINAASNSFYDVRIPGLKLTVVQADGQDVEPVSVDEFRFGPGETYDVLVRPDDEAYTIFAQSMDRTGYARGTLATRQGLSAPVPTLDPVEWLTMQDMMGAMNHEGMGDDASMEGMDHSNMNMEKMDHSKMDHSQMDHSQMHGGMAMDHSMHGMQQGSQNPLAKPSTSVNHARTEYGPSVDARVDTPRTNLDDPGIGLRDLAEKGLRPVSHKVLTLADLQSLDGVLDDHRVPEKELELHLTGNMERYSWSFDGLEFGRSTPVSLKHGQRVRIILQNDTMMTHPMHLHGMWSELETDQGELRVRRHTIPVQPAQRISFLTTPHDLGRWAWHCHLLFHMDAGMFREVVVS

SEQ ID NO: 92239 - protein, 286 aa, Magnetospirillum magnetotacticum MS-1
MGKATGFKEFERKTPGYEAPAERVKHYREFTTPLTNEELACQGARCMDCGIPFCHQGCPVNNIIPDWNDLVYRNRWQEAAEVLHSTNNFPEFTGRVCPAPCEAACTLNITDSPVAIKTIEHAVVERAFAEGWLVPDLPKRETGKMVAVVGGGPAGMAAAQQLARAGHAVTLFEKNAQVGGLLRYGIPDFKLEKAVIDRRVAQMEAEGVTIRANTHVGVTFPVKDLLDGFDAVVLTGGSEKPRDLPVPGRELNGVHFAMDFPHPAEPTQFGRGGRRRRYPAKGRRSW

SEQ ID NO: 92240 - protein, 501 aa, Magnaporthe grisea 70-15
MASAPEKDRHTFFAGKVQPSPDSPGTFTTVNPATAQPIATIHTSSRASVDAAVDAARAAFPAWSSTPAPERAQILQRAVAILRERNDALARVETLDTGKAFSETQAVDVVTGADVLAYYANLVASDGLNGESFRLRPGAWVYSSKEPLGACAAIGAWNYPIQIALWKSAPCLAAGNTLVYKPSEYTPLHAQYLADIYAEAGVPPGVFNVVYGAGDVGAQLSSHPKIAKVSFTGQVSTGRKVAGTAAGGLKSVTMELGGKSALVVLPDADVSQAADGAMMANFYSSGQVCTNGTRVFVPRALKEEFERAVLEKIVHVRAGDLFDANTNFGPLSSKVHYEKVVSYVRHGIEQDKARLLCGGIGQPRGVPKELGKGFWIEPTVFTDCTDDMRIVKEEIFGPVMSILTYDTLEEVVQRANATELGLAAGVFGKDLNQCHQVIAQLEAGITWINTWGESPAEMAVGGWKQSGIGVENGHKGLDAWVQNKSTLVEMGGAVPTVFAKI

SEQ ID NO: 92241 - protein, 135 aa, Brassica napus
  misc_feature (107)..(107): Xaa can be any naturally occurring amino acid
MAPTIRTVATYNTHQEHTVDFFGSEFTVTVTRSSSVITRWINNHYSSSHPLVVGVGVQWTPAGYHPIYLCDNCYYAEPSLGSYYNADPEADTLQLCVGTRCLVIQLXHCDDVPDELRSFLTDPRTVYVGFWNGQD

SEQ ID NO: 92242 - protein, 222 aa, Brassica napus
MNSRTVTIVLLLFAFLQNVAAKKRQHSIVASNAAVATDHGQCSKIGMNVLRQGGNAMDASVAVALCLGVVNPGSSGLGGGSFAVVKMASGKETAYDFREVAPLRATEDMYGGNLELKKKGPLSVGVPGEVAGLFTAWKQLGKLPWKQLVYPAEKLAAEGYMISKYLYMQMNATRDDILADKGGLSELFASNGELKKPGTIVRNPKLAFTLKQSLSMSKVFYN

SEQ ID NO: 92243 - protein, 177 aa, Oryza sativa
  misc_feature (61)..(61): Xaa can be any naturally occurring amino acid
  misc_feature (64)..(64): Xaa can be any naturally occurring amino acid
  misc_feature (70)..(70): Xaa can be any naturally occurring amino acid
  misc_feature (72)..(72): Xaa can be any naturally occurring amino acid
  misc_feature (77)..(77): Xaa can be any naturally occurring amino acid
  misc_feature (90)..(90): Xaa can be any naturally occurring amino acid
  misc_feature (97)..(97): Xaa can be any naturally occurring amino acid
  misc_feature (106)..(106): Xaa can be any naturally occurring amino acid
  misc_feature (108)..(108): Xaa can be any naturally occurring amino acid
  misc_feature (123)..(123): Xaa can be any naturally occurring amino acid
  misc_feature (148)..(148): Xaa can be any naturally occurring amino acid
  misc_feature (150)..(150): Xaa can be any naturally occurring amino acid
EDPPHFPPGISPGARPPPTRGPRGAKRPRQTGARHHTPGKHHQRTDRGSTQPTSENARATXTRXHREQRXAXAKRRXREANIAGVKAAAXATIAAAXPTPASVRMXPXAKANINPTGQARIIXTAAGMAYSVAADKKILSLARRPSLXNXPEHLKNTSFRAPAALPCLLRPDSPITT

SEQ ID NO: 92244 - protein, 325 aa, Agrobacterium rhizogenes
IAGWKAINESDMVLMPDTETVHMDPFFAQSTMVILCDILDPVSGEAYNRDPRGTAKKAEAYLKASGIGDTAFFGPEAEFFVFDDVKYKADPYNTGFKLDSSELPSNDDTDYETGNLGHRPRVKGGYFPVPPVDSAQDMRSEMLTVLGEMGVTVEKHHHEVAAAQHELGIKFDTLVRNADKMQIYKYVVHQVANAYGKTATFMPKPIFGDNGSGMHVHQSIWKAGKPTFAGDEYAGLSESCLYYIGGIIKHAKALNAFTNPSTNSYKRLVPGYEAPVLLAYSARNRSASCRIPFGTNPKAKRVEVRFPDPTANPYLGFAAMLMAGL

SEQ ID NO: 92245 - protein, 140 aa, Bacillus subtilis subsp. subtilis str. 168
MSSVKDTMTTQVATVSPNQTIQEAASLMKQHNVGAIPVVEQGVLKGMLTDRDIALRTTAQGRDGQTPVSEVMSTELVSGNPNMSLEDASQLMAQHQIRRLPIVDQNNLVGIVALGDLAVNQMSNESAGSALTNISHQNIH

SEQ ID NO: 92246 - protein, 118 aa, Glycine max
MPEEDLVDIKFRLYDGSDIGPFRYSSAATVDMLKQRIVSDWPKGKTVVPKSANEVKLISSGKILENNKTVGQCKVPFGETAGGVIIMHVVVQPSLSKTKADKKVDDSPKKVVCSCSIL

SEQ ID NO: 92247 - protein, 325 aa, Rhizobium galegae
IGGWKAINESDMVLMPDPATVHMDPFFAQSTMVIFCDILDPISGEAYNRDPRGTAKKAEAYLKASGIGDTVFVGPEPEFFVFDDVKYKADPYNTGFKLDSSELPSNDDTDYETGNLGHRPRVKGGYFPVPPVDSLQDMRSEMLTVLAEMGVVVEKHHHEVASAQHELGVKFDTLVRNADKIQIYKYVVHQVANAYGKTATFMPKPIFGDNGSGMHVHQSIWKDGKPTFAGDEYAGLSESCLFYIGGIIKHAKAINAFTNPTTNSYKRLVPGYEAPVLLAYSARNRSASCRIPFGTGPKSKRVEVRFPDPLANPYLAFAAMLMAGL

SEQ ID NO: 92248 - protein, 345 aa, Zea mays
MGYLWRVRLSSFAAGAATASAAGFFLLYKDHLLARAADAESNSASYSPPLATADTAFSAPPRAVAPADLQLSGSYASDIYTYLRSLEVDPQRRSRSDYIEAVQADVTAHMRSILVDWLVEVAEEYKLVADTLYLTISYVDRFLSVNALGRDKLQLLGVASMLIAAKFEEISPPHPEDFCYITDNTYTKEELLKMESDILKLLKFELGNPTIKTFLRRFIRSAHEDKKGSILLMEFLGSYLAELSLLDYGCLRFLPSVVAASVMFVARLTIDPNTNPWNTKLQKMTGYKVSELKDCIVAIHDLQLNRKCPSLTAIRDKYKQHKFKCVSLILVPVVIPTSYFEDLAE

SEQ ID NO: 92249 - protein, 325 aa, Rhizobium huautlense
IGGWKAINESDMVLMPDPATVHMDPFFAQSTMVIFCDILDPISGEAYNRDPRGTAKKAEAYLKASGIGDTIFVGPEPEFFVFDDVKYKADPYNTGFKLDSSELPSNDDTDYETGNLGHRPRVKGGYFPVPPVDSLQDMRSEMLTVLAEMGVVVEKHHHEVASAQHELGVKFDTLVRNADKIQIYKYVVHQVANAYGKTATFMPKPVFGDNGSGMHVHQSIWKDGKPTFAGDEYAGLSESCLYYIGGIIKHAKAINAFTNPTTNSYKRLVPGYEAPVLLAYSARNRSASCRIPFGTGPKSKRVEVRFPDPLANPYLGFAAMLMAGL

SEQ ID NO: 92250 - protein, 453 aa, Coccidioides immitis RS
MGRPRRNVRFQHRSGNEASRTHSDTTDASEPPSPRKDSNGEKGEMASHIKQEPAESQLSEYEKKKQTFITRTIWTFVMIAGFFIAMFSGHIYVIAIVTAIQIVSFKEVIAIANVPSKAKNLRFTKALNWYFLATTMYFLYGESVIYYFKHILLVDRVLLPLATHHRFLSFMLYLMGFVFFVGSLQKGHYRFQFTQFAWTHMALFLIVVQAHFIMNNIFEGMIWFFLPVSLVITNDIFAYVCGITFGRTQLIKLSPKKTVEGFVGAWICTIIFGYAMTNILMKYKYFTCPVNDLGSNVLTGLECNLNPVFKPQPYQLPGWSHVGRTFYIAPMQFHILMFATFASLIAPFGGFFASGLKRTFKIKDFGESIPGHGGITDRMDCQFIMGFFSYMYYHSFIAVHKASVGGVIEAAITGLTVDEQIDVMKGLAKYLYNQGAVSETLLECFNGDFKLRR

SEQ ID NO: 92251 - protein, 441 aa, Alkalilimnicola ehrlichei MLHE-1
MSDFLMPSLGADMASGELVEWRVRPGDRVEKGQVIAVVETNKGAIEVEVFESGVVEALYEEPGTRLPVGAPMARIGDGRGLEAGEGSPKPEPKPEPKPKPEPKPKPKPKPKPKPKPKPKPEPEPEPEPEPEPEPEPEPEPEPEPEPAVSGPEPPAGTPGRAPVRLSPAARRRARELGVDPAGLRGSGPGGAVLAGDVEHAAGARPAAAPAEPPPTRPAGFDRDEMRRAIAAAMTRSKREIPHYYLNTTVDLKAAHDWLTAYNRERPPESRLVMAALFAKAAARALRKYPDLNGHYHEQGFQPADSVHLGVAIHLRGGGLIAPALLDADRLNVPDLMVRLRDLIDRARGGGLRSSEVTAPTATITALGERGVDTVYGVIHPPQVAMIGFGRVRRRPVVVGDGLAARPAVDVSLAADHRVCDGHLGARFLNRIEQDLQQPEAL

SEQ ID NO: 92252 - protein, 325 aa, Sinorhizobium arboris
IAGWKAINESDMVLMPDPETAHMDPFFAQSTMVIFCDILDPVSGEAYNRDPRGTAKKAEAYLKASGIGDTVFVGPEAEFFVFDDVKYKADPYNTGFKLDCSELPSNDDTDYETGNLGHRPRVKGGYFPVPPVDSSQDMRSEMLTVLSEMGVTVEKHHHEVAAAQHELGVKFDALVRNADKMQIYKYVVHQVANAYGKTATFMPKPVFGDNGSGMHVHLSIWKDGKPTFAGDEYAGLSETCLYFIGGIIKHAKALNAFTNPSTNSYKRLVPGYEAPVLLAYSARNRSASCRIPFGTNPKAKRVEVRFPDPTANPYLAFAAMLMAGL

SEQ ID NO: 92253 - protein, 306 aa, Glycine max
MRSKTTQFTCTFKVALLSLAVFCLFILVFRSSIFSLSPQLTSQTNMSSSDTIVPVSPQETENAGTPSSSSCPNSPPLNPPCTKAPPSLANAIIHYATANVTPQQTLHEISVSARVLEKKSPCNFLVFGLGHDSLMWTSLNYGGRTVFLEEDKSWIDQIQEKVPSLESYHVMYDTQVHQAEELMKTGMKEDCQKVTDPRFSRCPLAHKGLPSEVYDIDWDVIMVDAPTGYFDEAPGRMSAIYTAGLIARNKERGQTDVFVHDVDRKVEDMFSKAFLCEGYFKEQEGRIRHFNIPSHRSRLWRPFCPE

SEQ ID NO: 92254 - protein, 360 aa, Oenococcus oeni PSU-1
MTMVKAAVIYGPKDIRFEKRNIPDPAPDEVQIEVAFNGICGSDIHEYLEGMDLATMPHPLTHMQAPLIPGHEFSGTISKIGKQVSKLRIGDKVAVEPMIACGKCPECLSGHYNWCEHAIGSDQSAGFLGFSANGGLAEKCNVKSTFAHLLPTDFPLDLGALVEPVSVAAQAVMASRVSPGDDVLIQGAGPIGLFTALIAQISGAHHVIINDMSEERLDLANELGVQYPIRADSQKSLAHAISTITENQGVDVAFDCAGVQPTLTGAIQALKNGGKVTVIALFQHPPVVDVRALLKKGGSLLTSYGYANIFDRVIKIIDTYRSLFKRVITKKIELNELVSEGIESLEKDKKQAKILVRLHS

SEQ ID NO: 92255 - protein, 486 aa, Bacillus subtilis
AEIRKLKNYINGEWVESKTDQYEDVVNPATKEVLCQVPISTKEDIDYAAQTAAEAFKTWSKVAVPRRARILFNFQQLLSQHKEELAHLITIENGKNTKEALGEVGRGIENVEFAAGAPSLMMGDSLASIATDVEAANYRYPIGVVGGIAPFNFPMMVPCWMFPMAIALGNTFILKPSERTPLLTEKLVELFEKAGLPKGVFNVVYGAHDVVNGILEHPEIKAISFVGSKPVGEYVYKKGSENLKRVQSLTGAKNHTIVLNDANLEDTVTNIVGAAFGSAGERCMACAVVTVEEGIADEFMAKLQEKVADIKIGNGLDDGVFLGPVIREDNKKRTLSYIEKGLEEGARLVCDGRENVSDDGYFVGPTIFDNVTTEMTIWKDEIFAPVLSVIRVKNLKEAIEIANKSEFANGACLFTSNSNAIRYFRENIDAGMLGINLGVPAPMAFFPFSGWKSSFFGTLHANGKDSVDFYTRKKVVTARYPAPDFN

SEQ ID NO: 92256 - protein, 267 aa, Shewanella oneidensis MR-1
MTEAYQNRFGGIGRLYGQKALAKFAVSHVVVIGIGGVGTWAAEALARSGIGQMTLIDLDDICVTNTNRQIHALISTIGDSKVAVMAKRIREINPDCQVNEVEDFITVDNLGEYLLSAQAGGNIDYVVDCIDAVKQKAALIAWCKRQKIKIVTVGGAGGQVDPTQIQLTDLAKTYQDPLLAKVRNILRREYNFSKNVQRRFAVDAVFSSEQLVYPQADGSVCSSKASADGTMRMDCASGFGAVTMVTGTFGFVAASRVLARLAQLANE

SEQ ID NO: 92257 - protein, 121 aa, Kluyveromyces marxianus
GHVDVALPCATQNEVSGAEAEHLVANGVKYVAEGSNMGSTQEAIDIFEGARLKTASATAPAVWYAPGKAANMGGVAVSGLEMAQNSSRVQWTRETVDAELKKIMTTCFDDCVATAQEYSNE

SEQ ID NO: 92258 - protein, 581 aa, Vibrio cholerae O1 biovar eltor str. N16961
MDAVTINSFFMIGALLIGISVLLSPVSSKLGIPILLVFLAVGMLAGEDGIGQIAFDNYPVAYLVSNLALAIILLDGGMRTRVASFRVAFWPSVSLATLGVAVTTLLTGLLAMWLFNLSLLQGVLVGAIVGSTDAAAVFSLLKGRSLNERVGATLEIESGTNDPMAVFLTVTLIAVLGSAETNLSAGFLLLSFIQQFGVGALLGLAGGWILWWLINRNQLPEGLYSILAVSGGLMIFALSNALGGSGILSIYLTGLLLGNRPTRSRHAILNVLDGMTWLAQIGMFLVLGLLVTPSELMEIALPGLALAVGMILFARPIAVWIGLAPFKSFTAREKWFVSWVGLRGAVPIILAVFPMMAGLPNAQLYFNLAFFVVMVSLVVQGGTLTKAMSLAKVELPPKPEPISRTGVEIYPTSEWELFIYKLKADKWCIGEPLRNLFMPEGTRIAAVFRDNQLLHPSGSTELCEGDTLCVMAQERDLESLSRLFSEAPEKASLARFFGDFFLDIEAKLQDVALLYGLDLGELEADAKLKDLVLEHLGETPVLGDYFEWHGLQWVVADVVDWKVTKIGLRLPPEEELQEGAE

SEQ ID NO: 92259 - protein, 373 aa, Oryza sativa Japonica Group
MIVWENFCSREDTIFCGVFDGHGPNGHLVAKRVRDLLPIKLGADLGTDEGRQTSTSSIKSNGDETGSPGNMGRDAEQNGEYPEIFTALRTSFLRAFNVMDRDLKLHKSIDCFFSGTTAVAVLKQGRNLIIGNLGDSRAILGTRDKDNQLMAVQLTVDLKPNIPSEAQRIRQRRGRIFALPEEPEVARVWLPKYNSPGLAMARAFGDFCLKDYGLISMPEVSYHRITEKDEFVVLATDGVWDVLSNTEVVSIVNRATSRASAARLLVESAHRAWRARFPTSKIDDCAVVCLFLDTDELSETSSSMARDMTNAVEVSSGQHSNTIQLSTGVSSDVVTAVLTDGDDLSAVDAVAKLVTLTDLPNNASGATQSITTK

SEQ ID NO: 92260 - protein, 497 aa, Salmonella enterica subsp. enterica serovar Typhi str. CT18
MKTQTTHAAEQHAAKRRWLNAHEEGYHKAMGNRQVQMIAIGGAIGTGLFLGAGARLQMAGPALALVYLICGIFSFFILRALGELVLHRPSSGSFVSYAREFLGEKAAYVAGWMYFINWAMTGIVDITAVALYMHYWGAFGDVPQWVFALGALTIVGTMNMIGVKWFAEMEFWFALIKVLAIVIFLVVGTIFLGTGQPLEGNATGFHLITDNGGFFPHGLLPALVLIQGVVFAFASIELVGTAAGECKDPQTMVPKAINSVIWRIGLFYVGSVVLLVLLLPWNAYQAGQSPFVTFFSKLGVPYIGSIMNIVVLTAALSSLNSGLYCTGRILRSMSMGGSAPKFMAKMSRQHVPYAGILATLVVYVVGVFLNYLVPSRVFEIVLNFASLGIIASWAFIMVCQMRLRQAIKEGKAADVSFKLPGAPFTSWLTLLFLLSVLVLMAFDYPNGTYTIASLPLIAILLVAGWFGVRRRVAEIHRTAPVTADSTESVVLKEEAAT

SEQ ID NO: 92261 - protein, 297 aa, Salmonella enterica subsp. enterica serovar Typhi str. CT18
MKPQIYHVDAFTSEPFRGNSAGVVLHADTLSDAQMQLIARELRHSETAFLLKSEESDVRIRYFTPTVEVPICGHATVAAHYVRATVLGLGNTTVWQTSLAGRHRVEIHAEHNDYRITLEQGQPSFEPPLVGEIRAAIITALNLTEDDIVPGAPIQVASTGHAKVMILLKPDVDIDALSPNLAALTAISQQIGCNGFFPFQIRPGKNETDGRMFSPAIGIVEDPVTGNANGPMGAWLVHHGLMAHDGKTLQIQGHQGRALGKEGTVDVTVTIRDNQPENVTISGQAVILFHAEWAITF

SEQ ID NO: 92262 - protein, 601 aa, Ustilago maydis 521
MTRSNTDGSMTPSKQEGNLVSATHPPLAKRRFGSTSLTEDLQRHWRVYLLGICASFGGLLFGWDTGLIGGVLNMAAFQNDFGLKNNPSKLAALKGNIVSVLQAGCFFGAASSFYLPHRFGRRNAMLISAAVFLVGSIIQTTCRLHGQSATSALNQLYVGRVIGGFGVGLASSVVPTYLSECAPRSIRGRLAGMYQLLIVTGICIAYFVNYGMVQNYPDQHSSAMWQVPFALQCLPGFLFVVTLFFQPESPRWLVEQGRSEEAHRALARINRTPIDDPSVVAILQEIQNDLQGKQGLSIRQQVRMAFAERVTTYRVFTGALLMFFQQFTGTNSINYYSPQIFASLGVTGQSSGLLATGVYGVVKIVTTGLFMVVAIEQLGRKWCLITGGIVQVFCLFWIAIYQAVRPSGTPVDGVGYLTIAMIYLFVVGYGLGWSSVTWAVSAEIAPNQLRALAMSAATMSQWFFNFVIALITPRALEHIKFGTFILFAVVTSVAVLWAAFFLPETSGVSLELMHRVFQGNIITRSIQDLSPKKRKAFRDRLMAEADGTIDQGTNPGVNQEQTASADVATLDRVPSKLPKGGEDGILNTSDAVSSDNDHGKR

SEQ ID NO: 92263 - protein, 439 aa, Fusobacterium nucleatum subsp. nucleatum ATCC 25586
MIIFCLLIFKEEFRMSKETLNPLESGQKQVKKACDALGLDPAVYELLKEPQRIIEITIPVKMDDGSIKTFKGYRAAHNDAVGPFKGGIRFHQNVNSDEVKALSLWMSIKCQVTGIPYGGGKGGITVDPSELSQRELEQLSRGWVRGMWKYLGEKVDVPAPDVNTNGQIMAWMQDEYNKLSGEQTIGVFTGKPLSYGGSQGRNEATGFGVAVTMREAFKALGKNLKGATVAVQGFGNVGKFTVKNIMKLGGKVVAVAEFEKGKGAYAIYKDSGFTFEELEAAKAAGSLTKVAGAKELSMDEFWALNVEAIAPCALENAITNHEAELIKAGIVCEGANGPITPEADEVLYKKGIVVTPDVLTNAGGVTVSYFEWVQNIYGYYWTEKEVEEKEERAMVDAFTPIWALKKEFDGKGQPISFRQATYMKSIKRIAEAMKIRGWY

SEQ ID NO: 92264 - protein, 644 aa, Xylella fastidiosa Dixon
MISLRHFAMRRGGRLLLSNVDITLHAGDRVGVVGRNGVGKSSLFAAIRGELEADKGNVELPGKLRIASVAQETPSLSDLALDFVLSGDDVVAEVLRVEAEANAREDWEAVAAAHQRLAEIGGYDAEARAGKLLHGLGFITQTQRRAVSTFSGGWRVRLNLARALMMPSDLLLLDEPTNHLDMDAVFWLEQWLQKYPGTLLLISHDREFLDNVATHILHLHDGNAKLYVGGYTDFERQRAEQLRQQQIAFEKEQAERVHLQSFIDRFKAKASKAKQAQSRIKRLEKLAGTEAIRMEREFRITFAPPTKLPHSLITLRQVNCGYSVLSPSTPSDPPPVDIHAAAPSQHAVILHRVDFGLEAGDRIGLLGPNGAGKSTLVKTLVSDLAPLTGERIAHPDVRIGYFAQHTVESLHEGQSPIDHFRTLAPQAPIQSIRDFLGKWNFPGDRAFEPVDGFSGGERARLALSLIAWRQPNVLLLDEPTNHLDLEMREALAEALSDFDGAIVMVSHDRHLIGLVCDTFWRVADGVVEPFAGDLDQYAAWLRTRPAARGVRAKTEEVNQPQASLTAKSLASQLPVKKSVNSQKLLVAEKHVSELETLLAELDRKLADPVNYANGEVMRRLGDEREHAARRLAEAEQAWLLLMDG

SEQ ID NO: 92265 - protein, 466 aa, Physcomitrella patens subsp. patens
MSTMNPVPRLDTSQVASSLRAAFRTGRTRSVKWRLEQLHAIVKLLEENEEDIYWALDADLRKPRHEAFLSEIYTITASARYSIKNLHKWMAPAKKGVPLLAWPASASIVPEPLGVVFIMSPWNFPFMLAVDPLIGAISAGCAVCLKASEITPTTSALLARLIPKLSARGYGVAGTEMGQDLLHWITMRAAARHLIPVTLELGGKCPLFIDDTVDLQVASRRIMSGKFSSNNGQACIAPDYILVEEHLAPKLIKQLQSTLVQFYGEDPRSTKDLARIVNKNHFQRLSRLLDHPSTAENIIHGGERDEESLYIAPTLIKDPPLSSPIMEEEIFGPLLPIITDHVDAAVDLINDKPKALEIYLFSTRKDYAMKFAEETSSGGLVMNDCIVQFAVSELPFGGVGESGTGAYHGVASFNTFSHYKSIFNKSLGVDVAFRYPPFTTQKQGMMRAFLEGRFVNFILLALGLQK

SEQ ID NO: 92266 - protein, 432 aa, Burkholderia mallei ATCC 23344
MQLLTIGINHHTAPVALRERVAFPLEQIKPALSTFKSVFLGHPAPNAPEAAILSTCNRTELYCATNDRAARDAAIRWMSDYHRIPADELAPHVYALPQSEAVRHAFRVASGLDSMVLGETQILGQMKNAVRTASEAGSLGTYLNQLFQRTFAVAKEVRGTTEIGAQSVSMAAAAVRLAQRIFEQVAQQRVLFIGAGEMIELCATHFAAQGPRELVVANRTAERGAKLAERFGGRAMPLADLPARMHEFDIIVSCTASTLPIIGLGAVERAVKARRHRPIFMVDLAVPRDIEPEVGKLKDVFLYTVDDLGAIVREGNASRQAAVAQAEAIIETRVQNFMQWLDARSIVPVIRHMHTQADALRRAEVERARKMLARGDDPDAVLDALSQALTNKLIHGPTSALNRANGADRDSLIDLMRGFYQHAPRSSDTSDR

SEQ ID NO: 92267 - protein, 450 aa, Bacillus subtilis subsp. subtilis str. 168
MEMMGMENIQQNQGLKQKDEQFVWHAMKGAHQADSLIAQKAEGAWVTDTDGRRYLDAMSGLWCVNIGYGRKELAEAAYEQLKELPYYPLTQSHAPAIQLAEKLNEWLGGDYVIFFSNSGSEANETAFKIARQYHLQNGDHSRYKFISRYRAYHGNTLGALSATGQAQRKYKYEPLSQGFLHAAPPDIYRNPDDADTLESANEIDRIMTWELSETIAGVIMEPIITGGGILMPPDGYMKKVEDICRRHGALLICDEVICGFGRTGEPFGFMHYGVKPDIITMAKGITSAYLPLSATAVKRDIFEAYQGEAPYDRFRHVNTFGGSPAACALALKNLQIMEDEQLIQRSRDLGAKLLGELQALREHPAVGDVRGKGLLIGIELVKDKLTKEPADAAKVNQVVAACKEKGLIIGKNGDTVAGYNNVIHVAPPFCLTEEDLSFIVKTVKESFQTI

SEQ ID NO: 92268 - protein, 377 aa, Lactococcus lactis subsp. lactis Il1403
MTNLFENYGRLPFSLIKGEDQYLFDDRGNKYLDFTSGIGVMNLGYSFEKGKVAVKAQLDSLSHLSNLYQNPLQEDVAEKLSQNHSYKAFFCNSGTEANEAALKLTHLIKKDQKILAFTDGFHGRTFGAMSATMQEKIQAGFSPLLPNFVASPFNDVVALEQILEKEKIGAIIFEIIQGEGGVLPISPDFVEALKSCQQKGILLIIDEIQTGIGRTGKLFAFEHFDFEPDIFTLAKALANGIPTGAMLAKNKYASYFSAGKHGSTFGGNPLAMASANEVLKEIDSDFLEKVTDKGIFFLKLLTEKLSVKATVKSIRGLGLMIGIQLTDEKKVPEVLALLRENGLLALSAGHDVIRLLPPLVMTKVELQKGAELLEKIL

SEQ ID NO: 92269 - protein, 536 aa, Arabidopsis thaliana
MTTISDLPEDVVEEILPRVPLTSLSAVRSICKTWNTLSKNRVLCKAAVKKQFLGFIMMDYRVCSMKFHLRNDEGGDLVDDLSIKQVGILDQIEISEVLHCDGLLLFVTKDNSSLVVWNPYLGQTRLIQPSNNFHCSDRYAIGYDNNRNLKILRNFSDYGSSGSNKRGVSFKGNTYILAQGKIRVDSRWKIEAILLSFDFTTERFGPRLQLPFGFYYPQDLFSLSCVREEQLVVLHQSWMVSGELEIWITNKIDPGVVSWTKFLRSISCCRISIQAGSFFINEENQVAVVFDLDEYKGSETCRNQTAYIIGQDEYFKSVNIGEAPNLGRPEKYAPHIYCRPLGNTYILAQGKIRVDSRWKIEAILLSFDFTTERFGPRLQLPFGFYYPQDLFSLSCVREEQLVVLHQSWMVSGELEIWITNKIDPGVVSWTKFLRSISCCRISIQAGSFFINEENQVAVVFDLDEYKGSETCRNQTAYIIGQDEYFKSVNIGEAPNLGRPEKYAPHIYCRPLVCSSYVPSLVPLQINQPDTRKESDD

SEQ ID NO: 92270 - protein, 238 aa, Medicago truncatula
MLRFLNGLKQLCLAVVNWCNTELSSPEQPPPHGGFNNAEEISNETVFTVSDVEALYELFKQISSAVVDDGLITKEDFQLALFKTSSKRSLSAERVFDMFDTNSHGVLNFKEFASAMSIFHPIAPVDDKIEFLFRLYDLKQQGYIDREQLKEMVVATLSESGVQLSDYVINRIIDKTFEDADRNHDGKIDKEEFYNLALRHPSLLKNMSLLYLTEITTKFPSFVFHSQVEDTEASALSC

SEQ ID NO: 92271 - protein, 283 aa, Lactococcus lactis subsp. lactis Il1403
MRDSQNTAQTLTESLKYFLKYRDQTVVIKYGGNAMIDEKVKESILKDILLLKTVGIKVVLVHGGGPAIGELLEKYEQKSQFVQGLRVTDKKTAQLALTALAGKVNKSLVQDIIRLGGNAIGVSGIDGKLIEAKPISEDLDYVGEITAIHPEIIERINQTDAVPVIASAGIGLDGEIYNVNADTAASRIAGALSAEQFILLSDVRGLYGNFPDEESFIDEINLTNLEKLVKEKKITDRMIPKIEAIKYAMFEGLGQAVLLDGRVPHALLLELFTDKGQGTMINH

SEQ ID NO: 92272 - protein, 333 aa, Lactococcus lactis subsp. lactis Il1403
MFQGRSFLKEIDFSKDELLYLIDFAIHLKKLKKEHIQHKYLLDKNIALIFEKTSTRTRAAFTTAAVDLGAHPEFLGPNDIQLGKKESISDTAKVLGSMFDGIEFRGFKQSDVEILAKDSGRPVWNGLTDVWHPTQMLADFMTIKEHFGHLQDLTLAYVGDGRNNVANSLLVTGAILGVNITIISPESLQPALEIQKLARKYAMKSRSKISIRTDLNGLENADIVYTDVWVSMGEEAQTAKRIKLLKSYQINQKVVEKIINKNFIFMHCLPSFHDLNTEVMKEIKENYNLNELEVTDEVFNSKNSVVFEQAENRMHTIKEVMAATLGDLFIPKI

SEQ ID NO: 92273 - protein, 224 aa, Medicago truncatula
MTCCFKQLWHAVANWCNTEVSKRPPSGLKNPEAISRESVFTVSEVEALYELFKKISSAVVDDGLITKEEFQLALFKTSNKRSLFAERVFDMFDTNSHGALDFKEFASALSVFHPIAPIDDKIEFLFRVYDLKQQGYIERDELKQLVVATLSESDMELSDEMINGIIDKTFEEVDTNHDGKIDKEEWKNLAMQQPSLLTNMTLPYLTEITTAFPSFIFHTQVDDN

SEQ ID NO: 92274 - protein, 555 aa, Bacillus subtilis subsp. subtilis str. 168
MMNHQFSSLERDRMLTDMTKKTYDLFIIGGGITGAGTALDAASRGMKVALSEMQDFAAGTSSRSTKLVHGGLRYLKQFEVKMVAEVGKERAIVYENGPHVTTPEWMLLPFHKGGTFGSFTTSIGLRVYDFLAGVKKSERRSMLSAKETLQKEPLVKKDGLKGGGYYVEYRTDDARLTIEVMKEAVKFGAEPVNYSKVKELLYEKGKAVGVLIEDVLTKKEYKVYAKKIVNATGPWVDQLREKDHSKNGKHLQHTKGIHLVFDQSVFPLKQAVYFDTPDGRMVFAIPREGKTYVGTTDTVYKEALEHPRMTTEDRDYVIKSINYMFPELNITANDIESSWAGLRPLIHEEGKDPSEISRKDEIWTSDSGLITIAGGKLTGYRKMADDIVDLVRDRLKEEGEKDFGPCKTKNMPISGGHVGGSKNLMSFVTAKTKEGIAAGLSEKDAKQLAIRYGSNVDRVFDRVEALKDEAAKRNIPVHILAEAEYSIEEEMTATPADFFVRRTGRLFFDINWVRTYKDAVIDFMSERFQWDEQAKNKHTENLNKLLHDAVVPLEQ

SEQ ID NO: 92275 - protein, 184 aa, Medicago truncatula
SVSEVEALYELFKKISSGVVDDGLITKEEFQLALFKTSNKRSLFAERVFDMFDTNSHGVLDFKEFASALSIFHPIAPIDDKIDFLFRLYDLKQQGYIDRERLKQMVVATLSEFGMRLTEEMLNSIMDKTFEEVDTNHDGKIDREEWKNLAMQQTSLLKNMTLPYLTEITTTFPSFIFHTQVDDD

SEQ ID NO: 92276 - protein, 94 aa, Physcomitrella patens subsp. patens
QEDEMRSLKGIREALVALETQLKSLQSVQQQQRIRKDAVLAKLEESRRVLLQRLKEHDGREMQVVEEAMTFAGEPVKKTDDLPLPPYLNPISPS

SEQ ID NO: 92277 - protein, 269 aa, Bradyrhizobium sp. BTAi1
MISIKDLFVYPVKSCKGIKVSEVELSPTGFLDDRNWMVIDEAGVFVTQREHPKLALVEPTLTADELILKAPGMQDLAVPRKTCSSQSRDVELFGEKIPAIIAGDEPSSWFSDYLGGHFSFVSRDQRFLRKGGVQYPSRDDAPTSFVDNYGILVVSEASCADLNSRLASGVPMNRFRPNIVIEGVDAYGEDYFARAYVGDVALRFVDVCYRCNMTTIDQDKAEFGHEPLQTLGHYRHSSIGVRFGSYAAVADGIGKRLAAGSRLEIELNF

SEQ ID NO: 92278 - protein, 245 aa, Coccidioides immitis RS
MAVTLGPSSPDADIHPIATGPAKEVVEKHSIQKTWIVLEEKQIPYQYIEVNASLDPSSLLSLNPRGPIPTLYCPQPNGSKPLYESNIINEYLDDVFSSHQPHLFPLDPYKKARAKTWVDFVTSRIIPSFNRFLQAQGEGEIAKAHNEFLGHLKEFIDAMDSSGPYFFGEDFTMPDVALAPWAMRLWLLDHLKGGLRIPEPGEGGEDEQVWERWREWVDAVGSRNSVANTLSEKEYYLPIYKKVCR

SEQ ID NO: 92279 - protein, 416 aa, Coccidioides immitis RS
MSYISHHSTCQSILAALSLSALDPSKATLSTHRRGSGFASTAHLRVLIPNPENPQAEIERHFFIKTSLSSLSRSHVSSDGPHPDPAPDPAMEMFRGECASLNAIAAVVPALCPRGLAWGKLGDDGSGGWFLATEFLDLGGPAGRGGRSSSGVKTSRARLARRLAQLHCTPAPPAPTSVVGDEIVNLAEKRKKEEEKSDNNNVENNSGVGDEDDGRLQFGFPVPTFCGDVRQPNEFRRSWAEFYADQRLRTVLAESEKRNGPDKELKDLVERVAVEVVPRLLGDGHLGYDRRGNGNGIVPVVVHGDLWSGNVGRGTILRARISDDGDDAGFHEEKEDIGDVVYDPSACYAHSEFELGIMNMFGGFGRDFYEEYHCLVPKTEPVDEYHHLNHHTIFGGGYRSGAVSIMQKLLSKYGHH

SEQ ID NO: 92280 - protein, 511 aa, Mycobacterium avium 104
MPGEDAVTAPMLYIDPQACVDCGACVEVCPVDAIRHEDELTDEQARFKDINAAYFAAQPLTVRPMSPISVPEPLEQGALRVAVVGAGPAGCYAVADLIRTKGIEVNVFERLPTPFGLVRFGVAPDHQLTKDVTRTFASALSAREVTCFFNVAVGRDVTHDELMAHHHAVIYAVGATGSRDLGIPGEQLDGVFAAGDMVAWYNGHPGHADDEFDLSSPRAVIIGNGNVALDVARVLVMNHDDLAATDIAEHALTRLRDSAIDEVIVLGRRGAAHAAFSVGELLGLDNLREVDVAIDGDLGDRPQDFDGAIKYDIIAEYAGRAPRPGHRRIVLRFGARPVEVVGADRVEGLEIADSEGTTIIGTSLVLRSIGYRGSAVDGLPFDDEAGIVPNDGGRVIRDGHPVPGVYVTGWIKRGPHGVIGTNRLCARETVANLLADARGGLLPPAVSTTTELATLLTSRDVTVVDWAGWRSIDAAERRHGEAVSRPRMKIVGLDALLTTARLVDAGLPHHD

SEQ ID NO: 92281 - protein, 567 aa, Prochlorococcus marinus str. MIT 9215
MSTKSDLLKVKLTENFSEFSQLSDYSFMNSLKADPQSTKDGNDHKPRSVYSGHYVPVVPTAIPEPEYISHSNKLFKELRLSSDLTKDRKFCSFFSGDMSVANYPMSPFGWATGYALSIYGTEYTQQCPFGTGNGYGDGRAISVFEGLFNGKRMEMQLKGGGPTPYCRGADGRAVLRSSVREFLAQELMDALGIPTSRSLTLYVSRSEIVRRPWYSKRSRYFEPDIMIDNKAAITTRVAPSFLRIGQIELFARRVRNNAHAEALNELKMIVQHLIYRNYKDEIENEISLESGVIKLAFLYRSRLISLVANWMRVGYCQGNFNSDNCAAGGYTLDYGPFGFCELFDPRFQPWTGGGEHFSFFNQPTAAEINFKTFCSSLSPLLSESKQAQEKLHQIEKDFSELMKKELKKMWASKLGLENYNGTLFNELFNLMVISKADYTILFRKLSEIPNSLDSIKDSFYLPINDELNNRWEVWIENWQSVLNKEGNIKAKSASMKSLNPVYTWREWMVVPAYEEAEKGNYKKIKELQDVFSNPYIEQPSEIDKKYNRLKPSQYFNYGGVSHYSCSS

SEQ ID NO: 92282 - protein, 474 aa, Alkalilimnicola ehrlichei MLHE-1
MANSYDVIVIGAGPAGYVAAIRCAQLGMTTAVIDEFRYKDGKPQPGGTCLNVGCIPSKALLDSSEHYHKAKDGGLSVHGITAKDVSIDVKKMIARKDKVVKDLTGGIHQLLKANKIDFKTGHGKLISNSTVEFTPHEGKAEELKGEYIILATGSKPIDIGAAPADEKDILTSNGALDMEAVPKRLGVIGAGVIGLEMGSVWNRLGSKVVLLEAQDEFLAPVDRQVARMAHKAFTDQGLDIRLGCRVTDTKVGKQVSVHYEDKDGKHTLQVDKLIVSVGRRPNTDGLAADDVDLLLDERGFVHVDDECRTNLPNVYAVGDVVRGPMLAHKGSEEGVMVAELIAGHPGHLNYDTIPWVIYTHPEIAWVGKTEAQLKSEGVPYKSGTFNFAANGRARAMEESTGMVKIISHAETDRILGVHMVGAATSELIAEAVVAMEFAGSAEDLARICHAHPTLSESVHEAALAVSKQAIHKAN

SEQ ID NO: 92283 - protein, 325 aa, Sinorhizobium medicae
IGGWKAINESDMVLMPDPETAHMDPFFAQSTMVIFCDILDPVSGEAYNRDPRGTAKKAEAYLKASGIGDTVFVGPEAEFFVFDDVKYKADPYNTGFKLDSSELPSNDDTDYETGNLGHRPRVKGGYFPVPPVDSSQDMRSEMLTVLTEMGVTVEKHHHEVAAAQHELGIKFDALVRNADKMQIYKYVVHQVANAYGKTATFMPKPIFGDNGSGMHVHLSIWKDGKPTFAGDEYAGLSETCLYFIGGIIKHAKALNAFTNPSTNSYKRLVPGYEAPVLLAYSARNRSASCRIPFGSNPKSKRVEVRFPDPTANPYLAFAAMLMAGL

SEQ ID NO: 92284 - protein, 146 aa, Populus trichocarpa
MATPSGSWMQEFNEASKLGDEINGMINGKNSLPPSGPETQRHLSATRRKIAILRTKLDILQSLLTALPSKQPITGKEMNRLQDMLKNLSTKVNQMATTLNISSAANRENLLGPDKKTDDDVVNRASGLDNHGLVGFQRQIMKGLLI

SEQ ID NO: 92285 - protein, 422 aa, Alkalilimnicola ehrlichei MLHE-1
MSIEVKVPPLPESVSEATVVAWHKQPGDAVSRDENLVDLETDKVVLEVPAPADGVMGERFKNEGDTVTADEVLGKLEEGAAPAKAESKPAEAAPAPKQEAASAPAPKPAEAPAAASAPAEDLADLPPAARRLVEENNLDPKQIPGTGRAGRITKEDVVRFMKGETQPVQQPAAGQPAAAAAPQVSADAADRPEKRVPMTRLRQRIAERLVEAQQTAAMLTTFNEVNMQPVMNTRGQYKDKFEKTHGIKLGFMSFFVKAAVEALQRFPAVNASIDGKDIMYHGYYDVGIAVSSPRGLVVPVLRDADQMSFAEIEAKIAEFGQKAREGKLSMEELTGGTFTITNGGIFGSLLSTPILNPPQSGILGMHKIQERPMAENGQVVIRPMMYLAHSYDHRIIDGREAVQFLVTIKECLEDPTRLLLEV

SEQ ID NO: 92286 - protein, 552 aa, Buchnera aphidicola str. Bp (Baizongia pistaciae)
MKKINPNNTESWKMLQNHFYEIKSFHIKELFKKDKNRFKKFSLKFDNRILVDYSKNRITSFTIKLLLKLANEMDLNNSIKSMFSGKIINETENRAVLHTALRNRSNSSIIHNGCNIMFDINKVLEKMKHFSNLVINRKWLGYTGKYITDIVNIGIGGSDLGPKMVIKALNSYRNHLNIHFVSNVDGANIFNVLKKLNPESTLFIIVSKTFTTQETIVNANTAKKWMLNAVNKNEFLDQHFIAVTTNAQEAMNFGIRYKNIFLFWDWVGGRFSLWSSVGLSIVLAVGFKNFEQLLDGAYMMDQHYLHTKFDNNIPVLLALIGVWYNNFFKSETEAIFFYDWNMNYFSSFLQQMNMESNGKNICRSGEFVNWQTGPIIWGEPGTNGQHAFYQLLHQGTKLIPSDFIISIIPKHPFKDHHKYLLSHFFAQTQALAFGKFNQKCNVHINDKKTFDERLSSISFHKVCKGNQPSNSIVLDQLNPYNLGILIALYEHKVFTQGVIFNIFSFDQWGVELGKLLAKEIFLNMNTTGSKNYEYDSSTNGLINFYKIHSNNT

SEQ ID NO: 92287 - protein, 398 aa, Candidatus Protochlamydia amoebophila UWE25
MPFFNNISLLPPDPILNLSIDFSLDQNPQKINLSAGTYKTADGHSLVFTSVRKAEIDLLQKHLNKDYQPIEGNSVFLKNSLELLFGSDHALFTNKKFFAVQTVGGTSALRLGGEFLNKLTCQKIFISQPSWPNHKQVFEKTGLKIDSYPYFDFNAYKLNFSGMCQAIRQMPTGSVILLHGCCHNPSGVDPTFEQWKELSQLIKKHELIPFFDIAYQGFGKDLELDAQPIRYFASEGHEMLIAYSFSKNFGLYGERVGFLTVVTSQQKQIPSIASQLKVLIRANYSNPPLQGARIVSTILSSPELTEEWKIELKNMRDRVVEMRKTFIASLLVKGEDKNLNYLQQQIGLFGFCGLNYSQVNRLRKEFAIYIPSDGRINIAGLNTQNIEYVVNAISSVME

SEQ ID NO: 92288 - protein, 727 aa, Zea mays
MAAGSIRVTMEVGADGVALITIANPPVNALHPIIIAGLKDKYAEAMRRDDVKAIVLTGAGGKFCGGFDINVFTKVHQTGDVSLMPDVSVELVSNMMEEGKKPSVAAIQGLALGGGLELTMGCHARISTPEAQLGLPELTLGIIPGFGGTQRLPRLVGLPKAIEMMLQSKFIAAKEGKERGLIDALCSPNELIKTSRLWALEIANCRKPWMRSLGRTDRLASLSEARAVLNAARQQAMKVSPNMPQHQACLDVMEEGILYGGQAGVLKEARVFKELVVAPTSKALVHVFFAQRSTTKVPGVTDVQLKPRPIRKVAVIGGGLMGSGIATSLLVSNISVVLKEVNPQFLQRGEKMIAGNLEGLIKKGSLTKDRMHKAMSLFKGALDYSDFKDVDMVIEAVIEKIPLKQSIFSDIEKICPKHCILATNTSTIDLNVVGEKTNSQDRIIGAHFFSPAHIMPLLEIVRTEKTSPQAILDLITVGKIIKKVPVVVGNCTGFAVNRTFFPYTQASHLLVSLGIDVFRIDRVISSFGMPMGPFQLQDVAGYGVALAVKDIYADAFGERNLGSNLVGLMVKDGRQGKVNAKGYYIYEKGAKPKPDPSVKHVIEEYRKQANTMPGGKPVTLMDQDILEMIFFPVVNEACRVMDENVVIRASDLDIASVLGMGFPKYRGGLVFWADTVGAPYIHSKLSKWAEMYGPFFKPSSYLEQRAKSGVPLSAPGTSQQGSARSRM

SEQ ID NO: 92289 - protein, 148 aa, Magnetospirillum magnetotacticum MS-1
MTRVLIIEARFYDHIADGLLAGARAEFDKAGVAHDLLVVPGIFELPAALKLVLTAAEQGNEKARYDGFVTLGCAIRGESDHYHHVGTECMRGIADLSMAYDLALGNGVLTVHNEAQALARSDPARKNLGGQAARACLRMMAVKRELGL

SEQ ID NO: 92290 - protein, 411 aa, Candidatus Kuenenia stuttgartiensis
MIIKLQKGFSENMVINISYCILIVAAMLTFCCSLFAAVPQISGGGSHSLVLKPDGTVWAWGGNHAGQLGDGTTNPRKFAIQVKGLEDVVSIAAGWEHNLAVKSDGTVWAWGNNRFGQLGDGTNENRNTPVKVKTIKDVTEIDAGFYHSIALQSDGTVWVWGNNELDQLGDGTKSDAYKPMQVQGLNNVVAVSGGNHHNLVLKADGTIWGWGANGYGQLGDGTMTESSIPTPVYDFNGAVFIASGNNYNVAVKADGSIWGWGMNTYGQLGNGTQTNSKIPIRINGLNNSVSIATGGYHALILQQDGTVLSMGYNRTGQLGTGATSNYQYTTLKVHGLSDVVSIAAGYYHSLALKKDGTIWAWGNNEYGQLGDGTLNYKKLPILSQIKLDQTITPAPKEDSASANTPIPTLVK

SEQ ID NO: 92291 - protein, 247 aa, Candidatus Kuenenia stuttgartiensis
MDSFKKYIAEFLGTFTLVFIAAGAICTDYYLRKAGGDGIGVLGISIAYGLAIVSITYALSYISGAHINPAVTIACWITRRMNPNLAIKYIAAQIAGAALAGFVLKILFPEAIYTVHLGASMLGDGISVMQGLVMEFIVSFLLVLTVFGTAIDKRSFGSFSGLTIGLVVLFGVLIGSPISSGAMNPARAFGPAIASWQFANHYVWWVGPVLGGVAAAFFYDAVFAEKEKKMKAAKKTTIPAFRRKRRR

SEQ ID NO: 92292 - protein, 664 aa, Arabidopsis thaliana
MKTETHNRQCIPLAISVLSLFINGVSSARQPPDRCNRVCGEISIPFPFGIGGKDCYLNPWYEVVCNSTNSVPFLSRINRELVNISLNGVVHIKAPVTSSGCSTGTSQPLTPPPLNVAGQGSPYFLTDKNLLVAVGCKFKAVMAGITSQITSCESSCNERNSSSQEGRNKICNGYKCCQTRIPEGQPQVISVDIEIPQGNNTTGEGGCRVAFLTSDKYSSLNVTEPEKFHGHGYAAVELGWDCYCNSPGYKGNPFLPGGCVGVLIGSALLLFAFGIFGLYKFVQKRRKLIRMRKFFRRNGGMLLKQQLARKEGNVEMSRIFSSHELEKATDNFNKNRVLGQGGQGTVYKGMLVDGRIVAVKRSKAVDEDRVEEFINEVVVLAQINHRNIVKLLGCCLETEVPVLVYEFVPNGDLCKRLHDESDDYTMTWEVRLHIAIEIAGALSYLHSAASFPIYHRDIKTTNILLDERNRAKVSDFGTSRSVTIDQTHLTTQVAGTFGYVDPEYFQSSKFTEKSDVYSFGVVLVELLTGEKPSSRVRSEENRGLAAHFVEAVKENRVLDIVDDRIKDECNMDQVMSVANLARRCLNRKGKKRPNMREVSIELEMIRSSHYDSGIHIEDDDEEDDQAMELNFNDTWEVGATAPASMFNNASPTSDAEPLVPLRTW

SEQ ID NO: 92293 - protein, 690 aa, Arabidopsis thaliana
MAHEQQHLQIVILQALVTEPLEESQSRSHLESAGRIAISIVGTRLSVTAPLPGPAKLINREVVNISLPKSDFFSPYGVVHIKGPVTSLGCSSNISQGLQKTLPDLNITGRGSPYFLTDENRLVAVGCGTKALMTDIESEILGCESSCKDTKSNEVGNSLCNGYKCCQARLPVERPQAVGVNIESNNDTRGEGCKAAFLTSMKYFPSNITKPEWFQADGYAVVELGWYFDTSDSRFRNPLGCTNLTRSSGSYFLTDICLCRYGYFSRMSYRSCYCGSGYRGNPYIRGGCIDIDECEVPNKCGEDTCVNMAGRYSCVPKITKPAKLAHVLRGIFGLYKFIRKRRRIIRSMKFFKRNGGLLLKQQLTTKDGSVEMSKIFSSRELEKATDNFSIDRVLGQGGQGTVYKRMLVDGSIVAVKRSKVVDEDKMEEFINEIVLLSQINHRNIVKLLGCCLETEVPILVYEYIPNGDLFKRLHDEYDDYMMTWEVRLRIAVEIAGALSYMHSAASFPIFHRDIKTTNILLDEKYRAKISDFGTSRSVATDQTHLTTLVAGTFGYMDPEYFLSSQYTHKSDVYSFGVVLVELITGEKPMSRVRSEEGIGLATYFLEAMKENRAVDIIDIRIKDESKQVMAVAKLARRCLNRKGNKRPNMREVSIKLERIRSSPKDLDVHTENEEEEEEDQLMEINRIYDS

SEQ ID NO: 92294 - protein, 446 aa, Lactococcus lactis subsp. lactis Il1403
METNQSLKKKMAARHITMIALGGAIGAGLFKGSSSAIAAAGPSVLIAYFIGGIVLYFVMKSLEKLVLSSKDPHGLSGLVQPYLGNHTADFTDWVYWSMWMINIIAEAVAAASFLQLWFANVPTWVFVLIIALLTSLINLFSVALFAETEYWLAFIKISVVILLIIFGVFLVAKQIFDTNLVTTFSGMTAHGGFAPHGFKGVINSLLIVIYSYGGSELIAITVSETEDPKRAIPKAIRGVIGRIISFYIIPMFLLLVIYNWQTLATSSMSPFVMVFNKMHIPFAGDIVNLIIILALFSSINSGIYASSRLLYFRLKNRQGKMAQRMAHLNKHHVPQRAVIFCSGTLYIGVVLSYFVGDRLFNYLAGSLSYTVLAVWILISLAGFGLSLKTKSLSGRTMSLLALIALFLILIGILFTNPIGVTVFTAILYFIIFISYQKKNDSVSNLN

SEQ ID NO: 92295 - protein, 700 aa, Arabidopsis thaliana
MKKETQNLQCIPLVISVLSLFGVSSARKPPYLCNRVCGGISIPFPFGIGGKECYLNPWYEVVCNTTTSVPFLSRINRELVNIYLPDPTEYYSNGVVHIKGPVTSSGCSTGTSQPLTPQPLNVAGQGSPYFLTDKNLLMAVGCNVKAVMMDVKSQIIGCESSCDERNSSSQVVRNKICSGNKCCQTRIPEGQPQVIGVNIEIPENKNTTEGGCKVAFLTSNKYSSLNVTEPEEFHSDGYAVVELGWYFDTSDSRVLSPIGCMNVSDASQDGGSCYCNSMGYAGNPFLPGGCVGVLIGSALLLFAFGIFGLYKFIKKQRRSSRMRVFFRRNGGMLLKQQLARKEGNVEMSKIFSSNELEKATDNFNTNRVLGQGGQGTVYKGMLVDGRIVAVKRSKAMDEDKVEEFINEVVVLAQINHRNIVKLLGCCLETEVPVLVYEFVPNGDLCKRLRDECDDYIMTWEVRLHIAIEIAGALSYLHSAASFPIYHRDIKTTNILLDEKYQVKVSDFGTSRSVTIDQTHLTTQVAGTFGYVDPEYFQSSKFTDKSDVYSFGVVLVELITGKNPSSRVQSEENRGFAAHFVAAVKENRFLDIVDERIKDECNLDQVMAVAKLAKRCLNRKGKKRPNMREVSVELERIRSSSYKSEIHNDDDDDDDDDDEDDQAMELNIEETWDVGMTAPASMFNNGSPASDVEPLVPLRTW

SEQ ID NO: 92296 - protein, 363 aa, Candidatus Kuenenia stuttgartiensis
MIASRMSNIDSSGIRKVFDLAQKMKSPVNLSIGQPDFDVPGEIKEVAIKSINEGANKYTLTQGIPELRNVLMDRLKKDREVTTEDIMVTSGVSGALTLAIMTLVDQEDEVIIPDPAFVIYKHMVNFCSGKSVFVDTYPDFKLSAERIEPHITKKTKIIVINSPANPTGVMNTPQELKDIAELAKKHDLLVISDEIYHDYDYNNEFESIGKYYNKTLILDGFSKSFAMTGWRLGYAAGPETIIKEMIKLQQYTFVCAPSFSQYAVFRSWGFDLSKYIADYRKKRDMMYEGLKDKFRIIKPEGAFYFFPQVPWGTDEEFVMAAIKNNLLIIPGSVFSERHTHFRISYAATEETIEKGIKILNGLA

SEQ ID NO: 92297 - protein, 453 aa, Fusobacterium nucleatum subsp. nucleatum ATCC 25586
MKFWSIVLLTINSIIGTGIFLSPGAVAKLVGDKAATIYLAAAVFAAVLAVTFAAASKYVVKSGAAYAYSKAAFGDEVGSYVGITRVVSASIAWGVMATGVVKTTLSIFGQDSSNVKNVTIGFITLMFVLLIINLIGTKLLTLISNISTIGKIGALGITIIAGIFILVFSDGANLQGLTLLKDAEGNNLIPEFTTSVFVTALVGAFYAFTGFESVASGSADMEKPEKNLPRAIPLAIAIIAAIYFGIVFVSMYIDPVAMVTSKDPVVLASVFKNQLLQKIIVMGALMSMFGINVAASFHTPRVFEAMAKEKQVPDFFAKRTKSGLPLTSFILTAIIAVVIPLAFNYNMAGIIIISSISRFIQFIVVPVAVIVFFYGKSKEEILNTNKNFIIDVIIPIIALLLTILLLVKFNWAQQFSTKLDDGTVTVNLKAVVSMVIGYLILPIVLRIYMRTKK

SEQ ID NO: 92298 - protein, 652 aa, Gluconobacter oxydans 621H
MTDENDDLPLPPENGGGFFGDAPEPEMSALPAAEATPYRVLARKYRPQTFDDLIGQDSLVRILRRAFELKRVAHAFMLTGVRGVGKTTTARIIARALNCVGPDGKGGPTADPCGVCPNCTAILADRHPDVLEMDAASRTGVDDVREIIEATRFRPMQARMKVFIIDEVHMLSRNAFNALLKTLEEPPPQVTFIFATTELRKVPVTVLSRCQRFDLRRVPQSLLAGHFHNIAVKEGATLSEDALALIARAADGSVRDGLSLLDQAIAQGASDADAVADMLGLADRGLVFDLLDALMAGKPADALDLTDQAYARGADLGVLLADLLDLLHLISRLKAIPSLREGRDLPEAERTRGAALADRLSNAVLGRAWQILLKGVQEVETAPDRRQAAEMVLIRLCHASLLPTPDRLIRQLTEGGQDLSLPTGPSGPTGGASSAAPSGAVSGIASSSVSETSGGPGPRAHVRLVANGGEIVEPGIGYAEAAPEPEPEPELPPAPRTWREMVAMVAREREPVLHGLLRNAVHLVRFSPPDVQIRAEEPQARIERQLQKLLDRVYPGQWRVSASTAPGEPTLDEQGAEVVALNQASVEQHPLVQAILKTFPGAKIGEVQDHSLDEYGLPPEITVPLTDDEPPDLEFAPLDADFLDEDDLNLNR

SEQ ID NO: 92299 - protein, 599 aa, Gluconobacter oxydans 621H
MRAFPLLLATLLISSTTLANAAPQALSSAHDPLAFGPDHVSAGVLASGRHGMVVSAQHLASDAGAKILAQGGNAVDAAVAVGYALAVVYPAAGNIGGGGFMTLRLKSGQTVFIDFREHAPGAATATMYQDASGKVIPGLSTEGWKAVAIPGTVAGLDAILQKWGRLSREKVMAPAIALARDGFILNQGDADLLHTSTRYFQKDPYAPAFYLRPDGTPLQAGDRLVQKDLANSLELVAKEGPKAFYEGPIAKEIVRASTEGGGLLQPADFTSYHIRHLEPIRCTYRGYTIDTAPPPSGGGVALCEILNILSGYDMHALGLHTAPSVQREVEAMRHAYSDRRDLGDPDFVHNPVEHLIDPAYAYQIRQGIPTDHALSSSTLRAGEPLPVPVAQAAPDTQEKHETTQFSVLDHDGMAVSATYTLNGWFGAGVMGGHTGIWMNDEMDDFSSKPGAPNMFGIVGSEANAIAPGKTPLSSMSPSIVSRDGKTVMVIGSPGGSRIPTITLSVILGVIDYGLDIRQAVDLPRIHEQWEPSAVELEPGALSDETMQTLKAEGYALSPHRPWGVAEGILADHPSLSAAKTGLIYGAADPRHMGGAAVGE

SEQ ID NO: 92300 - protein, 266 aa, Gluconobacter oxydans 621H
MDKARGIVLYDQDDFKHLHRVGRLTAEALDMITPHVQPGVTTEELNQLIHDFTIAHGATPAPLNYRGYPKSCCISINHVVCHGIPGSKKLSNGDIVNIDVTSILDGWYGDSSRMYVVGKAPKKAEKLVDVTYDAMMRGIAQVRPGNTLGDIGHAIQEYAEANRFSIVRDFCGHGIGRDFHSEPNILHYGRPGEGVQLVEGMVFTIEPMLNIGRPDVKILDDGWTAVTRDRTLSAQFEHQVGVTADGCEIFTLSPKGYTKPPYGETA

SEQ ID NO: 92301 - protein, 324 aa, Lactococcus lactis subsp. lactis Il1403
MSYSNLKLFSLSSNHELAQKVAKEIGIELGKVSVGAHSDGETVVHIDESVRGDHVFILQSTSDPVNDNLMELLIMMDALRRASAASINIVLPYYGYARQDRKARAREPITSKLVANMLQIAGADRLITFDLHAPQIQGFFNIPVDHLMGSPLIAEYFRRQLVSAGDDIVVVSPDHGGVGRARKLANFLKAPLSIIDKRRPRANVAEIMNIIGDVQGKKCILIDDMIDTAGTITLAANALKELGATEVYASCTHAVLSGPAIERINNSAITKLVVLDTIEMPEERQSEKIVQLSIAHLLADAIIRIHERRPLSPLFELHLPSEQI

SEQ ID NO: 92302 - protein, 325 aa, Sinorhizobium saheli
IAGWKAINESDMVLMPDPETAHMDPFFAQSTMVIFCDILDPVSGEAYNRDPRGTAKKAEAYLKASGIGDAVFVGPEAEFFVFDDVKYKADPYNTGFKLDCSELPSNDDTDYETGNLGHRPRIKGGYFPVPPVDSSQDMRSEMLTVLAEMGVTVEKHHHEVAAAQHELGVKFDALVRNADKMQIYKYVVHQVANAYGKTATFMPKPIFGDNGSGMHVHLSIWKDGRPTFAGDEYAGLSENCLFFIGGIIKHAKALNAFTNPSTNSYKRLVPGYEAPVLLAYSARNRSASCRIPFGSNPKAKRVEVRFPDPSANPYLAFAAMLMAGL

SEQ ID NO: 92303 - protein, 287 aa, Zea mays
MGQRLLDRLAGFLLVVVVVVVLYGGTEQRIAEAADGANPHRLLATVSVSKPSYPTVVTTPMSAYGADPASKPSYSTFPSLATGNGGAGAGAGAGGGGAAAGSGGGGGTWCVASQSASPTALQVALDYACGYGADCSAIQQAGSCFNPDTVHDHASYASNSYYQKNPAPTSCDFGGTATITNTDPTSSGGAQNMVPPPSPTTTMPPTVPSTVPMTPTPTAPDTGTPVYGLSPPDYSGSTSPPGYGSTSPPDYNDVSAAAARVRQQGGAALALTLLCVVVATVSLRVSK

SEQ ID NO: 92304 - protein, 363 aa, Prochlorococcus marinus str. MIT 9215
MLKAGIIGLPNVGKSTLFNALVENAKAQAANFPFCTIEPNKGIVSVPDQRLKELGDLSSSQNIIPTKIEFVDIAGLVKGASKGEGLGNKFLSNIREVDAIVHVVRCFEDSDVIHVSGKVDPLDDIEIINLELNLADLSQLQKRRERIKKQVRTSKEAAKEDTLLEKIEEKLQKGLSVRSISLSEEENLIIKQLGFLTAKPIIYATNLNENDLAEGNDFSSKVQSFASSENTECIKISAQVESELIELEPEDKKDYLMGLGVKEGGLSSLIRSTYKLLGLKTYFTTGEKETKAWTIKDGMTAPQAAGVIHTDFEKGFIRAQTISYQNLIDSGSIANAKTKGLLRSEGKEYIVNEGDVMEFLFNV

SEQ ID NO: 92305 - protein, 172 aa, Populus trichocarpa
MDHDETGCQAPPEGPILCTNNCGFFGSAATMNMCSKCHKGMLLKQEQANLAASSIGSIVNGSSSSNVFEPVIADIIDVQNNAVEPKTITVQPSCASGSGERVEAKPKEGPNRCTSCKKRVGLTGFKCRCGSLFCASHRYSDKHDCPFDYRSAAREAIAKANPVVKAEKLDKI

SEQ ID NO: 92306 - protein, 255 aa, Triticum aestivum
MKLNIANPTTGCQKKVEIDDDMKLRNLYDKRISQEVVGDLLGEEFEGYIFKIMGGCDKQGFPMKARSANFPGRVRLLLHRGTSCFRGHGRRVGERRRKSVRGCIVSQDLSVINLVIVKKGKNDLPGLTDTEKPRMRGPKRASKIKKLFNLGKDDDVRQYVNTYRRSFTNKKGKTVSKAPKIQRLVTPLTLQRKRARIADKKKRIAKKKSEAAEYQKLLKMSFISWTKLPTTFSFLEFVVDDILREHEYLSAGVCY

SEQ ID NO: 92307 - protein, 158 aa, Zea mays
MAMGLINANPIIHEKKERRARQAPETTDENAAEPIDQLEIFDHIRDIKDPEHPYSLEQLNVVTEDSIELNDESNYVRVTFTPTVEHCSMATIIGLCIRVKLVRSLPPRYKVDIRVAPGSHATEAAVNKQLNDKERVAAALENPNLLDMVEECLSPTFD

SEQ ID NO: 92308 - protein, 628 aa, Zymomonas mobilis subsp. mobilis ZM4
MVDSSSLATPYRVLARKYRPQKFSDLIGQDAMVRTLGNAIARDRLAHAFLLTGVRGVGKTSTARLIAKALNCVGKDGHGGMTIDPCGECEACRAIAEGRHIDVVEMDAASHTGVDDIRDIVESVRYASVSARFKVYIIDEVHMLSKSAFNALLKTLEEPPAHVKFLFATTEINKVPITVLSRCQRFDLRRISTATLTDYFSKVVQLEQVEAEEEALAMIAKAAEGSVRDGLSILDQAIAHSSGSILAADVREMLGLSDRGVIKSLLVDLLEGKGDRVLDHVKAQYDLGVEPEALLHGLLQLIHAITRSKMGRPDNLTLHPTEEEIWLAELGKKLSFPVLHRLWQLLLKGHSEVQNAVLPLEAAEMALLRVIHASQLPDPAMIIAQFKKQGSVSSNLSPSPEDNRLAPPTSSFQDREAGDVKKNISEQVSPSQFQAKEALLKNGSDFSKSLQSAEKKDFSPFDDDNNSRVAASDYPVEGNQKFSELPENQPRPSAIPIAPASEAKLKNPHFPPDFKSLTEMLFDNGHALLGHSLEDYGRLIEYNPPRLLLENHSRISGETRQELSLALKNLTKQAWQVEFLQDRKGQPSFREAEIAQKEARQKAILNTPIVQAVLKTFPDAEWVQSSDE

SEQ ID NO: 92309 - protein, 452 aa, Triticum aestivum
  misc_feature (93)..(93): Xaa can be any naturally occurring amino acid
  misc_feature (347)..(347): Xaa can be any naturally occurring amino acid
  misc_feature (364)..(364): Xaa can be any naturally occurring amino acid
LPHTYLIYHGSCVAISKGIPIPFSYDKHGPNSDPSSEIAKAVDNFGATTFTWHLSNITDVCQQCEHQGRYCGFSSQRRQAFCQHHGTLVFPMXAASSVAAFVVLSLMVATAMYLSLKSRYNEEINMNVEMFLKAYGTSKPTRYTFPEVRKIARRFKDKLGQGGFGSVYKGELLNGVPVAVKMLESSTGEGEEFINEVATIGLIHHANIVRLLGFCSEGMRRALIYEFMPNESLEKYIFTHVSNISRKLLAPNKMLDIALGIARGMEYLHQGCNQRILHFDIKPHNILLDYNFNPKISDFGLAKLCARDQSIVTFTAARGTMGYIAPELYSRNFGGVSHTSHDVYSFXGSWLWEMVSGGRNSDPXVENQDEVYLPEWIYEKVFSRHEWELTPEMTAEDKEKMRQLTIVGLWCIQWNPKNRPSMTKVVNMLTGRLQNLQVPPKPFVSYENQPRT

SEQ ID NO: 92310 - protein, 533 aa, Burkholderia mallei ATCC 23344
MKSSIQRNIGPFALMLTGLGSIIGSGWLFGAWKAAKIAGPAAICAWIIGAVVILAIALTYAELGAMFPESGGMVRYARYSHGSLVGFISAWANWIAIVSVIPIEAEASIQYMSTWPYAWAHALFVNGELTTPGLLLSAILVVIYFLLNYWGVKLFARANTAITIFKFLIPGLTIAGLLLSSFHSENLGTAGGSSGFAPYGWSAVLTAVATSGIVFAFNGFQSPVNLAGEARNPSRSVPFAVISSILIALVIYVLLQVAYIGAVNPADVAKGWAHFNFASPFAELAIALNLNWLAILLYVDAFVSPSGTGTTYMATTTRMIYAMERNNTMPKIFGSVHPLYGVPRPAMWFNLMVSFVFLFFFRGWSSLAAVISVATVISYLTGPISLMALRCAATDLERPLAIPCMKLIAPFAFVCASLILYWAKWPLTGEIILLMIVALPVYFYYQGKAGWSGWGRDLKAAWWLVAYLPTMAVLSLIGSKEFGGHGVLPYGWDMLVVAAIAPVFYYWGVHTGYRTEYLDERESRDEILEGIGA

SEQ ID NO: 92311 - protein, 453 aa, Oryza sativa Japonica Group
MAAAVAASSSSSSSSCAAVGVATASHPHRHRQARFVVSPPAPASPAALLWRRPRRVAPTTFCSAPSLGPRRVAAAGGCRLAAVVPRRPGFFPVVGGGGRSFPGRSPRCSRSSSPPPPSPRSATPLPSHGEWEIVKSSQTPWTLSRMFLAWNLGATSTWVSKEYYAPALGGIMLSIGIKLSIDDFALAFKRPVPLTIGYMAQYIVKPLMGVLIARAFGMPSAFFAGFVLTCCVSGAQLSSYASFLSKGDVALSILLTSCSTISSVVVTPVLTGLLIGSVVPVDGIAMAKSILQVVLVPVTLGLLLNTYAKAVVNVIQPVMPFVAMLCTSLCIGSPLAINRSKILSSEGFLLLLPIVTFHIAAFIVGYWISKLPMLRQEEPVCRTISVCTGMQSSTLAGLLATQFLGSSQAVPAACSVVIMAIFGLTLASYWGNGLRIRDIGSRFVPQASAGVSS

SEQ ID NO: 92312 - protein, 113 aa, Cucumis melo
MEQDFHAERFDDFLREVAIMKCLRHPNIVLFMGAVTEPPNLSIVTEYLSRGSLHRLLYRPGAREVLDERRRLNMAYDVAKGMNYLHKRNPPIVHRDLKSPNLLVDKKYTVKVC

SEQ ID NO: 92313 - protein, 149 aa, Cocos nucifera
RTLRELKLLRHMDHENVVAIRDIIPPPVREIFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDVWSVGCIF

SEQ ID NO: 92314 - protein, 487 aa, Sinorhizobium meliloti
MRAQPKASHFIDGEYVEDAAGTVIESIYPATGEIIARLHAATPGIVEKAIAAAKRAQPEWAAMSPTARGRILKRAAELMRQLNRELSELETLDTGKPIQETIVADPTSGADSFEFFGGVAPAALNGDYIPLGGDFAYTKRVPLGVCVGIGAWNYPQQIACWKGAPALVAGNAMVFKPSENTPLGALKIAEILIEAGLPKGLFNVIQGDRATGPLLVNHPDVAKVSLTGSVPTGKKVAGAAAAELKHVTMELGGKSPLIVFDDADLESAIGGAMLGNFYSTGQVCSNGTRVFVQRKIKEPFLARLKERTEAIVIGDPLDEATQLGPMVSAAQRDKVFSYIGKGKAEGARLVTGGGIPNNVSGEGTYIQPTVFADDTDGMTIAREEIFGPVMCVLDFDDEVEVIARANATEFGLSAGVFTADLTRAHRVADRLEAGTLWINTYNLCPVEIPFGGSKQSGFGRENSVAALNHYTELKTVYVGMGPVEAPY

SEQ ID NO: 92315 - protein, 313 aa, Zea mays
MDVPARPGPLGARASPQSRPSKAFCTCAQTAAAVDTRAATPRSKPPLLPPPPLTMGSAATSPQPSGNLTQDELKRVAAHRALEFVESGMTLGLGTGSTAAHALDRLGDLLRAGALPGVAGVPTSLKTEAHAARVGIPLLPLDAASGASIRLSIDGADEVDPDLNLVKGRGGSLLREKMIEGAGDRFVVIVDESKLVPRLGCTGAVPVEVIPFGAPHTLGLIRKVFDGVPGFHARLRTVPAANGEDSDAPFLTDNGNYIVEMFFEDGIRGDLLDISDRLLRITGVIEHGMFLGMATTVIVANKDGTVTVINKKK

SEQ ID NO: 92316 - protein, 210 aa, Rhodopirellula baltica SH 1
MNNQQQSPIHIKSPVVTKYARPLKIRWSKHLDGTLKPHHGKVQVVFSGDKKERISFDGRDFHIVQFHFHHKSEHWIEDKQFQMELHIVHQNCDPDDGKLAVLGIMIEADNSAKTVPGLIELMETMAKDDARKFMDFKTNPHEWLPPNTQHFYRYEGSLTTPEYDEIVSWIVLREPLKLPSKEINKLIRFAAEPARLPQPLNRRFVLSNFS

SEQ ID NO: 92317 - protein, 493 aa, Anabaena variabilis ATCC 29413
MQLNHNGVHSEGHSFVVPQICPSQSSVGSDFPSNRVHSLPGEASSQYLERQQARESNARSYPRRIPIAISEAQGIYIKDADGNVYIDCLAGAGTLALGHNHPVAIEAMRKVLDGGLPLHTLDLTTPVKDKFVEELFASLPPEFAQNVKIQFCGPSGADAVEAAIKLVKTATGNRSVLSFHGGYHGMTHGALSLTGNLNPKQAVTGLMPDVHFLPYPYHYRCPFGLGGEAGQRTSSRYIESILDDPESGIVTPAAMILEVVQGEGGVIPAPDDWLREMRRITRDRHIPLIVDEIQTGLGRTGKLYAFEHSGIMPDVLLLSKAIGGSLPLSVVLYNKELDKWSPGAHAGTFRGNQMAMAAGTATLQYILENSLTEHAAAMGDRLLKHLHQIQGETYCIGEVRGRGLMVGVEIINPQASADRRGKYPAHPQLASRIQAECLRRGLIVELGGRFGSVVRFLPPLIVTPAQIDSICEIFASAVQAAEKQVLSVLSQVS

SEQ ID NO: 92318 - protein, 430 aa, Physcomitrella patens subsp. patens
MDALDQLVAQVQALSGSEQDVAHLSSLLKQADELLRTHALRLPFSLSSLHPTKHSLGYLYLLEAQSSGTLTREQSDSFLALASSFLTVCAPEQIRLAPDKFNSVCRRLRDQAMHLHEPMRAILPLQCAIRKLQPSSEYLTAIHADYLQMCLLSKCYKASLSILEDDIFEIDQKKTSLVPRDFLLYCYYGGMIYIGLKKFSKALEFFQHAITAPTTALNAITIAAFGKYVLVSLIQNGQVPPFPKYTPAVVLRNLKSCVQDYLDLANLYASRNIAEVKRCITQHEEVFKNDNNLGLAKQVIASLYKRNIQRLTQTYLTLSLQDIANTVQLDDEKDAELHILQMIKDGDIFAAINQKDGMVSFQEDPEQYNTCDMTQRLNNEIHHIVCLAKKLTWVDEQVSCDHAYLSKIGRDRPRYDEDFDLVPQKIYTNI

SEQ ID NO: 92319 - protein, 316 aa, Bacillus clausii KSM-K16
MFDVITLGDAMISFSPNATGPLKFVHSFERRVGGAELNVAIGCSRLGLKTGWITRLGKDEFGQHIQTFARGEGVDVSETKLVDGYATSLNFKEIMANGAGRTLYYRNPSPTETLKPEDLNPSYFQQAKILHLTGIYPAVATGNMAVTKQAIKLAKENGVKVAFDPNIRLRLWSKEEARLALYPLLQEVDILLTGDEEMEIILGTSDPAEIIAETTKLGIDLVAIKRGENGSVGSYQGKVVEAAPVQAAKVVDTVGAGDGFDAGLLYGYLQGWPLERMLAFANTIGSMVVSIVGDNEGLPYLEEVQAQLGELERIER

SEQ ID NO: 92320 - protein, 228 aa, Bacillus clausii KSM-K16
MDQLKRMAAEAAAEYVKDGMKIGLGSGSTVFEFVRVLGEKAKEGLNIQAVAASRKTEALAKACGIHIIDFPTMEKLEVAFDGADEIAPGLMLLKGGGGSLLREKLVAAAAKRLVVLADESKLVEELGAFKLPVEIIPFGWETTAMRIEALGGVASLRQTGKSPFVSDNHNWILDCDFGNIRDPYSLHEKVKKLVGVVETGLFLDMACEAIVASKNGIHHITKGDEFNV

SEQ ID NO: 92321 - protein, 280 aa, Arabidopsis thaliana
MSKEVSEEGKTHHGKDYVDPPPAPLLDMGELKSWSFYRALIAEFIATLLFLIVTVATVIGHKKQTGPCDGVGLLGIAWAFGGMIFVLVYCTAGISGGHINPAVTFGLFLAGKVSLVRALGYMIAQCLGAICGVGFVKAFMKTPYNTLGGGANTVADGYSKGTALGAEIIGTFVLVYTVFSATDPKRSARDSHIPVLAPLPIGFAVFMVHLATIPITGTGINPARSFGAAVIYNNEKAWDDQWIFWVGPFLGALAAAAYHQYILRASAIKALGSFRSNATN

SEQ ID NO: 92322 - protein, 178 aa, Xylella fastidiosa Dixon
MGLELVNAGNNLPEEINVIIEIPKDSEPVKYEVDKASGAIFVDRILSTPMRYPCNYGYVPNTLCGDGDPVDVMVVLPLPLVPGSVVRCRPVGVLQMKDEAGNDEKLLAVPVSKIFSGYSHIEDINQVSAHWLERIGHFFEHYKDLEEGKWVEIDGWGNATTAKQILTSAVQRYKDTLP

SEQ ID NO: 92323 - protein, 120 aa, Zea mays
  misc_feature (15)..(15): Xaa can be any naturally occurring amino acid
  misc_feature (97)..(97): Xaa can be any naturally occurring amino acid
MESSANKLISLPITXLDGDDDETVDPHQPPPAGPSAAAVDSDDDDEEEEAEVTLGVLSIPKHPGLLLRHLFPSKAGGIPAWLDPENLSSGKSSCCGXFCGQPLQSALHIYAAVEDQVAAF

SEQ ID NO: 92324 - protein, 769 aa, Hevea brasiliensis
MGTAVLSELGTEILVPVCAVVGIVFSLIQWYLVSRVKLTPERQAPGSSPAGANKNGYNDCLIEEEEGLNDHSVVAKCAEIRTAISEGATSFLFTEYQYVGVFMVAFAILIFLFLGSVEGFSTKSQPCTYDKQKTCKPALATAIFSTVSFLLGAFTSVVSGFLGMKIATYANARTTLEARKGVGKAFITAFRSGAVMGFLLAANGLLVLYIAINLFKLYYGEDWEGLFESITGYGLGGSSMALFGRVGGGIYTKAADVGADLVGKVERNIPEDDPRNPAVIADNVGDNVGDIAGMGSDLFGSYAESSCAALVVVPISSFGINHDFTAMLYPLLISSVGILVCLITTLFATDFFEIKAVKEIEPALKKQLIISTVLMTVGIAIVTWIGLPSSFTIFNFGTQKVVKNWQLFLCVAVGLWAGLIIGFVTEYYTSNAYSPVQDVADSCRTGAATNVIFGLALGYKSVIIPIFAIAIGIFVSFSFAAMYGIAVAALGMLSTIATGLAIDAYGPISDNAGGIAEMAGMSHRIRERTDALDAAGNTTAAIGKGFAIGSAALVSLALFGAFVSRASISTVDVLTPKVFIGLIVGAMLPYWFSAMTMKSVGSAALKMVEEVRRQFNTIPGLMEGHAKPDYATCVKISTDASIKEMIPPGALVMLTPLIVGTFFGVETLSGVLAGALVSGVQIAISASNTGGAWDNAKKYIEAGASEHARTLGPKGSDPHKAAVIGDTIGDPLKDTSGPSLNILIKLMAVESLVFAPFFATHGGLLFKMF

SEQ ID NO: 92325 - protein, 325 aa, Sinorhizobium kostiense
IAGWKAINESDMVLMPDPETAHMDPFFAQSTMVIICDILDPVSGEAYNRDPRGTAKKAEAYLKASGVGDTIFVGPEAEFFVFDDVKYKADPYNTGFKLDSSELPSNDDTDYETGNLGHRPRIKGGYFPVPPVDSVQDMRSEMLTVLTEMGVTVEKHHHEVAAAQHELGVKFDTLVRNADKMQIYKYVVHQVANAYGKTATFMPKPVFGDNGSGMHVHMSIWKDGRPTFAGDEYAGLSETCLYFIGGIIKHAKAINAFTNPSTNSYKRLVPGYEAPVLLAYSARNRSASCRIPFGSNPKAKRVEIRFPDPSANAYLAFAAMLMAGL

SEQ ID NO: 92326 - protein, 406 aa, Brassica napus
MAAALQTNIRPVKFPATLRALTKQSSPAPFRVRCAAASPGKKRYNITLLPGDGIGPEVISIAKNVLQQAGSLEGLEFSFQEMPVGGAALDLVGVPLPEETVSAAKESDAVLLGAIGGYKWDKNEKHLKPETGLLQLRAGLKVFANLRPATVLPQLVDASTLKREVAEGVDLMVVRELTGGIYFGVPRGIKTNENGEEVGYNTEVYAAHEIDRIARVAFETARKRRGKLCSVDKANVLDASILWRRRVTALAAEYPDVELSHMYVDNAAMQLVRDPKQFDTIVTNNIFGDILSDEASMITGSIGMLPSASLSDSGPGLFEPIHGSAPDIAGQDKANPLATILSAAMLLKYGLGEEKAAKRIEDAVLGALNKGFRTGDIYSAGTKLVGCKEMGEEVLKSVDSHVQASV

SEQ ID NO: 92327 - protein, 412 aa, Salmonella enterica subsp. enterica serovar Paratyphi A str.
MADSRPERRFTRIDRLPPYVFNITAELKMAARRRGEDIIDFSMGNPDGATPPHIVEKLCTVAQRPDTHGYSTSRGIPRLRRAISHWYQERYDVDIDPETEAIVTIGSKEGLAHLMLATLDHGDTVLVPNPSYPIHIYGAVIAGAQVRSVPLVEGVDFFNELERAIRESYPKPKMMILGFPSNPTAQCVELEFFEKVVALAKRYDVLVVHDLAYADIVYDGWKAPSIMQVPGARDVAVEFFTLSKSYNMAGWRIGFMVGNKTLVSALARIKSYHDYGTFTPLQVAAIAALEGDQQCVRDIAEQYKRRRDVLVKGLHEAGWMVEMPKASMYVWAKIPEQYAAMGSLEFAKKLLNEAKVCVSPGIGFGDYGDTHVRFALIENRDRIRQAVRGIKAMFRADGVLPSHPKPVEASTE

SEQ ID NO: 92328 - protein, 325 aa, Sinorhizobium fredii
IAGWKAINESDMVLMPDPETAHMDPFFAQSTMVIVCDILDPVSGEAYNRDPRGTAKKAEAYLKASGIGDTVFVGPEAEFFVFDDVKYKADPYNTGFKLDSSELPSNDDTDYETGNLGHRPRIKGGYFPVPPVDSCQDMRSEMLTVLAEMGVTVEKHHHEVAAAQHELGVKFDALVRNADKMQIYKYVVHQVANAYGKTATFMPKPVFGDNGSGMHVHLSIWKDGKPTFAGDEYAGLSETCLYFIGGIIKHAKALNAFTNPSTNSYKRLVPGYEAPVLLAYSARNRSASCRIPFGSNPKAKRVEVRFPDPTANPYLAFAAMLMAGL

SEQ ID NO: 92329 - protein, 149 aa, Cocos nucifera
RTLRELKLLRHMDHENVIAIRDIIPPPVREIFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDGGLVGCIF

SEQ ID NO: 92330 - protein, 148 aa, Cocos nucifera
TLRELKLLRHMDHENVVAIRDIIPPPVREIFNDVYIAYELMDTDLHQIIRSNQALSEEHCQYFLYQILRGLKYIHPANVLHRDLKPSNLLLNANCDLKICDFGLARTTSETDFMTEYVVTRWYRAPELLLNSSEYTAAIDVWSVGCNV

SEQ ID NO: 92331 - protein, 187 aa, Parvularcula bermudensis HTCC2503
MLRFIDTPRQTPEKRAAELRREDFEEVYSGFKERQAEAQASRCSQCGVPFCSSGCPLGNHIPDWLRLAAEDQLEEAWRLSESTSNMPEICGRICPQDRLCEGSCVIEQSGHGTVTIGAVEQYITDNAWSKGWIKPIAPARERPQSIGIIGAGPAGLSAADELRSLGYRITVYDRYDRAGGLMTYGIP

SEQ ID NO: 92332 - protein, 520 aa, Physcomitrella patens subsp. patens
MVKSDPDTIMEATAAAHFSGLHFDDQYPVPNYKGSNKVPFVIGVAGGTASGKTTVCDMIIQQLHDHLAVLVNQDSLSLSLFSTFADSQIPADSFYRGLTPEEMANVGEYNFDHPDALDTEQLLECLGNLKANQPVQIPVYDFKNHQRCSDRFRKVNASDVVILEGILVFHDARVRELMNMKIFVDTDADVRLARRITRDTLERGRDVNGVIDQYAKFVKPAFDDFILPTKKYADVILPRGGDNHVAIDLMVQHIRMKLGQHDLRTIYPNVFVIQSTFQIRGMHTLIRDQETNKHDFVFYADRLIRLIVENGLGHMPFTEKQVITPTGSIYVGVDFCKQLCGVSIIRSGESMENALRACCKGIKVGKILIHREGDDGKQLIYEKLPINIADGHVLLMDPILGTGNSAVQAIELLIRKGVPESHIIFLNLISAPEGIHKVCKRFPLLKIVTSEIDAGLNEEYRVVPGMGEFGDRYFGTDDDGPEQVFKAPIEPKLQQGLYTPFKRLSHVGDAQDGPFPSSIA

SEQ ID NO: 92333 - protein, 731 aa, Debaryomyces hansenii CBS767
MSNLHILLPLPPKHSYFIPNFGPKNSIPAPRDSNNSNTVGTNPNNQSNNQNNNNNQSNMSKAAQKPGGFPLNFNQPSYTAQNTLGQFSPNIFTTRRVWVKKSQGTPTTIIVHQNDIIDDLKQAVVNKFPNSLAREIDPADLVIKMDLLARQTVNVTSNTQNLSTNKKTTYPTNPASLTSPDNLKNIKSPIASISSGTQTQLQTNPYSYINLEPDQNVWNILDTYYPHSMGMQEAFIAEAPYAEPLSNRSSFNAGYQNNISHRQQHTQVSQQQMRNTSQILNTSQSYHQPKPQYMHQSNPIAQNLNTIHDKSVSPASAANGRQSPLSYGINVHRRSQSNPLQSPTSSSTNVTSQNNNENSQPVLLLPKNFSLATNGNNSQSSNPFQNKKRLSLDENFVQKNRQEPTDKSPADSSNNLTNIGMGIHSESHSVPETFGLASKNTDFNGVRKLEGRSSTDPESLNQGSDISNQVTKDTDRLSISPSPSIDESTSNKQNNLSLDQILSGETHNSQVPKTSKSIGAPEPFKPSDYMAKAKNSNPVLAKGAKSSKLTTDTVLPSISVLVVEDNAINQAILGAFLRKYKIPYQIAKNGQEAVDKWRTGGFHLVLMDIQLPVKSGIEATKEIRHLEKINKIGVFAQHELSASTYPNSEKFELKEDEKLDLTVFRSPVIIVALTASSNSSVDRKNALRAGCNDYLTKPVNLVWLQNKITEWGCMQTLIDFDGWKAKRSVNR

SEQ ID NO: 92334 - protein, 1535 aa, Gibberella zeae PH-1
MDAATQHQVKTPEEAVARIAYLSSDVIVSVQPAIGTDSEFSSHLNRYAGRKDSSLVAQSADTVPEIIPVRHNTDPLLSVYTPTRAGKLVSVTTTSTILLPSVSHLYKLANYPVVLHVSLQPRTFPDYSVITAIRNSGFTFVQSETLQEAQDLALTAHALAIRTGKGVIHFFAPSTSANDKPIGVEDASVVRDVLDIESVRRYQAGSAPSSQTGIYADDGHIAVSSDHDAPATTGAASGNLTVPPSANASKAPSAGTSVKSSQDSESSTPVAPSSVATTVESAPPQVTSEDIYKSAGRIWAHLKTAVGREYSAFEYSGPPNAENCLFIFGSDAGAFAQAIDEANTQEIFANTAILTPRLYRPWLGSRLVEAIPRSVKRIAVLEQIHRKTTKWGPLLIDVLTSVKSGPGGVEAIVGHQLGYIAPEVVVQALRGVLQNLTAEKPIQNLEVGKKEAWKEPTGYDLKAPQLETAYTKILDQLFGQRAYVANAIKSSTTGISPTVSASPEFGFGSLLARKQRRGQFVSQVKDAATNGSFTTEAPKSWLARWAMNADDASKSTEIADDVIARLETDGSPLAAQLLTAKGLFRKESLWLTGSDAWSYDLGNSGVHHVLASGENVNMLIIDSTPYSERAAADANRRKKDIGLYAMNFGNVYVASTAVYSSYTQVLQALLEADKFEGPSVVLAYLPYFGETDSPLTVLQETKKAVDTGYWPLYRWNPENEKKGEPNFSLDSELIKQELKTFLARDNQLTQLASKEPKFAAALVKDFGSEVRAQQKRKAKDAYNQLLEGLLGAPLTVLYASDNGNSTTLAKRLASRGRARGLKTTVLAMEDYPLEDLPTEENIVFITSTAGQGEFPQNGLPFWDAIKDNTDLDLAAVNYSIFGLGDSHYWPRKEDKIYYNKPAKDLDRVLTNLGGKHLIDIGLGDDQDPDSFQTGYKEWEPKLWAALGVDKVDGLPDEPPPITNEDIKVASNYLRGTIVEGLNDTSTLAISAADQQLTKFHGTYMQDDRDIRDERKAQGLEPAYSFMIRCRLPGGISTPQQWVQMDDIANELGNETMKLTTRQTFQFHGVVKSKLKPAMQAINRALMTTIAACGDVNRNVMCSSLPTQSKYHREVFACSQLISDHLLPSTSAYHEIWLTDDDNKKTQVAGDAVQDFEPLYGPTYLPRKFKITIAIPPHNDTDVYAHDIGLIAIKGEDGKLAGFNVLAGGGMGATHNNKKTYPQTGRMFGFCKTEDVHIVCEKIMLVQRDNGDRKNRKHARLKYTIDDMTVPVFRSKVEELWGKKFENERPFEFKSNVDTFGWQKDEHGLNHFTFFIENGRIEDTPEFQMKTGLREIAKSLKGESEFRLTGNQHLILSNVADEHLDDVKELMKKYKLDNVQFSALRLSSSACVAFPTCGLAMAESERYLPVLISKLEGCLEENGLRQDSIVMRMTGCPNGCARPWLAEVAFVGKAYGAYNMYLGGGYHGQRLNKLYRQSIKEDEILDIMKPLLKRYALERNEGERFGDFCVRSGVIVATTDGQNFHDNVADEEEDDE

SEQ ID NO: 92335 - protein, 180 aa, Oceanobacter sp. RED65
MSAYENEIKQAVRTIENWPDEGVMFRDIMPLLQDAHIFRKLIDSFVHRYQKETVDAVAAIDARGFILGAPLAYELGVPLVPVRKKGKLPYETVSQSYKLEYGEAEIELHTDALKAGDNVVVMDDLIATGGTMLAACELIKKLDANVLEVAAIIDLPDLKGSERLRDAGFNIYSICQFDGL

SEQ ID NO: 92336 - protein, 452 aa, Zea mays
  misc_feature (139)..(139): Xaa can be any naturally occurring amino acid
  misc_feature (165)..(165): Xaa can be any naturally occurring amino acid
  misc_feature (169)..(169): Xaa can be any naturally occurring amino acid
  misc_feature (195)..(195): Xaa can be any naturally occurring amino acid
  misc_feature (257)..(257): Xaa can be any naturally occurring amino acid
SCEANFFVKSLDWLIYDMRGINILLLVQKIVHGPEICTGFLKDGKPVKSTREQEITITTDYSIKGDENMISMSYNKIVVHLKPRSTILCADGTITFTVLSCNHVQGLVRCRCENSALLGERKNVNLPGVVVDLPTFTEXDKVDILQWGVPNNIDMIVLSFVRKGXRSLXVRSVFGEHAKSILLMSKVENQEGVAXFYEILANSYAFMVARGDLGMEIPIEKIFYAQKVMIFKCNVQGKPVATTQMLESMIKCPHPTXDVANDVLDGTNCVMLSGETATRAYPELVVQTMSRTCLQAESHTYYGIVFKLISNTAPMPMSPLESLASSAVRTTNISNASLILVLIRGSTTARLMAKYKPTIPVITAMVPELKTDDNFNWTCSDERPARHNMIVRGMILMLLAATAKAFDTESTDEAISFAIDYAKKLKICKSGDSVVTLHRIGASCVIKILTIN

SEQ ID NO: 92337 - protein, 323 aa, Nicotiana plumbaginifolia
GEKNGIAKDVTELIGNTPLVYLNNVVDGCVARVAAKLESMEPCSSVKDRIGYSMITDAEEKGLIKPGESVLIEPTSGNTGVGLAFMAAAKGYKLIITMPSSMSLERRIILRAFGAELVLTDPAKGMKGSIQKAEEIKAKTPNSFILQQFENPANPKVHYETTGPEIWKGSNGKVDALVSGIGTGGTITGSGKYLREQNPDIKLYGVEPVESAILSGGKPGPHKIQGIGAGFIPGVLEVGLIDEVIQVSSEEAIETAKLLALKEGLLVGISSGASAAAAIKLAKRPENAGKLIVVVFPSFGERYLSSVLFESVRREAENMTVEP

SEQ ID NO: 92338 - protein, 314 aa, Physcomitrella patens subsp. patens
MVSLHLPKPLSIADLTLPPRGGSDVRVAYQGVPGAYSEAAAAKAYPRCEAVPCEQFEAAFSAVELWLADRAVLPIENSLGGSIHRNYDLLLRHRLHIVGEVQLTVHHCLMAVPGVKKKELQRVVSHPQALAQCEQTLTKLGVAREAVDDTAGAAQFIAAHNLRDTGAVASARAAEIYGLEILMDGIQDDLDNVTRFLMLAREPIIPSLDRKFKTSIVFTLQEGPGVLFKALSAFALRDINLTKIESRPQRKRPLRVVDDSNNGTAKYFDYLFYIDFEASMADVRAQNALSNLQEFATFLRVLGSYPMAMSLMRA

SEQ ID NO: 92339 - protein, 482 aa, Mycobacterium avium 104
MMIDGKLVDGQAGTFTNINPATEEPLGEVADASKEDMHRAIDAARRAFDETDWSTNRELRKRCLLQLHEAIESEKEELREELILEVGSPRAITFGPQLDAPLEDGLKYPARLIDEYAWETDLGDKVISLTGTLTTRKVWREPVGVVGAIVPWNFPFEVTLNKLGQALGTGNTVVLKPAPNTPFNATRLGRLIAEKTDIPAGVVNVVTASDHFVGEELTLSPKVDLISFTGSTVVGQRIMEKGAATMKRLFLELGGKSATIVLEDADFGMACAIGIAPCMHAGQGCANPTRMLLPRSRYDEGVAILKGIYENVTCGDPQDPGTLCGPVISQVQRDRVMGYIRKGVEEGATALVGGPDAPTGFDKGYYVRPTLFTDVDNSMTIAQEEIFGPVLCVIPFDDEEDAIRIANDSRYGLAGNVMSGSLERSLSVARRIRAGFMGVNGGAPYGADTPFGGYKYSGVGRQNGVAGFDQYTEIKSVAYPAG

SEQ ID NO: 92340 - protein, 392 aa, Prochlorococcus marinus str. MIT 9211
MKAMILAAGKGTRVQPITHVIPKPMIPILQKPVMEFLLELLKEHGFTEVMVNVSHLAEEIENYFRDGQRFGVEIAYSFEGRIEDGELIGDALGSAGGLKKIQDFQEFFDDTFVVLCGDALIDLDLTQAVRRHKEKGALATLITKRVPKEQVSSYGVVVTDENDRVKAFQEKPSLDNALSETINTGIYLFEPEIFKHIPSNKPFDIGSDLFPKLVEMEAPFYALPMDFEWVDIGKVPDYWRAIRSVLLGDVRQVDIPGKEVRPGVFTGLNVAANWDKIKVDGPIYVGGMTRIEDGVTIIGPSMIGPSCCICEGATIDNSIIFDYSRIGSGVQLVEKLVFGRYCVDKNGDHFDLQEAALDWLITDARRQDLGEPSPQQKAMAELLGTDLIGSIS

SEQ ID NO: 92341 - protein, 220 aa, Zea mays
MPVSRIAVGAPGELSHPDTAKAAVAEFISMLIFVFAGSGSGMAFSKLTDGGATTPAGLIAASLAHALALFVAVSVAPGLRRRPVFFLKIATGGAAIGAFSLSAGVGAMNAVVLEMVMTFGLVYTVYATAVDPKKGDLGVIAPIAIGFIVGANILAGGAFDGASMNPAVSFGPAVVTGVWENHWVYWVGPLAGAAIAALVYDIIFIGQRPHQQLPTTAADY

SEQ ID NO: 92342 - protein, 437 aa, Xanthomonas oryzae pv. oryzae KACC10331
MIGGGIFVITGQAAADHAGPAIMLSFVLAAVCCAFCAMAYAEFAAMVPVSGSAYTYTYATFGELAAWFIGWMLVLEYGVSASAVAVSWTGYFLSLLDHFGIHLPAAFVSAPLDGKLQPTGAIANLPAAGIVLLLTWLCYVGIRKSSAMNMAMVILKTGLILLVIAVGWKYVDTANWHPFIPANEGPGKYGMEGVLRGAAMVFFAYIGFEAVSVAAQESHRPQRDLPIGMILSLVICTVLYISMAAVMTGLLPYTLLGTDEPVVTAIAAHPQLAWLRVIVEVGALIGLSSVVLVMIIGQPRIFMIIARDGLLPSIFTRIHPKYRTPHINTVITGVGIALLAAVFPLDVLGELTSMGTLIAFAAVCAGVLILRRTHPELPRPFRMPAAWLICTAGMLSCLALLSAMTLHNWMLMGLWTLVGLVIYSGYGYRHSRLRDGR

SEQ ID NO: 92343 - protein, 238 aa, Zea mays
  misc_feature (80)..(80): Xaa can be any naturally occurring amino acid
MESLEALVAHIQGLSGSPEELAHLHSLLKQADGEPLRAHAAALVPFLAHLSPETHSLGYIYLLDACAASASNLCDFGGGXVTIAGFLTACSADQIRLAPDKFLHVCKVLKDQVMQLNMPIRGIAPLRAAVRKIQSSPEQLTPVHADYLLLCLLAKQYKAGLSVLEDDIFEVDQPKDLFLYCYYGGMIYIGLKKFPKALELLHNAVTAPMSTLNAIAVEAYKKYKVLRWWSILTRLSRG

SEQ ID NO: 92344 - protein, 512 aa, Xanthomonas oryzae pv. oryzae KACC10331
MRRTTFVRASARLCFATYGMYRMLKSVLRVKPIEPAGLVDAGEPVEGSPQGEATLQRTLSAKHLIMLGIGAVIGAGIFVMTGQAAANHAGPAVMLSFVFAGIACTFAGLCYAEFAAMMPVSGSAYSYSYATLGEGIAWFIGWCLVLEYLFAGSSVAVAWSAYLISFITGTLGLPFPTELTNAPLAWINGEFVASGSILNLPAVMIVTAVSGLCYVGITQSAFINAIVVAIKIAVICLFVGFGAAYVDPANWHPFIPENTAPGVYGWSGVFRAASIVFFAYIGFDAVSTSAGETKDPQRNMPIGILGSLAVCTIIYIIICAVLTGLMPYTQLGTAKPVATALEAHPQLTWLKTAVEIGAIAGLSSVVLVMLMAQPRIFYTMAKDGLMPKLFGKVHPRFHTPYVGTVIVGVIAASLAGLIPLSVLGELVSMGTLLAFATVCAGVMVLRFTKPALERPFRVPLAMIICPLGTLACLALFFQAFQEHWKVFVGWTVIGLLIYFGYGIHHSYLAKRA

SEQ ID NO: 92345 - protein, 174 aa, Prochlorococcus marinus str. MIT 9215
MKHTLSVLVEDESGALSRISGLFARRGFNIDSLAVGPAESKGISRLTMVVEGDDETLQQMTKQLNKLFNVLGVVDFTNLAAVERELMLLKVSSKEDTRSNILDIVQIFRAKVVDVSDIALTLEVVGDPGKLVALEKLLEPYGILEIARTGKVALKRSSGVNTEMLKINKYSLEI

SEQ ID NO: 92346 - protein, 333 aa, Alkalilimnicola ehrlichei MLHE-1
MDQSRMTLGRFLAQQCPQDEKGKALALLLRQVGDSCRRIADAVAGGALREMTGAADNVNVQGEEQKKLDVFANDVLIEGCNWGGTVAGMASEEEDDIYTLPEGEPRGPWLLLFDPLDGSSNIDVNVSVGTIFSVLPAPDTGRDPVNEDLLQPGHRQVAAGYAVYGPSTVLVLTLGDGVYAFTLDRGQGEWFLTSSKMKVPEQTAEFAINCSYQRIWPAPIKRYIEECLDGEEGPRGKRFNMRWIASMVADLHRIFTRGGVFLYPADEKRPNGRLRVLYEINPMSMLMEQAGGEAFTGKERALDLQPEALHQRSGLMLGSREEVEVLRRYYAEQ

SEQ ID NO: 92347 - protein, 715 aa, Salmonella enterica subsp. enterica serovar Paratyphi A str.
MTTTSAFMLNVRLDNVAVVAIDVPGEKVNTLKAEFAAQVRAILKQIRENKALQGVVFISAKADNFIAGADINIIGHCQNAQEAETLARQGQQLMAEIQALPVPVIAAIHGACLGGGLEMALACHRRICTDDVKTVLGLPEVQLGLLPGSGGTQRLPRLVGVSTALDMILIGKQLRARQALKAGLVDDVVPQTILLEAAVELAKKERLAQRTLPVRERILAGPLGRALLFRLVRKKTAQKTQGNYPATERIIDVIETGLAQGSSSGYDAEARAFGELAMTPQSQALRAVFFASTEVKKDPGSDAPPGPLNSVGILGGGLMGGGIAWVTACKGGLPVRIKDINTQGINHALKYSWDLLETKVRRRHIKASERDKQLALISGSTDYRGFSHRDLVIEAVFEDLPLKQQMVAEVEQNCATHTIFASNTSSLPIGDIAANAARPEQVIGLHFFSPVEKMPLVEVIPHASTSAQTIATTVKLAKKQGKTPIVVSDKAGFYVNRILAPYINEAIRMLTEGERVEHIDAALVKFGFPVGPIQLLDEVGIDTGTKIIPVLEAAYGERFSAPANVVASILNDDRKGRKNGRGFYLYGEKGRKSKKQVDPAIYKLIGVQGQSRLSAQQVAERCVMLMLNEAARCFDEKVIRSARDGDIGAVFGIGFPPFLGGPFRYMDALGPGEMVATLQRLAALYGPRYAPCEQLVRMAERREHFWTNGETDQGN

SEQ ID NO: 92348 - protein, 325 aa, Ensifer adhaerens
IGGWKAINESDMVLMPDPETAHMDPFFAQSTMVIICDILDPVSGESYNRDPRGTAKKAEAYLKASGIGDTVFVGPEAEFFVFDDVKYKADPYNTGFKLDSSELPSNDDTDYETGNLGHRPRVKGGYFPVPPIDSCQDMRSEMLTVLSEMGVTVEKHHHEVAAAQHELGVKFDALVRNADKMQIYKYVVHQVANAYGKTATFMPKPIFGDNGSGMHVHLSIWKDGKPTFAGDEYAGLSESCLYFIGGIIKHAKSLNAFTNPSTNSYKRLVPGYEAPVLLAYSARNRSASCRIPFGTNPKAKRVEVRFPDPTANPYLAFAAMLMAGL

SEQ ID NO: 92349 - protein, 565 aa, Chlamydomonas reinhardtii
MRLCTGRTFAGATHPLRRLAAPHLIMSTKRQKTSTPTADNVATEAVPSNADALALHARGKEHAQKLLDFINYSWTPFHAVEEASRRLVAAGFTPISEREPWSVQPGGRYFFTRNLSTIVAFAVGQQFKPGNGFFMVGAHTDSPCLKLKPVSLSNKSGYNMARPGRRAGGINVETYGGGLWYTWYDRDLGLAGRVLVREDGAAAAGAGTGAAAGAGGNGLKHRLVKLDRPLLRIPMLAIHLQRDIHTAGFKPNLQNNFAPMMATALSELSPGTSLNQSAAYSAKHSPLLLSLLAAELGVAPEAIVDFELHVCDLQPGVLGGPHQEFVFSGRLDNLAMSYVALQSLIDSCPDAASLAGETGVRAIALFDHEEVGSESAQGAGGPVMRDTITRVARALAGGEEGAVERTLRNSFLVSADMAHALHPNYSDKHDPDHQPRMHGGLVLKHNNNQRYATNAVSAALFREVARRHGLPVQEFSVRNDMPCGSTIGPILASNLGCRTVDVGIAQLSMHSIREQCGADDVAIAYDHFLAFFKEFSALDASLDVDSLPPPNISGTIADTPCNHMH

SEQ ID NO: 92350 - protein, 202 aa, Phaseolus vulgaris
EFLHFPAVVTSPATAKTYFLGGAGERGLTIEGKFIKFTAIGVYLEDKAVASLATKWKGKPSEELINTLDFYRDIISGPFEKLIRGSKILQLSGTEYSRKVMENCVAHLKSVGTYGDAEAKGIEEFAEAFKKVNFPPGASVFYRQSPDGILGLSFSEDATIPGEEAVVIENKAVSAAVLETMIGEHAVSPDLKRSLASRLLRY

SEQ ID NO: 92351 - protein, 338 aa, Triticum aestivum
MGLSSSLVPVASALLLLCCFTARNAAANGNGGGGLRLNYYSEICPRAEQIVKEQVRSLYEEHGNTAVSWLRALFHDCTVKSCDASLLLETDAATGLVSEQASPRSFGMRNFKYVGAIKSALERECPGTVSCADLLALAARDGAAMLAGPAAIPMRTGRRDAMESQYGEVERYIPNHNDTVSAVLARFAAMGLDAEAVVALLGAHSVGRVHCNNLVARLYPAGDGGIQPAYGAYLRGRCPTADAREDTRDVAYARNDRATPMVLDNMYHKNLLKGRGLLLVDQRLASDPRTAPFVKKMAADNGYFGETFAAALVRMSENGPLTGGQGEVRKDCRFVNAK

SEQ ID NO: 92352 - protein, 436 aa, Arabidopsis thaliana
MLLHFGVVPVIIVSSKEGAEEVLKTHDLETCSRPKTVGSGLFTYNFKDIGFAPYGENWREMRKIAVSELFSQKKLKSFRYIREDESQLLVRKVSKSALETPTSSVNLRKVIFTFAASIICRLSFGQNFCDFVDMETVEELVLESETNLGSLAFADFLPAGWIIDRISGQHSTVMKAFSKLTNFFELVIDDHLKSGKIEDHSDIISVMLDMINKPTEVGSYKVTDDHLKGLMSDVFLAGVNAGSITMIWTMTELSRHPRVMRKLQEEIRAALGPNKEKITEEDLEKVEYLKMVIEEAFRLHPPAPLLLPRLTMSDINIQGYSIPKNTMIQINTYTIGRDPKNWTKPDEFIPERFVDNPIEYKGQHFELLPFGAGRRVCPVMATGITIVELGLLSLLYFFDWSLPNGMTTKDIDMEEDGAFVIAKKVSLELVPTLHRW

SEQ ID NO: 92353 - protein, 318 aa, Candidatus Kuenenia stuttgartiensis
MITRFFLFNENIPFFYYMNDQISMETAIQKAGILLEALPYIKRFKDKIVIIKFGGSAMSDDKVLTNVLQDTVFMKTVGMMPILVHGGGPHISREMERRGLRPKFVDGHRITDRETLEIAKTVLVDQIGASMVKKISEMGNDAVCVWEDGYCPITAEKHYIEVKEDDGTTNQLDIGYVGKVTSIIRERFLSLCSECTIPIVPPLAKGNDGEIYNINADSVAAFLAKALGAEKLVFLSNTHGIMTRPNDETSFVSTLHEDEAHSLIDKKIINGGMLPKVFACIAAVKAGVKKAHIINGQIPHALLLEIFTDKGVGTQIIV

SEQ ID NO: 92354 - protein, 188 aa, Glycine max
MEQLKYKVVQGDDNNNKGPVVRSFFSSSSSEAGISSGSSLDSDSFEEVTSPASSSSSSAADQPATEPLSDMSSLFQQLPIKRGLSKYYEGKAQSFTSLAKVSSLEDLVKPENPYNKKLKTCSSYGGVMGETPLAGSCPSPSSMQGSQRGSCSFLIANRSSDNIMGRRPPIPPHRSTTTSSIPNQTALF

SEQ ID NO: 92355 - protein, 393 aa, Candidatus Kuenenia stuttgartiensis
MNTQEIQKIYERYVIPNYIRNPILLVKGNGVEIWDAEGKRYLDLFSGWAVSLLGHCHPATVKAIQNQAAKLQHAPNIYYTEPQGMLAKYISEKSFGGQCFFCNSGAEANEAAIKLARIHNSARGKYKIITFSDSFHGRTIATVTATAQPKYHKGFAPLVEGFSYVPFNDMEALRNAIDDKTCAIMLETIQGEGGINIATNEFLRDIRNICNEKGLLLILDEVQCGMGRTGKYFAYQHYGIEPDIMTLAKALGGGVAIGAMTAKKEVAKDLVPGSHASTFGGNPLACAAGVAVFETIEKENLLDNTKEMGEYAMEQLRLLKTQCNIIKEIRGVGLMIGIELAINGSTIIKECIQAGLFLNCTHDTVIRFMPPLNVKKEHIDEGLGILKSVLSNY

SEQ ID NO: 92356 - protein, 312 aa, Candidatus Kuenenia stuttgartiensis
MSKYFMKNKDLISIADLSRPEIEEIFQVTKELKDLHIKGVEEKCLSGRILGLIFEKSSMRTRVSLEVAIVQLGGYAIYQTQTEINLGKREAIKDVAKVLSRYLNGIAIRTFGHDTVLELAKYATIPVINALTDLYHPCQALTDVYTILEKFKTLENIKIVFIGDGNNVAKSLAQTCIKLGIDFHIASPKGYEFDADFISELKHMANGKNLLHLYRNPEEAAENANVIYTDTWTSMGQEAEAEIRRQAFENYQVNAALLKKCADNVKVMHCLPAHRGEEITDEVIDGKCSVVYDQAENRLHVEKAILKLLLVR

SEQ ID NO: 92357 - protein, 184 aa, Triticum aestivum
  misc_feature (23)..(23): Xaa can be any naturally occurring amino acid
QAINLHSTAVAPTVMACSATSVXPFPGVKSTAGLPVNRRSNGVSLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 92358 - protein, 285 aa, Arabidopsis thaliana
MAKDVEGPEGFQTRDYEDPPPTPFFDADELTKWSLYRAVIAEFVATLLFLYITVLTVIGYKIQSDTKAGGVDCGGVGILGIAWAFGGMIFILVYCTAGISGGHINPAVTFGLFLARKVSLIRAVLYMVAQCLGAICGVGFVKAFQSSYYDRYGGGANSLADGYNTGTGLAAEIIGTFVLVYTVFSATDPKRNARDSHVPVLAPLPIGFAVFMVHLATIPITGTGINPARSFGAAVIYNKSKPWDDHWIFWVGPFIGAAIAAFYHQFVLRASGSKSLGSFRSAANV

SEQ ID NO: 92359 - protein, 145 aa, Zea mays
MSSPSKRREMDLMKLMMSDYKVEMVNDGMQEFFVEFKGPAESIYQGGVWKVRVELPDAYPYKSPSIGFINKIYHPNVDEMSGSVCLDVINQTWSPMFDLVNVFEVFLPQLLLYPNPSDPLNGEAAALMMRDRPVYEQKGKGTVVH

SEQ ID NO: 92360 - protein, 325 aa, Ensifer adhaerens
IGGWKAINESDMVLMPDPETAHMDPFFAQSTMVIICDILDPVSGESYNRDPRGTAKKAEAYLKASGIGDTVFVGPEAEFFVFDDVKYKADPYNTGFKLDSSELPSNDDTDYETGNLGHRPRVKGGYFPVPPIDSCQDMRSEMLTVLSEMGVTVEKHHHEVAAAQHELGVKFDALVRNADKMQIYKYVVHQVANAYGKTATFMPKPIFGDNGSGMHVHLSIWKDGKPTFAGDEYAGLSETCLYFIGGIIKHAKSLNAFTNPSTNSYKRLVPGYEAPVLLAYSARNRSASCRIPFGTNPKAKRVEVRFPDPTANPYLAFAAMLMAGL

SEQ ID NO: 92361 - protein, 484 aa, Oryza sativa Japonica Group
MEKSEIFVGAHSYAAICAFTLIIGWLAHWVYRWINPPCNGRLPPGSMGFPIVGETFQFFRTSPSIDMPIYYKRRLERYGPIFKTNIGGQHVVISLDPEVNQFIFQQEGKLFQSWFPETTLNIFGKKTLTTYNRTAHKLIRSFVCKLYGPENVKKSLLPELENSMRESLASWIGKPSVEVNDGVSNMIFGLAAKHLIGLDITNSGELKKNFQEIFQVMVSIPFPIYFPGTSFYRCMQGRRNVWTTLTNVMKKRLSAPGNKFGDLVDLIVEELRSENPTIDESFAIDTLSGLLFASFAPLSCTLTTTFKFLNDNPEVFDKLKEEHEMILKKREGANSGFTWEEYKSLKFSTQVVNEINRITTVIPGGFRKALTDVQVNGYTIPSGWLVMISPMGVHLNPKLFEDPLKFDPWRWTEEKRISMQRNFMPFGGGIRMCPAAEFNKLFITLFLHIVVTEYRWKDIDGGNVKRISEVLVAQEYHIQLVPQT

SEQ ID NO: 92362 - protein, 325 aa, Ensifer adhaerens
IGGWKAINESDMVLMPDPETAHMDPFFAQSTMVIICDILDPVSGEAYNRDPRGTAKKAEAYLKASGIGDTVFVGPEAEFFVFDDVKYKADPYNTGFKLDSSELPSNDDTDYETGNLGHRPRVKGGYFPVPPIDSCQDMRSEMLTVLAEMGVTVEKHHHEVAAAQHELGVKFDALVRNADKMQIYKYVVHQVANAYGKTATFMPKPIFGDNGSGMHVHLSIWKDGKPTFAGDEYAGLSETCLYFIGGIIKHAKSLNAFTNPSTNSYKRLVPGYEAPVLLAYSARNRSASCRIPFGTNPKAKRVEVRFPDPTANPYLAFAAMLMAGL

SEQ ID NO: 92363 - protein, 398 aa, Mycobacterium avium 104
MLGIVLAGGEGKRLYPLTADRAKPAVPFGGAYRLIDFVLSNLVNARYLRICVLTQYKSHSLDRHISQNWRLSGLAGEYITPVPAQQRLGPRWYTGSADAIYQSLNLIYDEDPDYIVVFGADHVYRMDPEQMVRFHIDSGAGATVAGIRVPRSEATAFGCIDSDESGRIRKFVEKPLDPPGTPDDPETTFVSMGNYIFTTKVLIDAIRADADDDHSDHDMGGDIIPRLVDDGMAAVYDFSDNEVPGATDRDRGYWRDVGTLDAFYDAHMDLVSVHPVFNLYNKRWPIRGESENLAPAKFVNGGSAQESVVGAGSIISAASVRNSVLSSNVVVDDGAIVEGSVIMPGARVGRGAVVRHAILDKNVVVGPGEMVGVDLERDRERFAISAGGVVAVGKGVWI

SEQ ID NO: 92364 - protein, 419 aa, Xanthomonas oryzae pv. oryzae KACC10331
MAGAAMGQGTLFCSVRAQPPGGFAYTRVPPFLVRTGTMPLTTKLPKVGTTIFTVMSQLAAEHGAVNLGQGFPDFAVPQRLVDELTKAMAAGHNQYPPMPGVATLRQAIAGKAQRCYGAQVDADTEITVTSGATEAIFNAIHAVVRASEDVIVLDPAYDCYEPAIDLAGARAVHVALDPQTFAVDWDALRAAITPKTRLLMINSPHNPSGAVLSADDMQTLTELLRGTEIFLLSDEVYEHIAFDGRRHESVLRWPELRERAFVISSFGKTYHCTGWKIGYAIAPPALTAEFRKVHQYNTFTSFGPAQHAFAAMIRDEPEHDEQLGAFYQAKRDRFREQLLTTRLKPLPVPGGYFQLVDYSAISDLPDTAFVKWLTVEKGVAAIPLSPFYERAPAGQRLARLCFAKNDATLDAAIERLQKL

SEQ ID NO: 92365 - protein, 478 aa, Glycine max
MFASVADGAFEGSGVSGPFLIPQRFVWPYGGTTVFLTGSFTRWSNHIAMSPMEGCPAVFQVVCNLMPGFHQYKFNVDGEWRHDEQQPFVNGSCGVVNTIYIVREPDILPSILNTETPGRSHMEVDNMEANPRMTVSDLEVSRHRISVFLSTHTSYDLLPESGKVIALDINLPVKQAFHVLYEQGISMAPLWDFCRSQFVGVLSAMDFILILKELGNHSSNLTQEQLETHTIAAWKEGKFQQFRTLDSNGGSYPWRFVHAGPHECLKDVALKVLQNKVSTVPIIHSSSEDGSYPQLLHLASLSGILKGICRHFKHSLSSLPILQLPVASIPLGTWMPRVGEPNGRPLAMLMPSASLGAALSMFVQAEVSSIPIVDANDSLLDIYSRSDITALAKDKAYARISLDEISIHQALLLGQDATSPYGLYNGHRCHMCLRSDSLYKVMERLANPGVRRLVAVEAGSKRVEGIISLSDVFRFLLG

SEQ ID NO: 92366 - protein, 471 aa, Desulfitobacterium hafniense Y51
MWKGGAIIMALKVPRHEMPCQDPKERAHNFNEVALGYASETAIEEAQRCLQCKKPKCVEGCPVNISIPEFIQKITEEDFEGAAAVIKQSSSLPAVCGRVCPQESQCEAKCILGIKGESVAIGRLERFVADYEISKGCKIPEVAPPSGKKVAIIGAGPAGLACAGDLAKAGHKVTIFEALHVAGGVLMYGIPEFRLPKDIVQNEICNLEPMGVEILVNQVVGKVTSVHELMQNGYDAVFIGTGAGLPNFLGIPGENLNGVYSANEFLTRTNLMKGYRFPEYKTPVKIGKKVAVFGAGNVAMDAARTALRLGAEEVSIVYRRSRAEMPARHEELEHAEEEGVKFQLLTNPVAIQGDEKGAVKSLTCLRYELGEPDASGRRKPVPIPGSEFEIEVDTVVVAIGQGPNPLVTQSTEGLELNKWGNIVVNEETLETSIPGVFAGGDIVTGAATVILAMGAGKKAAAGINAYLKNKG

SEQ ID NO: 92367 - protein, 264 aa, Legionella pneumophila str. Lens
MKKIKIYQVDAFASSIFSGNPAAVCVLDEWLSEEQMQFIASENNLSETAFVVPNQGNFDIRWFTPATEVDLCGHATLASAYILFEKLGYKSSEIIFQSKSGMLRVTGQNQQLQLDFPALPYHRITPTRVLLDALKIKPQEVYESTFDLLCVYPHESDVAEAVPDLLALSQLPYRGIIITSLCGDGSVYSRCFYPACNVPEDPVTGSAHCVIAPFWCARLNQPLIRARQGLKRQGELLCELNGNRVLLTGTCHLYLEGNIYIPEI

SEQ ID NO: 92368 - protein, 415 aa, Candida boidinii
MSLSSKLSVKDLDCTGKRVFIRVDFNVPLDGDKITNNQRIVAALPTIKYVLEQKPKAIILASHLGRPNGEVNPKFSLKPVAAELESLLGEKVEFLKDCVGPEVESAVNSAAPGSVILLENLRFHIEEEGSAKKDGVKVKADKADVEKFRKQLTSLADVYVNDAFGTAHRAHSSMVGFELPQRAAGFLMAKELEYFAKALENPVRPFLAILGGAKVSDKIQLIDNLLDKVDILIIGGGMAFTFNKIAQNMEIGKSLFDEAGAATVPDLLAKAKKNNVKIVLPVDFVTADKFDAAANTGYATVEQGIPAEWQGLDCGEKSIKLFTETIGEAKTIVWNGPPGVFEFEKFAKGTHAMLDACVKSCAAGNTVIIGGGDTATVAKKFGGADKLSHVSTGGGASLELLEGKELPGVVFLSNK

SEQ ID NO: 92369 - protein, 95 aa, Oryza sativa Japonica Group
MESIKTQSQGSASSVPKNPAMSSCRKKKSDDATFLEDLKDHIDEFIHASMDEHKHCFKNTIQKMFGMSKVVAERSAEAKEAEVESALPLQTSVSQ

SEQ ID NO: 92370 - protein, 415 aa, Debaryomyces hansenii CBS767
MSLEAEVPELGQDDSQRELTIKEEYQLWRKNCRYMYEFVSETALTWPSLTIQWLPENKTNEAEGLIDAKLLLGTHTSGEDTNYLKLASTQIPLSNSSNTEEKSNKKVTSRIKITKKFENNFEINRARYMPQDPSIVSTINGAGEIDLYNLGGDQKTAIAHFTPHEDNGYGLSWSPHKKGYLLTASDDKTVVLTDTSRLDATDLSQVCKFTTHKDIVNDAKWHQFDESLFGSVSDDKYFYLFDIRTPGEPVSKFYHPESEGINSLSFSPFSQYLVATGNANSNISLLDTRKLSTKSAVSDGLLHTMMGHSDSITSLEFSPHKDGMLASGSQDRRLILWDLFKVGEEQAQEDAEDGCPELFMMHAGHTGAVTDLSWCPYKDWTIGSVADDNIVHLWEIGKTLLNAEKGIELKDTDLE

SEQ ID NO: 92371 - protein, 498 aa, Oceanobacter sp. RED65
MSGGRRIDDGLSGDNMSYLEHSVEKIGGTSMSDYASVRDNIIKQPDNASGDLYQRIFVVSAYGGITDKLLEHKKSGQPGIYALFSDAIEEDSWVEAFENLEKQLLDINHELYGDTDLLEKANAFLYERLKSAKDCLLDLQSLCKHGHFSLDEHLDTVREMLASIGEAHSAYNTATLLKRDGVNARFVDLTAWQSTEHVSLDERIKEAFSDIDLSKELPITTGYAHSEDGLMRTFDRGYSEMTFSRIAVLTNAREAVIHKEFHLSSADPRLVGEENAVPIGRTNYDVADQLANLGMEAIHPKAAKGMRQQAIPLRVKNTFEPDHAGTLIDTDYVSDKPCVEIIAGCKGVYAIELFDQDMAGNLGTYDEKYLAVLKRFKVNIISKDVNANTITHYVSTNLKTVKRICQALAEISTDAEVSQRKVAIVSAIGSDMHVPGILAKTVRALADSNISVLALHQSMRQVDMQFIVSDQDYDQAIKSLHACLVEVHDHGDAICVAS

SEQ ID NO: 92372 - protein, 318 aa, Musa ABB Group
MDSFPVIDMEKLSGGERGAAMEILRDACEKWGFFEILNHGISHDLMDEVEKVNKEQYNKYREQKFNEFANKALENADSEIDHLDWESTFFLRHLPVSNISEIPDLDDQYRKALKEFAAAIEKLAERLLDLLGENLGLEKGYLKKAFSNGSKGPTFGTKVSSYPPCPRPDLVKGLRAHTDAGGIILLFQDDQVSGLQFLKDGEWLDVPPVRHAIVVNLGDQLEVITNGKYKSVVHRVVAQTDGNRMSIASFYNPGSDAVIFPAPALVEKEAEEKKEVYPRFVFEDYMKLYVGHKFQAKEPRFEAMKAMEAVATHPIATS

SEQ ID NO: 92373 - protein, 865 aa, Debaryomyces hansenii CBS767
MHRPDNSSSRTHVSPSRSNTRSDPNMRRATSQSPSIRHISQRKVNTLERKPLLDRANSDMVDYQAAGNIPPSRSLLLSDIYRDDVESIVYNNAASDASCNEGHKRSSLTHAVTNEDMQSTRSEYLMGMNLNRENLSWKVVLPYYLPFLSWIHHYCPSFFVGDLVAGLSLVFFQLPLSLSYATSLAHVPVICGLYSLAISPLVYMVFGSVPQMIVGPEAAILLIVGQAVEPLLHHYKKKHSEKLDPVELVVAITFISGASLLGFGLGRFGFLDNVLSASLLKGFISGVGIVMAINSTIVMLGLTELLQEITEDPTKMDIHSPFDKMRFLFQHYKQFHILTFKISIIAFIVILLCRVFKNFMSKKNSNLLKKCVYLPEILFVVIVSTSLCAVNRWDEKGIEIIGKVTDISSSQILHNPVAVERWYLIKKLSTPGFLCAMLGFFESTTALKSLGSRYDLPISSNRELVALGAMNILVSIFGGLPAFGGYGRSKINAISAKTTMLGAIMGLCTIFTISYLLDALYYVPKCILSAITAVIGILLIDEAPHELWFHWKSKGYNELITFFITVMTTLFFSMEAGIAVGLVYLLIRVIKHSALSRIQILGRISGSDTFVNADVSHIPPNIGLLSDDVKHSHLPLNMFTDNNFTHLNLKVIEEIEGCLIVKIPEPLTFTNTSDLRGRLKRVEMYGSTKAHPAQRRTRDVTMTKYVIFDLNGMTGLDSSAAQILKELIKRYTNRNIYSFFVRVNDEEKLRYRLENTGITKLLAEVLESIKNNDDQNTFMFNKIKDNRKVSGLQRENSDILHPDMDEHMDIYNLTENSHTPYFEHISDVLKVIDYYEINDQLQSRNEFLDVDQAERRSSLPSVDIA

SEQ ID NO: 92374 - protein, 789 aa, Yarrowia lipolytica CLIB122
MEVDDPRQGQGHDQGLSGIKTKKSTITTTTTTQHIRSHSSHPQQEAPLYVPKVSLNPSTSLPLLACRLMPQPKCSEVTRNTPRPRNIETYALDVQEVLVMEDLLNVLMGHEGVYINYSDSYNPRLELDRLKGPDYRTARGLDPSFKDFTRACIKIASTYVSLSAFVDKMTRDRRGLVNGALAASIRKLLKEYVKLAQGLEYSLRFESGLTLHKFHLKLMTIGGILHETHELAKDILREDEVRFHNATLEPSNDLDALLAKFRENSVEIDTRGYGISLNGSSMCRGGITLKVIAERLNAHSGDPTANQLLTRLLNDASKPYLQMLSRWIYQGVILDPYGEFCIQENGDLATGNEGAYDEYWEQRYSVRKDELPLLLSQSNLLEKVLLAGKYLNIVRECGGGDTSKDAAVNWESIQDPALVPSIASASDESNRALLSLLLSSHNLFDRLASLKHYFFLDRADYYINFQDIAWTELARPASQSSVTKLQYLLDLCLRQPGSITSTDQYKDDVVASLAPTTVWDYLLQIVCATDPNESGWESDSRKMSMDDMPVSCAFQLDFKVPFPLSLVISRRALIRYQILFRHLAELKNLERLLSIVWLEMAKSRHWRYPTSDERLHKWKAFSNILRIKMVEFVKQLLYHCTAEVIEPNWKRLQEKFKSASNVDELIADHITFLDTCLKECMLTNEKLIRVQQKIFGYIRFFVNTIQARSHFLEIVDPSHLSDFERSRLQPVYDRNGATIPNDTLVERMNRLVKTTDTNFSHSCKVFKDALEFFAATESTSLLALSARLS

SEQ ID NO: 92375 - protein, 387 aa, Glycine max
MVAKDTVAKKGKDASSKKAKKVEEVEEVEETVTPSKNEKKQKKEENGSAKKEKKDKKSKKAESDSEEEKPKEKEKKDKKAKKEEPKEEPKSESESEEEKDDSKRKRDDDADADADMEEEASSPKVAKVDDSELPPVVYVSRLPYEIKEETLRELFTDVGEIKSLEWINDENDTFCGGAVVTFEDLAAAQKAAEKNGQEVDGRQCAVELHKRVPSGCTTLFVGGLSRDRLDEDNFKEFLKTNGVSNFAEVRFPTAEGQYKGIAFISFESDDDCRAAYNAGLQAKGYGGRVIKIDPSESKQGGGGGRGGRGGGGGRGGFGGDRGGRGGRGGFGGGRGGRGGFGDRGGRGGRGGGFGGRGGRGGFGDRGGRGGRGGRGGGAGGKRTTFDE

SEQ ID NO: 92376 - protein, 306 aa, Moritella sp. PE36
MNKLVVLGSVNADHVLQVASFPRPGETLLGHSYAVIPGGKGANQAVAAARLGADIAFIACVGDDSFGASMITEFDLDGINTQAVMVEQDTPTGIAMIQVAATGENSICISAEANACLTPERLAPHSKLIEQADTLLMQLETPITTITQAAKIANQAGTRVVLNPAPAQPLSDELLAVVDLITPNETEAELLTGIKVTDMASAQVAANALHAKGISEVMITLGSQGVWISQAGTGKQVKGFRVDAVDTTAAGDTFNGGLLAGLQAGLVLDDAIRFAHAAAAISVTRVGAQTSIPTKAEVDEFLALQG

SEQ ID NO: 92377 - protein, 508 aa, Triticum aestivum
  misc_feature (259)..(259): Xaa can be any naturally occurring amino acid
MALTRIGLAGLAVMGQNLALNIAEKGFPISVYNRTTSKVDETVQRAKLEGNLPLYGFHDPASFVNSIQKPRVVIMLVKAGAPVDQTIATLAAHLEQGDCIVDGGNEWYENTERREKAMEERGLLYLGMGVSGGEEGARHGPSMMPGGSLEAYQYIEDILLKVSAQVPDSGPCVTYIGKGGSGNFVKMVHNGIEYGDMQLIAEAYDVLKSVGKLTNGELQQVFAEWNKGELLSFLVEITADIFSIKDDQGEGYLVDKVLXDKTGMKGTGKWTVQQAAELSVAAPTIEASLDSRFLSGLKDERVAASKIFQGDYSSGETVDKAQLIEDVRKALYASKICSYAQGMNIIKAKSTEKGWGLNLGELARIWEGAGASSGASFLDRIKKAYDRNGELANLLIDPEFAQEIMDRQAAWRRVVCLAINNGVSTPGMSASLAYFDSYRRDRLPANLVQAQRDYFGAHTYERVDMPGSFHTEWVQDCQLKDLRCCCCSVMSHESIRFRLSGILCCCQS

SEQ ID NO: 92378 - protein, 566 aa, Xanthomonas oryzae pv. oryzae KACC10331
MTKPIPTQRPTHSASAGARHMSDTPRKLSLNKLSLKRDSAPEAPKLEERLHKVLAQAGLGSRRALEQRIADGLIKVNGTVAQTGMSVRSGDKIELDGRSFVASALTEPSRVLIYNKPEGEVTTREDPEGRPTVFESLPALKGSRWIAIGRLDINTTGLLLLTTDGELANAMMHPSYEVEREYVVRVRAPEGEEKVSDAIIERLSRGVLLEDGGAKFDEIERIGGTDSHDWFRVVVKEGRNREVRRLWESQGCQVSRLKRSRYGKISLPRELLRGQSVEVAQDKVDALRAELKLEEGAPSALTLQPVIGQRRAAKSTVHVSRDGRSNAYVNGHTSGADEGRELRRFDNLREDRGRGGRGKPGDFKGGLTVSGEAAARQSQQRPFKQRGPAKGDRGALPEGNPAAFRSWYVPDGVSTGPSGHRNAGPSGPGTGQARPYAKKGPGGARPGAGGPGGARSGGPGRGGAGGGQGQSQGQGQGQRKHPYGHPGNAPSFPSDHANPGFSPYGAARPAGGPSGGRPGPGGHRGPASANRGPGGPGGPGGAPRGPGGRPPGGGNRRPPGGGNRGR

SEQ ID NO: 92379 - protein, 98 aa, Oryza sativa
MSQAFVQRPAPEFSATTLFPGGEFRDIKLSDFKGQWVVLLFYPMDFTFVCPTEIIQYNNALDRFKEINTTVLGVSTDSHFTHLAWVEKPRKQGGLGPD

SEQ ID NO: 92380 - protein, 573 aa, Thermoanaerobacter tengcongensis MB4
MLKGVAASPGIAIGKAFLYTKEKVTINVEKIEESKVEEEIAKFRKALEVTQEEIEKIKEKALKEFGKEKAEIFEAHLMLASDPELIEGVENMIKTELVTADNAVNKVIEQNASVMESLNDEYLKERAVDLRDVGNRIIENLLGVKSVNLSDLEEEVVVIARDLTPSDTATMKKEMVLGFATDVGGRTSHTAIMARSLEIPAVVGLGNVTSQVKAGDLVIVDGLEGIVIVNPDEKTVEDYKSKKESYEKKVEGLKQLKDLPAETPDGKKVMLAANIGTPKDVASALANGAEGVGLFRTEFLYMDRNSLPSEEEQFEAYKEVVEKMGGRPVTIRTLDIGGDKELPYLDMPKEMNPFLGYRAIRLCLDRPDIFKTQLRAILRASAYGNVQIMYPMISSVEEVRKANSILEEVKAELDREGVKYDKEIKVGIMVEIPSAAVTADILAKEVDFFSIGTNDLTQYTLAVDRMNEHVKEYYQPFHPAILRLVKMVIDAAHKEGKFAAMCGEMAGDPLAAVILLGLGLDEFSMSATSIPEIKNIIRNVEYEKAKEIAEKALNMSEAREIEKMMKDVIKDIG

SEQ ID NO: 92381 - protein, 478 aa, Oryza sativa Japonica Group
MASAAVAVAPVVSDLVDFLNASPTAFHAVDEAKRRLKAAGFSQLSEREEWAGLQPGRKYFFTRNHSTIVAFAIGAKYAAGNGFHIIGAHTDSPSLKLKPVSKVTKGGYLEVGVQTYGGGLWYTWFDRDLTVAGRVIVREKKDGAVSYAHKLVRVQEPVMRIPTLAIHLDRNISSEGLKINNQNHLVPVLATSVKNEMQKLVAENGSESSESKNTKHHPLLLQLIAKEANCKPDEICDFELQLCDTQPSTVAGAMKEFIFSGRLDNLCMSFCSLKALIESTSSEESLAHESGVRMVALFDHEEVGSDSAQGAGSPAMLDALSRITGSFNSSNSRLLEKAIQRSFLVSADMAHALHPNYMDKHEENHQPKLHGGLVIKHNANQRYATNAVTAFIFREIAERHHLPIQDFVVRNDMGCGSTIGPILASGVGIRTVDIGAPQLSMHSIREMCAVDDIKHSYEHFKAYFEEFTELDSKVKVDC

SEQ ID NO: 92382 - protein, 473 aa, Thermoanaerobacter tengcongensis MB4
MDEKVKIKEEIPEYITLEEALTLNKNQVKENYKEYINSVFVSMLSMLQFDKLFVRAKGVSVWDSEGNEYYDFLGGYGALNLGHNPDEVIEAVEKVKDMPNLLQASIGNLPGVLAHNLARVTPGNLKRSFFCNSGAEAVEGALKLAKIASGKKKIVYCENSFHGKSMGALSVTGRRKYQKYFEPLVPETVAVPFGDEKALEEALKEKDVAAFIVEPIQGEGGVIVPPEGYLRKARELCTKYEAYLIVDEIQTGFGRTGKMFACEHEEVVPDIMTLAKSLGGGVMPIGAYITTDEIWQKAYGTMEKALLHTSTFGGNTYACAAAIASIQAIIEKKLSEAAKEKGEYFLGRLKELKEKHPKLIKDVRGKGLLIGIEFNQPEGGLLDKLSGGAISKLSSEYIGSLIAAELQNKHRIITAYTLNNPNVIRLEPPLIVTKEQIDKVVDALDEILTRNSSFLGITVSGAKTVLGSLFKRQ

SEQ ID NO: 92383 - protein, 1123 aa, Arabidopsis thaliana
MSLSQNAPKSKGIKREELKKQYEDVEDEEEIGSDDDLTRGKRRKTEKEKQKLEESELVEMKKLENLIFGSLYSPVTFGKEEEEDGSALFHVDRSAVRQIPDYEDDGDDDEELSDEENGQVVAIRKGEAAWEDEEEKQINVDIASVNRLRKLRKEENEGLISGSEYIARLRAHHAKLNPGTDWARPDSQIVDGESSDDDDTQDGGVDDILRTNEDLVVKSRGNKLCAGRLEYSKLVDANAADPSNGPINSVHFHQNAQLLLTAGLDRRLRFFQIDGKRNTKIQSIFLEDCPIRKAAFLPNGSQVIVSGRRKFFYSFDLEKAKFDKIGPLVGREEKSLEYFEVSQDSNTIAFVGNEGYILLVSTKTKELIGTLKMNGSVRSLAFSEDGKHLLSSGGDGQVYVWDLRTMKCLYKGVDEGSTCGTSLCSSLNGALFASGTDRGIVNIYKKSEFVGGKRKPIKTVDNLTSKIDFMKFNHDAQILAIVSTMNKNSVKLVHVPSLTVFSNWPPPNSTMHYPRCLDFSPGSGFMAMGNAAGKVLLFPHCTAVPFVEITTRKSLRFSKLMASLQLYGVKTPGLALSSKRLEFASKGACFSVTLPSSSAVFRDVEHSCRNIGLRVSCEALRVDLLQRKEPETCDSSGTGKELTCVMKFGGSSVESAERMKEVANLILSFPDERPVIVLSAMGKTTNKLLKAGEKAVTCGVTNVESIEELSFIKELHLSVHSPNLALFSWEIKFSMFRTAHELGVETTVIEKHLEGLHQLLKGISMMKELTLRTRDYLVSFGECMSTRLFSAYLNKIGHKARQYDAFEIGFITTDDFTNADILEATYPAVSKTLVGDWSKENAVPVVTGYLGKGWRSCAITTLGRGGSDLTATTIGKALGLREIQVWKDVDGVLTCDPNIYPGAQSVPYLTFDEAAELAYFGAQVLHPLSMRPARDGDIPVRVKNSYNPTAPGTVITRSRDMSKAVLTSIVLKRNVTMLDIASTRMLGQYGFLAKVFTTFEDLGISVDVVATSEVSISLTLDPAKLWGRELIQRVNELDNLVEELEKIAVVKLLQRRSIISLIGNVQKSSLILEKVFQVFRSNGVNVQMISQGASKVNISLIVNDEEAEQCVRALHSAFFETDP

SEQ ID NO: 92384 - protein, 253 aa, Legionella pneumophila str. Lens
MLVKTPEAIEKMRVAGQLAASVLEMIEPYVIAGASTKELEQICRQYIVEDLKAIPSTLNHYGFPACICTSINHVVCHGIPSEKKLKNGDIINIDVTVQKDGYIGDTSKMFLVGNIKPFAKKLVEVTQECLYKAISIVRPGAHLGDIGNIIQTHAEQHGYSIVREFGGHGIGKSMWEDPHIMHFGKPNTGLRLQAGMTFTIEPMLNLGRKEVKTLGDGWTVVTKDHKLSAQWEHTILVTDNGHEILTLRADEHL

SEQ ID NO: 92385 - protein, 227 aa, Arabidopsis thaliana
MNLVLAPLISSHRTLQDKREMAGAEQSQRWSLKAKTVLVTGGTKGIGHAIVEEFAGFGAVIHTCARNEYELNECLSKWQKKGFQVTGSVCDASLRPEREKLMQTVSSMFGGKLDILINNLGAIRSKPTLDYTAEDFSFHISTNLESAYHLSQLAHPLLKASGCGNIIFMSSIAGVVSASVGSIYSATKGALNQLARNLACEWASDGIRANAVAPAVIATPLAEAVRY

SEQ ID NO: 92386 - protein, 302 aa, Physcomitrella patens subsp. patens
MVGSGNKKGDGLPAISSTNIFAALERRRSKSSSRRKLEREKSKGKEESGEPKQEEQAQFWSATQVSVKSWADCDDEDDYFATTAPPPDIDVAPVSESKEALSQGEETEGDEDGEGEDEVDDEVEEEAENESVAALGTDEAPLKPDVILPPVFREPERQLSKKEIKKKELAALEAVLAEFGLEPTEEKDENGSNTHADDKKEEEASSKRRKAKKEKSFKERDGDVPPTPDSERKEEETGANEVSEPVDPKEILKRMQSLKKKKAGDSDSSAAKAAAREASARAAKLAAAKKKEKSHYNQQPVR

SEQ ID NO: 92387 - protein, 334 aa, Haloarcula marismortui ATCC 43049
MGTIQIMQILVTGGAGFIGGHLAQRFAADGHDVVVLDNRDPFYDLDIKQHNVDAGQEAARNSDGSYEFIEGDVRDAELVTDLVADADYVYHQAAQAGVRPSVKNPRKYDEVNVNGTLNLLDACRDEGIERFVMASSSSVYGKPQYLPYDEQHPTTPVSPYGASKLAAERYACAYSEVYDLSTVALRYFTVYGPRMRPNMAISNFVSRCHNGEPPVIYGDGTQTRDFTYIEDVIDANMTLLHEDAADGKAVNIGSTDNIEIKTLATEIRDQIDPDLDLVYEERHDADAEHTHAATDRAEELLGYDPDHTIREGVAKFIDWYRDNRDWYEPLVRQS

SEQ ID NO: 92388 - protein, 369 aa, Candida albicans SC5314
MFRQVTKSAPVIRTTQRLFARSYIAGQFTGSKGSDGKYTVTLIEGDGIGPEISQAVKDIYAAADVPIHWEPVDVTPLLIDGKTTLPQPAVDSVNKNLVALKGPLATPVGKGHTSMNLTLRRTFNLFANVRPCKSIVGYETPYENVDTVLIRENTEGEYSGIEHTIVPGVVQSIKLITKPASEKVIRYAFEYAKSINKPHVLVVHKASIMKLSDGLFVNTAKEVAQEYPDVSLDFELLDNTSLRLTADPSQYKNVVMVMPNLYGDIMSDLSSGLIGGLGLTPSGNMGNKVSIFEAVHGSAPDIAGKGLANPTALLLSSCMMLRHMSLNSDADRIENAVLKTIASGPDNRTGDLKGTATTTRFTEEVIKNL

SEQ ID NO: 92389 - protein, 460 aa, Bacillus clausii KSM-K16
MNVLEKEKGTYTSDVHEYVQHVYETVKQRNPYENEFHQAVKEVLDSLLPVLAKRPQYIRQAILERIVEPERMISFRVPWVDDQGNVQVNRGFRVQFNSALGPYKGGLRFHPSVNTSIIKFLGFEQIFKNALTGQPIGGGKGGSDFDPKGKSDGEIMRFTQSFMSELSKYIGPDTDVPAGDIGVGAKEIGYMFGQYKKMRGRFEAGVLTGKDIAYGGSLARKEATGYGTVYFVEEMLKEKGHSFAGSTVVVSGSGNVSIYAMEKAMHLGAKVVACSDSEGYIYDKRGINLETVKRLKESEKKRISEYVNEHPQAHFFQGCSDIWSVPCDIALPCATQNEIDENTATVLVSNGVKAIGEGANMPSTLEAVNVFHEHGVLFAPAKAANAGGVSVSALEMAQNSARLSWTFEEVDAKLQDIMKTIYRDCIEAAKENDAPGNLVVGANIAGFVKVADAMIAQGVI

SEQ ID NO: 92390 - protein, 439 aa, Oryza sativa Indica Group
MAASPAAAAAAATVSSFVSPSSFSSVNFRFEAFKTKVPRNANMAKLQAGYLFPEIARRRAAHLLKFPDAKIISLGIGDTTEPIPDVITNAMAERAHALSTVDGYSGYGAEQGEKKLRAAIAATYYADLGIEETDIFVSDGAKCDISRLQVLFGSNVKIAVQDPSYPAYVDSSVIMGQTGLYQEDVQKYGNIEYMKCSPENGFFPDLSSVPRTDIIFFCSPNNPTGAAASRDQLTKLVKFAKDNGSIIVYDSAYAMYISDDSPKSIFEIPGAKEVAIETASFSKYAGFTGVRLGWTVVPKELLFSDGHPVAKDFNRIVCTCFNGASNISQAGGLGCLSPEGLKAMSDVVGFYKENTKIIVDTFTSLGFNVYGAKNAPYVWVHFPGRNSWDVFAEILEKAHVVTTPGSGFGPGGEGFVRVSAFGHRENIIEAARRLKQLYK

SEQ ID NO: 92391 - protein, 521 aa, Streptomyces sp. JP95
MTTETAAASDPTAELAQLKQEAADGPDEQATARQHAKGKLTARERIDLLLDEGSFQEIEALRRHRASGFGLENKRPYTDGVVTGWGTVHGRTVFVYAHDFRIFGGALGEAHAAKIHKIMDMALAAGAPLVSLNDGAGARIQEGVTALAGYGGIFRRNTLASGVIPQISVMLGPCAGGAAYSPALTDFIFMVRGTSQMFITGPDVVKAVTGEEITQNGLGGADVHAAVSGVAAFAHDDEAACLEDVRFLLSLLPSNNRETAPHRAPDDPADRPTDALRDLVPANPNQAYDVRAVIEEIVDDGEFFEIQPDWASNIVCALTRLDGHVTGVVANQPAAFAGVLDIHASEKAARFVQFCDAFSIPLVTLVDVPGFLPGVDQEHGGVIRHGAKLLYAYCNATVPRVQLITRKAYGGAYIVMDSRSIGADVSLAWPTNEIAVMGAEGAANVIFRREIAAADDPDAVRAQRIKQYRTELMHPYYAAERGLVDDVIDPAATRSALIGALAMLRPKYTDLPSRKHGNPPV

SEQ ID NO: 92392 - protein, 285 aa, Oryza sativa Indica Group
MACLLRDQHDQWKHRQGNPCRSVKVFRCQLPRSNAFYSSEPPKHNDSDKPLCPGAPVCHWCGTWKGDKICSSCKKARYCSEKHQTLHWRSGHKSDCLQLISSSEASSSIFPAVGKVPASKSWPEYEIAIDYEGAFDSDSCDESNSKSLVMQRPGKPDDMMQSWMDQFEADADNKCWASFQERVSRAPKQVLRYCREENAKPLWALSAGCPSNADIPSCSYCRGPLCYEFQIMPQLLYYFGVKNEPDSLDWATIVVYTCKGSCDQNVSYKEEFAWVQLYPTTTTRS

SEQ ID NO: 92393 - protein, 132 aa, Helicobacter pylori
SNIKYELDKESGALMVDRVLYGAQNYPANYGFVPNTLGSDGDPVDALILSDVAFQAGSVVKARLVGVLNMEDESGMDEKLIALPIDKIDPTHSYVKDIDDLSKHTLDKIKHFFETYKDLEPNKWVKVKGFEN

SEQ ID NO: 92394 - protein, 389 aa, Blastopirellula marina DSM 3645
MLPRKAQPLYGRHPWALHSAFDHIDTAAVDGDVVQLVGDHGRFVAYGVVNRKSRIHVRLYSWDVEQPLTDDFWKQKIATSIDARRQLGLFDENAGCRLIYSEADGLSGLIVDYFAGHIVLQVNALAMERRLDVIVAALNEQVSPKSITLRGEAGVIKAEGVTIEPRVLQGEVPTEPIFIQENGIEFELDLSTGQKTGFYLDQRENRVAAAKYFSGRRVLDMFCYTGGFALAAAKLGGASEVIGIDGSDKAIDLARRNAERNGLSNVRFESVDAFDHLKALVDAGEKFDAVILDPPKFTKTRRNINEALKAYYHINRQAVNLLNPGGILVTCSCSGNISRDDFQMTLLGVAQKSGRDIQLLEQRSASIDHPTLLTCPETQYLKCFICRVE

SEQ ID NO: 92395 - protein, 216 aa, Glycine max
MSLLLRIRHYLPKGLCRQPLHPTVVRLNASNLNVFSRHFGQPARKEEEDDVEEVEIDQKCLPADFDPATFDPNDHRGPPSERVFRLIDEIASLTVAEAGELGLILMKKMGVKEMPNVGFMKAGAGNLAGMAAKAPTAAKEEQKLEKTVFELKLESYEAASKIKIIKEVRGFTDLGLKEAKDLVEKTPSVIKKGISKEEGEQIIEKLKALGAKVVME

SEQ ID NO: 92396 - protein, 249 aa, Brassica napus
  misc_feature (234)..(234): Xaa can be any naturally occurring amino acid
EEAEEMEEKELEEKDAFAELKNMAAAASSKEVVSGNGAATEAPKKPSLVDNAVKHRGFIAYEREGVKYRDPSVRMNDWNEVTDESKPGPLLKTQSARCMDCGTPFCHQENSGCPLGNKIPEFNELVYQNRWQEALNRLLETNNFPEFTGRVCPAPCEGSCVLGIIENPVSIKSIECSIIDKAFEEGWMVPRPPLTRTGKKVAIIGSGPAGLAAADQLNKMGHSVTVYERADRMXGAMMYGVPNMKTDKI

SEQ ID NO: 92397 - protein, 132 aa, Helicobacter pylori
SNIKYELDKESGALMVDRVLYGAQNYPANYGFVPNTLGSDGDPVDALVLSDVAFQAGSVVKARLVGVLNMEDESGIDEKLLALPIDKVDPTHSYVKDIDDLSKHTLDKIKHFFETYKDLEPNKWVKVKGFEN

SEQ ID NO: 92398 - protein, 468 aa, Salmonella enterica subsp. enterica serovar Paratyphi A str.
MDTLQQPPPAEPEGGLRRNLKKRHLLMMLLGGTIGTGLFIGIAEPLSSVGPAGTLLAYLFAGTIMLATMMCLGELSCAFPHSGSFQHYALMFMPSPCWSYTIGWLYWFSWVFSLAADLTAAGFIAHQFFPAVPVYMFCLAILLILTAINLTSAKSFGECEYWLSAIKVFAIVLFICAGGVMIYSLMGHSDWHPTLKTDGMWFPHGWEQIVVCMTIVIYSFQGVELVGNAAGETESPHIILPKVILGIGLRIILFYGLAIAVLALVYPHELTPNGQSPFVWVFSHAGIPGADTLMTLVIFSAAVSAANSAIYASSRMLWSMAGDRFAPACFGKTNGGGVPVYAILITALLALVSLLTRYIPAQQFYLYLIASTGQVGCLAWITIGWCQYRFRQSVRNGTYASDLLRYRSPLFPWTARFVIITNFAIMVGTWFSEQGVVIMLVELAFMIGILLSWYLFRPTLSRLRNTVG

SEQ ID NO: 92399 - protein, 257 aa, Triticum aestivum
MASRFLSVAALLVAAAACVLANTQSPINIKSSEAVDAELPALSFKHYRSSQSSYYLANTGHGCQITLKNWLYNPKVKGGPLPRTFVLEQVHFHWGASDGVGSEHYLNGNPSSMEVHLVHWNSKYASYSEASTKADGLAVIGFFIEGIDNYRNPDFQKLVNAIPKIVAEESEKVEVNADLLAWVVPYLEASGYYTYDGSLTTSPYSENVLWIVYENPIPIGKAQIAPFRAIENHESEQLTTNFRQLQNADGVEVRYVA

SEQ ID NO: 92400 - protein, 643 aa, Oceanobacter sp. RED65
MTEYFIQAFIYLCAAVIAVPLARRLGLGSVLGYLIAGLVIGPVLGLVGSETDTIQHFAEFGVVMMLFLVGLELDPKELWGMRNRLLGLGGLQVALTTILVAIIAWLAGLNASTALSVGLIFSLSSTAIVLQTFNEKQLTKTEGAKTSFSVLLFQDIAVIPMLALLPLLASSDLMESATAAAGHGAHGYSLVDHLSGWSYGLVVLAAIGFVVVGGHYLSYPLFRFIADSGLREMFTTSALFIVIGIAALMSLVGLSPALGAFLAGVVLANSEFRPELESHIEPFKGLLLGLFFITVGAGINLNLLQQEWFAIAAMTIGIILVKGIILYGLGRIFNVYGSNLWLFTLAMAQAGEFGFVLLNFSAQNFIISNELKQLLSLPVALSMFLTPGLFIFYEKVVVPNYRQKGEQKADEIEEQHPVIIAGSGRFGQIVNRLLIANDIPTTVLDYQSAQVDLMRRINIKSYFGDASDPKLLHTAGIEEASMVVVAIDQRDQAVDMVRYIRSIRSDIRILARAFDRGHGYTLEKSGADCVISETYHSALQLGRQALVESGMHPFSALQNMQTFEELERKQKPKLYKVWRETMDDGGFTSHYRELFMELEKQINHAMDEERDDAHAKSERGWTPPPKNYEEGLLKELDDKKSAD

SEQ ID NO: 92401 - protein, 498 aa, Oryza sativa Japonica Group
MPADAAAKGMKLERYASGAGAMLLLRRAASGKVVSASSHLLFRATVLATMALVFLFTFHYPSLLSRSFTLSSGAGAGEGGAAAHASHRSLLMSSSSASASAASVYGGAAWEKEVRRSAKPRKDGGIAVLVTGAAGFVGTHCSLALRARGDGVLGLDNFNAYYDPELKRARQRLLAGRGVLVLDADINDALLLEKLFDLVPFTHVLHLAAQAGVRYAMEAPQTYVASNVAGLVTVLEVAAKHADPQPAIVWASSSSVYGLNTDAPFSEEHRTDRPASLYAATKKAGEAIAHTYNHIYGLSITGLRFFTVYGPWGRPDMAYFFFAKSIVSGEPITLFRAADGADARRDFTYIDDVVKGCLGALDTSGKSTGSSKSGKKSGPAPLRVYNLGNTSPVPVTRMVAILEKLLGKKANKRIVAMPSNGDVPFTHANVTHAAHDFGYRPTTSLDAGLRHFVDWFADYYKLKLDVPKIAAKVAGAGKPSSSSASKKKKKAAAMSASS

SEQ ID NO: 92402 - protein, 275 aa, Physcomitrella patens subsp. patens
MGAVTSSVAARFAFFPPTPPSYQVVVDEATGKLRMTDVAPRENVDVLKLQTRRNNEIVALFVRHPSASLTLLYSHGNAADLGQMHELFVELSVHLRINILGYDYSGYGASTGKPSEPNTYADIEAAYKCLEGTYGIREENIVLYGQSVGSGPTCDLATRLPSLRGVVLHSPILSGLRVMYPVKRTYWFDIYKNIDKIGQISCPVLVMHGTSDEVVDWTHGKQLHDLSKEKYEPLWLKGAGHCNLELYPEYIKHLRKFLQSLERSPDSTKKSLESA

SEQ ID NO: 92403 - protein, 335 aa, Zea mays
MEPTHLPSDGNNGHTPKKSSESALILIRHGESLWNEKNLFTGCVDVPLTPKGVEEAIEAVISSSMCINLPEKSCFAGDICIYRSQLSRIMRVNKLTSGVRYTLQGLNKQETVDRFGKEQVHEWRRSYDIPPPNGESLEKCAKRAVAYFKDQLMEYCELLDKADECEDPYMHMVYASTWAVSVYFTYQRTWKPFNSILGETYEMVSHHPPMGVAHCENEHFTYDITPKVKTKFLGNSLKIYPVGRTRVTLKKSGVVLDLVPPLTKVNNLIFGRTWVDSPGEMVMTNLTTGDKVVLYFQPCGWFGFNDESETFIVPVLPTVESYEKVKQERESAERS

SEQ ID NO: 92404 - protein, 440 aa, Synechococcus elongatus PCC 6301
MSLWGNRVDCYEVARSMVAALAAPRLNAPHWQQLENGLIIIAERLPVPAVTFDLWVKVGSAVEPDAVNGVAHFLEHMVFKGSQRLKAGEFEQQVEARGAIANAATSQDYTHFYFTCAPSDFTDLVSLQTDVVLNPLLAEAEFERERRVVLKEIRRAADNPRRRAYYRMIEAAFERLPYRRPVLGPYDTIAQLPLTDLQAFHRQWYGPNQLVAVVVGDLPEAEMIDAVRAAVADHPPVTAQRSPLLPEPAFSQPQQQIYHDADLHQARLYLTWRVPGLSQLSRTYALDAIASILASGRTSRLVAQLREQQGLVSNIVASNSTYRDQGLFAITARLPVAHLDTVRSQVLAELQSLQTEPVTPAELERIRRQVVNRFIFGNERPSDRASLYGYYATLLGSLEPAFNYVDEIHALSVDDLQAAVQTYLAPEACSTIQILPGEHG

SEQ ID NO: 92405 - protein, 179 aa, Leifsonia xyli subsp. xyli str. CTCB07
MSKHTAVATLYTNYGDIKVNLFGNHVPKTVRNFAGLATGEIEWTHPATGEKTNTPLYDGVIFHRIIPGFMIQGGDPIGQGIGGPGYQFDDEINPELDFAQPYMLAMANAGSPGGRGTNGSQFFITVGPTTWLQGKHSIFGEVADDASRKVVDKLAEVPTDAGDRPLDDVVIESVEIEQV

SEQ ID NO: 92406 - protein, 201 aa, Prochlorococcus marinus str. MIT 9211
MLLVIDNYDSFTFNLVQYLGELAESHPSARDIRVERNDALTIKEIQELGPEAIVLSPGPGDPDQSGICLEVLRNFSAQIPILGVCLGHQAIAQVFGGKIVQAKELMHGKTSQVFHNSKGVFFDLPNPLVATRYHSLIAQRETLPDCFEITAWLKDGTIMGLQHKDYPYLHGVQFHPESVLTEAGPLLLSNFIALAESRKKP

SEQ ID NO: 92407 - protein, 263 aa, Brassica oleracea
MPRLSNAAVITTNAILALIGLATLCFSVYLFIEGPSQCQRFIQNPLIVTATLIFFISSLGLIAALYDNYIIITLYLFFLFLSILLTLIFSIFIFLVTNSSAGKAFSDKGIGNVKTGDLQNWIGDHFLQGKNWEGIKRCMADSSICRFRPRDVDFDAKHLSHVKFGCCRPPVECGFEAKNATWWTVPATSTAEIKEDCKTWSNTQSQLCYSCETCKVGVYKGIRKRWRILLVFNLLLILLVVLLYSWGCCVRKNNRVPWKRRFL

SEQ ID NO: 92408 - protein, 223 aa, Fusobacterium nucleatum subsp. nucleatum ATCC 25586
MSIKTNVEEILEDIKKYSPYPEKVKLVAVTKYSSVEDIEKFLETGQNICGENKVQVIKDKIEYFKEKNKKIKWHFIGNLQKNKVKYIIDDVDLIHSVNKLSLAQEINKKAEQSSKIMDVLLEINVYGEESKQGYSLDELKCDIIELQNLKNLNIIGVMTMAPFTDDEKILRMVFSELRKIKDELNKEYFNNNLTELSMGMSNDYKIALQEGSTFIRVGTKIFK

SEQ ID NO: 92409 - protein, 511 aa, Magnaporthe grisea 70-15
MSTTDDISAGNVSTTPGSLLMSKLGIDDIIMPLISRVHGNPLIRTLILVNQSLGAYLPTALVTATSFAWVTYHLTPPDREVEAADSRNGFPVRVGRRHATVFRSIKPIRYTPSSGPHIFSFQGKYFSIDRQQRSVMDNSNTGSEAVTIREKETFIISTFGLSPEPIKQFLAHARKHHHKDHGDKTLIMRPNSLPQRRFHDRAWREVAKRPVRPISTVVLDQEQKTAVLSDMNEYLQPKTECWYSNRGIPLRRGYLFHGPPGTGKTSLSFALAGVFGLEIYVISLIEPQLSDEDLSTLFNGLPRRCIVLLEDIDTAGMSRAEGEIRTETKTEGPSEWKVADLARALKVGRGHGDDQKGISMSGLLNVIDGVAAHEGRIFIMTTNKPEILDEALIRSGRVDLQVAFRNATQQQASELFQRLYSTEKSVKSSRCLSPLDATDKKDDLETSITDADELIEMAAEFGSKIVPDQMSPAEIQGFLLKRKTCPRKALRDVEAWVKTSLDHKASKTTSG

SEQ ID NO: 92410 - protein, 132 aa, Helicobacter pylori
SNIKYELDKESGALMVDRVLYGAQNYPANYGFVPNTLGSDGDPVDALVLSDVAFQAGSVVKARLVGVLNMEDESGMDEKLLALPIDKMDPTHSYVKDIDDLSKHTLDKIKHFFETYKDLEPNKWVKVKGFEN

SEQ ID NO: 92411 - protein, 210 aa, Prochlorococcus marinus str. MIT 9303
MTQPNTQTTPNDVPAAAEGQHQEQQQQQRRGGGRERRGGGRRGDRRGQERDSEWQERVVQIRRVSKTVKGGKKMSFRAIVVVGNERGQVGVGVGKAGDVIGAVRKGVADGKKHLVKVPLTRHNSIPTLSNGREGAANVLIRPAAPGTGVIAGGSIRTVLELAGIKNVLAKRLGSKTPLNNARAAMVALASLRTHKETAKERGISLEQIYS

SEQ ID NO: 92412 - protein, 921 aa, Oryza sativa
MSVLNPPPKRRAISAIRKFPRDCGRAASTLAESGASMEELPLEATPISVATGGASMEDSLARTPISVQGASLVCGLDHSSEAIDGKTIEDDESSKVENRIQEFQVATNVAEDDFEGAKNGSTHPNDSIAKPSPSHGFVERVNGKGSQQEKKLVARSAGDGKMVSKYEERLQKGTPETRMRDLVDVKAKKKILKSDKMNGALQNDARSSGDGKMKTKASSTQRGVVRSDMSLKQGDIARKVDATGKCKGGVNSLIKEATSGKHATTNGIEENDDRDLVSDRIIVQALMAPDKCPWTRRRKSIGGSSESRTPKLKKKFGRPRKELKDTTPREEVSPEVASCKAIKHEAIEDKEDSYFEDEGNSKASYSDVEGNSKELVRGGKALVVCGGKKELCVTLPPSAPFGTDPRSKIRNLLIKFHAACRKLVQVEEQHKGNIGRIDIEAGKALKQNGFIKPGPIVGNVAGVEVGDEFNFRIELSFVGLHRPYQGGIDSTKVNGILVAISPRAAGIGTRELSSSDELIYTGSGGKAIGNKAAGDQKLERGNLALKNSIETKTPVRVIHGFKGHSKGEASHSKSKQISTYIYDGLYMVVDYWKEGPEGSMVYKYKLQRIPGQPELALHIIKATRKSKVREGVCVPDISQGRERIPIPAINTIDDTQPTAFKYTTEVIYPHSYAKEPPKGCDCTNGCSDSNRCACAVKNGGEIPFNSNGAIVEAKPLVYECGPSCRCPPTCHNRVSQHGIKIPLEIFKTGNKGWGVRSLSSISSGSFVCEYAGEVLQENGDEHVETDEYLFDIGHHYHDEVWEDPKFEGILGLESSTSKTTEDTEGSKTTEDTEGSTIDASKCSNVGRFINHSCSPNLYAQNVLWDHDDMKKPHIMFFATENIPPLQELTYDYNYGKVEDKNGKEKVKPCFCGSPDCSRRLY

SEQ ID NO: 92413 - protein, 406 aa, Bacillus cereus G9241
MNIHEIRKQFPILDQKVNGKQLVYFDSAATSQKPIQVIETLERYYKEYNSNVHRGVHTLGTKATDAYEGAREKVRKFINAKSMEEIIFTRGTTTALNTVAASYGLENVKEGDEIVISYMEHHSNIIPWQQVAKKTGATLKYLPLQPDGTISLEDVRQTVTPNTKIVSIMQVSNVLGTINPVKEIGAIAHENGAIMVVDGAQSTPHMKVDVQDLNCDFYALSAHKMCGPTGIGVLYGKKELLNNMEPIEFGGEMIDFVDLQESTWKELPWKFEAGTPIIGNAIGLGAAIDFLEEIGLHNIEKHEHELAQYALERLSEVDGVTIYGPKHRAGLVTFNIEDVHPHDVATVLDVEGIAVRAGHHCAQPLMKWLKASSTARASFYLYNTKEEIDTFVESLIKTKEYFTNVI

SEQ ID NO: 92414 - protein, 132 aa, Helicobacter pylori
SNIKYELDKESGALMVDRVLYGAQNYPTNYGFVPNTLGSDGDPVDALVLSDVAFQAGSVVKARLVGVLNMEDESGMDEKLIALPIDKIDPTHSYVKDINDLSKHTLDKIKHFFETYKDLEPNKWVKVKGFEN

SEQ ID NO: 92415 - protein, 463 aa, Streptomyces kanamyceticus
MHDTGTAAPSAPAPDQSEGQEAQSRHARRFGLPIATCLVMGNIIGGGIFLLPASVAPFGTISLVAFAVLTAGAIALALVFGRLAERDPRTGGPYVYARAAFGDFAGFLAAWSYWITTWVSNAALAVAAVGYLNVLIPVNDHKWSACLAALVLQLLPALANFAGTRYVGAVQLVATVLKFLPLLLVAVGGLFFFDSANLGPFQASDDSPMGAVSAAAAILLFSYLGVESAAVSAGEVRDPRRNVGRATILGTLGAAVVYLLGTLAVFGTVAHDKLITSTAPFSDAVDVMFGGSWGGTAVAFAALISMVGALNGWTLLSAQTPYAAAKDGLFPAAFGRKKRGVPTVGVLVTVVLASLLTVYNYTAGSSGVFESLVLITTFTATVPYLLATVAQIYFLVSGQRERVNRGRLVRDAVLAGAAFAFAMWLVAGSGYAAVYQGVLFLFVGVLVYAWMAARKQRAATSND

SEQ ID NO: 92416 - protein, 415 aa, Chlamydomonas reinhardtii
MLRGLGQRQRASGRQGRQQSACPSVSGVSRKQLVVHARASRYDRRKPPPPDLPSLLFDQRIVYLGMPLVPAVTELMVAELLYLEKQGATLPIEMLINSSGTTRQDGEILSFDSEGVALTSTMGFIKNPISTVNMGLAVGWSCVVLSFGRKGWRKSLPHSLAMIQQPRVPPTGQRQAIEVHIKWREVLDYKRELLRMFSLGTGLPVDKLDADMQRPLYMRPQDALEYGIIDEIIEPNEDKAEKAAQYWIRSGRAESEGRLEQWQEYLSLQEEYALKDSFRKVMTQDLRAAYRDTSSKLLKNSSRNMEQVQEFKERLPDDMLTENDEVRLPFSRDGVKLAILNAECYAERNIARQVAANKVSVPDKWRAAYAARPAPAAPAAEVDYDALIRAVEAMDEKAFATTDLDTLVEQYRVPA

SEQ ID NO: 92417 - protein, 473 aa, Oryza sativa
MSALFAASRCASLRVMRPQCSHIAAASLLLSRWYSSKFPPHTVINMPALSPTMTQGNIASWSKKEGDQLAPGEAIAEIETDKATMDFEFQEDGYLAKILMGDGSHDIPVGKPIAVYVEESNDVAAFENFTAEDAGEGEAKPAESKEEPKQESKEESKDTSKESKAAPAKSESKSSSTPKPSGRIIASPLAKTIALEKGISLKNVKGSGPNGRIVAKDLENIKESAAAAPAAAAAAAPVGASYTDTPLTNMRKTIASRLLQSTQQSPSYIVSSEMSVSKLLKLRQSLNASAEDRYRLSVNDLLIKAIAKASLRVPEVNSAWLGEQGVIRTYNYVDVSVAVATPTGLITPIVKNADTKGLATISAEIKDLGKRAKANKLAPEEFQGGTVTLSNLGMNHAVTSFTSIINPPSCAIFAVGTVTKKAVPSDVNEQGFIFDDVMNITGTFDHRLVDGALGGEFMKALKKIVENPLEMLV

SEQ ID NO: 92418 - protein, 297 aa, Synechococcus elongatus PCC 6301
MAEAESLWSAIAAVINTQRDRPSLIQQAQPVGGGCINRSYRLVLEDGQAWFVKLNQRDSLAAFAAEAEALTAIAASQTIRVPQPIAWGETNRSAYLVLEWLELDRGPTDWRQMGAQLAQLHRQTRSPQGFGWHRDNVIGQTPQINPWQWDWGAFWQVQRIQFQLDLAARNGYRWPHAQALCDRIPDLLADHQPKPALVHGDLWSGNASFLADGTPVIFDPATYYGDREVDLAMTELFGGFPPAFYEGYRQVWPLDPGYRSRRDLYNLYHVLNHVNLFGGGYVHQAQRLIDRLLATNR

SEQ ID NO: 92419 - protein, 238 aa, Zea mays
MSAASKKLFQAARSLVLSASNRSVLAAEGRTAALATLTNFGRKTLPTAYLSYHKQGSHHAASGWGAIAAAVPAAVYMLQDQEAHAAEMERTFIAIKPDGVQRGLISEIMSRFERKGYKLVAIKLIVPSKEFAEKHYHDLKERPFFSGLCDFLSSGPVLAMVWEGEGVIKYGRKLIGATDPQKSEPGTIRGDLAIVVGRNIIHGSDGPETAKDEIALWFEPKELVSYTSNAEKWIYGVN

SEQ ID NO: 92420 - protein, 212 aa, Leifsonia xyli subsp. xyli str. CTCB07
MTRVLVIDNYDSFVYTLNGYLLELGAETDVVRNDDIPVEELTARLAEYDAVLVSPGPGKPVDAGVSIPAVTAAFESGQPLLGVCLGHQAIAEAFGGGVTNAEELMHGKTSLVEHDSSTLFDGVPQPFTATRYHSLAVVEGTLPEELVVTARTLGGVIMALQHRDVAIYGVQFHPESVLTEGGYRMLGNWLEVAGITGAAETARSLNPRVKHS

SEQ ID NO: 92421 - protein, 303 aa, Clostridium acetobutylicum ATCC 824
MNYIDDIRQIIGNTPIIKINNFGLNSGVNIFAKLELLNPGGSVKDRVGVYMIEDAEKKGKLKKGYTIVEGTAGNTGIGIALAAINKGYNVIFVVPEKFSIEKQTLMKAFGAKIINTPREEGMQGAVKKANELLSTIPNSISLGQFVNQANPLAHYETTGPEIYRDLEGNIDYVVAGAGSGGTYAGVLKFLKEKKPNIKGVLADPEGSTMGGGEEASYDIEGIGNDFIPDTMDMNLVDEVIKVNDAEAFHMVRQLALKEGLIVGSSSGAAMAAAIKLSKKIKSGNIVTIFPDRGDRYFSKNILG

SEQ ID NO: 92422 - protein, 464 aa, Thiobacillus denitrificans ATCC 25259
MISTRRHRVLIIGAPYDNFKSMDDLLSRTRAAVWHPCTQMKDLEATPPLAIARGEGPWLIDTAGRRYVDAISSWWVNLFGHCNPRINAAITDQLGRIEHVMLAGATHEPVVALSERLSALTALGHAFYASDGASATEIALKMSAHYWRNTGRPEKNAFVSLQNGYHGETVGALSVTDIPLFRATYEPLLRHSARVPSPDARLAASGESPAAFAERCAAALEAHLAAHAETTAALIVEPLVQGAAGMAMYDPIYLTRARELCDRYEVHLIADEIAVGFGRSGTMFAFEQAPLPGGPAPKPVRPDFICLSKGITGGYLPLSSVLTTDSVYAAFYGDETARGFLHSHSYTGNPLACRAALAVLDLFEQDDVIAANRAKAATFTTILAPVRAHRRVRHFRRCGMIWAFDVAGATPGFAARFHRAALAQGVFVRPIGNVVYVMPPYVTGDDEMRQVCDALLACLDAPEV

SEQ ID NO: 92423 - protein, 700 aa, Physcomitrella patens subsp. patens
MSATSNGVWQGDVPVHFALPLLIVQIVLVLAITRALAFVLKPLKQPRVVAEIIGGILLGPSAFGRNKDYLHTIFPHESVIILEVFADMGLLFFLFMVGLELDMTQIRKTGKQAMSIAAAGITLPFVAGVGVSFVLHLTIAPEGAFGPFLVFMGVAMSITAFPVLARILAERKLLTTEVGQLAMSAAAVNDVVAWVLLALAVALSGSGRSPAIVAWVLLCGIAFCLAIFLVVQPCMQWVAHRSPDNEPVKEYIVALTLLCVLVAGFCTDAIGVHSIFGAFLFGLVIPKEGPFAAALVEKLEDFVSILLLPLYFASSGLKTNIGAIHSAQSFGLLVLVISVACLGKILGTFAAAKACRVDARKALTLGILMNTKGLVELIVLNIGLDRGVLNSETFAIMVLMALFTTFMTTPLVMAIYKPARNPTPYTRRTLEMEDSKDDLRILSCVHGMKNVAAMINLTEATRGMRKRTLRLYILHLMELSERTSAIMIVQRARRNGRPFFNQSKHSDNKDQIVAAFETYEQLSKVTVRPMTAISGFDDMHEDICATAADKRTALIMLPFHKSPRLDGHFDSTPGFRTVNQKVLKHAPCSVAILIDRGVGGSAQVPSSNVDHNVVVYFFGGPDDREALAYGFRMAEHPGVKLHVIRFLSHSVVMDDGHGGLASVGSEVSEIGKTEVLLIRDTLVPMQSPPIKDMNLKELKY

SEQ ID NO: 92424 - protein, 426 aa, Thiobacillus denitrificans ATCC 25259
MSVVAVVGLGYVGLPLAVEFGKKTRTVGFDLSREKIEHYRRFCDPTGEVSSDDLKAATHLTVTTDPAALAEADFIVVAVPTPVDAAHIPDFSPLVGASTTVGKHMKKGATVIYESTVYPGATEEVCIPILEKNSGMTWRHGFHVGYSPERVNPGDKERTITRIVKVVSGDDAATLDKVAELYGSVITAGVHRASSIKVAEAAKVIENTQRDLNIALMNELSLIFHRLGIDTLEVLKAAGTKWNFLPFRPGLVGGHCIGVDPYYLTHKADMLGYHPQVILAGRRINDGMGAYVAQETVKKMIAGGVQVKGAKVNVLGLTFKENCPDLRNSKVVDVIRELQSFGCEVHVHDPLGESKEAEHEYGIGLTAWEELPACDALVAAVSHAAYLDKPFAELTATLKKGGTFTDVKSAYDPATVEAAGFALWRL

SEQ ID NO: 92425 - protein, 830 aa, Yarrowia lipolytica CLIB122
MGKLHPLHRKPKEEHLKVDPDSKNFKRGLHDREAVGGTNYKIAKNNFKKKHAQHHHHIPHHLHHHVNTTDPAELADTQETLMSLKQVTNTKDIDALDYLNNLEVSVGSSGFATWYMISSSFPLIAAAIGPLANMCAIAALTEAWLEYRDGNIPESDGGTLYNTIKDPAWVTALNAVSLAIGVTANMSMLLNFAGRINYTASQVISICGFGSAAIMLLVLTMVTKFVLLEDDMQLSASYWHGIMTFACYMACSILLFFNEFGHLLGFYGATFNLNQAQRGLMLQNISLAVWTASGAGLFQYLMDLSYPDALYFCHVSILTIGLGDIHPLGNLERALIIPYALIGTLMLGLIISSIRSMIIDSSSKTLAWNHAERNRKKEYHELLKQTVDPEKERELFEKMREFHKQAEKYRTWLNLTVAIITFGAFLCLGAMCFKFVEHWSYWTAVYFCLLCLTTIGYGDVYPQSSVGKAFFIVWSMAAVPMMTILISSMGDTVIAKVVQFTDVFGDWALAFPSLNPYSHNPPPTDPEKGEETATDSENGAKDQASKETEKDPEVKRKISELENDINTIRDLAKALNDVFSNAIEDPLRKYSFEEWREMMHLVGRVPHLVGAGEINRSEVPQYNHEFWAQTRGHSEEPEIPAAPSAAPVKLPPPANDSVEDVDEEIGEIASMIEQEREDELMENAKLEHNLKKSGVSPAHYNDFSEHVDTASLVLPARVRFEEGGNNNLAFLAPKKIDGRPQFWLSDSSPLRFPVRENRVFLKKYINALDETARTMLEKHCRQEPDLSKGNTGVIENCSCESLNEHSRSTNVGDEDVKNNAEPTPEVGGQT

SEQ ID NO: 92426 - protein, 596 aa, Prochlorococcus marinus subsp. pastoris str. CCMP1986
MIKVEKVKKKKEIAKQEIVCLANGLEVSKFENFKKGSEFLKEPLASELKNESDHFTNDAVQLLKFHGSYQQDNRENRKPGKSKDWQMMLRLRSPGGEIPGNLFLSLDELSDKLGNGTLRVTTRQAFQMHGIRKDNLKEVIKSIVNSMGSTLAACGDINRNVMAPAAPFETAEYITARTLAVKVADLLTPMAGQGTFLELWADGDLEYTIKPDKEIEENRKLQFKENVFSGTKKEPLYGSTYLPRKFKCAVTVPGDNSVDLLTNDIGIVAFTSKEGSFEGCNFYIGGGMGRTHNNEETFARIADPLGYVENKDTYELIQSIVAIQRDYGDRKSRKNSRMKYLLHRKGIKWFKKILSDKYFRKEIKPLRKEPENKLIDYLGWHKQNEDYFFVGLPLLSGRLSGKKKSLIRDLVKENDLYLRLTPNQDILLCNIPNKNKSKIKKALKKIGYDNLNDINEIQRHALACPALPLCGLAMTEAERILPEVLTRIENLLTDMNIEKTILFRMTGCPNGCTRPYMAELALVGSGQNKYQLWLGGSKNLQRLAKPYLQRMELDDLERTIQPLLELWKKSSAEKDFGDFINNQTESFITNLLSEIN

SEQ ID NO: 92427 - protein, 342 aa, Thiobacillus denitrificans ATCC 25259
MSAFDALKAELVAEPKTWLVTGAAGFIGSNLVEALLRLDQRVVGLDNFATGHEKNLAQVQASVGPARWANLSFKRGDIRDLITCHDACKGVDYVLHQAALGSVPRSIEDPISTHAANNTGFLNMLVAARDARVKRFVYAASSSTYGDHPALPKVEDIIGKPLSPYAVTKLVNELYADVFGRCYGMESIGLRYFNIFGRRQDPQGAYAAVIPKWVASMIHGEPVYINGDGETSRDFCYIDNVIQANLLAATSPHADAANQVYNIAVGDRTTLNELFEAIRSLLAPRFPHLADVKPVYRDFRSGDVRHSLADISKARTRLGYAPSHRIADGLAEAMDWYVQDLA

SEQ ID NO: 92428 - protein, 402 aa, Prochlorococcus marinus str. MIT 9211
MAKRSLSSLSAEELCGKRVFVRVDFNVPVNAEGDITDDTRIRAALPTIKDLIDKGARVILSAHFGRPKGQVNDAMRLTPVAQRLSELLGHTVIKTDSCIGSDAQAKAQSLNNGDVMLLENVRFIQGEEKNDPDFAKELSELAEVYVNDAFGAAHRAHASTEGVTKFLSPNVAGYLMEKELQYLQGAIDSPKRPLAAIVGGSKVSSKIGVLESLIDKCDKVLIGGGMIFTFYKARGLSVGKSLVEDDKLELAKALEEKAKSKGVELLLPTDVVLADNFSPDANSQIAQINSIPEGWMGLDIGPDSVKLFQDALEDCQTVIWNGPMGVFEFDKFANGTNSIATTLSVLSQKGCCTIIGGGDSVAAVEKAGLADKMSHISTGGGASLELLEGKTLPGVAALDELD

SEQ ID NO: 92429 - protein, 159 aa, Vitis pseudoreticulata
MVAQCLGAICGVGLVKAFQSAYYNRYGGGANELSAGYSKGTGLGAEIIGTFVLVYTVFSATDPKRSARDSHIPVLAPLPIGFAVFMVHLATIPITGTGINPARSLGAAVIYNNEKAWDDQWIFWVGPFIGAAIAAFYHQFILRAGAIKALGSFRSTPRV

SEQ ID NO: 92430 - protein, 272 aa, Bradyrhizobium japonicum USDA 110
MLFVEANGARIPAIGLGTWELSGRPCARVVEQALRLGYRHIDTAQVYDNEREVGDGVRASGVRRDDVFLTTKVWTNHFAPNDLERSVKESLARLRLPSVDLLLLHWPNSHVPLAETLGALSHARQMGLTRHIGVSNFTVALIEQAVALSPEPLVCNQVEFHPYLDQAKVRAACDQHGLALVAYSPIARGRIKTDQTLAGIGRAHRKTPAQVCLRWLVQQNVAAIPRTSRIERLSENIEIFDFELSDDEMARIAALANPKGRLTDFGFAPKWD

SEQ ID NO: 92431 - protein, 379 aa, Bacillus clausii KSM-K16
MKAVTFQGKKQMEPKEVPAPSIQQDTDIIVRITASGICGSDLHLYHGGIVPETDYVVGHEPMGIVEEVGPMVKSLKKGDRVVIPFNVSCGECFFCQHQMESQCDNSNGNPHSDAGGLFGFAEQFGNYPGGQAEYLRVPYGDFTSFKLPAESELDDEQVVLLSDVIPTAYWSVKHAGVSTGDTVIILGCGPIGLMAQKFAWLHGAKRVIAVDQVAHRLEHGKRTNLVETYNFSNTPDIGKQLYEDTEGGADVVIDCVGMDGTVPPGETFGSSGDNQFGTIQPIVTASEAVRKFGTVQITGVYGSEANQFPINDFFTRNVSLKMGQAPVVHLMPTLYTMIERGTIDPTDIITHRMGIEDAPDAYRIFDQKEDGNIKTIFKL

SEQ ID NO: 92432 - protein, 296 aa, Moritella sp. PE36
MQLSNSITRYQGRINDYLQQQINLLPTHDTQLAAAMEYGLLQGGKRIRPVIVYAVGEMLGVNLRDLDGPAAAIESIHAYSLIHDDLPAMDDDDLRRGQPTCHIKFDHATAILAGDALQPFAFEMLLDCALAPEAEKNRFAMLKSLTQASGYSGMCGGQAMDLAATDKQISLTQLEAIHNNKTGALINCAAKLGCLASPHCSIELLAALDKWSNAIGLAFQVQDDILDIISDTETLGKPQGSDVELNKSTYPALLGLAGAQEKAQALYQQAIFALETIPHDTTVLALFTQYIIERNK

SEQ ID NO: 92433 - protein, 621 aa, Moritella sp. PE36
MSLDISNYPTLALADIPEELRQLPADRLDDLCDELRSYLLHTVGKSGGHFASGLGVVELTVALHYVYNTPYDKLLWDVGHQAYPHKILTGRRDRMSTIRQKGGLHPFPWRDESEYDHLNVGHSSTSISAALGLAVAADQEDKNRKTVAIIGDGAITGGMAFEALNHAGHIDKDVLVILNDNDMSISANVGAVNKHLAKLLSGVAYSSFRENGKKVLSGIPPIKELARRAEEHLKGMVVPSTLFEEFGFNYIGPIDGHDVNGLVETLRNMRNLKGPQFLHVITKKGKGYAPAEQDQLGYHAVPKFNPAEDTLPVAAPSKPTFSKIFGNWLCDVAATDKKLAAVTPAMGAGSGMIKFSETYPKQYFDVAIAEQHCVTFAAGLAIGGHKPVVAIYSTFLQRGYDQLIHDVAIQDIPVLFAIDRAGLVGADGQTHQGAFDISFMRCIPKMVIMTPSDENECRQMLHTGYQYHGPAAVRYPRGSGTGIDVEQAFTEFEIGKGIVRRQGEKVAILCFGTLMHNAMPAAKRLNATVVDMRFAKPLDEALLAEMANSHDILVTIEDGAIMGGAGSGVNEYLMANKLMTPTLNLGLPDKFIHQGTQDEIYAELGLDDIGIEASIKAFIAL

SEQ ID NO: 92434 - protein, 132 aa, Helicobacter pylori
SNIKYELDKDSGALMVDRVLYGAQNYPANYGFVPNTLGADGDPVDVLVLSDVAFQAGSVVKARLIGVLNMEDESGMDEKLIALPVDKVDPTHSYVKDIDDLSKHTLDKIKHFFETYKDLEPNKWVKVKGFEN

SEQ ID NO: 92435 - protein, 132 aa, Helicobacter pylori
SNIKYELDKDSGALMVDRVLYGAQNYPANYGFVPNTLGADGDPVDVLVLSDVAFQAGSVVKARLIGVLNMEDESGVDEKLIALPVDKVDPTHSYIKDIDDLSKHTLDKIKHFFETYKDLEPNKWVKVKGFEN

SEQ ID NO: 92436 - protein, 132 aa, Helicobacter pylori
SNIKYELDKDSGALMVDRVLYGAQNYPANYGFVPNTLGADGDPVDVLVLSDVAFQAGSVVKARLIGVLNMEDESGMDEKLIALPVDKVDPTHSYVKDIDDLSKHTLDKIKHFFETYKDLEPNKWVKVKGFKN

SEQ ID NO: 92437 - protein, 219 aa, Candidatus Pelagibacter ubique HTCC1002
MKKIQISPSILSADFSQLRNEIKRLEEGGADMIHVDVMDGHFVPNLTMGPPIIKSLRKFTKLPFDVHLMISPVHKYIKDYADAGADIITIHPEATENLAVSINHIKSLGKKVGVSLNPESKINLITDLLNQIDLVLIMSVNPGFGGQKFMPEVLEKIKELKKIRDQKNIDFDIEIDGGINFDNNKLAIEAGANILVSGTTIFKNNNGDIKKNIDLLKSS

SEQ ID NO: 92438 - protein, 99 aa, Oryza sativa
LGRPTSVSGVQIAISASNTGGAWDNAKKYIEAGASEHARTLGPKGSDCHKAAVIGDTIGDPLKDTSGPSLNILIKLMAVESLVFAPFFATHGGLLFKWF

SEQ ID NO: 92439 - protein, 317 aa, Salmonella enterica subsp. enterica serovar Paratyphi A str.
MIKLAPAGLKDDIEMRKVYAGFVAGQIEAGSPIIALEADLMSSMAMDSVARDYPQHVINCGIMEANVIGTAAGLALTGRKPFVHTFTAFASRRCFDQLFMALDYQRNNVKVIASDAGVTACHNGGTHMSFEDMGIVRGLAHSVVLEVTDAVMFANILRQLMDLDGFYWLRTIRKQATSIYAPGSTFTIGKGNVLREGDDITLIANGIMVAEALEAARQLEQEGVSAAVIDMFTLKPIDRMLVKNYAEKTRRIVTCENHSIHNGLGSAVAEVLVENCPVPMRRVGVKERYGQVGTQDFLQQEYGLTAEAIVEAAKSLL

SEQ ID NO: 92440 - protein, 584 aa, Vitis vinifera
MAKLFAFGALWLCLVVTVICPRHCVSVRSDQEIRDRFYGNLLNGTAPDSGDGSIAKIGVIDKRFRGNGLTKFFCSIIVYIKFEIFGSNGSSFNSSVADQQAVLETVAKITHEKAKRNDTQEANGTRSFQFQDVFSLDNEGTDDVTTLIDKKDNVFVMSNKKSKYPVLQVDLRLISDLVVVIVSAAIGGIIFSCLGQPVIVGYLLAGSIIGPGGLKFISEMVQVETVAQFGVVFLLFALGLEFSLPKLKAVGPVAVLGGLLQIFIFMFLCGVTAMLCGAKLSEGVFVGSFLSMSSTAVVVKFLVERNTNNALHGQVTIGTLILQDCAVGLLFALLPVLGGNSGLLQGMISMGKLLLVLSMFLTAASVLSWSFVPRFLKLMIQLSSQTNELYQLASVAFCLLSAWCSDKLGLSLELGSFVAGVMISTTDFAQHTLDQVEPIRNLFAALFLSSIGMLIHVQFLWTHVDILLASVILVVVVKTAVVAVVTKAFGYSVRTSFLVGVLLAQIGEFAFVLLSRASNLKLIEGKMYLLLLGTTALSLVTTPVLFKLIPAVMHLGVLMHWFPSENSNQNEERASVLESRDRLL

SEQ ID NO: 92441 - protein, 785 aa, Oryza sativa Japonica Group
MGGARAQVNKPHKTRFASKASRHAHKIDKVRTGKPEGSHRAAVKGARAARVQRSKAIRDQKRAALLKEKRSSVGSSSAPRVVVLFGLSSSANVRSLAKDLLTIASGDEEKPTSSTVASPTYKLRTTVLEAPYGDLTSCMELAKVADLLAFVLSANSLYDCDSSSPIDDFGSQCLSVFRAMGLPSTAVFIRDLPSENKSRQELKKTAISFVSPELPEDCKFYAADTKDDLHKFMWLFKEQHLSCPHWRNQRPYVMSEEACIKPDDSSGLCTLLMSGYLRAHNLSVNQLVHLSGVGDFQLGQIDILKDPFPINERKNSNAMVSEDSGIQIVDTFVPDPSSQEPLLVENTPDPLEGEQTWPTEAEMEEAYLNNKQRKLKRKLPRGTSEYQAAWIVDDTDDEDGDSENDNQDGAGMVIDEQDHSDNGGDGSDMDVVSHFTEKFDEETIGGTEMADDENLTKEQIEAEIKKIKEANAEDEEFPDEVETPLDVPAKRRFAKYRGLKSFRTSSWDPKESLPQDYARIFAFDNFTRTQKHVLAKMAERDEGTLKDCAQRGSFVRLHLKNVPTEIASKLVHPSRRLPVVVSGLLQHESKISVLHFSIKKHDSYEAPIKSKDSLIFNVGFRQFTARPLFSTDNINCNKHKMERFLHHGRFSVASVYAPICFPPLPLIVLKSRDGEQPAIAAVGSLKSVDPDRIILKKIVLTGYPQRVSKLKAVVRYMFYNPEDVKWFKPVELWTKHGRRGRIKETVGTHGAMKCIFNSSVQQHDTVCMSLYKRAYPKWPEQLYQI

SEQ ID NO: 92442 - protein, 439 aa, Klebsiella pneumoniae
MHDKYDVLIIGGGPGGYVAAIRAGQLGLRTVLVEKQHLGGICLNWGCIPTKALLHGAEVAHTITHASQLGISVGEVNVDLQKLVQFSRTVSQQLTAGVAYLLKKNGVRVIDGTARLRGKGQITVEDARGEARDYRADHVILATGARPRALPGIAPDGEHIWTYFEALRPKLLPKSLLIIGSGAIGVEFASLYNDLGCKVTLVELASQILPVEDAEVSAAVRKSFEKRGIQIHTQTLVTQVQLTDTGVRCTLNNTGGEYSQDVERVLLAVGVQPNIEDLGLETLGVELDRGFIKTDAACRTNVFGLYAIGDVAGPPCLAHKASHEGVLCVETLAGVEGAHPLDRDYVPGCTYARPQVASLGLTESTALARGRPIRIGKFSYQSNGKALVSGETEGFVKTIFDAETGELLGAHMVGAQVTEQIQGFASPVTWRPQTKASCR

SEQ ID NO: 92443 - protein, 364 aa, Thermoanaerobacter tengcongensis MB4
MRVHKFGFIIHPIEYEDVSRKFKVMQKFPKWVVEGFTRLLPPMKVSEITGVRSEYAETEGWFVAVPLTSEQMLKLPEDYVLKKIIKAVKIAENLGAEIVGLGAMTSVVGDAGITIAKNSNIAVTTGNSYTVATAIEGAIKAAELMGKDVRDSHVVVIGATGSIGKVCAEILSRDAKYMTLVARNKEKLQNFRDYLMQKTGMSAHITSDVKEALEDADIIITVTSAVDTVIKPEYLKPGAVVCDVARPRDVSKEVADKRDDVLVIEGGVVEVPGDVDFHFNFGFPPKTSYACMAETMILAMEGRIENYSLGRDLTVEQVDEIARLAKKHGFKLAGFRSFEREVTMEKIETVRKNAKKKLETWKFA

SEQ ID NO: 92444 - protein, 326 aa, Arabidopsis thaliana
MRSTCKKWYVLTKDQRFAKKRGKEFLMIMNRRVYLIGVNLHNNIDLSIKCRGRLISRDETAQGFYVSQVFHCNGLLLSVSGKTIDDTRLVVCNPYGVKPKWINPKDNYGRLDIFSLGFDKLCGSYKILRIYDFDNKLQIYDLSSNSWMIPRDTLGRDIEYMQNGVSSKENTYWCARDKQSQYCFLFCFDFTRERFGPRLPLPFNGAYVSLSAVKEEQLAVLFQPSDKSEIEIWVTNKIEPEEVSWSVFLKVEMKLRVLSWNFLIDKEKKFAVVFDKDKAKGFKTNYDIAYVIGENGYYRRVDLRESPNKPLCRIVSCYVPSCVQIE

SEQ ID NO: 92445 - protein, 454 aa, Lupinus luteus
MASRPIVPLQPQQAKGEGVIGGRRKQENKNGAANGKNRVVLGDIGNLDRVKGANINLNRPITRSLCAQLLAKAEAGENDKNLAIPNVTGPKPQVADGVVAKRRVAPKPAEKKVTAKPKPVEIVEISSGKEVQKDKSANKNKEQGDALSKKKSQTLTSVLTARSKAACGLTEKPKDQIIDIDAGDSRNELAAVEYIEDMYKFYKLAENENRPHQYMDSQPEINERMRAILVDWLIDVQTKFDLSLETLYLTINIVDRFLAVKTVLRRELQLVGVSAMLMASKYEEIWPPEVNDFVCLTDRAYTHEQILVMEKIILGKLEWTLTVPTTFVFLTRFIKASVPDQELENMGHFLSELGMMHYATLVYCPSMVAASAVFAARCTLNKTPIWNETLQLHTGYSEEQLMDCARLLVSFHSTLANGKLKVLYRKYSDPQRGAVSMHPPAKNLMPESSCGSRV

SEQ ID NO: 92446 - protein, 164 aa, Oryza sativa Japonica Group
MAAEKKEVADAAAGSGSDTILLISSDGEHFNVPSAAASLSQLVSNMIEDDCTTNGVPLPNVASKVLAKVIEYCIKHAAAGEEEEKDLKSFDAEFIDVDKNMLYDLLLASNFMNIKSLLDLCCQHTANLIKGKSPEQIRKEFGIKNDFTPEEEEEIRKENTWAFE

SEQ ID NO: 92447 - protein, 200 aa, Oceanobacter sp. RED65
MQINYQKAQFLISAPSIRQCPEDNGAEVAFAGRSNAGKSSALNTLAQQNKLARTSKTPGRTQLINFFEIEEGLRLVDLPGYGFAKVPERMKREWQKNMSEYLEQRKSLKAMVLVMDIRHPLSEFDLMMCQWALDCNMPTHILLTKADKLKKGPANSTKLKVKKELKEMGDLLTVQTFSALKRDGVDQLRSRLNVLLTGED

SEQ ID NO: 92448 - protein, 389 aa, Synechococcus elongatus PCC 6301
MKAMILAAGKGTRVRPITYTIPKPMIPILQKPVMEFLLELLKEHGFKEVMVNVSHLAQEIESYFRDGQRFGVEVAYSFEGRIEDGQLIGEALGSAGGMKRIQDFSPFFDDTFVVLCGDALIDLDLTEAVRWHKEKGALATIVMKTVPREEVSSYGVVVTDSDGRIQAFQEKPSVEEALSTTINTGIYIFEPEILNYIPSGQEYDIGGDLFPKLVETGAPFYGISMDFQWIDIGKVPDYWQAIRSVLNGEVRNVAIPGKQVRPGVYTGLNVAIDWDSVAIEGPVYIGGMTRIDEGVRIVGPAMIGPNCHICKGATIENSVIFEYSRLGSGVRLVDKLVFGRYCVDRNGNAIDVQAAALDWLITDARRAEPVQPSAEHQAIADLLGSNVLP

SEQ ID NO: 92449 - protein, 437 aa, Desulfitobacterium hafniense DCB-2; identical to SEQ ID NO: 1265

SEQ ID NO: 92450 - protein, 197 aa, Oryza sativa
MANRDTTSSCVTFVNAVAQLKLVVGAWACASRTPCSYSHVIIVSTLVPKIVRLHLPGIHLDDDAKATASLPLDTTIKPPPSWGYTRFYDGGMLFNQGHELRERVTTAVAVSDGSSMTPSTSAASAFLQEMKDWAPAIIASALFALLCPGGILQMPGRNRPVDFMNMKTSLASIVVHAVIYGLLLMLFLVILEAHLYI

SEQ ID NO: 92451 - protein, 132 aa, Prochlorococcus marinus str. MIT 9211
MSKKTDEILDSLKSLSLLEASELVKQIEEAFGVSAAASAGVVMAAPGAGGGASAAGEAAEEKTEFDVILESFDAAAKIKVLKEVRNATGLGLGEAKAMVEAAPKTIKEGASKEDAEALKKAIEAVGGKVTLK

SEQ ID NO: 92452 - protein, 242 aa, Oryza sativa Indica Group
MAAPPQPVPAPAAASPEVFRLGFIGPGNLAESIARGVAASGVLPATAIRTAPHRRPERAEAFSSIGAHILETNAQVVDDSDVIVISVKPQIVRQVLVELKPLLSEEKLLVSIAAGIKMEDLQGWSGHRRFIRVMPNTPSAVGQAASVYLLKELRINQLLISLYLLVMCLGEMATENDENRVLGAATMVNKTGKHPGQLKDMVTSPAGTTITGIQELEKGAFRGTLINAVVAATKRCRELSQS

SEQ ID NO: 92453 - protein, 480 aa, Oryza sativa
  misc_feature (201)..(201): Xaa can be any naturally occurring amino acid
MMPHSGVVDAAAKGVKLGGGGGGALMVRRVASGKLLSASSHLLFRATILATLCLVCLFTVHYPSLLSHSFHLSSAAAAANGKHRAASRSSHRSLLGSSAAVAYGGAAWEKEVRRSAAPRRDGGLSVLVTGAAGFVGAHCSLALRARGDGVVGLDNFNSYYDPSLKRARQRLLASRGVAVLDADINGRRGWLERLFDAAPLXTHVLHLAAQAGVRYAMRAPQTYVASNVAGLVSVFEVAAKHADPQPAIVWASSSSVYGLNTDAPFSEEHRTDRPASLYAATKKAGEAIAHAYNHIYGLSITGLRFFTVYGPWGRPDMAYFSFARSIVAGEPITLFRTADGADARRDFTYIDDVVKGCLGALDTAGESTGTKSGKKRGPAPLRVYNLGNTSPVPVTRMVAILEKLLGRKANKRVVTMPSNGDVPFTHANVSHAARDFGYRPATPLDAGLRRFVDWFVHYYKLDTAKIAKGKRKSMAMSAAS

SEQ ID NO: 92454 - protein, 251 aa, Prochlorococcus marinus subsp. pastoris str. CCMP1986
MPETNSKNSVGVNRPIQIIPSVLPADWANMGACVKDLEEAGVDRIQFDVMDGNFVPNLTFGPEMIAACRKYCEVPFETQLMVSQYNCETMLEAYVKATKGPNGEPGVVIAHAEANVHLHRVLGKIRDLGGSPSVALNPHTPFEMIENIMDMVDHVLVMTVNPGFGGQAYIPTMLNKIRKIRNFVIEKNLNVDIEVDGGIKANWTISQCAEAGANCFIAGSGMFAYPTLKEGCDELRSVALDAQNGKIISEP

SEQ ID NO: 92455 - protein, 433 aa, Prochlorococcus marinus subsp. pastoris str. CCMP1986
MHIVVVGLSHRTAPVEVREKLSIPDQSISESLKTLSINSDILEVSILSTCNRLEIYALVKEINIGISSIKEFLTDYSSVNFEDLNPHLFDFRQEEAVLHLMKVSAGLDSLVLGEGQILSQVKKMMRLGQENQSTGPILNRLLSQSVSAGKKVRSETNLGTGAVSISSAAVELAQLKIGQDHGVDGLVSLKSEKVLVVGAGRMSRLLITHLKSKGCNRLTLLNRNIERAVNLAGDFPDLEINCKSLNELDKNISLSSLVFTSTASEKPFIDLARVEKISLNNKLKFIDIGVPRNISNDVKHHAFIESFDVDDLEEVVSRNQEFRQKIAKEAESLVKDERIIFLEWWASLEAVPVINKLRSDLELIRKEELQKALSRMGPDFSARERKVVEALTKGIINKILHTPVTKLRSPQSRDERQASLKIVEKLFSLVDDE

SEQ ID NO: 92456 - protein, 431 aa, Prochlorococcus marinus subsp. pastoris str. CCMP1986
MKRVLAIILGGGKGSRLYPLTKMRAKPAVPLAGKYRLIDIPISNCINSGINKMYVLTQFNSASLNRHIGRTYNLSAPFGQGFVEVLAAQQTPDSPKWFEGTADAVRKYQWLFQEWDVDEYLILSGDQLYRMDYSLFVQHHRDNKADLTVAALPVDESQAEGFGLMRTDDLGNIKEFSEKPTGEKLKSMAVDTSKFGLTKESASEKPYLASMGIYVFSRKTLFDLLNKFPSYTDFGKDIIPEALSRGDTLKSYVFDDYWEDIGTIGAFFESNLALTQQPKPPFSFYDEKFPIYTRPRYLPPSKLVDAQITDSIVCEGTILKSCSILHCVLGVRSRIESDSVIEDTLVMGSDFFESLEERIELRKGGGTPLGVGEGSTIKRAILDKNARIGDNVVIVNKDRVEEADKPDVGFYIRNGIVVVVKNATIANGTII

SEQ ID NO: 92457 - protein, 132 aa, Helicobacter pylori
SNIKYELDKESGALMVDRVLYGAQNYPANYGFVPNTLGSDGDPVDALVLSDVAFQAGSVVKARLIGVLNMEDESGMDEKLIALPIDKVDPTHSYVKDINDLSKHTLDKIKHFFETYKDLEPNKWVKVKGFEN

SEQ ID NO: 92458 - protein, 472 aa, Prochlorococcus marinus subsp. pastoris str. CCMP1986
MPKAHFGLIGLGVMGENLVLNAERNGFSSVVFNRTYSKTQEFLEGRGLGKNVEGAKTLQEFVNKLERPRRILMMVKAGAATDAVIDNISEYLEEGDLLIDGGNSQFKDTERRVATLESKSFGYIGMGVSGGAKGALEGPSMMPGGTKASYDAIESLLTKMAAKVEDGPCVAYVGPGGSGHFVKTVHNGIEYGIEQILAEAYDLMKRVKNMNGSQMAEVFGLWNNTDELASYLVEITQICLNTKDELTGEDVVEKILDKAGQKGTGLWTVVSALELGISVPTIYASLNARVMSSLKVQRSEIEKTIPMEAIEDFDLGEISNGMKPLFDAVVLATIASYAQGMDILSEASSVYNYELNMPSIAQIWKGGCIIRSKLLKKIQDAYQKDPNLKNLIFDDWFNNEISTRIDNLASVVSSSTKAGIPVPCLSSTLDYLNSYRTNRLPQNLVQAMRDCFGSHTYERVDKEGSFHTEWMK

SEQ ID NO: 92459 - protein, 241 aa, Prochlorococcus marinus str. MIT 9303
MRPLPGANAVETLCTGLDGLLERAADYYVQGARFANWRAALQITSDGCPSDLSIRENSWGLARYARCVQESGLVPIVEPEILMDGNHSIEQTARAQERVIREVYQACLVNDVLLEGTLLKPSMTVKGTDCAKKEDPKTVASLTVRTLERSVPSSVPGITFLSGGLSEEPASVHLNEMNCIERKSRWTLVFSYGRALQHSCLKAWAGSDIAAGQKVLIARAQANSEASLGQYLAGSQPSSDE

SEQ ID NO: 92460 - protein, 161 aa, Moritella sp. PE36
MKVIEGNVPAPEAKIAIVISRFNSFINESLLAGAIDSLKRFGQVSEDNITIVRVPGAVELPLVTQRVAATKQFDAIIALGTVIRGGTPHFEFVAGECNKGLAQVAMDYDVPVAFGVLTTDTIEQAIERAGTKAGNKGSEAALSALEMVNVLHQVDVLLEKK

SEQ ID NO: 92461 - protein, 432 aa, Prochlorococcus marinus str. MIT 9211
MIDSLDLVIDTVLAREVLDSRGNPTVEAEVLLEGGAIGRAIVPSGASTGAYEAHELRDAGDRYFGKGVLKVVENIEERIAPTICGLSASDQATIDGVMSELDGTENKSKLGANAILAVSIATARSAANGYGMPLYRYLGGPMASLLPVPLMNVINGGAHAANNLDFQEFMLVPHGANTFREALRMGAEVFHTLKQLLSEKGLSTAVGDEGGFAPNLQSNQAAGDLLVKSIEKAGFIPGEQISLALDVASTEFFKDGAYFFGGRNYSTEGMIEELVKLVNAYPIVSIEDGLAEDDWEGWGLLTKELGEKVQLVGDDLFVTNTSRLQRGINQKVANSILIKVNQIGSLTETLQAIDLANRSGYTSVISHRSGETEDTTIADLSVATRAGQIKTGSLSRSERVAKYNQLLRIEDELGSEATYAGSNDLGPLCGKK

SEQ ID NO: 92462 - protein, 369 aa, Moritella sp. PE36
MALSRIEDIIEDIRLGKMVILMDDEDRENEGDLIMAADKVTPEAINFMATHGRGLICLTLTKDRVAKLQLPLMVQDNTAQFSTNFTVSIEAAEGVTTGISATDRAVTILSAVAGDAKPADIVMPGHIFPLAAQDGGVLTRAGHTEAGCDLARLAGCEPAGVIVEILKDDGEMARRPDLEIFAEKHGLKLGTVADLIEYRNSNETTIERVAECKLPTEYGDFDLVTYRDTIDNQVHYALRKGEVVAGQPTLVRVHVQNTMTDILHTDRASKISWSLADAMARISQDGGVMVILGNEENSLDIIEKVKQFAKEDKGETQPKAKWQGTSRRVGVGSQILADMGVSKMKLLSSDKRYHSLSGFGLEVVEYISK

SEQ ID NO: 92463 - protein, 290 aa, Streptococcus pyogenes MGAS315
MDKLARIDEAIRRYYKTTSNGVSEELIDAILYSVDSGGKRIRPLILLEMIEGFGVSLQNAHFDLAAALEMIHTGSLIHDDLPAMDNDDYRRGRLTNHKQFGEATAILAGDSLFLDPFGLIAQAELNSEVKVALIQELSLASGTFGMVGGQMLDMKGENQALSLPQLSLIHLNKTGKLLTFPFKAAALVTDQAITVRQQLEQAGMLIGHAFQIRDDILDVTASFEDLGKTPKKDLFAEKATYPSLLGLEASYQLLTESLDQALTIFQTLENDVGFKPQIITKLIEGLRLNA

SEQ ID NO: 92464 - protein, 340 aa, Brassica napus
MDHEADAFRTDLMTITRFVLNEQSKYPESRGDFTILLSNIVLGCKFVCSAVNKAGLAKLIGLAGDTNIQGEEQKKLDVLSNDVFVKALVSSGRTSVLVSEEDEEATFVESSKCGKYCVVFDPLDGSSNIDCGVSIGTIFGIYTMEHSDEPTTKDVLKPGNEMVAAGYCMYGSSCMLVLSTGTGVHGFTLDPSLGEFILTHPDIKIPKKGNIYSVNEGNAQNWDGPTTKYVERCKYPKDGSPAKSLRYVGSMVADVHRTLLYGGIFLYPADKKSPNGKLRVLYEVFPMAFLMEQAGGQAFTGKKRALDLVPKKIHERSPIFLGSYDDVEEIKALYAEEEKN

SEQ ID NO: 92465 - protein, 315 aa, Ralstonia solanacearum GMI1000
MVAKRSVLSSAAADVLVVGSLNMDLVIRTPCLPRPGQTVAAPALETIPGGKGANQAVASARLGSRVAMLGCVGDDPHGMALREGLLREGVDTAMVTAHAGAPTGIACVTVADNGQNTIVIVAGANRQLTPAMIDAQRAAFERAKVIVCQLESPPDAVERALLLGQRLGKTVILNPAPAAGPLPTPWLAACDYLIPNETEAALLTARRVDSPEAALNAAADLHAQGARHVIVTLGARGVAYVDATTRLLMPAHPAQAIDTTAAGDTFVGALATALAEGAAPVEAIQFGLAAAAVSVTRLGAQPSIPFRSELASPVQ

SEQ ID NO: 92466 - protein, 63 aa, Brassica napus
MVKVLTYFGMTLAAFAFWQSMDKVHVWIALHQDEKQERMEKEAEVKRVRAELLRKAREEDTLA

SEQ ID NO: 92467 - protein, 362 aa, Arabidopsis thaliana
MMMSNLPKDLVEEILSRVPFKYLRAIRSTCKNWYDLSKNRSFANKNIDKAAVSGEKEFLMITQFNVFWVGVNLHRSQNNSFDLSIQLKAKIVSRDKKDDLFQKSQVIHCNGVFLCVREKMLVVLNPYWGQTKRIMPRPPFGCFDRYALGYDKSSGSHKILRLFGVNQNNLNIYDLSSSSWMIPDGTLERDMEYMKQGVSLNGDTYWYAKDKESIDWYLLCFDFTRERFGTPLPLPFSNEGYTLHKGYKSLSALKEEKLAVLLWDTMVIWVTNKIEPDAVSWSIFLKLDMEPSIYCRYGNFFIDEEKKVAVVFEKDSSSWSWMYNPNYNKAYIAGENGYFKSVNLLKSPNTLQLGHLVCSYAL

SEQ ID NO: 92468 - protein, 405 aa, Ralstonia solanacearum GMI1000
MSTPHLPIYMDYSATTPVDPRVVDKMIPYLREQFGNPASRSHAFGWEAEKAVETAREQVAALVNADPREIVWTSGATESDNLALKGAANFYGSKGKHIITVKTEHKAVLDTARELERQGFEVTYLDVQENGLIDIEQFKQALRPDTILASVMSVNNEIGVIQDIEQIGEICRDKGVIFHVDAAQATGKVELDLQKLKVDLMSFSAHKTYGPKGIGALYVRRKPRIRVEAQMHGGGHERGMRSGTLPTHQIVGMGEAFRIAREEMATENERIRMLRDRLHRGLTAMEEVYVNGDMERRVPHNLNISFNFVEGESLIMAIKDVAVSSGSACTSASLEPSYVLRALGRNDELAHSSIRFTVGRFTTEQEVDYVVELLKSKIGKLRDLSPLWEMYKDGVDLNSIQWAAH

SEQ ID NO: 92469 - protein, 133 aa, Ralstonia solanacearum GMI1000
MSYSSKVLDHYENPRNVGAFEKGDDTVGTGMVGAPACGDVMKLQIKVNEQGVIEDAKFKTYGCGSAIASSSLVTEWVKGKTLDQALEIRNTQIAEELALPPVKIHCSILAEDAIKAAVADYKEKHGTAEQKAA

SEQ ID NO: 92470 - protein, 516 aa, Thermoanaerobacter tengcongensis MB4
MSVQEKIEELKKRRAKAEEGGGEARIKAQHEKGKLTARERINILLDKGSFVELDPFVEHRCYDFGMEKQKYPGEGVVTGYGTIDGRLVYVYAQDFTVLGGSLGEYHAKKITKVMDMAMKMGAPLIGLNDSGGARIQEGVDALSGYGQIFYRNTLASGVIPQISVIMGPSAGGAVYSPALTDFIFMVDKTSQMFITGPQVIKAVTGEEVTPEELGGSITHNRVSGVAHFRGPNDEEVLKMVRKLLSYLPSNNLEDPPRYETGDDPNRTSERLMEIVPDNPNKPYDMKELIREIVDRGEIFESQEMYAENIITAFARLNGRTIGIVANQPRVLAGVLDINASDKAARFIRFCDAFNIPILSIVDVPGFLPGTNQEYGGIIRHGAKMLYAYSEATVPKVTLIVRKAYGGAYLAMCSKDLGADIVFAWPTAEIAVMGPEGAANIVFKNEINEAENPAEVREQKIKEYRENFANPYRAAARGYVDDVIIPSETRPRLISAFEMLRSKRETRPAKKHGNIPL

SEQ ID NO: 92471 - protein, 361 aa, Myxococcus xanthus DK 1622
MALTLPDAQPPTGLLPLEQAWLQLVQTEVETSLAELFELPDEAGLDVRWTQALTQARAYTLRPAKRLRPALVMAGHCLARGSAVVPSGLWRFAAGLELLHTFLLIHDDVADQAELRRGAAPLHRMLAPGRAGEDLAVVVGDHLFARALEVMLGSGLTCVAGVVQYYLGVCRHTAAGQYLDLDLGRAPLAEVTLFQTLRVAHLKTARYGFCAPLVCGAMLGGASSGLVEELERVGRHVGLAYQLRDDLLGLFGDSNVAGKAADGDFLQGKRTFPVLAAFARATEAERTELEALWALPVEQKDAAALARARALVESCGGRAACERMVVRASRAARRSLQSLPNPNGVRELLDALIARLAHRAA

SEQ ID NO: 92472 - protein, 819 aa, Myxococcus xanthus DK 1622
MRVMKFGGTSVGNAERMRGVADLAAAARKQTRVMMVASAVSGITNLLLEAARAAQEGQPVESLHGRFEDVHRGIIRELAPELGEARQRSLEEGLSTLASELRGLLQGVGLLRECSPSVLAHLSGLGERAACLILGALMHARGLEPHAVEPRDVILCAGDPLQATPLQEETRARFTPLREAGGPGLMLMPGFFGGDTRGKTMCLGRGGSDYSAALAAAALDAELLEIWTDVDGIFSADPRLVPEAFPLPEVSFEEAMELAYFGAKVLHPKTIAPARERGIPVRVCNSFRPDHPGTRVTDDAAPPEHPVRGLSFLPGIALVNLGGAGLKGVPGTAARVFESMALANISVVLITQGSSECSISFCVQQADAERAVQALEVAFEMERAAGKVDTIEQQRGLAVLSIVGDGMRHRVGVAGTFFSALADVGCSIAAIAQGSSERSISAVIAETDGPRALAHVHGRCFGTTEVVELLLAGVGSVGGELLKQVHQQAPKLRAHGVDLRVCVIANSKRVATASEGIPLEDWKQRLAASSDGAPLDAFRDWARAKRPGRPVFVDCTSSEDIALAYPSLMEAGLHVVTANKKANAGQWSHYRKLRETASRHQRRFLYETNVGAALPVIDTLKNMLRTGDRVLRVEGILSGSLSFILGLTEEGVPLSQAVGTAMEKRFTEPDPRDDLHGTDVARKVLILARELGRQVELEQVTLDSLLPSDFDATGPLDDFLARLPQVDAAFQRRVETLRAEGKVLRYVGSVTEDGCFVGLVPVPLTHPLAAVKGGENALSFTSERYSPTPLVIRGYGAGAAVTAAGVLADVLRLVDGPLP

SEQ ID NO: 92473 - protein, 182 aa, Synechococcus elongatus PCC 6301
MAAFGDRTWGEPDCQRATYVAESAVICGDVVLAEGVSIWPTAVLRGDVERIEIGCNSNVQDGAVLHGDPGQPTILEEDVTVGHRAVIHSANIGAGSLIGIGAIVLNGVQIGAGSIVGAGAVVTKSIPAGSLAMGVPAKVVRSLSAAEIADLRQHAQHYVALAEAHAQQQAGKTSEKRSESAQ

SEQ ID NO: 92474 - protein, 404 aa, Escherichia coli CFT073
MKFERHHEILKRLSKFGSVKVSDLSNSLNVTKETIRSDLNELARLGYLTRCHGGAFIVLDSLDTIAKNEIAYALENYDTAQGIKKGHSTMKSQVCVIGSFNVDIISYLPRLPTIGESLLASNFIFSPGGKGCNQALAASFADTDVYFITKVGTDHFSDYAINFMNSSKIYKSIIYQTKETQTGTATILVNEGTGDNVIAIYPGANMTMSSDEITIQKEAIINSDVILLQLETNYTALQQAITLAQKNSIPVIINPAPYNDIVNELIQDVDYITPNETEAGLLSGIDVHDLESAKRAAEAIHNKGVKNTVITLGSKGSLAFDGKKFIHSPAFPAVVKNTAGAGDAFNGALASGLAKGKSLESALCYASAFASLAVETSNASDMPEHESVIHRIQSIHYQQTIFTH

SEQ ID NO: 92475 - protein, 217 aa, Oryza sativa
  misc_feature (211)..(211): Xaa can be any naturally occurring amino acid
MSKVVRRFFGKKTADADKQKSDAINKLLKESGQALEFKVLLLGSGESGKSTVLKQLKNIMKVKLEETELKQIIMSIHSNAFTCMKTLIEAAERLQIEIEGTTDQERAKAIMSMENFEYPLKMELAEWITSLWQNPGIKKTYERRNEFWILDATPYYFQHALRFAEDDYSPTEDDIIMARVRTTGIGGTEFDEPPIHYRVVDVAGQRGERKXWIHCFD

SEQ ID NO: 92476 - protein, 377 aa, Bacillus clausii KSM-K16
MKAVTYQGMNHVEVSTIKAPEIQDPEDVIVRITSTAICGSDLHLYQGNMYTPKGFVIGHEPMGIVEETGPEVTKVKKGDRVVIPFTVACGHCPYCQNHQESQCDRSNPHYDSGGLFGYSEKFGDYPGGQAEYLRVPFGNYTPFRLPDDCELEDEQVLFLSDVLPTAYWSVVHAGVKKGDTVIVLGCGPVGLMTQAFAWQQGAERVIAVDYFDYRLEKARQMNHTETFDFTKDKDTGETLKELTKGGADVVIDCVGMDGKKSPLEMVEQKLKLQGGTLGPIQIATKAVKKCGIVQLTGVYGGNYNLFPLGAFFSRNVTLKMGQAPARAYMETLYEQISKGLINPTSIITHKLALSDAPKGYDLFNNKKDGCIKVVLKP

SEQ ID NO: 92477 - protein, 198 aa, Triticum aestivum
MASHDDDTMPEETQGYKFSQPKQSLAEYQQMDAGDESLQRYKESLGLGGGTDISDPNDPRVCIILSLTMDSPGRPPVTIDLSTPGSETTLKDKPFNIKEGAKFTMSAKFKVQHEILSGLHYVQVVKRKGIRVSKDSEMIGSYAPSTDKQPTYIKKFQEEEAPSGMLARGHYNAISSFVDDDKKKHLEFEWSFDIAKDW

SEQ ID NO: 92478 - protein, 577 aa, Prochlorococcus marinus str. MIT 9211
MEGTPYESTVNDLIWFNLDPKWSFSTVTLINGFHLKNIRGDILGGLTAAVVALPLALAFGNAALGPGGAIYGLYGAVVVGFLAALFGGTPAQVSGPTGPMSVTVAGVVASLAAVGVPRDLSAQQILPLVMAAVVIGGLFQVLFGVLKLGKYITLVPYSVVSGFMSGIGVIIIALQIGPLLGISTRGGVVESLTTVASNFEPNGAAIGVAIMTLGIVFLTPRKVSQWVPSPLMALLIVTPISIILFGDSGLDRIGEIPRGVPSLSLPSFNQYLPIILKAGLVLAVLGAIDSLLTSLVADNISQTRHNSDRELIGQGIGNAVAGLFSGLPGAGATMRTVINVKSGGSTPLSGMVHSIVLLIVLVGAGPLAEQIPTALLAGILIKVGLDIIDWGFLRRAHRLSLKTATVMYGVLLMTVFWDLIWAVLVGVFIANMLTIDSITQTQLEGMEADNPLQGSDDDLPSLPADEQSLLESCSGEVMLFRLKGPLSFGAAKGITERMMLVRNYKVLILDITDVPRLGVTATLAIEDMIQEAKINSRKAYVAGASGKVQERLSKFGVEGVVSTRKEALEAAVSLIKN

SEQ ID NO: 92479 - protein, 257 aa, Bacillus clausii KSM-K16
MKGTVVLITGAASGIGFHLAQRFAAEGASVMVADVHADSLHKATLALTENGYVAKGIQTDVTNENEVKAMVQKTVACFGRIDVLINNAGMQHVSPIEDFPTETYKLLVDIMLVGPFMAIKHVMPIMRKQQFGRIINMSSINGLIGFSGKAAYNSAKHGIIGLSKVAALETAEDGITVNCIAPGYIDTPLVRNQMEALAKSRQVPVEKVLDDVIYPLVPQKRLITVEEVASLAIYLSSAEAKGITGQTLVVDGGYTVQ

SEQ ID NO: 92480 - protein, 295 aa, Moritella sp. PE36
MKITKAVIPVAGLGTRMLPATKAIPKEMLPVADKPLIQYIVNECAAAGITEIVLVTHASKNAIENHFDTSFELESTLEKRVKRQLLAEVQAIAPKGVTIMHIRQGVAKGLGHAVLCAKPIIGDEPFAVVLPDVLMDEVSADLKTENLASMMRRFDETGFSQIMVEPVPMNLVSGYGVADCGGVELSAGESTPMTAVIEKPAQDKAPSNLAVAGRYVLPAAIWDLLARTAPGAGDEIQLTDAIDDLMKLETVEAFHISGKLHDCGSKLGYMKAFIEYGLRHPEVGADLQEFIRGLK

SEQ ID NO: 92481 - protein, 335 aa, Moritella sp. PE36
MKYLITGAAGFIGSRCAELLCQQGHQVIGVDNLNDYYDVNLKHARLANTTKSALFTFLELDLADRDGVAALFAEHQFDRVIHLAAQAGVRYSIDNPMAYADSNLTGFLTVLEGCRNNQVKHLVYASSSSVYGLNNKTPFSTSDSVDHPISLYAASKKSNELMAHTYSHLYGVPTTGLRFFTVYGPWGRPDMALFKFTKAIIAGETIDVYNNGDMLRDFTYIDDIVAGVLQIQDVIPTPDTEWKVETGSPATSSAPYRVYNIGHGSPVKLMDYIEALEDSLGIKAKKNFMPMQPGDVYATYADTQDLFAVTGYTSKVKVKEGVKAFVDWYRDFYSV

SEQ ID NO: 92482 - protein, 132 aa, Helicobacter pylori
SNIKYELDKESGALMVDRVLYGAQNYPANYGFVPNTLGSDGDPVDALILSDVAFQAGSVVKARLVGVLNMEDESGMDEKLIALPIDKIDPTHSYVKDINDLSKHTLDKIKHFFETYKDLEPNKWVKVKGFEN

SEQ ID NO: 92483 - protein, 388 aa, Moritella sp. PE36
MNITIAGTGYVGLSNAVLLAQHNSVIALDIIAEKVELINNKKSPISDNEIEDFLENKELDLIATTDKQLAYANADYVIIATPTDYDVVHNYFNTKSVEAVIKDVMAINPSAVMVIKSTVPVGYTKEVKQRLGCDNILFSPEFLREGSALYDNLHPSRIIVGEQSKRAEIFAGLLMQGAVKTDIEVLFTDSTEAEAVKLFSNTYLAMRVAYFNELDSYAETHGLDTRQIIQGVGLDPRIGSHYNNPSFGYGGYCLPKDTKQLRANYENVPNSLISAIVDANSTRKDHIADAIIAKNPQVVGIYRLIMKTGSDNFRASSIQGIMKRIKAKGIKVVVYEPVLTESEFFKSPVLTDLNEFKALADVIVSNRLADELLDVADKVYTRDLFGND

SEQ ID NO: 92484 - protein, 317 aa, Desulfococcus oleovorans Hxd3
MKEPNNDFKIFSGNANPGLVEKICAYLGRPLGKAKVSRFSDGEVQIEINENVRRKDVFLIQSTCAPVNDNLVELLLMLDALKRSSVSKITAVIPYYGYARQDKKVAPRVPISAKLVADLLTQAGANKIITLDLHAGQIQGFFNVPVDNLFAAPVLITHIKKHFSPDNLVIVSPDAGGVERARAFAKRLDAELAIVDKRRSAPNQAQAMAVIGDVKDKIAIILDDMVDTAGTLTEAAAALDAKGAREVNACCVHPVLSGPAVDRITGSKLKQIIVTDTVPLNENAKQCNKIEVLSIADLVGEAMIRSYRGDSVTSLFV

SEQ ID NO: 92485 - protein, 1601 aa, Oryza sativa
  misc_feature (895)..(895): Xaa can be any naturally occurring amino acid
  misc_feature (909)..(909): Xaa can be any naturally occurring amino acid
MAAGRFVVRWPAAAADQEHSAQPSSAAGGVDARAIHDATVRSSLAGTCALASSRRSSAACPAPGRRRRREEEEATSDQSAAAIATRIGTREAATPRPTARSAAPAAAARLRAAPDDNPIRFAHPRTASARGARRPRPPLLLTSSLSTAAAAAVDDAESAVDTHELDAVDRASSSSSTTSTPNRRRAVPGREEVGAVHLVVTYQAKKRGVSGAVHRGHAPAQLAPGATTAALAVADLHYRLQEAGLLCHSVEHLAGLTLGAVLAKGRIMVFNLRETTRPADVVPFFAVHIRNNASQDPGGLTHASPHPVRMRASKHSSLAGAGVLAPGDGTLVPTAMFPRRACFRRKWRGFCVCSSKLSHSFVCAKLFLFSPMAEQAKAHNLSPSVSGDDGEPNPRRRARTPPPPPRQSPRREEALERVEGSATSTSTGDEEGRRDGERRLLVYGDGSTPQGALQAAGALLRHPPIVPDPESPAQRWLDDVANLVMTARQRLGAGGRSSATKTSGAATTGSVSSRRRARRAAAVARHSAATPSSAPPTQEDLRGGPDARISIERRRNGRRAAHATEGASSSGVSHQHGRGDQPSVPPVGGVGCRAFVASLRNVRWPPRFRPTIAEKYDGSVNPAEFLQVYTTGIEAAGGDDRVMANFFPMALKGQARVQRRDDESLRSYIQRFCQVRNTIPCIPAHAVIYAFRGGVRHNRMLEKIASKEPQTTAELFQLADRVARKEEAWTWNPSGSGVAASAAPGSAARSGRRDRRRKKRSAHSDDEGHVLAVEERRWRAALRAARYQQSLRRYHQRHVRARSLCVDDLVLRRVQTRAGLSKLSPMWEGPYRVIGVPRPGSVRLATGDGTELPNPWNIEHLRRFYPYIFDFLKAIKSAYNKKGARRPRKKKEKLXDWRRPGGSLRRARXAPDPQDGLRATAGRPHLSPSDPEANPVPTRPGREQGEEAPEPNGGLRPLTTGVGPLPACPTTPGAPDPQDGPEATVGRPPLSSSDPEVVGTEDECTPRGRLDKERPRDVAPSEEDRPHRKVQRPVYFVSEALRDAKTRYPQAQKMLYAILMASRKLRHYFQAHRVTVVTSYPLGQILYNREGTGRVVKWAIELSEFDLRFEPSHAIKSQALADFVVEWTPAPELVSAPEASSSPSQLPHTALWVIHNRPRGLAPSGGVGPEGDVFALLFVSPRGRTAPVSAPRAEAPRPLVGFVPCGLTHASPHPVRMRASKHSSLAGAGVLAPGDGTLVPVCGIRNPDTYLHGNGWSYLALFHGIYAVILLLSSSVASLRRRPALGTSACSEVTRISAAPSDLIVFFQPTRSARRLLTPTSVASFRAGMDEWVRQAEVWVGQAERWIRQQPPEQVYVAVAVVAVTVLLLVAVSCLKSSKANTIVLSGLSGSGKTILFYQRGKVKPVHVVDVPGHARLKPKLDEVLPQAAGIVYVVDAQDFLSTMHAAADCYGLTIFSFRRYLYDILTKATVVKKRVPVLIFCNKTDKVTAHSKEFIKKQLEKELNKLRESRNAISSADITDEVKLGNPGEAFNFSQCQNKVTVTEGAGLTGNVSAVEEFIREGTSSFSATTTDGKRHFTRCKGTFYPIGVPENKPWYEGAV

SEQ ID NO: 92486 - protein, 620 aa, Triticum aestivum
  misc_feature (150)..(150): Xaa can be any naturally occurring amino acid
MESGLIASHRLRLPALPSAAHAHLLRHRRLVATPLRLPTTPTPLRQPAALPLRPCLRPPRAASVASPAPVPGDAPDNSRKFLGVDALTLKKIVPLGLMFFCILFNYTILRDTKDVLVVTAKGSSAEIIPFLKTWVNLPMAIGFMLLYSKXLADVLSKEALFYTVIFPFIAFFGVFGYVLYPMRDAIHPTALADRLLASLGPSFLGPVAILRVWSFCLFYVMAELWGSVVISVLFWGFANQITTVEEAKEFYPLFGLGANVALIFSGRTVKYFSNMRQNLGPGVDGWAISLKGMMSIVVVLGFVIAGIYWGVNKYVIDKTSLPVERKKKNKPKLSMGESLKVLVSSQYVRDLATLVVAYGISINLVEVTWKSKLKAQFPSPNEYSSFMGDFSTATGIATFTMMLLGRLILRKFGWGVAATITPAVLLVTGVGFFSLLLFGEPLTPLLATFGMTPLLAAVFVGALQNIFSKSAKYSLFDPCKEMAYIPLDEDMKVKGKAAIDVVCNPLGKSGGALIQQFMILSFGSLANSTPYLGGILLVIVIAWLGAVRSLDSQFSPLAKQDLEREQQLKAEVVETTAQVVGTGNGSLQENVASQSSTNGTVIKQSQEPEITAPEKSGKQS

SEQ ID NO: 92487 - protein, 251 aa, Cryptococcus neoformans var. neoformans B-3501A
MARKFFVGGNFKMNGSLESVEKIVRSINDANLDGTNEVVIAPPALYLLKVQSELNAPTQVSAQNAFTESSGAFTGEIAPQQLKDANVHWVILGHSERRSLFGDTDKLVADKTKAAINAGLSVIACIGESLEERESDKTMTVVERQLEAIAAAIDVDAWKRIVIAYEPVWAIGTGKVATVSQAQEVHAAIRSWLSRRASPEIADSTRIIYGGSVNGKNCGELSAAKDIDGFLVGGASLKPEFIDICKSGKKA

SEQ ID NO: 92488 - protein, 356 aa, Oryza sativa Indica Group
MGVLCFGASNILLCAEDSSSVLGLGGFGGGGGEVAAELGCGGGGGFDFFGFGGGAVFPIDSDEFVALLVEKEMDHQPQRGYLEKLELGGLECSWRKDAIDWICKVHSYYNFGPLSLYLAVNYLDRFLSSFNLPHDESWMQQLLSVSCLSLATKMEETVVPLPMDLQVFDAEYVFEARHIKRMELIVMKTLKWRLQAVTPFSFIGYFLDKFNEGKPPSYTLASWCSDLTVGTLKDSRFLSFRPSEIAAAVVLAVLAENQFLVFNSALGGSEIPVNKEMVMRCYELMVEKALVKKIRNSNASSSVPHSPITVLDAACFSFRSDDTTLGSSQSNSNNKDYNSQDSAPASKRRRLNTTPI

SEQ ID NO: 92489 - protein, 391 aa, Chromobacterium violaceum ATCC 12472
MVPNYGPAGFIPVRGEGSRIWDQDGREFVDLAGGIAVNSLGHCHPELVAALTEQANKLWHVSNVFTNEPALKLASLLVEKTFAERVFFCNSGAEANEAAFKLARKYAHDNFGADKNQILSCVNSFHGRTLFTVSVGGQPKYTEGFGPVPGGIDHFEFNNIESLKAAISDRTCAVVIEPIQGESGVLPADPAFLKAARELCDQHNALLIFDEVQSGMGRTGALYAYQQYGVTPDILSSAKGIGGGFPIGAMLTTEKVAKSFGIGSHGSTYGGNPLACAVAHKVVSIVSSPEVLAGVEARHKRLVAGLEAINAKYKVFKQVRGKGLLIGCVLTDEYNGRAREFLKAAEKQQLMILVAGLSVLRLAPSLVISDADIAEGLKRLDAAIADLQSAK

SEQ ID NO: 92490 - protein, 520 aa, Borrelia hermsii DAH
MSKNGKEELKNIDNQAFDLIIVGGGATGLSIGIDSITRGYKTLLIDKFDYAKGTSSRSTKLIHGGVRYLAQFNLSLVKEALHEKALFEKNAPHLVSKRAFITPIYNLLSIPYYYFGLSWYHNLLGKYKKSKYKTKLLSKSKTIEKMPNIKTKGLKCSVLYYDNSFDDARMAISMLRTFTEKGGIAFNYTELTGFTKRNGKISGAIIKDTINGEQVIINSKCIINATGIFADELRKLDDTNATNIIKPSQGTHLIIKKDKLRTKYAMLMPTTSDKRVLFSIPWYDGIICGSTDISIDKIEEEPKRLESEIEFIIKNMNNYLDIKITKNDILSVYTGIRPLIIDPKKEQNTSKISRNEKIFVSDSNLITIAGGKYTTCRKMAEKVIQKAIDAKLIPDSIPKTENLKLHGYIEREEALKIPEHFRVYGSDFKYLSQMKDFNNKIHTDLPLTEAQITFAIEFEQAKTIEDILSRRTRSLLLNAKATIEATPKVAEIMMHKLGKSEKWKNEQIKSFKEVATKYLA

SEQ ID NO: 92491 - protein, 186 aa, Zea mays
RRSCRANPASARGAGGEGRAEGAMAAAAAAAKDAAVTLSSGHRMPAVGLGVWRMDKPDVRGLIHAALRLGYRHLDCAADYQNEAEVGDALAEAFQTGLVKREDLFITTKLWNSDHGHVLEACKDSLKKLQLDYLDLYLIHFPVATRHTGVGTTSSALGDDGVLDIDTTISLETTWHAMERTLVPWG

SEQ ID NO: 92492 - protein, 350 aa, Borrelia hermsii DAH
MKISIVGAGAWGTAISKVLADKFKDNVFIWSFEEDVRDSINNDHENVKYLKDIKLPDNLIASSDLLDVVSQSDYVFVATPSLYTLNVFNKLKSMYATKKFNLAILTKGFITIDGKPCPIVEVAESVLREYKDEITYIAGPSHAEEVGLGVITGLVAASKNRANAFEFIDLFSATSISMFYSDDVLGVQIASALKNIFAIAFGILDEIKIKDPNLIGNNTESFLFSVSLNDMRNIAFKLGACNEGTFLFLAGSGDLDVTCRSIFGRNRRFGREIISKNILEGLTDIDDLINNIHKIGYLPEGIVASKEVSVLLKYLGNNSNEHNLVNIVYKILNKELKPEAVVDYIRNFKF

SEQ ID NO: 92493 - protein, 820 aa, Aspergillus nidulans FGSC A4
MARVCPNTLSSVIDAKRPAGDWVVQLTLLSPFHAVNSARNLLANAGFQEIKEKDSWASTCRPGGKYYLTRNQSTIVAFAVGKKWKPGNAIAMIGAHTDSPVLRIKPVSNKRGEGYIQVGVETYGGGIWHTWFDRDLGVAGRAMVRTDDGSIVQKLIKIDRPILRIPTLAIHLERQETFSFNKETQLFPIAGMIAAELNRTGQAEGASDKSNTAAESENAEFSPLKAITERHHPHIVELIAAEAGVEPADVLDFEMILFDTQKSCLGGLMEEFIFSPRLDNLNSSFCATAGLIESVADESALDDESTIRLIALFDHEEIGSRTAQGADSNVLPGIIRRLSVLPSTAGDVDTSTAYEQTLSTSFLLSADMAHAVHPNWSAKYENDHRPEINKGPVIKINANARYATNSPGIVLLQEVARKAVETEGEGVPLQLFVVRNDSSCGSTIGPMLSAALGARTLDLGNPQLSMHSIRETGGTYDVAHNVFRDAEYIADVSGIQYGSITEASPTLQDDSLRKKLQTAAKLAFIDRLLRDLDILIYCELSALYYLDCSIVLFAIRAISQLIFFTPKAPPFDPTRNQPFVGAIIASNVFCMIFHKFFSQSEAGEATRDYLHGGILIDFIGQKAPVPLFRLLCLDLLIMVLNIVMLGLIIERVKLAELRTTTAAVSATAAADTTAQADSAQAQDHDHEERGVLSHETEARGESTNAENERIEQSSHTALSSTHSPPPSEEELERTRLLADPSENGGSHTNHQHALDAYSSGGAVIVRLGLWNVIRDQWRYSPSAVRRSATYAPSHQTAAFLRERFGLQVGADGRLERITTT

SEQ ID NO: 92494 - protein, 179 aa, Oceanobacter sp. RED65
MGVRSFKGHTPKLGETVFVDPTSTIIGDVEIGDDCSVWPNAVIRGDMHKIRIGHRTSIQDGSVLHITHASDYNPGGYPLIIGNEVTIGHMAMLHGCTIGSQVLIGMQSMVMDGAVIEDQVVLGAGALVPPNKTLESGYLYVGRPAKKARALTDKELAYFSYTAGNYVKLKNEHIAEGYK

SEQ ID NO: 92495 - protein, 282 aa, Pseudomonas syringae pv. phaseolicola 1448A
MTAPSLLIAGCGDIGSRLATRLLPHGWTVHGLRRTVSELPAGVHGVAGDLFDTRKPALWPAAALDYVVYCATPSKRDEAGYRMAYVEGLRNVLSWLEQTGQRPKRLIFVSSSGVYGQQNGEWVDEDSITEPANYTGTVMLEAEQLALNSGLPATAVRLTGIYGPGRSDLSNRVRQGHSVRIDPPVYANRIHADDAASLLEHLLQADQRGVALESCYLGVDDDPAALADVVAWIREYLGVTEWSEEVSVQRVGSKRCSNARARALGWTPMYPDYRAGYAALLG

SEQ ID NO: 92496 - protein, 348 aa, Leifsonia xyli subsp. xyli str. CTCB07
MEATAEQPRAGVPRTGLLATIGEAMVVLYPEDRRPLAEAHTYASAVGGAEYNVATSLARLGLPTAWISRLGADGLGDRILKTANEAGVDTSAVERDELRPTGLYLKETSDGPDGVRTRMRYYRRDSAAAALSNGLLRSAPAADLLGRASIVHTSGITPALSASAAEAMSDLRSAIGPQTIVSVDLNHRPLLWAGRETEPLDALIGQADILLLGRDEAEAYAGHADPERFFAANPRLGVLVVKDDARRASVYRRDGGETHVPCLTVEVVEPVGAGDAFASGFLCGLAEGRDDASALRLGHALAALTLIGHGDRPLTVPDNAQRDRIAAVPETEWAGWSVRPGEIPWNGA

SEQ ID NO: 92497 - protein, 433 aa, Oryza sativa Indica Group
MAAAAAESAAATALRAVLGRAAKAAERSGRAAEAVRVVAVGKTKPVSMVRELYDAGHRCFGENYVQEFVTKAPQLPEDIRWHFIGHLQSNKVKSLLAAVPNLHMVEGVDNVKIANHLDRAVSSLGRDPLKVLVQVNTSGEESKSGIDPSRCVELAKHVKLACPHLIFSGLMTIGMKDYSSTPENFKALVNCKLEVCKAIDMPAEQFELSMGMSGDFEQAVASSMAGSEDLSGLTASLGELHVESSALKDSEISHPGNAFDDDAIADDDVWDDVSDSPGHGSTLDREWAHRQNQFHKMGYRDGIAEGQKDIAQEGFNVGFGQSVHVGYKWGLVRGITSALASLPDNLKEKMFPNVQCRGQLQDLNNSVQEISAEDALQMFHESILRSSHSSEEPDATLKRATDSSRLQSLSKDLVILLHECPDVKVSEELTGDS

SEQ ID NO: 92498 - protein, 318 aa, Prunus persica
METFPVVDLSQITGEKREAAMEKMNDACENWGFFELVNHGISHELMDTVEKLTKEHYKKCMEQRFKEMVASKGLEAVQSEIHDLDWESTFFLRHLPVSNISQIPDLDEDYRKVMKEFAVELEKLAEQLLDLLCENLGLEKGYLKKAFYGSKGPNFGTKVSNYPPCPKPDLIKGLRAHTDAGGIILLFQDDKVSGLQLLKDGQWIDVPPMHHSIVINLGDQLEVITNGKYKSVMHRVIAQPDGTRMSIASFYNPGDDAFICPAPALLEKETENISAYPKFVFDDYMKLYSGLKFHAKEPRFEAMKAMESTVNLDPVATV

SEQ ID NO: 92499 - protein, 288 aa, Brassica napus
  misc_feature (260)..(260): Xaa can be any naturally occurring amino acid
  misc_feature (268)..(268): Xaa can be any naturally occurring amino acid
MVARKRVKYAVVDAFADSAFKGNPAAVCFLDDDDQRDDAWLQSLAAEFNLSETCFLTPITVSDDQVLPRFSLRWFTPVAEVDLCGHATLASAHVIFSNSLVDSEVVEFATRSGILTAKRVPLTEEESTFLIELDFPVVPTCEVNSTTDLSVFSNAVNGAAIVDIKATEKDVLVVLSSWESVTELQPRIDEISKCPCQGLMVSAAASAGSQYDFCSRYFAPNFGINEDPVTGSAHCALAHYWSSKMNKCDFLAYQASRRGXTLNVHLDXEKQRVLLRGKAITVMEGCVL

SEQ ID NO: 92500 - protein, 485 aa, Desulfitobacterium hafniense DCB-2
MDNLDPVVKEQNDIVVKVQNDTKTKVYALIGAIILGILVWFLGEGLGPQGRMALALTMTAIVLWIFEVYPVEITAVLLSTFFVFTGSATPVEAFSGYGDAIVWFIFAALVFGTAVEQSGIGKRIACSLMRFSGTSFKSMMGIIVLVGALLSFLTPAGVERLLIIYPIAIGVAAVFVKGNVQGTNTGKLAMSITYLAGNTFGFGILTGIAVNILGAGIIKEMLGIEIFWSQWILWFGVPTVITTLIAIFVAWKLFPPEDYVLTAKKENANQDFMNLGPMTIVEKRALLYLVITLGLWATDRWHHLPSWGVAIFSAALFCAPGFGVISKEQLKKIQFPIVIFSGAAITIGTVLGKTGVAAWIGKVFLGSFIRPDMSTQLMGAITYLVGVVAHIPLVESKTAAAAFTPAVAAYFDSMQLPALGPTLMSIMSADTVAFFPYMMMPFLALMGLGYFTTKDSIKLLSSYTFVAIIVQVISCFTWYHWVGLL

SEQ ID NO: 92501 - protein, 299 aa, Prochlorococcus marinus subsp. pastoris str. CCMP1986
MSKRHPVVAVTGSSGAGTSTVKRAFEHIFAREDIVPAVVEGDSYHRFERMPMKKAMAEALSKGENFSHFGPEANLFDKLEELFKIYGESGGGKKRYYLHSTEEAQEHNARLGTSLEPGQFTPWEDIPNGTDVLFYEGLHGGVEGEGYNVSSYADLLVGVVPITNLEWIQKIHRDNAERGYSAETIVDTILRRMPDYINHICPQFSKTDINFQRIPTIDTSNPFICRNIPTPDESFVIIHFRKGAREKWGIDFQYLLGMIHDSFMSSPTSIVVNGGKMGFAMELILTPIIHKMIEEKKHS

SEQ ID NO: 92502 - protein, 357 aa, Prochlorococcus marinus subsp. pastoris str. CCMP1986
MKRYKVVLLSGDGIGPEISEISITILKKLSKKYGFNLDIKEEYFGGIAYEKHNDPAPKETLDQCKASDAVLLACVGDVKYDTLPRELRPESGLLKLREALNLFANIRPVKIRKSLLDSSSFKKEVIENVDLIVVRELIGGIYFGQPRGEITQTKIKKAFNTMVYDSNEIERITEVAIKIANQRSKKICSVDKSNVLEVSQLWRDTVSLVASKENDLALSNMYVDNAAMQLVKDPGQFDVILTSNLFGDILSDLAAMITGSIGMLPSASLSNSGPGVFEPVHGSAPDIAGKNIANPIAMALSTSMMLKIGLNEIEAADDIEIAIDNVLSKGYRTSDLDNGNCQVLSCSEIGEKIIQEI

SEQ ID NO: 92503 - protein, 105 aa, Glycine max
MASRQNNKQELDERARQGETVVPGGTGGKSLEAQQHLAEGRSKGGQTRKEQLGTEGYQEMGRKGGLSTVDKSGEERAQEEGIGIDESKFRTGNNKNQNQNEDQDK

SEQ ID NO: 92504 - protein, 690 aa, Desulfococcus oleovorans Hxd3
MEALTGNLPLLCTLIGVVGIIYSLIMAGIVKSAPAGNEKMNQIADAVKEGAIAYLNRQAKSMGITGIIICVVIWFTMGSLTAIGFAVGAIASFFAGYIGMRVSVIANVRTAEAARGGLSKGLAMAFRGGSVTGMIVAGLALTSVAGYYAFLLSKDLTGVNAVIPLVALGFGGSLISIFARLGGGIFTKGADVGADLVGKVEAGIPEDDPRNPATIADNVGDNVGDCAGMAADLFETYAVTAVAAMLLGALFFKANGPEVQSIAINFPLVLGAVSIIASIIAIFFVRLREGSDYIMGALYKGMFGAAAISAVAFYFVAKKMLTGVEGMDAMNLYYCSLIGIILTVVIVIITEYYTGKYQPVKDIAEASTTGHGTNIIAGLAVSMQSTALPVIAICIAIYVASTLGGLYGIAMAAMSMLSMTGMVIAIDAYGPITDNAGGIAEMAGMDESVRAVTDPLDAVGNTTKAVTKGYAIGSAGLAALVLFACYVMEFQFHEGGDHVALIFDLSDVRVLIGLFIGGLLPFLFASIAMKAVGRAGGAVVDEVRRQFREIPGIMEGTAKPDYSACVDLVTKFAIKEMMVPALIPVVAPIIIGVLFGKVGGPYAVGGLLIGSIVTGVFLAISMTTGGAAWDNAKKYIEDGNFGGKGSDAHKAAVTGDTVGDPYKDTAGPAINPMIKIVNVVALLMVPVLFL

SEQ ID NO: 92505 - protein, 463 aa, Pseudomonas putida KT2440
MQTHKNNLSHGLKSRHVTMLSIAGVIGAGLFVGSGRAIAEAGPATILAYILAGGLVVLVMRMLAEMAVASPDTGSFSTYADLAIGKWAGYTIGWLYWWFWVLIIPIEANIAATIINSWVPQLEIWVLSLVITLLLTATNLFSVKNYGEFEFWLALVKVVAIVSFIALGVCAIFGLLPGAGVSGVSRLWDTGGFMPNGFGAVLSAMLITMFSFLGAEVVTIAAAESDEAGKHISKATNSVIWRITLFYILSIFIVIALVPWTDPRLATEGSYVTVLDTLGVPNAKAIIDFVVLTSVTSCLNSSLYTASRMVYSLSRRGDAPACAQITSRSGTPVVAVLLSTGAAFLAVIANYLVPAKVFGFLMASSGAIALLVYLVIAISQLRLRQRLTAQGKTLGYRMWLFPWLTWGVILFISGVLVLMLFRPDHRLEVVSTMVLAVLVVCSGVLVTRRRARGGAVAGVGQGA

SEQ ID NO: 92506 - protein, 330 aa, Prochlorococcus marinus str. MIT 9211
MSIPPVIVAIARESWRWQWEQLMKGLAPADKSGNFQRVPSQVTNAVVPIKENLVNRHANEFPRLIIGRSCPWAHRTWLVYQIRGLQTSLDLLLAKADHRQGLWKIEPSWLGCSSLLDLYKLCGISPKHRATVPAIIDPKSTHTNAPKLLGNESAQLIEVLNEWPAKENSPDLFPHRLRKEINECSKILQSSINDGVYKCGFARNQKAYENASEELFNGLNEVELRLSKKGPWLCGENLTLADIKLFPTLIRWEAIYAPLFKCSKKPLLLFPKICEWRRRLFHIPEVMKTCNSIDWQNDYFGALFPLNPSNIVPNGPDLTTIVNSSRKTMK

SEQ ID NO: 92507 - protein, 203 aa, Candida glabrata CBS 138
MSEYKNLPVTVEKPIPVTYDLGNLSVFDTNVIDRNDVDSSNAKREEVIKSVTRDNVQLLINQLLSLPIKKTTEHTGGNSGQGATVALLQLPEPSSELPREKPLPKPKALTKWQKFAAKKGIKPKERAGKMVFDEATGKWAPKWGYNGINKKLDDQWLVEVDDDTKGTENELIDPRSLNRAERKRLVKKNERQQKKNLKNAMGQ

SEQ ID NO: 92508 - protein, 178 aa, Prochlorococcus marinus subsp. pastoris str. CCMP1986
MNDHNSKDNYEAQTLILNDSNGNELFCYLEQIVKVEEKEYALLTPVDTPVSLFKINENDEPELIEKIEKNEQVLKNADAVLQEHDLKLIRSAVTLTVSGELEEPIYDELEEDGIEEESETYELLVSFNLLEQEYGLYIPLDPFFIVGKLINQGALLIEDDEFDKVQPLIESELEKSSF

SEQ ID NO: 92509 - protein, 575 aa, Rhodospirillum rubrum ATCC 11170
MDSPRIAPRPSITRPPEEDSFLALFTPKLVTMLRDGYGLGDLRADALAGLTVAIVALPLSMAIAIASGATPEQGLFTAIVGGFLISALGGSRFQIGGPAGAFIVLVAATVAEHGFAGMILATFVAGLILVAMGLLRLGTYVKFIPYPVTVGFTAGIGVVIFTTQIKDLLGLSLSGPEPGEILPKLMALGSALPSITPAALLISIPTIAFIVLQKRFRPGWPGMLLAVALGSFTAWLFNMPIETVGSRFGEIPRTLPLPSMPVFSFDLLIAVLPDAAAFALLGAIESLLSAVVADGMTGRRHRSNCELVAQGIANMASALFGGVCATGTIARTATNVRAGARGPIAGMLHALFLLGFLAVAAPLVSYIPLASLAAVLAIVAWNMIERHAFAVLLRTSRGDTVVLMATFLLTIFRDLTEGIVAGFLIGTLLFLNRMAKATVVEADQPLIAEDRADGAFGRSAYDAALASDPRVVVYRISGAFFFGAASTVGSVLDRIADQRKAFVLDFAAVPFLDSTAANAIEGAVRKAQRHKVKVFFTGASPKVRRTLLAHDLRPPRVIYKRTIDDAVTAVKAEPI

SEQ ID NO: 92510 - protein, 132 aa, Helicobacter pylori
SNIKYELDKDSGALMVDRVLYGAQNYPANYGFVPNTLGADGDPVDVLVLSDVAFQAGSVVKARLVGVLNMEDESGMDEKLIALPIDKIDPTHSYVKDIDDLSKHTLDKIKHFFETYKDLEPNKWVKVKGFEN

SEQ ID NO: 92511 - protein, 699 aa, Desulfococcus oleovorans Hxd3
MLNAILSMLGLGMASSVILGVASRVFYVYEDPRIAEVESATAGANCGGCGYAGCSAAAAAVVKGEALPSVCIVGGPDSAANIAAIMGVDPGTAEPRVSENECTGGNRAENKYNYKGILSCNAVTALYGGRRDCPTGCLGYGDCIKACAFDAIVMGEDGYPVVDPAKCVGCGACEAVCPKNIIRVKTMSQRLFEFNATNGAHAPCTQTCPAQIDIPKYINQIKTGDYEGAVNTIRERNPLLLACGRVCPHPCEDKCRRGVVDEPVSINQLKRFAADYEMNSGKRLPISCAPSTGKKVAVIGGGPAGLTAAYFLRRVGHGVTIFDDNPELGGMIRYGIPEYRLPKKVLKWETDGILNMGIEHKPNMRLGRDFDMGSLMAAGYDAIFLGIGAWKDYGLKIEGNDLKGVYTGISFLTKFAAWQQGAGTDPVPVGRKCAVIGGGNTAIDCVRTLVRLGAEEVSIVYRRTRNEMPANMVEIEAAEHEGVNMKYLFSPNRILGDENGNVVGLEVQEMELGEPDASGRRKPVPKEGAVQVLETDMIVLAIGQGPDISFKETEKGRRGEALATTKWDTIDQIDPQTLQTNIPYIFTAGDSATGASLVVEAIGGGRRAARSIDLYLSGQPVTPPPNDLFKTHIPGCLFETVDGVTKSKRVEMPELEVSSRIKTFDEADLVISEENALKEADRCLFCCTTCYNREDGCKL

SEQ ID NO: 92512 - protein, 430 aa, Oryza sativa Indica Group
MEQTNAAASSAKPIRCRAAVSRAAGQPLEMEEVEVAPPRAHEVRIKIICTSLCHTDITFWRMEGLHPSIFGHEAVGHTKVKMLIISRVLYPFHNKKSNQKSSKLTGGRIPFSPSVVESVGEHVREVAVGDTVVPVFTAQCSECPDCLSDRSNICSKLPDVHGFMPRDGTTRFSSASTGEPIRHFLSVSSFVQYTVVDVSHVVKLDANFPPAMACLLSCGISTGVGAAWKVAAVEPGSSVAVFGLGAVGLAVAQGARMRGATRIIGVDLNPDKFDVGKRLGITDFINPNDTGGKTVSEVIKEMTGGGGADYCFECIGSASVMAEAFQSSRMGWGKTILLGVIGSMAPIGIPPQDLLPGRSVIGSLFGGIKPKNDIPMLAQKYLDKELELEEFITHEMGFEEINRAFELLTQGKSIRCIIWMDGAKVIDNGE

SEQ ID NO: 92513 - protein, 300 aa, Oryza sativa Indica Group
MVVPVFAAQCSECPDCLSDRSNLCSKLPNVAGLMPRDRTTRFSSVSTGEPIRHFLSVSSFAEYTVVDITHIVKLDVGFPPAMACLLSCGISTGVGAAWKVAAVEPGSSVAVFGLGAVGLAVAQGARMRGAKRIIGVDLNPDKFDVGKRLGMTDFINPNDTGGKTVSEVIKEMTGGGGADYCFECIGSTSVMAEAFQSTRNGWGKTILLGVSGNKAPISIPSHEILRGRSVIGSLFGGIKPKNDIPMLAQKYLDKELELEEFITHEMGFEEINRAFELLTQGKSIRCIIWMDGAKEIDNGV

SEQ ID NO: 92514 - protein, 86 aa, Zea mays
  misc_feature (56)..(56): Xaa can be any naturally occurring amino acid
DNKDMTLVYRLLNMPLTHMLDKVGRERTTTNMDGDLDTKERVTTVQLFAALPAVDXETVEVKRIHNCRGLSYEWPAYISRTYYLRK

SEQ ID NO: 92515 - protein, 174 aa, Bacillus anthracis str. A2012
MVIMLAPFDWGSYTIGDVDLPIQHLVGALIFIVASATDWIDGHYARKYNLVTNLGKFLDPLADKLLVSAALITLVEMQYVPAWIVIIIISREFAVTGLRLVLAGTGEVVAANQLGKIKTWTQIIAIAAYLLHDVPLNLIHIPVADIFIWIALIFTVISGWDYFWKNRAAFVNSK

SEQ ID NO: 92516 - protein, 132 aa, Helicobacter pylori
  misc_feature (106)..(106): Xaa can be any naturally occurring amino acid
SNIKYELDKESGALMVDRVLYGAQNYPANYGFVPNTLGSDGDPVDALVLSDVAFQAGSVVKARLVGVLNMEDESGMDEKLLALPIDKIDPTHSYVKDIDDLSKHTXDKIKHFFETYKDLEPNKWVKVKGFEN

SEQ ID NO: 92517 - protein, 127 aa, Desulfitobacterium hafniense Y51
MSDMYTEKVMDHFMNPRNVGEIEDANGVGEVGNAKCGDIMRIYLDVEGDIIKDVKFKTFGCGAAVATSSMVTEMVKGKSIDEALQITNAAVAEALDGLPPAKMHCSNLAADALHEAIKDYKEKTLKV

SEQ ID NO: 92518 - protein, 325 aa, Glycine max
MAVERSGIAKDVTELIGKTPLVYLNKLADGCVARVAAKLELMEPCSSVKDRIGYSMIADAEEKGLITPGKSVLIEPTSGNTGIGLAFMAAARGYKLIITMPASMSLERRIILLAFGAELVLTDPAEGMKGAVQKAEEILAKTPNAYMLQQFENPANPKVHYETTGPEIWEGTRGKIDALVSGIGTGGTITGAGYGRGGRNPNIKLYGVEPVESPVLSGGKPGPHKIQGIGAGFVPGVLEVSLVDEVVQISSDEAIETAKLLALQEGLFVGISSGAAAAAAIKIAKRPENAGKLIVVIFPSFGERYLSSVLFESVRREAESLTFES

SEQ ID NO: 92519 - protein, 673 aa, Cryptococcus neoformans var. neoformans B-3501A
MAQSAASACGPSNMVGSVHLADVQGVSREINPYDRNGMFVGAHTICRMFPSSLVPSFTQPAIVFQRPTPPPLAVPSSVQHASSATNSLSASQASQATSVLTDDEEDLEDYRPGGYHPVNIGDEFNNGRYRIVRKLGWGHFSTVWLARDNVANRHVALKVVKSDGHYTETALDEIQLLQRVVSSAPGHAGRHHVLDLLDSFRHTGPNGSHVCMVFEVLGENLLGLIKRYQHRGVPQHIVKQIAKQVLLGLDYLHRECRIIHTDLKPENVLICIDDVESVVQAELASCPAAVPTKLVGVPPSQGRLGNQTPRKDGIFIVGSQPLPSPSSSYSSSPMLDKYGFGMSKISGASAAKAGNQPSGVGGPSYPPTQPKKSATTEAIGTDLENVKLGEGSSLKWEKTATPAPAPPKGPSLLSQQLHHPPASPPLNPSVPSGSASVSTNHTINTATDETEVSTPATTPDHVTRLSDERAPEAGDPTTLPPPFPYDPVSLERITVKIADLGNACWVDHHFTNDIQTRQYRCPEIILGTRWDESVDMWSAACLFFELLTGDYLFDPQPGVKYDKDDDHIAQIMELLGEMPRSLALSGKYSHEIFNRRGELRHINRLRFWPLTSVLKEKYLMEHEDAELLSSFLMPMLAYLPGQRAKASDLLNHPWLEGVVVQGELEMAQSLHKS

SEQ ID NO: 92520 - protein, 754 aa, Aspergillus nidulans FGSC A4
MVSTVSALQARLKELSTSVAQIHPLVSRLHNFTTAVGQGDDARLELGAVIHSRLKDAEDELELIKDDVDDLESTTDSRRRGAGLEKETEKERVIALARRLANDLKRTRGDFRNAQLQAKRNAELAKRKERELLFARSAGGTEKRNPAKEKLTQEDIVKNASKDVTAALRRTHQLMQAELSRSQFAQETLEQSGAALSSLSESYTNLNTLLSSSRNLVGSLLRSQKSDTWYLETAFYILVGTISWLVFRRLLYGPLWWIVWMPFKLILRSVFGVAGAIGVTSKAVQSSVAIGTDGVAQETLALNHIPEAKAHVVGDTVPDDVPGTDAADLDWVMDKIGEIVEENTDQEGANLDDFSLEELQRQEDMPSNTKKRINKARAAAAFSSSKQKPTEGKEEQSRLQPWVEKYRPKTLDDVAAQDHTTKTWARTNQAALQLPHMLFYGPPGTGKTSTILALAKSLFGPALYRSRILELNASDERGIGIVREKVKGFARVQLSHPTGLDAEYFEKYPCPPFKIIILDEADSMTQDAQSALRRTMEQYSRITRFCLVCNYVTRIIEPLASRCSKFRFKPLDNSAAGDRLAQIAQLEKLSLENGVVDKLISCSDGDLRRAITYLQSAARLVGAAKAAKDGDEDEEMKDQGSDMITVSTIEEIAGVVPESVLDGLIQSLQPKRMGSPYEAVSKVVTEIVADGWSATQILLQLYRRMVYNDAIPDIQKNKIVLVFSEMDKRLVDGADEHLSILDVALKISGILGGT

SEQ ID NO: 92521 - protein, 407 aa, Triticum aestivum
LGRTSLYKKAGWYRSGIPGISSTHASGAVMSKNDSMSTVFRCLSKGAVDFLVKPIRKNELKTLWQHIWRRCHSSSGSESGIHTQKCSKPKAGDEYENNSHDDDDDCGSHDDDDDDDDDADDDFSVGPNARDGSDNGSGTQSSWTKRAVEIDSPQLLSSDHLAESPDSTCAQVIHPRSEIGSNRWLPTANKRNINNQKENNDDSMGKYLEIGAPRNSSLGYQSSPNEMSVNPTEKQHENLTSQNKSVNKIVIDKPTCQTADLISSIARNTESKQAARITDAPDCSSKMPNGNEMKNDSPINMPSQELGLKISETTRCETEIHDERSIPKRSNLSAFTRYHTPMASDQGGATFRGSCSPQDNSSEAVKTNSTCKMESNSDAAQIKQGSNGSSNNNDMGSSTSVYIYLYT

SEQ ID NO: 92522 - protein, 350 aa, Thermoanaerobacter tengcongensis MB4
MSIMDGLMTAVVKQYHKEGADIVKKEIPKIGPDEVLIKVKATSICGTDVHIYVWNEWAKSRIKPPKTMGHEFVGEVVEIGENVTSVKVGDLVSAETHIVCGKCRACRTGNAHICENTLILGVDTDGAFAEYIKVPESNVWINDKNIPLEILSIQEPLGNAVHTVFSGDVVGKSVAVIGCGPIGMMAIPLLKRTGAAAIFAIEPADYRRELAHKLGATRVINPLREDVVSIIKSETEGYGADVVLDFSGNPTAIRQGLEYIAKGGRMSILGLPDNEVPIDITNNVVFKGITIQGITGRRMYDTWYTVKGLLKSGLAEDLKPIITHTFPLTEYQKGMELMIKGQCGKVVLYP

SEQ ID NO: 92523 - protein, 381 aa, Clostridium perfringens str. 13
MVIVIDDEGRENEGDLVMAGELVTGEKINFMATYGKGLICAPVSESIAENLGLNPMVSHNTDNHETAFTVSIDYKDTTTGISAFERAHTIKELINEESKAEYFRRPGHVFPLIAKNGGVLKRDGHTEAAIDLAKLAGLKEVGVICEIMKDDGTMARTDELLEFAKIHNMKIITIEDLIAYRTERDNFVYRVVETNMPTKYGDFKAIGFIDKLTGEHHVALVKGEIKSEEPVLLRVHSECLTGDVFGSRRCDCGEQFHSAMEKINEEGKGILLYMRQEGRGIGLINKLKAYKLQDEGLDTVEANIALGFPEDLRDYGVGAQILKDLGVREIRLMTNNPKKITGLEGYGLKIVERVPIEIKCNEENEFYLKTKKEKMHHLIMQ

SEQ ID NO: 92524 - protein, 153 aa, Clostridium perfringens str. 13
MRILEGNLIGQDKKFAIVAGRFNEFIVSKLIGGALDAFKRHGVEEENIDLAWVPGAFEIPLIAKKLAKSGKYAGVVCLGTVIRGATSHYDYVCGEVSKGIANVSLDTEVPVIFGIVTTENIEQAIERAGTKAGNKGFDAAMAAIEMANLLENI

SEQ ID NO: 92525 - protein, 324 aa, Triticum aestivum
AYLGDTIEQVCTKKQAGTGPEFPGYRRPTRPRTDRNRGYGFVEYYNNACAEYSRQKMTAPNFKLDTNAPTVSWADPKNGDSASTGSTSQVKSVYVKNLPKNVTQGQLKKLFERHGEIIKIVLPPSKDGHDNRYGFVHFKDRHMAMKAVKSTEKYELDGQLLDCSLAKPPADKKDDAVSLPTAKGGPLLHAPLGYGMPRPDPYGAPPAYGAPPAYGAPPAYGGQPLLYAPGAPPGAAMVPMLLPDGRLVYVVQQPGAQQHFASPPPQVRQHQHFTSPPPQARQIGRHGGSGGGGGSGGSSRSGSGTKRPRGEDNNSSSRNRQRRY

SEQ ID NO: 92526 - protein, 241 aa, Candida glabrata CBS 138
MAPQYISEEYESMIDAVLTYCDEEVSLNSLRAQLNEVFSLNIKSFDLNLRTLVDKKLEAFKNVTEKPKVKDISTDKVMTENRRYINVIKQTLKEAELKKEGITVTKVQKPKLKLKVTNSKKSMIHIKMTVTPELQAVIGTHYQSRTEIVRNLWKYIKEHNLQNPDDKRQIISDAMLEPVLGKTSDIFMMHRALKHHILGPAPIEAEVIRTDQESTPSLASESSEQEHADSTDTSDSVYYST

SEQ ID NO: 92527 - protein, 341 aa, Synechococcus elongatus PCC 6301
MQLSRNDAMRVGINGFGRIGRLVLRAAWDWPELEFVQINEPYGEAAAAAHLLEFDSSQGRWSREITATVDSLTIEGRSLHYSRAKEPTAIDWAAQGVELVLECSGQFRTTEKLEPHFQAGVQTVIVSAPVKEALNIVVGVNDDRYDPSQHRLLTAASCTTNCLAPVVKVLREAIGIRHGLITTIHDQTATQSIVDSYHKDLRRSRAAGQSLIPTSTGSATAIGLIFPELQGKLDGLAVRVPLLNASLTDAVFELERETSVAEVSGLFQAASSGSLQGILGYEERPLVSVDYRGDARSAIVDALSTRVINGTQVKVLAWYDNEWGYSNRLAELARKVARAAV

SEQ ID NO: 92528 - protein, 334 aa, Clostridium acetobutylicum ATCC 824
MKKNHTITLIPGDGIGPEVTGAAKKVIEAAGVSITWDIVEAGAKVMDEYGTPLPEYVLESIKKNKIALKGPITTPVGSGFRSVNVALRQTFNLYANVRPIKTYEGIPTRYKDVDLIIVRENTEDLYAGIEHKIGDYAAESIKIITREASERIADFAFDMAVKQNRKKVTAVHKANIMKFSDGLFLDCARKVAEGYKEKEFEDMIVDAMSMKLVQNPEKYDVLVMPNLYGDILSDMAAGLVGGLGVAPGANIGKEISIFESIHGSAPDIAGKNIANPTAAILSGVMMLRYIGELEAADKIDNAIKVVLKEGTKVTSDLGGNATTDEFANEVIKNI

SEQ ID NO: 92529 - protein, 497 aa, Bordetella parapertussis 12822
MSEVHRLPLLIGGKLVQSKTTQWRDVINPATQEVVAQVPFATREELDLAVANAKEAFKTWRNTGQGARMRVMLKLQQLLRDNTGKLAEMITREHGKTLPDAEGEVGRGLEVVEHACSIANLQLGEYAENAAGGIDVYTLIQPLGVCAGITAFNFPVMLPCFMFPIAVACGNTFVLKPSEQDPSSSLFLAQLALEAGLPPGVLNVVHGGPDIANGLCEHPDIKAVSFIGSTRVGTEIYNRASAAGKRCQSMMGAKNHCVILPDADPEVALNQLVGAAFGAAGQRCMATSVAVMVGEARNWLPDFVERARKLKVNNGVDREADLGPLVSPAAKQRVEGLIQKGVDEGAKLLLDGRSLKVAGFEQGNFVGPTIFDGVTENMTIYTEEVFGPVLCVVGVDTLEDAVEFINRNPNGNGVALFTQDGGAARYFQNNIDVGQVGINIPIPVPVAWFSFTGSRGSKLGDLGPNGKQAVQFWTQTKTVTARWSAHGRGVNTTISMK

SEQ ID NO: 92530 - protein, 297 aa, Aggregatibacter actinomycetemcomitans
NRDHYRIFNDDMQGTGAIVMAAVFSGLKVTKQNFAEQRLVVYGAGTAGTGMADQISAAMQRDGLSREEAKKRVWLIDINGLVTDDMPNLPDYQQEYARPAAEAAAWAKTDGKIGLLEVVKQVKPTILIGTSTDHGAFTEDVVKALCAGVERPILLPLSNPTERIEVMPTDAVQWSDGKALISVGIPVPPVPYKGVNYQIGQANNAMLYPGLGLGVIVSGAKQVTDGMLLAAAEAVASQVNPQDEGASLLPPVDNLRASSATVAVAVAKQAVKDGVAANTSDNWVQAVQDAMWQPEYR

SEQ ID NO: 92531 - protein, 501 aa, Gibberella zeae PH-1
MSEHYPTLAQTALVAAAFKILLFPAYKSTDFEVHRNWLAITNSLPLEKWYVEKTSEWTLDYPPFFAYFEWILAHVARLVDPLMVKVYNLDYDSWQTVYFQRTSVIVTELVLVWALQTFIETAPLKSRRAAQTVALSIILSPGLLIIDHIHFQYNGFMYGILVMSLVLARQNSELLSSGLIFAALLCFKHIYLYLAPAYFVYLLRAYCLSSKSIFRIRFLNSIKLGLGIGAIFGAAFGPFAAMDQIPQLLSRLFPFSRGLCHAYWAPNVWALYSFADRILIHVAPRLGWAVNKSALQSVTRGLVGDTAFAVLPEISPRTCFVLTLFFQVVPLIKLFFQPTWETFIGAVTLCGYSSFLFGWHVHEKAILLVIIPFSLIALRDRRHLGAFRPLVVAGYVSLFPLLFTPAEFPIKTIYTIVWLVVFLLAFGRLAPASNKPRIFLLDRFSTLYIAISIPLILYCSLLHHLIFGKAYEFIPLMFTSSYTAIGVVGSWVGYMVVYFTA

SEQ ID NO: 92532 - protein, 69 aa, Zea mays
MAPASCGRSSQRVFHFGKGKSEGNKNMKELLGGKGANLAEMASIRLSVPPGFTGSTEACQQYQEVGAPF

SEQ ID NO: 92533 - protein, 1150 aa, Desulfitobacterium hafniense DCB-2
MKEVTKQQRIRVTVNGRQMEVYGDLTILQALLQEDIHIPHLCYDIRLERSNGNCGLCVVELGEGSEQQDVKACHTPIQEGMIIHTNSPRLEHYRKIRLEQILADHNADCVAPCVMTCPANIDIQSYLSHAGNGNFETAIKVIKERNPFPIVCGRVCPHSCEAQCRRNLIDEPVAINHVKRFIADWDIAHEQPWAPRKKAATGKKIAVVGAGSSGLSAAYYSAIQGHDVTVFERHPRAGGMMRYGIPEYRLPKETLDREIGLIADLGVKIMTNKALGTHIRLEDLHQDFDAVYLAIGSWRATPLQIEGDNLEGVWLGINFLEQVTKGADIKLGEHVVVIGGGNTAIDCARTALRKGAGSVKLVYRRTREEMPAESYEVEEAIHEGVEMYFLTAPHKIVAEGGRKLLHCIKMTLGEPDRSGRRRPIPIEGSETAFEADTIIGAIGQSTNTQFLYHDLPVKLNKWGDIEINGKTMQTSEMNIFAGGDCVTGPATVIQAVAAGRHAAEAMDSFLMKGYVKEQPMDYSCSRGSLEDLPQWEFEKIPRLKRAPMPALPPAERRDNFREVETGLSEETARAEARRCLKCGCYERYDCDLRQEASLHHVEFKKPVHERPYIPIVEDHSIIIRDHNKCISCGRCIAACAEVEGPDILSFYMKHGRQLVGTKSGLPLDQTDCVSCGQCVNACPCGALDYRSEIGRVFRAINDPGKTTVAFVAPAVRSVVSSQYGVSYQEASRFIAGLLKKIGFDKVFDFTFAADLTIVEETTEFLTRLQSHKPIPQFTSCCPGWVNFVERRYPEIIPYLSSCKSPQMMMGATVKNHFTELTEIDPKDLYVVSIVPCIAKKYEAARPEFRSEGIRDVDAVLTSTEMLEMADIKLIEPADVEPQDFCEPYKRVSGAGILFGASGGVAEAALRMAVEKLTGEVLTDQLDYQEVRGLQGIKEAAVEAKGKKVNVAVISGLHNVEPILEKIIEGMEVGYDLIEVMACPGGCICGAGHPVPEKIDTLEKRQQVLVNIDQTSRYRKSQENPDILRLYDEYYGEANSPLAHKLLHTHYEAVKREPVAKHDRRMADSAFVTHELTLCTCDKCTAQGSRELFAALSGKIRKLKMDSFVTARTIRLKENHPGQGVYAAIDGKLIETPVEQLEQRIFQHLIR

SEQ ID NO: 92534 - protein, 438 aa, Bacillus cereus G9241
MHHDEKNKIGLTVALSIVVGTIIGSGVFMKPGSVLDYSGSSNMAILAWVIGGLLTLASGLTVAEIGAQIPKNGGLYTYLEEIYGSFWGYLSGWMQTIVYGPAIIGTLGLYFSSLMINFFYLDKVWNLPIAIGTVVFLGVVNSMGTKYGGIVQTITTIGKMIPIVLIVVLGFWKGNSDIFNVVVPISENQSIGMAILATLFAYDGWILLASIGGEMKNPTKLLPKAMTVGILIVTAAYVLINLALLNVLPATQIVDLGENATATAAGMLLGEYGGKIISIGIIVSIFGCLNGKILTFPRIPMSMAERGQLPFAKFIAKESPRFKTPANAITVEIILGIILMIISDPNKLSEISVFIIYIFYVMTFIGVFILRKRNKNKERAYSVPLFPIVPIVAILGSFFVIGSAIINDPISCFLSIGIVFTGLPVYWYLNKKNKNEVS

SEQ ID NO: 92535 - protein, 548 aa, Leifsonia xyli subsp. xyli str. CTCB07
MLRMSEPLPEPADAPSARTPGEEKARVADAVAAVAADLRARAGTVTGAAADVLEAQSMMAEDSTLADDVSSRIDSGKTAERAVFEGFAVFRDMLIGLGGYMGERATDLDDVSQRVIAALEGRAAPGVPESDEPYVLVAHDLAPADTALLDLDKVLGLVTREGGPTSHTAILAREKAIVAIVGVASADTLTDGTEVIVDARAGIVTASPDTAQSAEAQRRIDERAAALSGGLGPGALADGTSVPLLANLGSAEGAGKALAAGAEGVGLFRTEFLFLDQRLAPTVEQQREQYAAVLRAFPGQKVVVRVLDAGADKPLEFLNDAHEDNPALGLRGLRALRSNEDILREQLTALAEADAQTGADLWVMAPMVSTVEETRYFVELASEFGLKTAGVMVEVPSAALLAGRVLQKAAFVSIGTNDLTQYTLAADRLLGSVASFQDPWHPAVLRLIGETGKAGAATGKPVGICGEAAADPLLAVVLVGLGATTLSMSTTAIADVRLSLKRYTLEQARGLAEIALAADGAAEAREAVRLAATASTSPAHPDRNEAPE

SEQ ID NO: 92536 - protein, 168 aa, Oryza sativa
MIERAIMRPAVPSRVALSASRLSNHHHHAVGGERYAIYRGRCPNPAIPMALAAAAAPGKGGGVLDRPIEKVTPGRQSEFDVRKSRKMTPPYRVLLHNDNYNRREYVVQVLMKVIPGMTVDNAVNIMQEAHVNGLSVVIICSQSEAEEHCTSLRGNGLRSSIEPASGGC

SEQ ID NO: 92537 - protein, 304 aa, Prochlorococcus marinus str. MIT 9303
MESQRHGLRLTRHDPIDLTCDALLMPIRVAFLGPEGTYGQQAAQALAELEGLANFELVPCIGLRSVVEHVATKRSEMAVVPVENSVEGGVTASLDALWSHPQLCILRAVVLPIRHALLSSGGLKDISEVLSHPQALAQCSGWLADHLPDALQLPTSSTAEAARMVIDSRFRAAIASRPTGQGRGLKELAFPINDVAGNRTRFLLLRQGTPLQRGDVASFAFSLHANAPGSLLEALTCVARLGFNMSRIESRPSKRELGEYVFFVDVELRDGGVGASEQLIEALQPFCEHLVHFGSYLSSDLELD

SEQ ID NO: 92538 - protein, 382 aa, Coccidioides immitis RS
MTLEIPQEPQPVPLWLDCDPGHDDAFAILLAAHHPQLKLLGITTVHGNASLENTTANAGSILEAIGRSDIPVYPGSKKPFCRLPVHAPSIHGSSGIDGTDLLPVPKVPPVTDVNPILAMRNALLAQPKDTAWVVATGALTNVGLLFATFPEVAEHVRGVSIMGGAIGSGFTDVPISKKPGEATRIGNTTPYSEFNIYTDPEAAKSILMSPILAPKTTLITLDLTHQVLATQEIQSLILATETSDNSEPSVLRQILHALLTFFASSYDTVFGIDSGPPLHDPVAVAVLLSNLNDSQMAGRKDILQFNDNDGERYIVDVVTNGSHGKDVQLTGEVGRTVAQKTADSLGGVTIPVSMDVNKFWGIILDCLQRAEKCKAMQLAANC

SEQ ID NO: 92539 - protein, 442 aa, Pseudomonas putida KT2440
MKVTVFGTGYVGLTQAVCLAQVGHSVLCMDVDADRVASLSEGHCPIFEPGLAPLLEKNLACGRLRFTTDAAAAANYARLQFIAVGTPPQADGSADLKHVFAVVDSILEHADGPKVIVNKSTVPVGTVHRIKARIAQAVADTSRFQVISNPEFLKEGSAVDDCMRPQRIIIGGAEAAEVELLRELYLPFNRNREKFMVMDARSAELTKYAANCMLATKISFINEIANLAEHLGADIEMVRRGIGSDPRIGYDFIYAGCGFGGSCFPKDLQALRHSAEAEGFETQLLRAVESVNEQQKGRLFSKIQRHYPGGLRGKVFALWGLSFKPNTNDIREASSRVLLEALWAAGARVQAHDPQAMEEIRRHYGPRADLQLVPCKDDALRGADALVIVTEWQDYRVLNLDEVPQQLADRVVFDGRNLYEPEHMASAGLAYYGIGRGKIAPA

SEQ ID NO: 92540 - protein, 182 aa, Arabidopsis thaliana
  misc_feature (172)..(172): Xaa can be any naturally occurring amino acid
MASSMFSSTAVVTSPAQATMVAPFTGLKSSASFPVTRKANNDITSITSNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIRIIGFDNTRQVQCISFIXAYKPPSFTEA

SEQ ID NO: 92541 - protein, 120 aa, Prochlorococcus marinus str. MIT 9303
MGERPTYIGALPIVLAMAVNAPSPSPGGAAVLEKQTERIRKQSPHYKVLLHNDPVNSMEYVVVTLQQVVPQLSEQDAMAVMLEAHNTGVGLVIVCDLEPAEFYCETLKAKGLTSTLEQES

SEQ ID NO: 92542 - protein, 228 aa, Glycine max
  misc_feature (17)..(17): Xaa can be any naturally occurring amino acid
MSFIFGKRKTPAVCDFXELLRENKRMLDKSIREIERERQGLQTQEKKLIAEIKKSAKQGQMGAVRVMAKDLVRTRHQVEKFYKLKSQLQGVSLRIQTLKSTQAMGEAMKGVTKAMGQMNRQMNLPSLQKIMQEFERQNEKMELTSEMMGDAIDDALEGEEDEEETEDLVNQVLDEIGIDINQELVNAPSSAVAAPASKTKVPQVETTGNDDGGIDSDLQARLDNLRKM

SEQ ID NO: 92543 - protein, 132 aa, Helicobacter pylori
SNIKYELDKDSGALMVDRVLYGAQNYPANYGFVPNTLGADGDPVDVLVLSDVAFQAGSVVKARLVGVLNMEDESGMDEKLIALPVDKVDPTHSYVKDINDLSKHTLDKIKHFFETYKDLEPNKWVKVKGFEN

SEQ ID NO: 92544 - protein, 300 aa, Populus trichocarpa x Populus deltoides
MCFHLWQDVVNAICDDDDIRAISFVGSNTAGMHIYSRASAKGKRVQSNMGAKNHAIVLPDANVDATLNALVAAGFGAAGQRCMALSTVVFVGDPQSWENKLVERAKSLKVNSGMEPDADLGPVISKQAKERVCRLIQSGVESGARLLLDGRNIVVPGFEHGNFIGPTILSGVTADMECYKEEIFGPVLLCMEAGSFEEAINILNRNKYGNGAAIFTASGAAARKFQTEIEAGQVGINVPIPVPLPFFSFTGSKASFAGDLNFYGKAGVNFYTQIKTITQQWKDLPGGSGVSLAMPTSQKL

SEQ ID NO: 92545 - protein, 229 aa, Glycine max
MVETEMDAETVANVVPPKETPNSVSISHHSSHPPLNERIISSMTRRSVAAHPWHDLEIGPGAPIIFNCVIEIGKGSKVKYELDKKSGLIKIDRVLYSSVVYPHNYGFIPRTICEDSDPLDVLIIMQEPVLPGCFLRAKAIGLMPMIDQGEKDDKIIAVCADDPEYRHYNDIKELPPHRLAEIRRFFEDYKKNENKEVAVNDFLPASAAFEAVNRSMSLYADYIVESLRR

SEQ ID NO: 92546 - protein, 588 aa, Synechococcus sp. RS9917
MALIDLTRRTKIVATIGPATESPERIRELIQAGATTFRLNFSHGDHSEHATRIATIRQVASELSQHIGILQDLQGPKIRLGRFALGPITLAKGDAFALTSRSVSCDQQIATVTYDKLAAEVSAGSRILLDDGRVEMKVERVDQAEQTLHCTVTVGGVLSNNKGVNFPDVQLSVRALTEKDRIDLAFGLQQGVDWVALSFVRNPSDMQEIRELIRQHGFSTPVVAKIEKFEAIDQIDAILPLCDGVMVARGDLGVEMPAEEVPLLQKELIQKANSLGIPIITATQMLDSMASSPRPTRAEVSDVANAILDGTDAVMLSNETAVGDYPIEAVETMATIARRIERDYPQRSIDSHLPSTIPNAISSAVSTIASQLNAAAILPLTKSGATAHNVSKFRPAAPILAITSEVAVARKLQLVWGVTPLVIAQQSTTSGTFTTAMAAAQDKGLLKEGDLVIQTAGTLAGVAGSTDLVKVGIVSAVLGQGTGVGQGTVSGRVRLAQCPGDACKIERGEILVVHDTTADDVDAIRDAAAVITEVPAATSHAALIAQRLGTPLIAGVAHATRHLLEGEVVTLQIKDGLVHRGTSINTAL

SEQ ID NO: 92547 - protein, 459 aa, Vitis vinifera
MYSLMSSPSISSSSSSFLGQTHFDSRNPNACLPTKDSWICKCVATPSTETTAHTTKVSRNANMAKLQAGYLFPEIARRRSAHMLKYPDAQVISLGIGDTTEPIPEVITSGMAKKAHALSTLEGYSGYGAEQGEKQLRAAIASTFYGDLSIEESDIFVSDGAKSDISRLQVMFGSNVTMAVQDPSYPAYVDLSVILGQTGQFQKDVEKYGNIEYMKCNPENGFFPDLSTVSRTDIIFFCSPYNPTGNAATREQLTRLVQFAKDNGSILVYDSGYAMYISDDSPRSIFEIPGAKEVAIEVSSFSKYAGFTGVRLGWTVVPKELLYSDGFPVAKDFNRIECTTFNAASNISQASGLACLSPEGLEAMHKLVGFYKENTNIIMETFTSLGFSVYGGKNAPYVWVHFPGQSSWDVFSEILEKTHVVTTPGSGFGPAGDGFIRVCAFSHRGNVLEACKRFKRLYK

SEQ ID NO: 92548 - protein, 387 aa, Candidatus Pelagibacter ubique HTCC1002
MKLAKNLQRLGTESAFSVLAEAKKLEAQGKPMIHLGLGQPDFKTPQHVVDAAKKALDEGHHGYVLSNGILECRQAVTRKIKKLYNKDIDPERVLIMPGGKPTMYYAIQCFGEPGAEIIHPTPAFPIYESMINYTGSTPVPYDLTEDKDLKFDPEKILSLITDKTRLLILINPNNPTGSFVEKSAIDVLAEGLKKHPHVAILSDEIYSRQIYDGKEMPTFFNYPDLQDRLIVLDGWSKAYAMTGWRMGWSVWPEELIPHVNKLIINSVSCVNAPSQFAGIAALDGPDDAIHEMMVKFDQRRKLIHEGLNSLPGVECSLPGGAFYAFPKVIGTGMNGSEFAKKCMHEAGVAIVPGTAFGKTCQDYVRFSFAASQDNISNALENIKKMLG

SEQ ID NO: 92549 - protein, 415 aa, Vitis vinifera
MFTVCCEAHMTKVSRNANMAKLQAGYLFPEMNGDKAPGPDGFSMAFWQRCWVIVKEEVLEMFKEFYEQSKANALSTLEGYSGYGAEQGENRLRAAIASTYYGDLSIEESDIFVSDGAKSDISRLQVMFGSNVTMAVQDPSYPAYVDSSVILGQTGQFQKDVEKYGNIEYMKCNPENGFFPDLSTVSRTDIIFFCSPNNPTGNAATREQLTRLVQFAKDNGSILVYDSAYAMYISDDSPRSIFEIPGAKEVAIEVSSFSKYAGFTGVRLGWTVVPKELLYSDGFPVAKDFNRIVCTTFNGASNISQAGGLACLSPEGLEAMHKVVGFYQENTNIIMETFTSLGFSVYGGKNAPYVWVHFPGQSSWDVFSEILEKTHVVTTPGSGFGPAGDGFIRVSAFGHRGNVLEACKRFKQLYK

SEQ ID NO: 92550 - protein, 197 aa, Oryza sativa Indica Group
MAAGKGKGKEGECDMAAAAAEAEKKGEGSTVSRGAAGERVVEDSGGGRRTIHLKSKDGKQHDVTEASARLSKTIAGMILAGGGADQCIPTPDIDHDTLRVVMQYCDKHAADDADEEDLKEWDEDFVDELDQDALFDVIAAANYLDIDGLLDLTCKRVADTIKGKTPEEIRKEFNIVNDLSKEEEEEIRRENPWAFEQ

SEQ ID NO: 92551 - protein, 663 aa, Oryza sativa Indica Group
MAAGNGGEAAVVGEGEGATASEVVEKMVSQAVVEKALWEAFEKVVSEAVEKKSEGAMASEVVETMVSQAVVEKALWEAFEKVVSEAVEKKGGGAVVSEGAVEKVESEVVEETVLDSAEKASASAGEEEEESSDGEPVEVTEASARISKVIGDKIDAGRGGEAIPLPHVDNKTLKKVIEYCDEHANENSDTDEQKEELKNWDKAFIDELDEDDGSFLFLVLLASSYLKIDGLLDLTYQRVADNSKAKTTEEIRKAFSTIEIELSDKEEEEQQQEEEIRPENHLKNFISEMYGLTDLVDEEEDGRGDDDRDAPADRDDRARGRRRGRRGHNNDHPRANQNWRCRDRDDDDWDERGRDFGRGRGEQRAIDQDYRRERTRSPRQRDRGGHSRHGGRRHHAGATDVDNVTDPVYPEPHLAEISLPSRQQELHTEVCKFRLLHALHTSPFRTQEIPASPPTSTGDQLLCLALVADKAMAAPPPTAMEDLAIRSSTGTEAWFSGTAWKPVPVARVFGRIREALPATPAVETPTTYQQIEEALMRLELAAAAARTPGDDTLLPQPMSPAPLAASPPRRLEDLASDAGADKILPAPLPRGAASPRDDPDASHPAPVGAGAGLAAGTRILAMRHRRTVHLASVGYHCVAAALDASISAVGRPHKEGEAPAEAA

SEQ ID NO: 92552 - protein, 513 aa, Synechococcus sp. RS9917
MDHYLPRILRARVYDVARETPLEPAANLSERLDNAIWLKREDLQPVFSFKLRGAYNRMAQLSPEQLSRGVIASSAGNHAQGVALSAEHLGCRAVIVMPITTPEVKVDAVRRRGGTVVLHGETYDEAYAEARRRSEAEELCFIHPFDDPEVIAGQGTIGMEILRQLPTPPDAIYVAVGGGGLIGGIAAYVKSLWPDVEVIGVEPHDAAAMTLSLEAGERIRLPQVGLFADGVAVREVGEHTFAIAQEHVDAMVTVSTDEICAAIKDVFEDTRSILEPAGALAVAGLKADVMRRGLRGQQLVAVACGANMNFDRLRFVAERAELGEEREAMLAVQIPERAGSLRHLCEQLQNRSLTEFSYRMAAGDTAQIFMGVQVRDHDDRLALIEQLQEQGFACQDLSDDELAKVHLRHMVGGRLPQGALEAAGQHCQELLYRFEFPERPGALMTFVTALHPDWTISIFHYRNHGADVGRIVVGVLVPEADRDAWNDFLRDLGYGSWEETGNPAYALFLGHRP

SEQ ID NO: 92553 - protein, 465 aa, Roseovarius nubinhibens ISM
MTQDKAQGGQNMSVNPNSIEARDVAYHMHSYTNARAHQENGPVVIDRGEGAYVFDSTGKKYFEAMSGLWSAGLGFGEERLVKAASNQMAKLPYYHNFNSKSHGPAIDLAEKLISIAPVPMSKVFYTNSGSEANDTVMKLIWYRSNAMGTPEKKKIISRQRGYHGVTIASASLTGLPNNHRSFDLPIANVLHTGSPHHYRDAQDGETEEAFASRRAEELEQMILAEGPETIAAFIGEPVMGAGGVIVPPATYWEKIQAVLRKYDILLIADEVICGFGRTGQMFGSQTFGIEPDILVMSKQITSTYFPLSAFMMNERVFEPIADETNKIGVLGHGFTGGGHPVGAAIALETLAIIEERDLVARAQEMGAHMQSRLRGLSDHPLVGEVRGVGMIAAVELVLDKAAKTGGETPGALGVQANRRLEAKGVISRNMMDAMAFCPPLISAQADLDFMVDALAETLDEMQAAM

SEQ ID NO: 92554 - protein, 406 aa, Myxococcus xanthus DK 1622
MSTEHAAPALSTRDFIDLEERYGAHNYHPLDLVIERGEGCWVHDVEGRKYLDCLSAYSAVNQGHCHPRILETLREQAAKVTLTSRAFRNDQLPHLYKALRELSGLSRALPMNSGAEACETAIKLARKWGYTVKGIPEDKAEVIVFANNFHGRTISLISFSTVRSYRQGFGPFTPGFTVVPYDDVEAVRRAITPNTCAILMEPIQAEAGVLIPRDGYLKQVAELCKQHRVLFMVDEIQTGLGRTGKTFAFQHEDVRPDVIVVGKALSGGFYPVSAVMADDEVMGVLRPGEHGSTYGGNPLGCAVARTALDVLRDERLVERSAEMGTSFLAMLKTLKNRHIVEVRGRGLMIGVALDISARPACEALMKEGVLCKETHDSVIRLTPPLIVTQAELDWAFERIKKVIEAL

SEQ ID NO: 92555 - protein, 332 aa, Roseovarius nubinhibens ISM
MTRPPVIVTGGAGYIGSHTCKALAQRGYLPIAVDDLRTGHADAVRWGPLEQLDLAETDRLTEVIAQSGARTVIHFAASAYVDESMREPLRYYTNNVATTVSLLRAMERCDVTRMIFSSSCATYGIPDRMPIAESTSQHPVNPYGRTKLMCEEIIRDHFNAVGGQFALLRYFNAAGADPMGQLSERHDPETHLIPLALMAAAGLRPPLEVFGTDYDTPDGTCIRDYIHVSDLARAHVCALEHLSNGAGALALNLGTGAGLSILEIADAIERLTGRPMPWTPAPRRAGDPPILVADPRAAREVLGFCPRLSDIDTILRHAAPQFGLEVQHARVA

SEQ ID NO: 92556 - protein, 68 aa, Glycine max
MNDWAPPLIAAALFWLLSPGMIFQLPGKNAPFQFMNMKTTVASMFVHTVIYGLFLMLFFVVLSIHLYI

SEQ ID NO: 92557 - protein, 297 aa, Rhizopus oryzae
DDNLVGGMTLDLPSDAPPISLSGSTNSASDGGKVVAATTAQIQEFTKYAGIAATAYCRSVVPGNKWDCVQCQKWVPDGKIITTFTSLLSDTNGYVLRSDKQKTIYLVFRGTNSFRSAITDIVFNFSDYKPVKGAKVHAGFLSSYEQVVNDYFPVVQEQLTAHPTYKVIVTGHSLGGAQALLAGMDLYQREPRLSPKNLSIFTVGGPRVGNPTFAYYVESTGIPFQRTVHKRDIVPHVPPQSFGFLHPGVESWIKSGTSNVQICTSEIETKDCSNSIVPFTSILDHLSYFDINEGSCL

SEQ ID NO: 92558 - protein, 625 aa, Glycine max
  misc_feature (270)..(270): Xaa can be any naturally occurring amino acid
TTSIFVDMSTNLCFEGMDERRERKLSFENNSEDDRWAKIGSLKKKALFASTKFRHSFKKKRSRKIDSRSNSLSIEDVRDVKDLQAVDAFRQALVLDNMLPPIHDDYHMLLRFLKARKFDIEKAKHMWANMIQWRKEYGTDTIMEDFEFKELNEVLKYYPHGYHGVDREGRPVYIERLGKVDPNRLMQVTTLERYLRYHVQGFEKTFAVKFPACSIAAKRHIDSSTTILDVQGVGFKNLTKSARELITRLQKIDGDYYPETLCQMFIIKAXRLEPGFKLLWNTVKSFLDPKTTSKINVLGNKLARGLLEIIDASELPEFLGGNCTCMDRGGCMRSDKGPWQDPNILKMVLSGEVQCSRQIVTVSNDEGTVIECDKACYPMPIRSSDTSTAESGSEVEDITSPKASGNYTNPRLTPVHEEARLIGRASGFSEYDEYVPMVDKAVDLGWKEKQVTTQNSYGSTENFLLRAGKSGGNCAYILAVIVGFFVAIFTFVRSLALRVTKGIQDTKSDSAKNMLPNTTVDSITKEESRPPSPVPRLTKTELISSALKRLGELEEKVDILQSKPNVMPYEKEELLNAAVYRVDALEAELIATKRALYEALIRQEELLAYIDSQERRKFEKKKFCC

SEQ ID NO: 92559 - protein, 296 aa, Thiobacillus denitrificans ATCC 25259
MSGATAFAGAIAEAIAAATGAPFPASALEPVAGGDTSQAFRVGDGERRFFVKTCSRERAAMFDAEVGALDALAGVDAVRVPRPVCTGVASDRAYLVLDYLDLRARGDAALLGTQLARLHRAPQHQFGWSRDNWIGSTSQPNGWARDWIAFWRERRLGFQFERAAQSGYGGALQREGGALLDRLDALFDGYVPLPSLLHGDLWGGNHGYIADGSPVVFDPASYVGDRECDLAMSELFGGFAPAFYAAYEEAWPLDPGYAVRKTLYNLYHVLNHANMFGGGYVAQAQRMTAQLLAEVR

SEQ ID NO: 92560 - protein, 366 aa, Blastopirellula marina DSM 3645
MAYEVTLITGDGTGPELAEAARKCVDATGVKINWDEQEAGVDIMEKVGTPLPQSVMDSVRRTRCALKAPITTPVGTGFRSINVHLRQELGLFACIRPCKYYPGVRSYFSELNVDIVIVRENTEDLYAGVEFEAGKPETSQLIEYINGLPSDKKIKTGGDETGVSIKPISVSGTQRIVRCAFDYAQKNGRKKVTAVHKANIMKYSDGLYLKTATEVAKEYPDIEFEERIVDNMCMQLVQKPELYDVIVLPNLYGDILSDLGAGIVGGLGVAPGANLGPEGAVFEATHGSAPKYKGQNKVNPVALILSGMLMLRHLGEIDAAERLEKAVADVIAEGKHVTYDLKPNRDDPTAVGTQEMAAAICAKLGG

SEQ ID NO: 92561 - protein, 321 aa, Synechococcus elongatus
MGSSHHHHHHSSGLVPRGSHMSSEFIEAGAADRVRILSEALPYLQQFAGRTVVVKYGGAAMKQEELKEAVMRDIVFLACVGMRPVVVHGGGPEINAWLGRVGIEPQFHNGLRVTDADTMEVVEMVLVGRVNKDIVSRINTTGGRAVGFCGTDGRLVLARPHDQEGIGFVGEVNSVNSEVIEPLLERGYIPVISSVAADENGQSFNINADTVAGEIAAALNAEKLILLTDTRGILEDPKRPESLIPRLNIPQSRELIAQGIVGGGMIPKVDCCIRSLAQGVRAAHIIDGRIPHALLLEIFTDAGIGTMIVGSGYHEAHQPWQ

SEQ ID NO: 92562 - protein, 180 aa, Corynebacterium diphtheriae NCTC 13129
MLMMNGMTLKTATAILHTNRGDVSIELFGNHAPKTVENFVTLANGTAEYKTENASGTNEGPFYDGAVFHRVIDGFMIQGGDPTGTGRGGPGYMFADEFHPELQFDRPFLLAMANAGPGTNGSQFFITVVPTPHLNNHHTIFGEVTDAASQKVVLDIAQTATDRMDRPVEPVVIESVEITE

SEQ ID NO: 92563 - protein, 899 aa, Yarrowia lipolytica CLIB122
MAAIREYVGSLLNNATGGSANNSNSGINSAPDSAGTSPKKHSLALPHTPPTGTSRAASHSSAFNSASDEADDNVQFRDIHPAALVRTETEDVDRQLNHFHFEDRGASSEPEQIPLRGRQGRKDDPYGSTFFSAKETFLDGRDRDIKLVIPETRDSRELSRPRRSPVSATASSHSGGGFFSRILQKRKNSGRQSIEAEEQEDDEQDQDGEDKRAEGWCADVMGYAPNYSMFSDLKYVKVRAHHRPSHQKKRNFDRLFLAQELRTHDPSDPLATDNSRLASQTAQKVISSSPIGAIWAMKFSLDGRYLAAAGQDRVLRVWKVCTRPQNSPYEDYFGFKGTKMYAPVFEESPEREFRGHEGDILDLSWSKNNFLISSSMDKTVRLWHPDRQEEIASFPHNDFVTCVEFHPKDDRFFVSGSMDRQLRLWSILDNQVAFARQVPDIVTAVAFTPNGNTVIAGCLRGQLYFYQTHQLVLQTQLQVRISTKVKHAYKSKITGIQVVTEPKKSRTHNNIYNPMHAAVAAEDDYKMLITTNDSRIRLYNYRTKALIAKYRGLDNDHSQIKASFSDDYRFIISGSEGERTYIWDTIRSDSGTGLNHVSSKTIKAYEYFHSHQSTVTVALFAPLQTRQLLDLAHDPIYSIVNPPKVVLGQNDMTPEKALYPHHDGHIIVAADYSGKIKVFRQDSAYTKRKLAEDSASFIQSRRSLNSIGGASGRSSPRGRSSRSSSASAWNRFSRGVRSPAVSPGTSVHRKSFGASTSTGPAPFGVIANGLSSANHTIMDPSTFPRARKSSTSGLSQISRRTSESLFSPEKSVPEIHVNDEDGREIEPTGSIRSNSVLMTDSDQELDEDTDQEEQDELTEQASLVCEKCGSQNFKVRVIEGMVILCCSACRTPISEAAST

SEQ ID NO: 92564 - protein, 537 aa, Moritella sp. PE36
MSIEIFVPDIGDDEVEVTEISVQIGDTVAEEDTLLAVEGDKASMEVPAPQAGVVQEIRVNIGDTVKTGSLIFIFADAASAAAPVAPVVADATAVAVEAAPAAPAAVQVLEVNIPDIGDDEVEVTEISVKVGDTVAEEDTLMAVEGDKASMEVPAPFAGVVKEIKVNIGDKVKTGSFIMTFEVAGAAPAVAPVAEAAAPAPAAPVVANAEAPKAAPAPAAKAPEVTGFVENDAYHHASPVVRRLAREFGVNLDKVGKTGRKGRIAKEDVQTYVKNAVKRLESGATGGNGSGMDVLAWPKVDFAKFGEIEVIKMTRIQKISGPNLHRNWVKIPHVTQFDEADITELEAFRKVENNKLVKQDKGFKISPLIFIVKAVAKALADYPKFNTSIGEDGATIIQKKYINVGVAVDTPNGLVVPVIRNVDQKGIYELSQDLAVISKKARAGKLTSSDMQGGCFTISSLGGIGGTQFTPIVNAPEVAILGVSRSEIKPKWDGKEFAPRLMLPLALSYDHRVIDGADGARFVTALNGYLSDLRKLVL

SEQ ID NO: 92565 - protein, 331 aa, Musa acuminata
KIKIGINGFGRIGRLVARVALQSDDVELVAVNDPFITTDYMTYMFKYDTVHGSWKHHEIKVKDSKTLLFGEKEVTVFGIRNPEEIPWGESGAEYVVESTGVFTDKDKAAAHLKGGAKKVIISAPSKDAPMFVIGVNENEYTSDINIVSNASCTTNCLAPLAKVIHDRFGIVEGLMTTVHSITATQKTVDGPSSKDWRGGRAASFNIIPSSTGAAKAVGKVLPSLNGKLTGMSFRVPTVDVSVVDLTVRLEKAATYDEIKAAIKEESEGKLKGILGYVEEDLVSTDFVGDSRSSIFDAKAGIALNPNFAKLVSWYDNEWGYSSRVIDLIRHM

SEQ ID NO: 92566 - protein, 477 aa, Moritella sp. PE36
MSNEVKAQVVVLGAGPAGYSAAFRAADLGLETVIIERYNTLGGVCLNVGCIPSKALLHVAKVIEEAKSLAEHGIVFGEPKTDITKIRSWKEKVVGQLTGGLGGMAKLRKVKVVEGLAQFTGANTIEATDRDGNVTTVTFDNAIIAAGSRPVKLPFIPHEDPRVWDSTDALALKEVPGKLLVLGGGIIGLEMGTVYSALGSDIDVVEFADQLVPAADKDIVKVYAKAVKNKFNVMLSTKVTAVDAKEDGLYVTFEGKKAPAEPVRYDAVLVAVGRVPNGLGLNAEKAGITVTERGFIETDKTMSTNVPHIYAIGDIVGQPMLAHKGVHEGHVAAENIAGKKHFFDPKVIPSIAYTEPEMAWAGLTEKEAKEQGVNYEAAVFPWAASGRAIASDASNGMTKLLFNKDTNRIIGGAMVGTNAGELLGEVCLAIEMGCDAEDIALTIHAHPTLHESVGMAAEIYEGTITDLPNAKAMKKKK

SEQ ID NO: 92567 - protein, 343 aa, Mycobacterium sp. KMS
MVTRRVVVSSLDDVVVETETTDTPQPGEVRVGTSLVGICGSDLHAACGRHPFIDLPYRPGHEAVGVVDAVGAGVDESWLGTRVTIEPNLACGHCTQCRAGRYNICRELLVFGCQTAGALADSFTIPVDRVVALPDELDDRHAILIEPLATPVHTVRRAAGLVGDLRDRAVVVIGAGPIGLFTLLAARHAGARVVVADLLESKRARAERLGAVGSFDPTGDDAVATAQRLLGGPAAVVVDCVSRESTVALAVDLVDKGGAVMIVGVAEGSTPVPLGLIQDRELALVGNLMYVREDFTAAMDLLASGIVPVDEIISADFDLDHAAQAFRASADPENVKVLVTVGS

SEQ ID NO: 92568 - protein, 307 aa, Arabidopsis thaliana
MEGRLNNMWRLTVNESKFVESALQSELRVDGRGLYDYRKLTIKFGKEYGSSQVQLGQTHVMAFVTAQLVQPYKDRPSEGSFSIFTEFSPMADPSFEPGHPGESAVELGRIIDRALRESRAVDTESLCVLAGKLVWSVRIDLHILDNGGNLVDAANVAALAALMTFRRPDCTVGGDNSQDVIIHPPEEREPLPLIIHHLPIAFTFGFFNKGSILVMDPTYVEEAVMCGRMTVTVNANGDICAIQKPGEEGVNQSVILHCLRLASSRASATTKIIRDAVEAYNRERSSQKVKRHHTLAKSEVLGPIVVV

SEQ ID NO: 92569 - protein, 648 aa, Synechococcus sp. RS9917
MHLSELTHPNQLHGLSMAELEDVARQIRERHLEVVSNSGGHLGPGLGVVELTLALYQTLDLDHDRVVWDVGHQAYPHKLITGRYGDFHTLRQQGGVAGYLKRCESDFDHFGAGHASTSISAALGMAIARDRRGEQFKCVAVIGDGALTGGMALEAINHAGHLPHTPFVVVLNDNDMSISPPVGALSTYLNRMRLSPPMQFLSGSVEESMKHLPFMGGELPAELNRLKGSMRRLAVPKVGAVFEELGFTYMGPIDGHDMAEMVRTFQAAHRVGGPVLVHVVTTKGKGYPYAEADQVGYHAQSAFDLSTGKARPSKTPKPPSYSKVFGQTLVKLCEQDPRVIGITAAMATGTGLDLLQKAIPEQYVDVGIAEQHAVTLAAGMACEGLRPVVAIYSTFLQRAYDQLIHDVGIQNLPVTFVLDRAGIVGADGPTHQGQYDISYFRAVPNFTVMAPRDEAELQRMLVTCLQHDGPTALRIPRGPGEGVPLMEEGWEPLPIGCGEQIRDGDDLLIVAYGSMVNRAMATADRLAQQGIEASVVNARFLRPLDEQLIHPLARRIGRVVTMEEGALAGGFGAAVLESFSDQDLHVPLLRLGIPDTLVDHATPQQSFESLGLTPDQMAERIVARFGSAPLRAGSAQVSSSVAATAALG

SEQ ID NO: 92570 - protein, 410 aa, Bacillus anthracis str. A2012
MQNMKIIVQKFGGTSVRDENGRKHALHHIKKSLDAGYKVVTVVSAMGRKGEPYATDTLLSLVNQEESHISNREQDLLLSCGELISAIVFSNMLNENGIKAAALNGAQAGFVTNDDFTNAKIIEMNCDRIHEELENVDVIVVTGFQGQTKKGDTTTLGRGGSDTSASALGVALHAEYIDIFTDVEGVMTADPRIVKDARHLQTVTYNEICNMAYQGAKVVHPRAVEIAMHAKVPLRVRSTYSDSEGTLIAAYDGATKGQDVEERPVTGIAHVSNVTQIKVLAKETAYDIQQHVFKEMANEGISVDLINISPTGVAYTVNDNVSARAVEVLKQLGYEPIVTEHCAKVSIVGAGMAGIPGVTAKIVTALAEKGIQILQSADSHTTIWVLVKETDLVEAVNALHRAFELSKEKQ

SEQ ID NO: 92571 - protein, 207 aa, Oryza sativa Indica Group
MAKGSGEAAAAAAAAEGKGEEPVAAAVVEMEGEDAVVPEAVAADAEKAEEKESGSRMITLKSNEGKAFVVTEASARQSTTIGHMIDDDCTREAVPLPNVDSKTLEKVIEYFDEHANNKADTDDEKAALDKFDKDFIGELDGDKAFLFHVTMAANYLHAQGLLDLTTQCIADTIKGKTPEEIRTAFNIAYDLTEEDQEEIKEEDAWAF

SEQ ID NO: 92572 - protein, 442 aa, Vitis vinifera
MGITTSLSYLLFFNIILPTLTASPILFQVLHIILSHILSLSLPMCLGFNWESSKKQGGWYNFLINSIPELSASGITHVWLPPPSQSAASEGYLPGRLYDLNASHYGTQDELKALIKAFRSNGIQCIADIVINHRTAEKKDSRGIWAIFEGGTPDDRLDWGPSFICSDDTLFSDGTGNPDTGAGFDPAPDIDHVNPRVQRELSDWMNWLKIEIGFAGWRFDFARGYSPDFTKLYMENTSPNFAVGEIWNSLSYGNDSKPNYNQDAHRRELVDWVKAAGGAVTAFDFTTKGILQAAVEGELWRLKDSNGGPPGMIGLMPENAVTFIDNHDTGSTQKIWPFPSEKVMQGYVYILTHPGIPSIFYDHFFDWGLKEEISKLIIIRTRNGIKPNSGVRILASDPDLYVAAIDEKIIAKIGPRYDVGNLVPSTFKLATSGNNYAVWEKQ

SEQ ID NO: 92573 - protein, 79 aa, Ralstonia solanacearum GMI1000
MDNIEQRVKKIVAEQLGVAEADIKNESSFVNDLGADSLDTVELVMALEDEFGMEIPDEEAEKITTVQQAIDYARANVKA

SEQ ID NO: 92574 - protein, 236 aa, Oryza sativa Indica Group
MAAAAEDAAAAEEEEEKESGSSRMITLKSNDEKLVEVTEASARQSRAIANLIDDGCADVIPLPNVDSKTLAKVIPYCDEHGRANSGTDEERAALGRFDADFVGELDKDKASLIDVIMAANYLNIQGLLDITCQRVADTIGSATAEKIREAFDIEDDLTEAEKKEIREENAWAFDGIPCLLVGIWFDGGIPIQEIRLQICNISQWVLSCLVKLNPIPCMCSAHAFFRITQMVSCFVV

SEQ ID NO: 92575 - protein, 440 aa, Zea mays
MDDGDTPRRKSVPDWLNSPIWSAPPPSPRHSSLPPTAPSPPQPPPSPLPSPQPRRDPTPIPPPNAPRDADVSDDEGKGAGAPSCAHLVAEFKVALDRKVVDLAELRRLACQGVPDAAGIRPIVWKLLLGYVPTDRALWPYELEKKRSQYCDFKDELLVNPSEVTRRMEEMTASEREEHNAEGTGVLPRAEIVRDEHPLSLGKTSVWNQYFQESEIVEQIDRDVKRTHPEMEFFNGDSSDSLSNQESLKRILTIFAKLNPGIRYVQGMNEVLAPLYYVFKNDPDQSQAALAEPDAFFCFVELLSGFRDNFCKQLDNSVVGIRSTITTLSQLLRRHDEELWRHLEVVTKVNPQFYAFRWITLLLTQEFQFRDCLSLWDTLLGDPEGPQATLLRVCCAMLILVRRRLLAGDFTANLKLLQNYPPTNIDHILHIANKLRGPLPF

SEQ ID NO: 92576 - protein, 187 aa, Herminiimonas arsenicoxydans
MSLINTQVQPFKAQAFHNGKFIEVTEQSLKGKWSVLIFMPAAFTFNCPTEVEDAADSYAEFQKLGAEVYIVTTDTHFSHKVWHETSPAVGKAKFPLVGDPTHALTNAFGVHIPEAGLALRGTFVINPEGVIKTMEVHDNAIARDVSETLRKLKAAKYVAEHPNEVCPAKWKEGEKTIAPSLDLVGKI

SEQ ID NO: 92577 - protein, 443 aa, Desulfitobacterium hafniense Y51
MIMKICVVGAGYVGLVSAAILADWQHNVVCVDHNEQKIEDLLAGKLPIFEPGLQELVELNRRRQYLRFTAEMAEALRGCEMIIVAVGTPPAENGHPNLEDFWAVVKSFRENVGNNVIVMIKSTVPVGTGEAVSLYLNEKVSHTFSVVSAPEFLRQGTAVHDFLHPDRLVVGCMSPEIREQMKELFQPLDCPKVFTDWHSAEMIKYASNSFLALKISYINTIANLCEAVGGNIQDVAAAVGLDHRIGQAYLKPGVGFGGSCLAKDTQGLIAQGEVHGVNVWMFKDVLEVNYEQRVHIVQRLTEVLGNLKGRKIAILGLAFKANTDDLRDAPSVTIIAQIIKLGGLVKVYDPVVDSSSLPNIISVSTADNPYAACQGVDAVIVLTEWEEFLDLDLKRLQKSMNAPVFIDGRYLFERKRLLEAGFFLPERPSSSEWPVVQSMISAR

SEQ ID NO: 92578 - protein, 481 aa, Populus trichocarpa x Populus deltoides
MASATAPTTLSLLKTAAASTSTSARASLLPVSTSGLRTTSLRGLGFSAADPLFSSHVVSKIRSFKSNGRAPRAVVSMAKKSVGDLTAADLKGKKVFVRADLNVPLDENQKITDDTRIRAAVPTIKYLISKGAKVILSSHLGRPKGVTPKFSLAPLVPRLSELLGIQVVKADDCIGPEVEKLVASLPEGGVLLLENVRFYKEEEKNEPEFAKKLASMADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLAVGSSLVEEDKLDLATSLLEKAKAKGVSLLLPSDVVIADKFAPDANSKTVPASAIPDGWMGLDIGPESVKTFSEALGTTQTVIWNGPMGVFEFEKFANGTEAIAKKLAELSGKGVTTIIGGGDSVAAVEKVGVADVMSHISTGGGASLELLEGKELPGVLALDEVERVAV

SEQ ID NO: 92579 - protein, 511 aa, Aspergillus nidulans FGSC A4
MSATIARAEEQQNGSTVELKDDTVIVVLGASGDLAKKKTFPALFGLFRNKFLPKGIKIVGYARTQMDHNEYLKRVRSYIKTPTKEIEEQLNSFCELCTYISGQYDQDDSFKNLAKHLEEIEKNQKEQNRVFYMALPPSVFITVSEQLKRNCYPKNGVARIIVEKPFGKDLQSSRDLQKALEPNWKEEEIFRIDHYLGKEMVKNILIMRFGNEFFNATWNRHHIDNVQITFKEPFGTEGRGGYFDEFGIIRDVMQNHLLQVLTLLAMERPISFSAEDIRDEKVRVLRAMDPIQPKDVIIGQYGRSLDGSKPAYKEDDTVPQDSRCPTFCALVAHIKNERWDGVPFIMKAGKALNEQKTEIRIQFKDVTSGIFKDIPRNELVIRVQPNESVYIKMNSKLPGLSMQTVVTELDLTYRRRFSDLKIPEAYESLILDALKGDHSNFVRDDELDASWRMFTPLLHYLDDNKEIIPMEYPYGSRGPSVLDDFTASYGYKFSDAAGYQWPLTHTTPNRL

SEQ ID NO: 92580 - protein, 221 aa, Glycine max
RGRTHAVRTAARRRQKGTPDEDFGILLEAAVMYDRRVAAILGEDDSVDEEVIWKEISDGKQCLYPRLLFIITGKGPEKEKYEVKIKRMKLKRVAFRTMWLSADDYPLLLGSADLGVCLHTSSSGLDLPMKVVDMFGCGLPVCAVSYSCIRELVRVDKNGLLFSSSSELADELLLLFKGFPDDCDALKVLKYGALETGSSSRWATEWEEHAKPLITEVISRF

SEQ ID NO: 92581 - protein, 173 aa, Desulfitobacterium hafniense Y51
MKALDFDKYIRVIDDFPKPGISFKDITTLLKDGEAYRAAVDAIVERVRESQPDLIVGPEARGFLLGAPVAYALGIGFVPVRKPGKLPGKTVSETYELEYGSDTLEVHADAIQPGQRIAIVDDLLATGGTTSATARLIEKTGAQVAGMSFLIELGFLEGRKRLEGYEVFSLIKY

SEQ ID NO: 92582 - protein, 128 aa, Brassica napus
  misc_feature (2)..(2): Xaa can be any naturally occurring amino acid
  misc_feature (10)..(11): Xaa can be any naturally occurring amino acid
  misc_feature (22)..(22): Xaa can be any naturally occurring amino acid
  misc_feature (26)..(26): Xaa can be any naturally occurring amino acid
  misc_feature (35)..(35): Xaa can be any naturally occurring amino acid
  misc_feature (53)..(53): Xaa can be any naturally occurring amino acid
  misc_feature (65)..(65): Xaa can be any naturally occurring amino acid
  misc_feature (71)..(71): Xaa can be any naturally occurring amino acid
  misc_feature (83)..(84): Xaa can be any naturally occurring amino acid
  misc_feature (86)..(86): Xaa can be any naturally occurring amino acid
  misc_feature (93)..(94): Xaa can be any naturally occurring amino acid
  misc_feature (99)..(99): Xaa can be any naturally occurring amino acid
  misc_feature (101)..(102): Xaa can be any naturally occurring amino acid
  misc_feature (105)..(107): Xaa can be any naturally occurring amino acid
  misc_feature (111)..(111): Xaa can be any naturally occurring amino acid
MXSSMLSSAXXVTSPDQATMVXPFTXLKSSAAFPXTRKANNDITSIASNGGKXSCMKVRTPVGKXKFETLXLTFPDLTEVELXXEXDYPSPHXXIPCVXFXXEHXXXHRDXREAPPYAHVEFPTPSRF

SEQ ID NO: 92583 - protein, 386 aa, Bacillus cereus ATCC 10987
MNIHEYQGKAVLRSYGVSVPNGKVAFTVEEAVEAAKELGTDVCVVKAQIHAGGRGKAGGVKVAKNLDEVRTYAESILGTTLVTHQTGPEGKEVKRLLIEEGCDIKKEYYVGLVLDRATSQVVLMASEEGGTEIEEVAEKTPEKIFKEYIDPAVGLQGFQARRIAFNINIPKELVGQAVKFMMGLYRAFIEKDCSIAEINPLVTTGDGKVMALDAKLNFDSNALYRHKDILELRDLDEEDAKEIEASKYDLNYIPLDGNIGCMVNGAGLAMATMDIIKHYHGDPANFLDVGGGATAEKVTEAFKIILSDKNVKGIFVNIFGGIMKCDVIAEGVIEATKQVGLELPLVVRLEGTNVELGKKILNESGLNIVAAESMADGAQKIVSLVG

SEQ ID NO: 92584 - protein, 252 aa, Zea mays
  misc_feature (89)..(89): Xaa can be any naturally occurring amino acid
  misc_feature (166)..(166): Xaa can be any naturally occurring amino acid
  misc_feature (224)..(224): Xaa can be any naturally occurring amino acid
  misc_feature (241)..(241): Xaa can be any naturally occurring amino acid
MAGLAFGSFDDSFSLASLRAYLAEFISTLLFVFAGVGSAIAYAKLTSDAALDTPGLVAIAVCHGFALFVAVAVGANISGGHVNPAVTFXASAVGGQITLITGVFYWMAQLLGSTAACFLLKYVTGGLAVPTHSVAAGVGAIEGVVMEIIITFALVYTVYATAADPXKKGSLGTIAPLAIGLIVGANILAAGPFSGGSMNPARSFGPAVAAGDFSGHWVYWVGPXLIGGGLAGLIYGNVFMXSSEQVPLASDF

SEQ ID NO: 92585 - protein, 487 aa, Oryza sativa Japonica Group
MVGSGAAGGGGGGGGGGDHARSKEAAGMMALHEALRNVCLNSDWTYSVFWTIRPRPRCRGGNGCKVGDDNGSLMLMWEDGFCRPRVAECLEDIDGRGPRPQGLQQDVHPALQLRRRVGAGLMGKVASDKCHKWVFKEPSECEPNIANYWQSSFDASPLAPLLLGGRDLITATTTHLINHLQKQAQHTATATVTIAVIQAGHGLLQLGSCKIIPEDLHFVLRMRHMFESLGYQSGFFLSQLFSSSRGTSPSPSSFPLKQQQPPPPQLFNWPGHAPPQLPPGASPLFPPGPAAFHPSSRPMPPFPGGGKDESHLFHLPPAAAAKQPQHMDEHHHHQQQPMAAPQQHGGKAPEGDLKWPQRAVVLHRAHRPDRGREVPLRRRRRRRRGRREQDGGGGAGRGARRRGERGGVPEPGEPLQQGEEDGERPEHQVQEELHVAGEDELVHHVDVPVGVGVDGAGAAAAAARDGVQGPTRGRRLLGPNGDVLGVA

SEQ ID NO: 92586 - protein, 537 aa, Alternaria solani
MQTHLLILAAVVLLIIHIVNNFLIKPLQTLLKSRRLGCGPVPFEPTRWPLDIDTIRRSLKADKEQRTPDFVAGRFETMGRYTWGLSLLGTSNLITAEPRNVQALLATQFDDFIMGTARRTNLKTALGRSIFAVDGKAWHRARETMRPIFSRENVSRLELLEEHVQTMLQIIETKDEGLTTDANDRAWSAPVSLAVLLPRLTMDSATELFLGQSTHSLKKALARQQQKSGNEEHDADSFDHAFERMLAILGTRMRLRSLYWLYGNKELQKCINALHAFVDSAIDAADQARKSGSSQLRYDFLETLRTRCSDRAEVREQVLGLLAAGRDTTASLTAWVFYCLVRNPRVYKKLRDTVLAEFGPYSTNPGQKITFEKLKGCTYLQHVLNETLRLHSVVPFNSRCAARDTTLPVGGGPDGSMPVFVPKGTEVNFSTHVLHRRKDLWGEDADEFVPERWEKKRPGMTWQYVPFNGGPRICIGQQFALTEAGYVLVRMVQRYDVIEGLDIDVERDWHNFTVVCSPGSPVARDAAVMCRLRVAVE

SEQ ID NO: 92587 - protein, 307 aa, Clostridium perfringens str. 13
MDINLDALVEANRRYTKEGHVATYIPALAKVNPDQLGVCIYDLKENKEFSAGEYDVRFAIESISKVPTLILAILDNGIEKVFSEVGTEPSGFAFNSIMNMQINHKNKPSNPFINAGAIKVVSLLKGKNDEERFKRILDFYRKIMNDDEITLDTEIYLSERETGDINRSLAYYMKGNGIMEGDVTDILDSYFKQCSVLVTAKDLARLGAVLANEGVMPWNGERLFSVETATVVKSLMTTYGLYDESGAFSVHIGLPSKSGVGGGILSSVPNKCGIGLFSPALDVSGNSVASMKLLKEIADKLKLDIFR

SEQ ID NO: 92588 - protein, 355 aa, Kluyveromyces lactis NRRL Y-1140
MIERFMRNDKDRPSARDGQQNGTNDDSYFVKFLHWIITLDTYDGSSRNYGRMTETTNYTFFFGGRVRTVTKTSVYSIVVFAMFIVPLILFSIFECNYLWHHKGTNWKPAIVILYYFYLLTICSFLRAACSDPGIVPRNVHIPDLNASYKIPQEYYNYAILPTKNPNASVSMKYCQTCRIWRPPRSAHCSVCDVCVLSHDHHCKWLNNCIGKRNYRFFLEFLMASTISCILLILLSSFRLSYSPQVRYTPVSLLIICYCGLGIWYPLILFIYHIFLAGTQQTTHEYLRSIGSKHPIFHKITRNRDSPYDRNSMFFNLIHLWFQERGWNLVDPRRKQHYPADIRFRKLPEAHSFETV

SEQ ID NO: 92589 - protein, 469 aa, Bacillus subtilis
MNQSQSGLKKELKTRHMTMISIAGVIGAGLFVGSGSVIHSTGPGAVVSYALAGLLVIFIMRMLGEMSAVNPTSGSFSQYAHDAIGPWAGFTIGWLYWFFWVIVIAIEAIAGAGIIQYWFHDIPLWLTSLILTIVLTLTNVYSVKSFGEFEYWFSLIKVVTIIAFLIVGFAFIFGFAPGSEPVGFSNLTGKGGFFPEGISSVLLGIVVVIFSFMGTEIVAIAAGETSNPIESVTKATRSVVWRIIVFYVGSIAIVVALLPWNSANILESPFVAVLEHIGVPAAAQIMNFIVLTAVLSCLNSGLYTTSRMLYSLAERNEAPRRFMKLSKKGVPVQAIVAGTFFSYIAVVMNYFSPDTVFLFLVNSSGAIALLVYLVIAVSQLKMRKKLEKTNPEALKIKMWLFPFLTYLTIIAICGILVSMAFIDSMRDELLLTGVITGIVLISYLVFRKRKVSEKAAANPVTQQQPDILP

SEQ ID NO: 92590 - protein, 98 aa, Bordetella parapertussis 12822
MHSSTLGYNSRDFSQLEICMESIEQRVKKIVAEQLGVNEAEIKNESSFLDDLGADSLDMVELVMALEDEFETEIPDEEAEKITTVQQAVDYINSHGKQ

SEQ ID NO: 92591 - protein, 365 aa, Triticum aestivum
  misc_feature (126)..(126): Xaa can be any naturally occurring amino acid
  misc_feature (135)..(135): Xaa can be any naturally occurring amino acid
  misc_feature (137)..(137): Xaa can be any naturally occurring amino acid
  misc_feature (142)..(142): Xaa can be any naturally occurring amino acid
  misc_feature (148)..(149): Xaa can be any naturally occurring amino acid
  misc_feature (154)..(154): Xaa can be any naturally occurring amino acid
  misc_feature (221)..(221): Xaa can be any naturally occurring amino acid
  misc_feature (245)..(245): Xaa can be any naturally occurring amino acid
LAWSRPRSDLFSDPPSVRRSSISPWLIKNRYQRVSGRIGRGLWPGVALQKPRCSSSCAVNDPFITTDYMTYMFKYDTVHGQWKHHEVKVKDSKTLLFGEKEVAVFGCRNPENPGLCVFSAGADTCXSTGVFNRQXQXATHIXGGAKKXXSAPNXDAPMFVCGVNEKEYKSDIDIVSNASCTTNCLAPLAKVINDRFGIVEGLMTTVHAMTATQKTVDGPSXSKDWRGGRAASFNIIPSSTGARKXLLGKVLPELNGKLTGMAFRVPTVDVSVVDLTVRLAKPATYDQIKAAIKEESEGNLKGILGYVDEDLVSTDFQGDNRSSIFDAKAGIALNDNFVKLVSWYDNEWGYSTRVVDLIRHMHSTK

SEQ ID NO: 92592 - protein, 598 aa, Glycine max
MAGKNKGVAAEDAIRAIGLGYDLTNDLKLKFCKNHSRLIAIDDDNLRTVELPPRISIPNVPKSIKCDKGDRMRLCSDVLSFQQMSEQFNQDLSLSGKIPTGHFNTAFGFTGVWQKDAANTKTLAFDGVSITLYDIAFEKTQVVLHDHVKQAVPSSWDPAALTRFIEKYGTHVIVGVKMGGTDIIYAKQQYSSTVPPAEVQKKLKDMADEFFIDKAGQYNSIGGRFNAKEKFMKDNVLNFMDIQARSYYESEAQDIKFMCRRKGGNGKRFLSHSEWCQTVLSQPDVISMSFVPITSLLGGINGSGYLTHAMNLYLRYKPGIEELHQFLEFQLPRQWAPVFGELALGPERKPQNTASLQFSFMGPKLYVNTTPVDVGKKPVTGLRLYLEGKRSNCLAIHLQHLSSLPKTFQLQDEPNGNASNDSSERKYYEKVQWKSFSHVCTAPVDSDDDNAVVTGAHFEVGDTGLKKVLFLRLHFCKVVGATRVKVPEWEGSPGLTQKSGIISTLISTTFSGPQKPPPPRPSDVNINSALYPGGPPVPTQSPKLLRFVDTTEMTRGPQDSPGYWVVSGARLLVEKAKISLKVKYSLLTVIPDEEGASF

SEQ ID NO: 92593 - protein, 598 aa, Candida glabrata CBS 138
MRVKKRNVRGNAKNFITRSQAVRKLQISLADFRRLCIFKGIYPREPKNKKKANKGSTAPTTFYYAKDIQYLMHEPVLAKFREHKTFARKLTRALGRGEVSSAKKLEENRSTYKLDHIIKERYPSFPDAVRDIDDALNMLFLFANLPATNQISSRVIRDAQVICNQWLAYVAKERLIRKVFVSIKGIYYQANVKGEEVRWVIPFKFPENIPSDIDFRIMMTFLEFYSTLLHFVLFKLYTDSGLVYPPKIDVEQDKILSGINAYILESQEETSVLNAEVPSDAPDKEAQSIDTKTLAQAMKADSKDKDDNSNDEAPENVEDVELDEFEDHNKNKGDILAQPSKFSSPTATLFEDFVFYVGREVPIEAIEFLILSCGGKVISEAAMDQIEGNTEFDLSKVTHQIVDRPVLKHKVAGRTYIQPQWVFDCINKGELLSANLYLPGVSLPPHLSPWGDALGYDPTKEVESEDESSDSSEESDSEIENEEEDTKPAAITNEDDDEDVEELAAQKELELEASGIAYSKAKDEGLHDDVASKKKRKVTDEDEEEKKLKMIMMSNKQRKLYKKMKYSNQQKEDKIEELKKKKKQLAKKEKTLKKVEKK

SEQ ID NO: 92594 - protein, 454 aa, Escherichia coli CFT073
MTMSHNVTPNTSRVELRKTLTLVPVVMMGLAYMQPMTLFDTFGIVSGLTDGHVPTAYAFALIAILFTALSYGKLVRRYPSAGSAYTYAQKSISPTVGFMVGWSSLLDYLFAPMINILLAKIYFEALVPSIPSWMFVVALVAFMTAFNLRSLKSVANFNTVIVVLQIVLIAVILGMVVYGVFEGEGAGTLASTRPFWSGDAHVIPMITGATILCFSFTGFDGISNLSEETKDAERVIPRAIFLTALIGGMIFIFATYFLQLYFPDISRFKDPDASQPEIMLYVAGKAFQVGALIFSTITVLASGMAAHAGVARLMYVMGRDGVFPKSFFGYVHPKWRTPAMNIILVGAIALLAINFDLVMATALINFGALVAFTFVNLSVISQFWIREKRNKTLKDHFQYLFLPMCGALTVGALWVNLEESSMVLGLIWAAIGLIYLACVTKSFRNPVPQYEDVA

SEQ ID NO: 92595 - protein, 322 aa, Bacillus licheniformis ATCC 14580
MNKKVALITTGGTIASRKTESGRLAAGAISGPELAEMCSLPEDVQIDVYPAFQLPSMHITFQHLLELKQTIERVFQDGGYDGAVVTHGTDTLEETAYFLDLTIEDERPVVVTGSQRAPEQQGTDAYTNIRHAVYTACSPDIKGAGTVVVFNERIFNARYVKKVHASNLQGFDVFGFGYLGIIDNDKVYVYQKPLKRDVHQLQRPLPAVDIVKCYLDGDGKFIRAAVREGVEGIVLEGVGRGQVPPNMMADIEQALNQGVYIVITTSAEEGEVYTTYDYAGSSYDLAKKGVILGKDYDSKKARMKLAVLLASYKEGIKDKFCY

SEQ ID NO: 92596 - protein, 333 aa, Thiobacillus denitrificans ATCC 25259
MAIKVGINGFGRIGRMAFRAIAKDFPDIEVVAINDLLDPEYLAYMLKYDSVHGNFKGDIAVEGNNLIVNGKKIRLTAEREPANLKWNEVGAELVIECTGFFLTKETCQKHIDAGAKKVVQSAPSKDDTPMFVYGVNHEKYAGEAIVSAASCTTNCLAPIAKVLNDNWGIKRGLMSTVHAATATQKTVDGPSSKDWRGGRGILENIIPSSTGAAKAVGVVLPELKGKLTGMAFRVPTSDVSVVDLTVELEKPAKYADICAAMKKASQSGDISKTLGYTDEKVVSTDFRGNGFSSIFDAEAGIALDDTFVKVVSWYDNEYGYTCNMLRFVQHVAK

SEQ ID NO: 92597 - protein, 424 aa, Bacillus licheniformis ATCC 14580
MVADQNTGHTEENTHDVLKSTQTVIHKALEKLGYPEEVYELLKEPIRFLTVKIPVRMDDGSVKIFTGYRAQHNDAVGPTKGGIRFHPGVTEKEVKALSIWMSLKCGIIDLPYGGGKGGIICDPRDMSFPELERLSRGYVRAISQIVGPTKDVPAPDVFTNSQIMAWMMDEYSRIDEFNSPGFITGKPLVLGGSHGRESATAKGVTICIKEAAKKKNIDIEGASVVVQGFGNAGSYLAKFMYDAGAKVVGISDAYGGLYDPEGLDIDYLLDRRDSFGTVTKLFNDTITNKELLELECDILVPAAIENQITAENAHNIKAKIVVEAANGPTTLEATKILSDRDILLVPDVLASAGGVTVSYFEWVQNNQGFYWTEEEVEERLEKMMVKSFNNIYEMAHNRRIDMRLAAYMVGVRKMAEASRFRGWI

SEQ ID NO: 92598 - protein, 393 aa, Thiobacillus denitrificans ATCC 25259
MAFIRVTDLDLAGKRVFIRADMNVPVKDGKVTSDARITASMRTIEHCMRAGAKVMVTSHLGRPTEGEFKEEDSLKPVVDVIAQKLGKNVRLIREWTEGGFDVANGELVVLENCRVNKGEKKNVDETAKKYAALCDVFVMDAFGTAHRAEASTHGIAKFAPTAAAGILLTEELDALAKALANPARPMVAIVGGSKVSTKLTVLEALSEKVDQLVVGGGIANTFLAAMGKNVGKSLCEHDLIPTAKTLIEKMAARGASIPIAVDVVCGKKFDANEPAVLKSADEVADDDMIFDIGPKSAQELADIIAKAGTIVWNGPVGVFEFDQFGEGTKTVSMAIANAPGFSLAGGGDTIAAIQKYDIYDKVSYISTAGGAFLEYLEGKVLPAVAILEERAQG

SEQ ID NO: 92599 - protein, 288 aa, Moritella sp. PE36
MIKKCLFPAAGYGTRFLPATKSMPKEMMPVVNKPLIEYGVDEAIEAGMNGMCIVTGRGKHSLMDHFDKNYELEDQIKGTNKEELLDDIREIIESAHFTYIRQREMKGLGHAILTGRELVGDEPFAVVLADDLCVNEGKGVLEQMVALYKQFRCSIVAVEEVPAGDIHKYGVIAGDQIRDDLYRVTDMVEKPAKGTEPSNLAIIGRYILTPDIFEYIENTQPGKGGEIQITDALLKQAQEGCVIAYKFKGKRFDCGSVEGYIDAINYCYENVYLQDSKAELGKKKTEKK

SEQ ID NO: 92600 - protein, 375 aa, Kluyveromyces lactis NRRL Y-1140
MQEKIANVRCSSLQCGKVTDSMLKCPICLKQGIEEVFCGESCFKDGYKQHKALHYGTDGSGEVYDPFPKFKYTGKLKAQYPLSPKRQVPDEIEKPDWAENGLPIIEQRNDRTNKIPVYNKEQIKRIRKACALGREVLDVAAAAVRPGITTDEIDEIVHNETIKRGAYPSPLNYYNFPKSVCTSVNEIICHGVPDKYVLKEGDIVNLDVSLYYQGMHADLNETYYVGETIAKDVINTVETARECLKLAIKMCKPGVTFQSLGDCIEKHSKSNKCSVVRTYCGHGVGEFFHCAPSIPHYANNRTPGVMKPGMVFTIEPMINEGVWQDITWPDDWTSSTKDGKVSAQFEQTLLVTENGVEVLTARNKKSPGGPRNRIK

SEQ ID NO: 92601 - protein, 432 aa, Bacillus anthracis str. A2012
  misc_feature (332)..(332): Xaa can be any naturally occurring amino acid
  misc_feature (342)..(343): Xaa can be any naturally occurring amino acid
  misc_feature (427)..(427): Xaa can be any naturally occurring amino acid
MLSLNNSIYLEKLAVGGKFLIKKYTCKNGVRIVMENIPTVRSVAIGIWIHAGSRNENEKNNGISHFLEHMFFKGTETRSAREIAESFDSIGGQVNAFTSKEYTCYYAKVLDEHAKYALDVLADMFFNSTFDEEELKKEKNVVCEEIKMYEDAPDDIVHDMLTKATYETHPLGYPILGTEETLNTFTGDTLRQYIKDHYTPENVVVSIAGNIDEAFLQTVEQYFGSYEGTTNREQVHSPIFHFNKVARKKETEQAHLCLGYKGLQMGHEDIYNLIVLNNVLGGSMSSRLFQEVREQRGLAYSVFSYHSSYEDTGMLTLYGGTGSQQLDTLYEXMQETLETLKXXGITEKELINSKEQLKGNLMLSLESTNSRMSRNGKNELLLRKHRSLDEIIESVNTVTKENVDELIRNMFTDEFSAALISPDGKLXKGIKL

SEQ ID NO: 92602 - protein, 388 aa, Moritella sp. PE36
MNITIAGTGYVGLSNAVLLAQHNNVIALDIIADKVALINDRKSPIADAEIEDFLANKALNLTATTNKYDAYENADYVIIATPTDYDSENNYFDTSSVEAVIKDVMSINPTAIMIIKSTVPVGYTKRIKQKLCCSHIIFSPEFLREGKALYDNLHPSRIIVGEQSERAEVFAGLLAQGAIKQNIDILFTDSTEAEAVKLFSNTYLAMRVSYFNELDTYAETHDLNARQIIEGVGLDPRIGNHYNNPSFGYGGYCLPKDTKQLRANFEDVPNTLISSIVESNTVRKDHIAFSIINKQPKVVGIYRLIMKTGSDNFRASSIQGVMKRIKAKGIEVIIYEPVLTEDTFFNSQVITDLDAFKAMSDVIVSNRMEAALQDVVDKVYTRDLFGSD

SEQ ID NO: 92603 - protein, 456 aa, Blastopirellula marina DSM 3645
MERICSQLDQLMSHDLVGGVVETIGTTIAVGGFPAPVGSVVEIQRQSGKPLAGEVVGFRGELTLVFPLEQLSGVRQGSSVRLIRTMRSIPVGDSLLGRIVDAHGNCIDGFPHPALTMRSPMDQDPPIATSRPRIHETFSTGVRAIDGMLTCGDGQRIGIFAGSGVGKSVTLGMMAKYASSEVNVIALIGERGREVNDFIERDLGPEGMARSVVIVATSDQPAIMRVQAAMAATSIAEYFRESGRRVLFMMDSVTRFAMAQREIGLAAGEPPTTKGYTPSVFAMLPKLVERTGRSAQGSITAFYTVLVEGDDTNEPVSDAVRGLLDGHVILSRAIAAKGHYPAIDILASISRLMNDLVSEETRRAAQTIRELMSTYRENEDLINIGAYRQGTNPQIDLAIRMRSEIDTFLRQAMEEKSSVAAAQQQLLQLAAKCGARPIPNAAALAKAKRQTQQAGA

SEQ ID NO: 92604 - protein, 319 aa, Coccidioides immitis RS
MAAKDVTQKDKSVLGMPGFVVDFMMGGVSAAVSKTAAAPIERIKLLIQNQDEMLKTGRLDRKYNGIVDCFRRTAQAEGVVSLWRGNTANVIRYFPTQALNFAFRDTYKSMFAFKKDRDGYAKWMMGNLASGGAAGATSLLFVYSLDYARTRLANDAKSAKKGGERQFNGLVDVYKKTLASDGVVGLYRGFGPSVLGIVVYRGLYFGMYDSIKPVLLVGPLEGSFLASFLLGWTVTTGAGIASYPLDTIRRRMMMTSGEAVKYSSSLDAARQIAAKEGVRSFFKGAGANILRGVAGAGVLSIYDQVQLLLFGKAYKGGSG

SEQ ID NO: 92605 - protein, 457 aa, Heliobacillus mobilis
MNVAIIGTGYVGLVTGASLALLGNTVKCHDIDQEKVNLLLKGRVPFFEPYLESIVQDQVTQKRLIFSSNLSTCISDADFIFITVGTPTDQVSGAVNLEYVCKAATSIGKLLTPDKSPVIINKSTVPVGSHKIVQKMIEEGVYQSGNDNVHFAVASNPEFLREGSAIIDFFYPDRIVIGSENTEALARLELLYRPLLDQSFNPPTTIPPRPEGFSQVPLIKVDPISSELIKYASNAFLAMKISFINEIANISDRLGGNIHDISRGIGLDRRIGPHFLKSGLGWGGSCFGKDLKGLVFDASASGYNPKVLTAVLESNSLQRTVPILKLQSYLKSLRGKSIGVLGLSFKPDTDDLRDAPSIEIIKKLVDLHAIVKVYDPVAMNHFRANYPSLPIKYANDEYDLVNSLDGLILVTEWDQFTQLDWKKIYDKMKHKVVVDGRNVLDKNCLEAIGFVYYGIGS

SEQ ID NO: 92606 - protein, 272 aa, Corynebacterium glutamicum ATCC 13032
MRAIAAETATLTAVRIRDKRAELTNLWDYTNTKSSTVDPVTIVDTLAEDFIANRLQELRPKDGLIGEEGTGTASISGVTWIVDPIDGTVNFLYDLPQYAVSIAAAIDGEVVAGAVINVVTGVLYTAARHEGATKYLPERDEIVPLKASAATVVSESLVATGFSYSALRRSLQADLLTKILPTVRDIRRMGSAALDLCHLADGQVDIYYEHGLNCWDFAAGSLIAAEAGAFVRAPGLSIPGSSGEICFGAAPGVFDDANAHFDVVGAFKALDR

SEQ ID NO: 92607 - protein, 388 aa, Thermoanaerobacter tengcongensis MB4
MNPNKYISDVVKKIPPSGIRKFFDLVTNSKDIISLGVGEPDFVTPWEIRKEGIETLCRGNTTYTSNLGLLELRIAISYFLKTHYDLNYDPEKEIMVTIGASEAIDLALRALLNDGDEVLIPEPSYVSYAPCVILTRGVPVFIPTDEKNNFILTPDDLRSKITSKTKALILLYPNNPTGAIMKKEDLEEIVDVIIEKDLIVISDEIYSELTYEGKHVSIASLPGMKERTILINGFSKAFAMTGWRLGYIAAEHEFIEAMNKIHQYTTICAPITAQYAAIKGIYECEEDIIKMRETYDQRRRFIVNGFREIGLDCFEPKGAFYIFPSIKKTGMTSEEFCEKLLKEEKVAVVPGNAFGPSGEGYVRVSYAYSIDKIAKALERIKRFAEKIL

SEQ ID NO: 92608 - protein, 337 aa, Aspergillus nidulans FGSC A4
MAGLIRLLRTQFIPPTEPSISFAGKTVVLTGATAGLGFEAAIKMLNLGVESLIIGSRNLQRGEATKTELEQRTNRLGVVQVWELEMSSFQSVKDFAARVESLKQLDVALLNAGIWNREFTTSTEGWEETLQVNTLSTSLLALLLLPKLRSCSTDSSPTHLTVVSSQQFVRVQAKSLRTDGPLLEHLNDARRFSGPKQYGVSKLLLEYVLKSVAAQLHNENGTVPVVVNTVSPGLCVSSLGRQYTGLHHRLVVWIMYKLFARTAEQGSRSLVSATYQGLESHGRRWRSDGYLDESTALTTGAEGKQFQAKAWKEIMAVLKEQSNLAVVLDSNTGVSAN

SEQ ID NO: 92609 - protein, 300 aa, Burkholderia xenovorans LB400
MNTVASTHPAPLLRESFIELPARERARSLLDAGTFRELLGPFDRIESPWLPLQGVVCQADDGCVIARGTIGGEPAVVAAIESAFQGGSIGEVSGSKIAAALELALRDCERGKIVRPVVLFETGGVRLQEANLGLAVIAEIQAAIVALRRHVPVVGVIAGMVGCFGGMSLAAALCSYLVVTKQGRLGMNGPEVIEQEAGIEELDASDRRRVWQLIGGEQRTATALADQLVDDDADAVRAAVHAAFAQGVPAAHRSEQVDLFLNRLAQIDPATVTPETMRDVFNHHVQNVQHVQNTLRKEQA

SEQ ID NO: 92610 - protein, 222 aa, Halobacterium sp. NRC-1
MSKHSNAAHAPGVGRAVDAFRDGQPVLVHDAADREGEVDLIYPAPAVTADAVARMRTDAGGLICVALGDAVADAFALPFIADELDHPAADHGHLGYDDRSSFSLTVNHRDTYTGITDDDRALTIAELGQAAADPAAVDFPATFRAPGHVHVLRAAPSLSARQGHTELGIALAGAAGVPPAVVVCEMLDADTGGARSVADAKRYASRHDIPYVEGSDLVAAFQ

SEQ ID NO: 92611 - protein, 347 aa, Flaveria linearis
YIGLRQRRASGKEYAELMNEFMSAVKQNYGEKVLIQFEDFANHNAFDLLEKYRTTHLVFNDDIQGTASVVLAGLISALKLVGGSLADHKFLFLGAGEAGTGIAELIALEISKQTNAPLEETRKKIWLVDSKGLIVRSRLDSLQHFKKPWAHDHEPVNKFLDAVKAIKPTVLIGSSGAGQTFTKEVVEAMRSFNEKPIILALSNPTSQSECTAEQAYTWSEGRTIFASGSPFAPVEYNGKVYVSGQSNNAYIFPGFGLGLIISGAIRVHDEMLLAASEALAEQVTQEHFDNGLIYPPFTNIRKISAHIAAKVAAKAYELGLASRLPQPENLVAYAESCMYSPKYRNYR

SEQ ID NO: 92612 - protein, 188 aa, Flaveria trinervia
LDAIKTIRPTVLIGSSGTGQTFTKEVVETMSSLNEKPIILALSNPTSQSECTAEQAYTWSEGRAIFASGSPFKPVEYNGKLYVSGQANNAYIFPGFGLGLIISGAIRVHDDMLLAASEALAEQVTQEHFDKGLIFPPFTSIRKISAHIAAKVAAKAYELGLASRLPQPENLVAYAESCMYSPKYRIYR

SEQ ID NO: 92613 - protein, 263 aa, Gluconobacter frateurii
MDMGISGKVAVITGSSSGIGLAIAEGFAKEGAHIVLVARQVDRLHEAARSLKEKFGVRVLEVAVDVATPEGVDAVVESVRSSFGGADILVNNAGTGSNETIMEAADEKWQFYWELHVMAAVRLARGLVPGMRARGGGAIIHNASICAVQPLWYEPIYNVTKAALMMFSKTLATEVIKDNIRVNCINPGLILTPDWIKTAKELTKDNGGDWKGYLQSVADEHAPIKRFASPEELANFFVFLCSERATYSVGSAYFVDGGMLKTL

SEQ ID NO: 92614 - protein, 477 aa, Thiobacillus denitrificans ATCC 25259
MIRRTKIVATLGPACSDAKTLDRMMEAGLDVVRLNFSHGVAQDHIDRAELVRSLARTRGRAVGVLVDLQGPKIRIGKFKDNKIVLAKGDNFILDAECALGDQERVGLDYKELPSDVARGVTLLLDDGRIELWVEDVKGSEIHCKVVQGGVLSNNKGINRKGGGLSAAALTEKDIEDIKTAAALKADYLAVSFPRSGADMRQARELLRAAGGRSQLVAKIERTEAIENLEEILDASDAIMVARGDLGVEVGDAAVPALQKRMIRMAIARNKVVITATQMMESMITSPIPTRAEVSDVANAVLDGTDAVMLSAETAAGQYPVEAVQAMDRVCLEAEKEAETQFTRERLDHSFLRADEAIAMSAVFTSVHLNIKAIAALTESGNTCLWMSRLSTRVPIYALTPQVETRRKVTLFRGVYPINLKTATKERDVLLAEAEEELRRRGAVRDGDLILLTIGEPIGQSGGTNTMKIVRVGASKKP

SEQ ID NO: 92615 - protein, 395 aa, Clostridium acetobutylicum ATCC 824
MNFSNRVHNMDFSPIRKLVPLSKAAEDRGIKVYHLNIGQPDVKTPDTFFQGITNYNEKIVKYSDSQGIDTLIDSFIRSLSDSNIYFEKDEIMITHGGSEAIQFAIMATCDPGDEILSPEPFYSNYNSFAKVSGAKIVPFETKIEDNFHLPKKEEIIAKITDKTKCIMLSNPCNPTGTVYSYEEMRMLGEIAKEYNLFIISDEVYRQFIFDNVPYTSSIHLTDILDRVILVDSISKHYSACGARIGLVASKNKDLMHQILKLCQARLCVSTIEQYAAANLINTMGSYITDVKMAYKKRRDIMYSGLSSIPGVICSKPEGAFYILAKLPVDDSDAFAKWLLTDFSYNNETVMFAPASGFYATLGLGKSEARFSYCTSIEDIENSIVILKKALEEYNK

SEQ ID NO: 92616 - protein, 431 aa, Clostridium perfringens str. 13
MEKVIANELINFLYESPTAFHAVKNVKDTLEFEGFKELKEADRWNLEVEGKYFVTKNDSALIAFRVGKGDIAENGFKIIGAHTDSPGFRIKPNPEITVENTYVKLNTEVYGGPILNTWFDRPLALAGRVSLVSKNPLNPVNKIVNINRPILIIPNLAIHMNREVNEGYKINRQKDTLPLLSLVNETLEKGNYLVELLAKELYCEKEDILDFELYPYEYEKGCLMGLNEEFISSGRLDDLSMVHAGIKALMDAEVSQATNVMVCFDNEEVGSATKQGGDSDFLKTILERIVLALGKDREDFLRSLSESFMISADLAHAVHPNLGEKHDPVVRPVLGKGPVIKIAASQSYTSDSDSSAVYEMICRNAGVNVQKFVNRSDMRGGSTIGPISSTHLPIRSVDMGTPILAMHSIREFGAVKDHFDCIKSFTEFFRI

SEQ ID NO: 92617 - protein, 310 aa, Thiobacillus denitrificans ATCC 25259
MRTLICGSLAFDSIMVFRDHFKHHILPDKIHMLNVSFLVPEMRREFGGCAGNIAYNLKLLGGEPLIMATVGDDFGIYGERLDAQAISREYIRHVAGTYTAQAFITTDLDDNQITAFHPGAMNFSHENDVRAVPDVKLGIVSPDGRDGMLQHIRGFHEAGVPCVFDPGQGMPLFSGEELLECVHKSRYVILNDYEAELLQSRTGENLDTLARHVEALIVTRGAEGSVIHTAGRAIEIPAVRPEAVLDPTGCGDAYRSGILYGITAGLDWETAGQLASVMGAIKIEHRGGQNHAPSRDAIVARLETAFGTRI

SEQ ID NO: 92618 - protein, 301 aa, Kluyveromyces lactis NRRL Y-1140
MLDDILRHCLQECQAAKFISPNTKSTTINQMSRVGVLVLGPAGAGKSTFCNAIISHMQSIGRRAHIVNLDPAAEATKYEFTIDIRDLISLEDVMEEFGLGPNGSLIYCFEYLLNNLDWLDEEIGDYNDEYLIFDCPGQIELYTHIPVLPTIVRHLQNQLNFNLCATYLLEAPFVIDTSKFFSGALSAMSAMILLELPHINILSKLDLVKDSHNKKALKKFLNPDPLLLTDKVNEETNPKFHKLNEAIANLVDDFGMVQFLPLEAKNPESVSTILSYIDDVTQWAEAQEPKEPNDQIEIDDM

SEQ ID NO: 92619 - protein, 596 aa, Arabidopsis thaliana
MPFWWPLIVLAFAYAICKFLLMLIPPNVPSIDADASDVLAHGKDTEENSFIYIPPRGRSQQSDKKVQCYEPATMKYLGYFPALSPTEVEERVTLSRKAQKTWAQSSFKLRRQFLRILLKYIIEHQELICEVSSRDTGKTMVDASLGEIMTTCEKITWLLSEGERWLKPESRSSGRAMLHKVSRVEFHPLGVIGAIVPWNYPFHNIFNPMLAAVFSGNGIVIKVSEHASWSGCFYFRIIQAALAAVGAPENLVDVITGFAETGEALVSSVDKMIFVGSTAVGKMIMRNAAETLTPVTLELGGKDAFIICEDADVSHVAQVAVRGTLQSSGQNCAGAERFYVHKDIYTAFIGQVTKIVKSVSAGPPLTGRYDMGAICLQEHSEHLQSLVNDALDKGAEIAVRGSFGHLGEDAVDQYFPPTVLINVNHNMKIMKEEAFGPIMPIMQFSTDEEVIKLANDSRYALGCAVFSGSKHRAKQIASQIQCGVAAINDFASNYMCQSLPFGGVKDSGFGRFAGIEGLRACCLVKSVVEDRFWPLIKTKIPKPIQYPVAENAFEFQEALVETLYGLNIWDRLRSLIDVLKFLTDQSSNVSRTRKSH

SEQ ID NO: 92620 - protein, 116 aa, Vitis vinifera
MSSHNNSSPAVNDPRQPSTANPYVAPMVRPEDLPVDYSGFIAVIFAIVGLMFRYKLCSWLAIIFCAQSLSNMRNFENDLKQISMAMITGAGEKAEFKFFLPDSIAIHLGGHEKYVK

SEQ ID NO: 92621 - protein, 377 aa, Zea mays
MATASLLEATRLLSTPRPPRRSLHTHLLRTPRLSALRAHLHRSATLDAQEPTARPGALLVLDALRRSVVDSLAALKRPALALLLAGALLAAASMGGPHAAALAASGGRVGGSAFSSRSSSPPSYGYSAPAPRGGYTAAPYYSPSPFVSFGPAVGIGFGGSGFLVTLIGFAAFLYLAGFLSDSSGGTSVLTETDKTTVLKLQVGLLGMARSFQKELDQIAEKADTSTPAGLSYVLTETTLALLRHPDCCISAYSSVDVKRSVDDGEKRFNQLSIEERGKFDEETLVNVNSIKRNKGGSQRSSGFSNEYIVITILVAAEGVHKLPVINSSNDLKTALQKMGAIPSSKILAVEVLWTPQNENDTLSERELLEDYPLLRPL

SEQ ID NO: 92622 - protein, 433 aa, Glycine max; identical to SEQ ID NO: 1400

SEQ ID NO: 92623 - protein, 320 aa, Heliobacillus mobilis
MQSRLFQDIQNDLAKVEAELAKYADTSLPTLTAASSHLLHAGGKRLRPAFVLLAGRFHNYSLERLLPLAVAMEMIHMASLVHDDVVDESKTRRGIPTVKARWGNRISIHTGDHLFARSLLLIAELNDDKISEVLAKVSVEMCKGEIQQMSGTFDVNQTFRDYLFHIKRKTALLISASCQLGAMAVKADPSIVRALKMYGHHLGMAFQVTDDILDLTADEAELGKPVGSDLRQGIITLPILEALWETKDPLLRLLVAKRDKSQEEVGQAIEIIKNSGAIDRSQKIARRYLEKAKDELKRLPPVPTRDSLASIAEFIEKRTY

SEQ ID NO: 92624 - protein, 191 aa, Ralstonia solanacearum GMI1000
MPFNFPILLTWLRVAMIPLVVGVFYVPDAWMAPPVKNLTAAAFFIVASLTDWFDGFLARRWNQTSAFGAFLDPVADKLMVAAALLVLLALGRVSDVIALVIIGREITISALREWMAQIGASRSVAVNFLGKLKTTFQMVAIPLLLFEGRLFDVVDARVWGAWLIYVAAVLTLWSMAYYMKLAWPQIRERSK

SEQ ID NO: 92625 - protein, 247 aa, Populus trichocarpa x Populus deltoides
MARIAFGRFNDSFSLGSLKAYLAEFISTLLFVFAGVGSAMAYNKLTGDAALDPAGLVAIAVCHGFALFVAVAVGANISGGHVNPAVTLGLALGGQMTILTGIFYWIAQLLGSIVACYLLKVVTGGLAVPIHSVAAGVGAIEGVVMEIIITFALVYTVYATAADPKKGSLGTIAPIAIGFIVGANILAAGPFSGGSMNPARSFGPAVASGDFHDNWIYWVGPLIGGGLAGLIYGNLYITDHSPSSYEF

SEQ ID NO: 92626 - protein, 331 aa, Halobacterium sp. NRC-1
MTHTVAAVLLAGGTGTRLYPASRSHRPKQLLALGDDDRSLLRRTADRAAFADDLLAVTREAYADRVRDEVPEATVLVEPAGKDTGPALAYAASEVRARFGEDAVMLCLPSDHVVGDGFQETAETAVDVAARTDGLVTIGIEPDRPATGYGYIEPGDDHGDHSEVAVFREKPDAETASRLVDRGCLWNAGMFAWTPTAFLDAARSGPLDPLVDALATDADPATAFERVDPVSVDYAVLERAADVRVVPAAFDWDDLGAWNALGRLLDGENAVLGDATTIDATGNVLASDDKHVSVVGVDDLVVAAYDDRVLVVPRADAQRVRDVVAALDAPF

SEQ ID NO: 92627 - protein, 1189 aa, Bacillus cereus ATCC 10987
MFLKRLEIAGFKSFAERVSVDFVPGVTSVVGPNGSGKSNITDAIRWVLGEQSAKSLRGAKMEDIIFAGSDTRRAVNVAEVTLTLNNEDQRLPIEYNEVCVTRRVSRSGDSDFYINKQSCRLKDIIDLFMDSGMGREAFSIISQGKVEEILSSKSEERRGVFEEAAGVLKYKLRKKKAEGKLADTQENLNRVQDIIHELSSQVEPLERQASIAKDYLEKKEELEKVEAALIVHEIEELHEKWEALRNQFGHNKNEEAKMSTHLQKGEEELEELRGQLQAVDESVDSLQEVLLLSSKELEKLEGQRELLKERKQNATTHCAQLEQLIVELTEKATSYDGEIESSTEVLMQFVNHVKELETKLHDNEQLLATFADNLEEQIENLKGDYIELLNQQASHRNELSMIEEQSKQQNSKNERLDEENAKYVEMRMEITAKKTKLVESYEQVKEKVAGILSNIQKTEAALGKCKAQYSENETKLYQAYQFVQQARSRKEMLEEMQEDYSGFYQGVREVLKARENRLQGIEGAVAELLTVPKEYEIAMEIALGAAMQHIVVQKEEHARNAIAFLKQNKHGRATFLPQAVIKGRSLSFEQLRIVNQHPSFVGVAAELVQYNNKYENVVSNLLGTVIVAKDLRGANELAKQLQYRYRIVTIEGDVVNPGGSMTGGAVKQAKSSLLGRQRELEEWTSKLTDMEEKTTKLENFVKAVKQEIQEKEVQIRELRQSVEAERVDEQKLREEISRLELEEHRINDRLSIYDLEIEGFLQDQVKMQGRKEELEKILATLQAEITELDSKITALTKQKSEQHSSKEKVQKEMTELKVLAAEKQQRLSNQKEKVERLTKEKEETDATLVKTKEDLAFLKQEMTSNSSGEEQITNMIEKKAYDRNQTSELIRSRREQRVSLQERVEQLERNLKETTGKHKYILEMLKDQEVKINRLDVELENRLQHLRETYTISFEAAKLKYTMVMPAEDARKKVKLIKLSIEELGTVNLGAIDEYERVAERHTFLLEQKDDLEEAKTTLHQLITEMDEEMKKRFSTTFEGIRMEFQSVFSELFGGGRADLVMTNPEDLLNTGIDIVAQPPGKKLQNLGLLSGGERALTAIALLFGILKVRPVPFCVLDEVEAALDEANVARFAQYLKKFSDETQFIVITHRKGTMEESDVLYGVTMQESGVSKLVSVRLDDGEELVASK

SEQ ID NO: 92628 - protein, 500 aa, Oryza sativa Japonica Group
MVLTHVEAVEEGSEAAAAVFASRYVQDPVPRYELGERSISKDAAYQIVHDELLLDSSPRLNLASFVTTWMEPECDRLILEAINKNYADMDEYPVTTELQNRCVNIIARLFNAPVGDGEKAVGVGTVGSSEAIMLAGLAFKRRWQNRRKAAGKPHDKPNIVTGANVQVCWEKFARYFEVELKEVKLTEGCYVMDPVKAVDMVDENTICVAAILGSTLTGEFEDVRRLNDLLAAKNKRTGWDTPIHVDAASGGFIAPFIYPELEWDFRLPLVKSINVSGHKYGLVYAGVGWVIWRNKEDLPEELIFHINYLGADQPTFTLNFSKGSSQIIAQYYQFLRLGFEGYKSVMKNCMESARTLREGLEKTGRFTIISKEEGVPLVAFTFKDGAGAQAFRLSSGLRRYGWIVPAYTMPAALEHMTVVRVVVREDFGRPLAERFLSHVRMALDEMDLAARAPVPRVQLTIELGPARTAGEEASIRVVKSEAVPVRKSVPLVAGKTKGVC

SEQ ID NO: 92629 - protein, 118 aa, Aspergillus nidulans FGSC A4
MAKLFIGGLAWHTTDDVLREGFSRYGTIEEAVVVKDRDTNRSRGFGFVRFASEPEADAAMGAMNNQEFDGRIIRVDKASERPAARNGGFQGRGGYNSPADGGYRGGGAGGWRNQAPGP

SEQ ID NO: 92630 - protein, 365 aa, Roseovarius nubinhibens ISM
MGFKMGIVGLPNVGKSTLFNALTKTAAAQAANFPFCTIEPNVGEVAVPDARLDRLAEIAGSRQIIPTRMTFVDIAGLVKGAAQGEGLGNQFLANIRETDAIAHVLRCFEDGDVTHVEGRVDPVADAETIETELMLADLESIEKRLQNIIRKVRGGDKEAVQQQRLLEAAKAALEEGRPARTVAVDDDDMRAWKMLQLLTTKPVLYVCNVSEEEAATGNAHSAKVAEMAAAQGNSHVVISARIEEEISQLDDEEAAMFLDEMGLTEAGLDRLIRAGYELLHLETYFTVGPKEARAWTIKTGTSAPKAAGVIHGDFEKGFIRAETIAYDDFVSLGGEQPAKDAGKMRAEGKGYIVKDGDVLHFLFNT

SEQ ID NO: 92631 - protein, 394 aa, Halobacterium sp. NRC-1
MRVVTKFGGTSLGSGDRVERAADSIADAVAAGHEIAVVASAMGNTTDELLDDITFDADEPDRAEIVSMGERTSVRMLKAALAARGVDATFLEPGTTDWPIVTNERGEVDADATAAGVDRLAGRLGDTVPVITGFLAEDPQGNVTTLGRGGSDTTAVMLGRYLDADEVVIVTDVEGIMTGDPQVVEGARNVGRITVDELRNLSFRGAEVIAPSALSFKDDALDVRVIHYQHGDLLSGGTRIEGTFESMIDMRDSPLACLTVAGRAIRNRPGITSALSTALSDSDINVDAVASGMDSMTFYVDESVAERAENILHQEVIAVSELSSVTVTDDIAAIRVLGGELPNRPGVLCRIIDPLADRNINVIDIISSATSVAVFVSWADREPALDVVQNGFGS

SEQ ID NO: 92632 - protein, 153 aa, Brassica napus
RELPQNSKIVATHTDSPDVLIWDTETQPDRHAVLGAPHSRPDLILTGHQDNAEFALAMFPTEPFVLSGGKDKSVVLWSIQDHITTAGSNKTGGRSVGPRGVYHGHEDTVEDVAFCPSSAQEFCSVGDDSCLILWDARTGTGPAMKVEKAHYAD

SEQ ID NO: 92633 - protein, 289 aa, Brassica napus
DHERSILTKLKQQCGGQFTSKMEGMVTDLTLARENQNSFEEYLGNNPAANPGIDLTVTVLTTGFWPSYKSFDINLPAEMVKCVEVFKGFYETKTEHRKLTWIYSLGTCHLNGKFDTKPIELVVSTYQAAVLLLFNTTDKLSYTDILTQLNLSHEDLVRLLHSLSCARYKILLKEPSTKTVSQTDSFEFNSKFTDRMRRIKIPLPPVDERKKVVEDVDKDRRYAIDAAIVRIMKSRKVLGHQQLVSECVEQLSRMFKPDIKAIKKRMEDLITRDYLERDKENPNMFRYLA

SEQ ID NO: 92634 - protein, 144 aa, Photobacterium leiognathi
MKLLKGVDCTSCCIAIVIARFNSFINENLLSGAINALQRKGQVKAENITVIRCPGAYELPLAAQQIAKQGNYDAIIAIGAVIRGGTPHFDFVAGECNKGLAQVALEYQTPVAFGVLTVDSIEQAIERAGTKMGNKGEEAALSAL

SEQ ID NO: 92635 - protein, 502 aa, Secale cereale
MDGGGEHSEALKNYYLGKILGVGTFAKVIIAEHKHTRHKVAIKVLNRRQMRAPEMEEKAKREIKILRLFIDLIHPHIIRVYEVIVTPKDIFVVMEYCQNGDLLDYILEKRRLQEDEARRTFQQIISAVEYCHRNKVVHRDLKPENLLLDSKYNVKLADFGLSNVMHDGHFLKTSCGSLNYAAPEVISGKLYAGPEIDVWSCGVILYALLCGAVPFDDDNIPNLFKKIKGGTYILPIYLSDLVRDLISRMLIVDPMKRITIGEIRKHSWFQNRLPRYLAVPPPDMMQQAKMIDEDTLRDVVKLGYDKDHVCESLCNRLQNEETVAYYLLLDNRFRATSGYLGAHYQQPMESASPSTRSYLPGSNDSQGSGLRPYYRVERKWALGLQQSRAPPRAIMIEVLKALKELNVCWKKNGDCYNMKCRWCPGFPRVSDMLLDANHSFVDDCAIKDNGDANSRLPAVIKFEIQLYKTKDDKYLLDMQRVTGPQLLFLEFCAAFLTNLRVL

SEQ ID NO: 92636 - protein, 668 aa, Ustilago maydis 521
MSLKVQLPHSSLCRIGQRTTGAQGGLSSDKAAQKEKVGPLKSGLLFSYMQNFCALQTRLRRPSRTTELDTMDFKPFLTLQHFRPQGFAGDVLAPGASYNQTWNTMASKFNGRGGNRVETGKVLEAASESLKETVPLLQLVVRARHHPLLVFLVGLFLGTIYLLYRYWDCAVGCERRPDLKGPKGLPLIGNLMWALKNRDPLSYQVYAQQKYGYGNTHTLPGLGRLIDISRPDWIEHVQKIKFSNYVKGEQFHDQMRDVLGDGIFTSDGERWKMQRKVASRIFTVSSFKAIITQTIREDCALVEQLIETYARQGTVFNLQELYFKFTLSSFVKIAFSQDIKSLSEPDRPDTFGDAFNYAQKVLDMRFVQPWWKIAERFNETGRKMRAARKIVEEFTTNIVEARRKESEAMGEKSKPESSRKDLLDLFMAYRSSDGQRLSNQQLKDTILNLMIAGRDTTAEALSWMSWHMLTKPDVYDRIRHEIDATLEEEGEQAGLEIDYDVFEQHTAKLTTFQETLRLHPSIPKNIRRALQDDVLPNGGPRVRKGDLMLYSDWAMGRNPDIWGPDACEFKPSRWTDQETGSSIKYSQFQAHFFNGGPRLCLGQKLASYEVVQLIHHIFAKFDLELIDLGPGRSAGFGKVPDYLNSLTHPMKRPLMVKATLRCCKEGTR

SEQ ID NO: 92637 - protein, 194 aa, Lactobacillus plantarum WCFS1
MAFPQLDLSQVDGPKATIKTNFGDIKVQLFPKQAPKSVENFVGLAQKGYYDGIIFHRVIPDFMIQGGDPTGTGMGGESLWGKPFEDEFSQEVFNLRGALSMANAGPNTNGSQFFIVQKPQLDAGMSDQMKQAGYPEEIVTAYGNGGTPWLDFRHTVFGAVSDGMDIVDKIAATETGMQDKPVKDVVIETITIED

SEQ ID NO: 92638 - protein, 464 aa, Desulfovibrio desulfuricans G20
MNAKLEHTPKSCWEIYGTEEHAQPMDELAERYIDFISRCKTERETMEYVVERLRSAGYTQNFAHDRVYRVFKDKTIFIAAKGRNSISQGLRLIGAHADTPRIDLKQHPLYEACGVGQAKTHYYGGIRKYQWLSRPLALHGVVVKEDGTVVQVNVGDDAGDPVFAISDLLPHLAQKQSGQTLSEAFEAEKMNIILAHRPVENAADSKDADTQQPPKEKIKARILEILHAKYGIVEEDLYSAELQAVPAGPARYVGLDSALIGGYGQDDRICVFAALEALLQDGTPEYTRCVLFWDKEEIGSEGSTGAKSRFFEYCIADLIAAWQPAARFSDVMLNTRAISADVHGAMDPDWQDLHEKLNAAIIGYGPCFCKFTGHRGKYEANDAHPEYVGWLRGVLNEQGIPWQMAELGRVDLGGGGTVAMYLAAYGMDIIDFGPAILGMHSPFELASKADLYATVKAYGAFLMC

SEQ ID NO: 92639 - protein, 353 aa, Halobacterium sp. NRC-1
MSDAYLALETGDVVEATARAPGMARGELVFTTAYTGYEESLTDPSYEAQVLTFAYPLIGNYGVRPERTESDRVHPSAVVARELTDDVADWLRTEGVPAVDGIDTRDLVLDIRDGGAMQVGIAAGPDASPATARAQLADCPRLSARTEIGAHVSVDTAETHGNGDTTVALVDCGAKRSIIDAFVARGATVHRLPYDATPADIAAVDPDLLFISNGPGDPANFDAAEHLVDEYIGTVPIAGICLGQQIVARALGGDTEKMDFGHRGVNQPVLDHDSGRVVMTTQNHGYTVADPGDLTVTQVNVNDGTPEALDSAPLDVLTRQYHPEANPGPHDTRGFFDDVLAMADASYTPATAD

SEQ ID NO: 92640 - protein, 347 aa, Halobacterium sp. NRC-1
MQAVTFDGHGGTGVIDYRTVPEPDLGADDVLVDVRAGALNHLDVWTRRGMPGIDLSMPHVPGSDAAGVVSAVGASVTRFEPGDRVAVLAGVSCGQCEFCRHGEPALCASFRVLGEHVPGVHSERAAVPADNLIAVPEHVDWETAAAAPLVFQTAWRMLNTRADVSPGESVLVLGASGGVGHAAVQIAAHAGAEVFATASTEQKLQYAAELGADHVVNYTETNFADEIRARTGKRGVDVVVDHVGEATWDDSLRSLAKGGRLVTCGATTGGRPETNVQRVFWNQLDILGSTMATPGEADAALEHVWDGTFDVRIRDVLPMRETARAHELLENREGFGKVVVKPDNELD

SEQ ID NO: 92641 - protein, 461 aa, Lactobacillus plantarum WCFS1
MTKENSQPATEQLSRGLKSRHVQLIAIGGTIGTGLFLGAGQSIHLAGPAILIAYLVTGLVCFLLMRALGELLLSDLHTHSYIDFIKQYLGDKTGFVAGWTYWVCWITIAMAEITAAGEYMQFWWPRLPQWLPGLIILILLLGLNSINVSAFGETEFWFAIIKIAAILALIAVGIGMVLLSVKTPVGHASLTNLVSYGGFMPHGIKGLVLSFQMVLFSFIGIEMVGMTASETADPKTVIPKAINDIPVRIILFYVGSLFFLMCMYPWQYFSAAHSPFVQVFTNLGIRSAAAIINFVVLTAAASSCNSALFSTGRMLFSLTYDGKSKFAKRMGILSTRQVPRNALWFSTLVIGLSVILNLLMPGKVFSLIASVSTTCFIFIWGAIVVAHIKYRRQAGSQAKVKFRMPLFPLSDYFILVFLAFIAVVLCLKFETLIALLVSAVWVVGLYIVKIVSDRIRQRTHD

SEQ ID NO: 92642 - protein, 558 aa, Synechococcus sp. RS9917
MTTARTTAISFDSISDALAAIRNGECVVVVDDERRENEGDLICSAQFASPDQINFMATHARGLICLAMEGERLDALDLPLMVDRNTDANQTAFTVSIDAGPEHGVSTGISADDRSRTIQVALRPDARPADLRRPGHIFPLRARQGGVLKRAGHTEAAVDLAQLAGLIPAGVICEIQNADGSMARLPELRDYARQWNLRLISIADLIRYRLNNERFVRRQAQATLPSLFGSFQAIGYRNELDGSEHVAIIKGDPQQLQEPVLVRMHSECLTGDAFGSLRCDCRPQLESALARIEAEGEGVVVYLRQEGRGIGLINKLKAYSLQDGGLDTVEANEKLGFPADLRNYGVGAQILSDLGIHRLRLLTNNPRKIAGLDGYGLEVVERVPLVIEPGDHNADYLAVKRDKLGHWIHEASTVICWDGTLPADALPQPLAMASEAAAIEGLVLVPVQSPRLLALWERPQFAWRLAEASAEATGEGQTSQAEPLDSRLKRLLSAMATWPITRRIGLYHTSRPDQLNHPPQTLEREERPLEELRTSSPERNGATELPLCSNDVALIQWS

SEQ ID NO: 92643 - protein, 532 aa, Synechococcus sp. RS9917
MSFPDFSASDAQTQWQRFCDLLWFHDDLGMWLDVSRMHVNSADLDALAPQFDQAFQAMQALEGGAIANADEQRQVGHYWLRHPQLAPSPDVADHISAEIDQIEQFGKAVIAGEIKAPNGAAFTDVLWIGIGGSGLGPLLMIRALQNQGEGLPFHFFDNVDPNGMSRVLAGLGEAIKTTLVITVSKSGGTPEPHLGMEQARHRLEACGGDWPGQAVAITMKNSHLDQQAQQEGWLQRFDMFDWVGGRTSITSAVGLVPGALIGANIRDFLAGAAQMDEATRLADLRRNPSALMAASWFVAGEGKGKRDMVVLPYRDRLEVFSRYLQQLVMESLGKRLDRSGAEVHQGIAVYGNKGSTDQHAYVQQLRDGVDNFFVTFIEELTDVEDIPEINGERPGDFLDGFLQGTRSALTEGGRQSISISMRHLDARRLGALIALFERAVGFYGELVNINAYHQPGVEAGKKAAAAILKLQGQVEALLADGVSRSAADVQQAIGASPVEPIFWILRHLCANKRGYIAQGSWDQPASLRFSKA

SEQ ID NO: 92644 - protein, 471 aa, Xanthomonas campestris pv. vesicatoria str. 85-10
MSSWLRRKSIDQVTVHETGRQLVRSLSWPHLIALGIGAIVGTGIYTLIGVGADKAGPAVLLSFVAAGIVCACAALAYAEMATMMPAAGSAYTYSYTALGESIAWVVGWSLVLEYSLVVSTVAVGWSGYFVGFLQWLGVGLPHELIAGPHAGGIVNLPAVVITFLVAGLLMAGTKESATLNAVLVVLKIIALGVFVAIALPAFNSANLQPFMPYGFSKAMGPDGVERGVMAAAAIIFFAFYGFDAISTAAEETKNPGRDLSIGIVGSMIGCTLIYVLVALAAVGAMSFTVFGKSPEPLALILRELGHGKAALVIGAVAIIALPTVLLAFLYGQSRIFFVMSRDGLLPRGLSKVNARTGTPVAITLFTAVLVAALAGVARLDEIAALANAGTLAAFTAVAACLLVLRVREPGRARAFRTPLAWVVGPVAIGGCLYLFWSLPSKTQVWFLLWNALGVVVYLAYGRRNSRLNQAG

SEQ ID NO: 92645 - protein, 726 aa, Coprinopsis cinerea okayama7#130
MWLLSRLLSSVANMPDWIKFQTAPLALGFLTSAISVFWDYALRHFYLEAVIYDRDPSFTWMVTWITNHPAWSSTQSSFEISTSHSGVDDGPKPMPFPGDEELPEKPTDQGSLYLLPKPGSWYRIRHGSSVISFFIEAGSNDSFRVAKTLRLRIYSFNAKSLLRKIATEAKATYRSTVGKVPEVWFYRPGGFDPRWEVTSHKPRRAIDTVILEPGRSEAIVSDVKDFVSSGDWYRARGIPFRRGYLLHGPPGTGKTSIVGAIAGELGLDVYCLALSARDLDDEKLSKLVNRVPPQSILLIEDIDAAVSPAPRQHGARNENPHVNSPPGPMGPDSAPVMGPGQVDNSEAPRTGVTLAGLLNALDGVDSAEGRILFATTNYPDRLDSAIKRPGRMDRHFYIGLTTRPQAKELFKKFYPTFPKGSRSEFVASGSLDSIAEADDVNERLELETLATTFANIVPENTYAMAALQGYLLTYKSDPYGACNSDNFKQFMDELSTDLKAKGDDEQTGDTAGSRVSGAAPRSPPANLNLSLPDAEPTDRLVQVPWWNHALTSPWVTPPSSEPPVIPSPGSPVPYQCFSPSSMLSTSAPTSVAPGPSTGLRAFEDFEAEYEEMRSAVARMAVHIWDVDRGVSALARRLASASGDSEESLLLRSASRQPCRHPDVDDAMRNLLSKSVGDGESPRSREGGPVTQVVPATESTSRRSLDSDRLSYLDGLASLFGEGAQPE

SEQ ID NO: 92646 - protein, 295 aa, Coprinopsis cinerea okayama7#130
MSPSTTYSKSSATTAGRGYLNGSPLKSKSLASGVDGKAAGGMETLSLIEASKRLAAYTAVDQHVKPEHRIIGIGSGSTVPYVVDRIVQQGVELNAGRVFIPTGFQSRQLIVAAGLTLGDVDQYPTIDITIDGADEVDHNLNCVKGGGACHLREKVLAEAAHTFILVADYRKNVQFLGTNYLSGVPIEVVPFAYNKVLHNLHHSLGSPKAALRMAIKKAGPVVSDNGNFIIDAPFTQEQLADPYTVLAQIKMLTGVVEVGLFCKMAKAAYFGNEDGSVTVRWDDGRVEVVPSATSA

SEQ ID NO: 92647 - protein, 442 aa, Roseovarius nubinhibens ISM
MTMKSTDAVADQLIEKLANRTATIGIFGMGYVGQPLALRYAQLGYKVIGFDIDQQKVDLLNGGQSDIEHISDEAIAEANASGMESTVDISRTPEADALILCVPTPLNKYREPDLSFVVDTTDSFVPYLRAGQVVSLESTTYPGTTEEELLPRITSGGLKIGREIFLVYSPEREDPGNANFTTNTIPKVVGGHTPICLEVGEALYGQAIDRIVPVTSTKAAEMTKLLENIHRAVNIGLVNEMKIVADRMGIDIFEVIDAAATKPFGFTAYYPGPGLGGHCIPIDPFYLTWKAREYGLHTRFIELSGEINRAMPEYVVGKLVKALNERRKALHGSKVLVLGIAYKKNVDDMRESPSVEVMELLRDNGAEVAYSDPHVPVFPKMREHKFDLASVALTPENIAGFDAVVLATDHAKFDYEMIRAHAQVIIDSRGVYRTAAENVVKA

SEQ ID NO: 92648 - protein, 497 aa, Arabidopsis thaliana
METKTLIFSILFVVLSLIYLIGKLKRKPNLPPSPAWSLPVIGHLRLLKPPIHRTFLSLSQSLNNAPIFSLRLGNRLVFVNSSHSIAEECFTKNDVVLANRPNFILAKHVAYDYTTMIAASYGDHWRNLRRIGSVEIFSNHRLNSFLSIRKDEIRRLVFRLSRNFSQEFVKVDMKSMLSDLTFNNILRMVAGKRYYGDGVEDDPEAKRVRQLIADVVACAGAGNAVDYLPVLRLVSDYETRVKKLAGRLDEFLQGLVDEKREAKEKGNTMIDHLLTLQESQPDYFTDRIIKGNMLALILAGTDTSAVTLEWALSNVLNHPDVLNKARDEIDRKIGLDRLMDESDISNLPYLQNIVSETLRLYPAAPMLLPHVASEDCKVAGYDMPRGTILLTNVWAIHRDPQLWDDPMSFKPERFEKEGEAQKLMPFGLGRRACPGSGLAHRLINLTLGSLIQCLEWEKIGEEVDMSEGKGVTMPKAKPLEAMCRARPSVVKIFNESV

SEQ ID NO: 92649 - protein, 171 aa, Brassica napus
  misc_feature (39)..(39): Xaa can be any naturally occurring amino acid
  misc_feature (65)..(65): Xaa can be any naturally occurring amino acid
MRSHHQGGRSKLTVLQLLCAVAVFSVLLFTIQSSFFSDXANRKVNILRPEDIQILSEFQSSVQQXDRGLGLSAHIIDHCNLILKFPQGTNSTWYNAQFKIFEPLEFKYNVCEAVLLWEQYRNMTTVLTREYLDVRPNGWLDYAAMRIAQLGAGKCYNRTWGEEHLNVILPA

SEQ ID NO: 92650 - protein, 491 aa, Oryza sativa Indica Group
MAVAAPGQLNLDESPSWGSRSVDCFEKLEQIGEGTYGQVYMAKETETNEIVALKKIRMDNEREGFPITAIREIKILKKLHHQNVIQLKEIVTSPVEGNKYKGSIYMVFEYMDHDLTGLADRPGMRFTVPQIKCYMRQLLTGLHYCHVNQVLHRDIKGSNLLIDNEGNLKLADFGLARSFSSDHNGNLTNRVITLWYGPAVDMWSVGCIFAELLNGKPILTGKNEPEQLSKIFELCGTPDELIWPGVTKMPWYNNFKPQRPMKRRVKESFKHFDRHALDLLEKMLTLDPSQRISAKDALDAEYFWTDPLPCDPKSLPKYEASHEFQTKKKRQQQRQAEEAAKRQKLQHPPPHSRLPPIQNPGQPHQIRPGQPMHNAPPVAAGPSHHYAKPRGPGGPNRYPQGGNQGGYNPNRGGQGGGYGSGPYPQQGRGPPPYPGGGMGGAGGPRGGGGSGYGVGGPNYQQGGPYGASGPGRGPNYNQGGSRNQQQYGNWQ

SEQ ID NO: 92651 - protein, 395 aa, Ustilago maydis 521
MTTRTATSTSTTVHGHLGDLKLRNAAITGPHLQPKAAKQDLADTKPDSARTFPGLGFKLSPTEERLRAKRNWGFLETAYDNSKVMGLTTHFVTITMAIVFNKSWLAKPVYDWLNTYDRFTIHTVHTWILLSTCQLLVIGLFALTDLSGRPSWLARYRMQPHKPPTLAQYKKLIPVVLFNLVVVNTISNIIYYPLAEWRGIQTTYETLPSGKKLVAQWLVCLLMEDIGFYTVHRALHHPRIYKYIHKKHHEFSAPIAGASTYAHPLEHYFSNLVPILVGLLITRAHISVQYLFFTGLMIGSHVQHSGYNRFANYCAVRVAPVPFLTCALVHDWHHYFNTENYGPVGLLDAIFKTNKTFKAWTSETVAAFHGDRAKARQAALEKLAQIEAEEQERIR

SEQ ID NO: 92652 - protein, 305 aa, Halobacterium sp. NRC-1
MVDVDSFVEDARAEISEALGDETAIIALSGGVDSSTAAALAYEAVGDQLVPVYVDTGLMRKGETDEIREVFDYMDSLRVVDASDRFFDELAGVTDPEEKRHAIGEQFIREFETVAEEVDATQLVQGTIYPDRIESEGTIKSHHNVGGLPERVGFEGIVEPMRDLYKDEVREVARHLGLEEIISERMPFPGPGLAVRVIGEVTPEKVAVCREATHIVEDELEAYEPWQAFAAVLGRATGVKGDNRVHGHVVAVRSVESRDGMTARAQELEWETLQRLQSRIAGTIDEVSRVVYDVTHKPPATIEYE

SEQ ID NO: 92653 - protein, 1281 aa, Coccidioides immitis RS
METAIRWAPASTPDDQRFLYVDIKGQEFKHCKVTSRPDKFTLTYDVLSAFSHGSEFRSFDWCPTEENLVAVGHASGDVVVAHLDTGALIPLALPSKVQRACHGLAWNSSGLLAAGLDKFRGDYCLNIWDPHQRPVRMASRGGSERQVPDPLRRYANGEPVASVRFFNDQPSLLIAGMKGHSVRLYDLRESHGNPSLQFSTRCVHELTVNRLDENYFASCAPFDNASICIWDRRSGSRYSTAAGTSSGTIDAGHVLEIRPGIASGSTIRSLRFSQTQRGRLGMLTDRGIFRAYHIAKDHSPDELRAALEKTVGRGSSKHYPEQLYTKTVRDFQTSFPPKTRSEDSSQRVSAFDFMTTDSFDGLEAITILNDRNVAVYSLPLVCGRVSLSPQGALVRGGFAHGQDFRVFAPAQGSKAAQTTQEIQDRASRKMESSMEGKEANGKAGEDDGKDSGGTGIISSRQRREKLLLPEKLANVQDALTLMTIPRLRLREGYTLNPERNQNIVSDDTALQDLWAWIERAHTRASDGSMIIHGVDMNYLGVQSIWSGNLGLSLENRLASSDLDDDVDVPKLIEQLAKKLDLQETKMCDTDFMPQRQLCLYICGAIASVDDLEGVVTQLVEERQHTQAAAFALFHDETELAYKALRNNRPTQAHKLLAMAIAGAPRGDPNFDWEEACAEIAKELTDPFAKAILALVSKGSWESVLRETTLPLRYRVEVAVRWLPDDQLTTYIRDTSMEAVQQGDIEGAVLTGLDHAAMDLFQSYINKFNDIQTAVLVMNYAVPRLVSDAFNANRFHAWRETYRQQMNSWKMHLHRAKFDVDSRNLAVSWDGRKLTRSQPQQVSLVCNYCTRPLSQQEERPDHQLAGAESTHHTPNNPLGNDTLVSVVNSGSEGATSCPPKLLFHLHHTSSSTGSTAPPPRTERSDWALPRHPIRTALQRLLKASRGALRMARTAGRGERKEPSRAVAVSKALSYVLRHAAEREVTFPDIIEAVSSSDKQRFGLLYVPSTSSSHSHDSLTQDAALQSAEENASKDPGANEDATAQALAASADDTDPSHYLIRARQGHSIKSIEASSLLKMLSLEDDNLPATVVHGTYHTAWPKILETGGLKCMGRNQMHFATGPALSEVLPNGDGGDVIIPSKLKGRSAGGGGGGDGSVISGMRSDSQILIYIDLKKALAAGCPFWISENGVILSEGLETGDSHGKVVGTEFFDVAVELRRGLGVLWEKGSLVQRTPDWMLQAKGPPGKGDKRHRGPKAAQKRALPRVHVGNDADGADVADQP

SEQ ID NO: 92654 - protein, 270 aa, Zea mays
MDMFGPIADNAGGIVEMSQQPESVREITDVLDAVGNTTKATTKGFAIGSAALASFLLFSAYMDEVASFAQLPFKEVDIAVPEIFVGGLLGSMLIFLFSAWACSAVGKTAQEVVNEVRRQFIERPGIMDYKEKPDYGRCVAIVASASLREMIKPGALAIISPMAVGIVFRILGHSTGQPLLGAKVVASMLMFATVAGILMALFLNTAGGAWDNAKKYIETGALGGKGSESHKAAVTGDTVGDPFKDTAGPSLHVLIKMLATITLVMAPIFL

SEQ ID NO: 92655 - protein, 151 aa, Oryza sativa Indica Group
MAVSAGGGGGAAGQFGDTTLTKVFVGGLAWETQKEGMRGYFEQFGDILEAVVITDKNTGRSKGYGFVTFREPEAAMKACFDPYPVIDGRRANCNLAYLGVQRSKAAAASLQPYAGHMRAMKSIIQTGGGGASLSMADHGIQQGIPTYNVYG

SEQ ID NO: 92656 - protein, 397 aa, Rhodospirillum rubrum ATCC 11170
MASFKTIDDLDVNGKRVLVRADLNVPIRDGVVTDTTRIDRSAETILALASRGACVVVCSHFGRPKGKRVPEMSLRPIVEPLSRALGGVPVAFAEDCVGPAAELVVNGLAPGEVALLENLRFHDEEEKNDPAFAQKLADLCDLYVNDAFSSAHRAHASTEYIARLVPAAAGRLMQAELEALGKALDNPERPVAAIVGGAKVSTKLELLGNLVSKVDMIIIGGGMANTFLFAQGIEIGASLCEKDMADTARAILEKAAAAKCEIVLPIDAVVASAFKEGAENHVVAIDAVPADKMILDVGPQTAQAVIAKLGECKTLVWNGPFGAFEIKPFDAATNTVAQAAAQATAEGRLLTVAGGGDTVSALANAGVEDKFSYVSTAGGAFLEWLEGKTLPGVAALL

SEQ ID NO: 92657 - protein, 335 aa, Rhodospirillum rubrum ATCC 11170
MAVRVAINGFGRIGRLVLRALVESGRKDVEVVAINDLGSPEANAHLIKFDSVHGVLPGDVSVSGDVMTIAGTPVKVLAERDPTKLPWGDLNIDIVMECTGIFSDREKAKVHLEAGAKRVLVSAPSNGADLTVVYGVNHDKLTKDHLVVSNASCTTNCLAPVAQVLHSVFGIEHGFMTTIHSYTGDQRTVDTLHKDLHRARAAAVSMIPTTTGAAKAVGLVLPELAGKLDGTSIRVPTPNVSVVDLKVVLSKTATAEAIGAAMKEAAAGKLKGVLGINELPLVSIDFNHNKNSSTFDLPQTKVVQGTFARVLSWYDNEWGFSNRMLDTAVEMGKLI

SEQ ID NO: 92658 - protein, 282 aa, Desulfitobacterium hafniense DCB-2
MSEQCNESCSSCGEDCADRKEGNPDFSAKLHEQSRVKKVIGIVSGKGGVGKSLVTSMLAVAMKKRGYHTAILDADVTGPSIPKAFGLKEKARGGESGLIPVKSEAGIDIMSINLLLAKDTDPVIWRGPIIAGIVKQFWTDAIWRDVDFMFIDMPPGTGDVPLTVFQSLPVDGIIVVTSPQELVAMIVTKAVKMAEMMKIPVLGLVENMSYFKCPDNGKEYQIFGDSHLEEIAAEHHLKILAKLPIEPQIAAACDQGTIEQVEVNWFDLAAELMEKMEGMKDA

SEQ ID NO: 92659 - protein, 392 aa, Synechococcus sp. CC9311
MPGPPSLSHRALALQPSLTLAISARAKALQQKGVDVCSLSAGEPDFGTPDFIVEASIQALRDGITRYGPAAGDPELRAAIAQKLSLENNIPTKTDQVLVTNGGKQAIYNLFQVLLNPGDEVIIPAPFWLSYPEIVRLAGGNPVTVPSSASDGFGLDLNKIEQSITPLTKVLVLNSPGNPTGRVLCLSELEALAELVRRHPHLMVMSDEIYEYLLEEGESHHSFAAVAPDLRERCFVVNGFAKGWAMTGWRLGYLSGDSTVIKAAAALQSQSTSNVCSFAQRGALAALQGSRDCIRAMAASYNTRRAELCNGLQQMKGITLVPPRGAFYAFPRLPDSITDSLAFCERALEEEGLAIVPGGAFGDDRCVRLSCAVSRETISDGLSRFQNLLTRR

SEQ ID NO: 92660 - protein, 306 aa, Lactobacillus plantarum WCFS1
MNKVTVLGSLNVDSILRFKRFPKPGETLPLTGKSVAGGGKGANQAIAAARAGAQTTFIGKVGTDQEGAFMVQQLTNSGVNDQYVQHSNVASTGSAFILLDSSSENRILIDGGTNQQVTAEDVERAQPAISASTFLIAQFETPIAATIRGFELAQAAGQKTILNPAPATTTVPAELLATTDLIVPNETETETLTGVHITDEQSMIQGAQKLQALGVANVIITVGSKGAFWMRGAEHGFVPAYKVEAVDTTAAGDTFIGALSSVLMPDFSNLAAAVRFANRASSIAVQKLGAQPSIPTKEAIEAAERA

SEQ ID NO: 92661 - protein, 737 aa, Coccidioides immitis RS
MASIPHDEILTTSAALPAAESGAARPDSPPKLKGRRRLLNRLQRMTSSPSLEQTGRSRSSSTGVRRLGKGSMSCISLSSTLSHGQCWESSSSSQFYGKFSGKPHGDDTGPIRVVETELISANGSQQTTIPLPAEMRPCSRGSLLRSAVAVLEDGENTPDTKGEKLLKMQNKNYWDYLPVEIQLRILSWLMPKELGKVACVSRSWRQLCFDGQLWAKFDTSTYYSDIPRDALVRLIFSAGPFIKHLNLRGCIQMAEAWFQCGEQIADACRNLVSVNLEGTHIDKPTITYFLVRNPKLVRISMTGLATVTNSEMNVISKSCPLLEYLDISWCRNLINANGLRRVVRACHRLKELRIDEFRAVDDEEFMLELFQTNTLETLVMSHCSSLTDSALKALLHGKNPEIDILTGRPIAPPRKLKHLNLSHCQGVSDFGIGHLAGFVPELESLQLSFCPALGNDSIINLIGTTPNLTRLDLEELEELTNNVLLALSKAPCAARLEHLNISYCEKLGDTGMMQIVKNCPNLKSLDLDNTRVSDLTLIELCSQMRKRGFGMQPPRCGLRVAVFDCGNVTWAGIREILSNNTFVPRYAEAAVLASRAEEEEESGSGSSSPSSSTTSVTILPSPPPETTQCKADLYPNEIIQLKCFYGWQTTVDIHTKRVLNGNLGAAMRLERRWTDCMMTNEEAEAGGIGARRRRRRARNAEMMYNLDDDDDADYGWSIHRKLGNMRERDRVRLASIS

SEQ ID NO: 92662 - protein, 384 aa, Listeria innocua Clip11262
MEKIYLAIALVLGVSQIFGVLASRMGLPKIVGELLVGVVLGPSLLNIVQPGEFLHIFSEIGVLLLMFIAGMETDFKKLKANLKPSIIVALFGVIIPLVAFLLFGKYLHMETMESFFVGIIFSATSVSITVKIFMDSDILQTKVAAIVLGAAVIDDILAVLLISAYKSVDQLATANIFFMLWDLLLSKILFFIMLYLFYKFALPWIKRYTEKWTWSFLPVTITLIICFFWGYFAELMGLSAVLGSFFFGLMLAISGTKQRVEKEIDLIANSIFIPLFLTSIGAAITLSDIWGNVGPIALGTLLAIITKLGSCYIAARASKLSRPDSFLIGSGMMSRGEMALVTLNIGISLHFIGEDYYSIFVAIIVMTTILSPLFIKLALPKSSH

SEQ ID NO: 92663 - protein, 92 aa, Vigna radiata var. radiata
MGFRLPGIRKTLSARNEASSKVLDAPKGYLAVYVGENMKRFVIPVSHLNQPLFQDLLSQAEEEFGYDHPMGGLTIPCSEDLFQHITSCLSAQ

SEQ ID NO: 92664 - protein, 337 aa, Heliobacillus mobilis
MNEAKENKEVTNRNDGGNGQTALATFAGGCFWCMVGPFEELDGIHQILSGYTGGHKENPTYHEVCSDETGHFEAIQITYDPAAVAYETLLDRFWRQIDPTDPGGQFHDRGSSYRTAIFYHDEGQREKAEASKKELEESRRFDKPIVTQILPASTFYPAEAYHQDYHKKSPFRYGLYRMGSGRDAFLEQYWRKPEKAQLKQKLSPVQYEVTQNNGTEPPFRNEYWDNHREGIYVDIVSGEPLFSSIDKFDSGCGWPSFSRPLHEEKVKEKMDLSHGMTRTEVRSQGADSHLGHVFDDGPAPGGLRYCINSAALRFIPKEDLEKEGYGQYKSLFEKKNS

SEQ ID NO: 92665 - protein, 280 aa, Desulfovibrio desulfuricans G20
MWDYTDKVRDHFLNPRNAGAIEDANAVGEVGSLACGDALKLYLKIDDQERIVDAKFQTFGCASAIASSSALTEMIKGMTVDEAMKVTNKDITAYLGGLPQQKMHCSVMGQEALEAAIKNYRGEEVEQHHHEGQLVCKCFGVTDEQIIRSIRENKLTSVEEVTHFTKAGGGCGDCLNDIQKLLDEELGKTAACEVPEPQPRTLSNVQRMQLVVKTLEEDIRPSLQKDGGDIELVDIDGKEVKVALRGMCTHCPSSQLTLTNFVQRTLREHVEPDITVKEVS

SEQ ID NO: 92666 - protein, 396 aa, Desulfovibrio desulfuricans G20
MRTIYMDNNATTAVDPAVLDEMLPYLKDLYGNPSSMHTFGGQVGRQVAEARERVARALGAQPEEILFTSCGTESDNTAIMSALQAQPEKKHIITTRVEHPAVLNLVQHLEKKGYEATYLSVDEKGRLDLDELRGALRKDTAIVSVMYANNETGTIFPIKEIAAIVKEKGALFHTDAVQAVGKLHINVQEVPVDFLALSGHKLHAPKGVGALYVRRGTPYRPFLRGGHQERGRRAGTENVAGIIALGKACELASLNMETERTTVKALRDRLENGLLNAIPEAIINGDTDNRLPNTTNIAFKYVEGEAILLLMDGHGICASSGSACTSGSLEPSHVLRAMGVPFTYAHGSIRFSLSRFNTQADVDYVVDELPRIIARLREISPYRSGEDAQAKPACTC

SEQ ID NO: 92667 - protein, 592 aa, Oryza sativa Japonica Group
MPEANAGGRAAPAAEQRSKNTTEMDFFSEYGDSSRYKIQEIVGKGSYGVVCSAIDQHTGDKVAIKKIHNIFEHLSDAARILREIKLLRLLRHPDIVEIKHIMLPPSRRDFKDIYVVFELMDTDLHQVIKANDDLTKEHHQFFLYQMLRALKYIHTANVYHRDLKPKNILANANCKLKICDFGLARVAFNDTPTTVFWTDYVATRWYRAPELCGSFFSKYSPAIDTWSIGCIFAEILTGKPLFPGKNVVHQLDLMTDLLGTPSMDAISRIRNDKARRYLSSMRRKQPVPFSEKFPNVDPLALKLLQRLLAFDPKDRPTAEEALADPYFKGLAKVEREPSCQPISKMEFEFERRKVTKDDIKELIFREILEYHPQLLKDYMNGSENTSFLYPSAVDNFRRQFAILEENGGKSGALDRKHVSLPRATTVHSTSIPPNEGLDATSQVTQRIPTARPGRTVGPVLPFENPGAADPHSARRVVRNPMVPPAAANKSGYSYNLKSDYSDRQHQEELEKDRVQYRPAQHLMDAKVAPDTAPDIRSSQYYFTRSAPRTDLTDRAALQGSMLYGIAPFNGIAAVAGGYSKVGAVQYGVSRMY

SEQ ID NO: 92668 - protein, 223 aa, Nicotiana tabacum
MAEVKLLGFWYSPFSRRVEWALKIKGVKYEYIEEDRDNKSSLLLQSNPIHKKVPVLIHNGKRIVESMVILEYIDETFEGPSILPKDPYDRALARFWAKFLDDKVPAVVKTFLRKGEEQEKDKEEVCEMLKVLDNELKDKKFFVGDKFGFADIAANLVAFWLGVFEEASGVVLVTSEKFPNFCKWRGEYINCSQIKESLPPRDELLAFYRSRCQAAAASASAPK

SEQ ID NO: 92669 - protein, 363 aa, Glycine max
MDFLNFLLNLLVPPGSMITLAFSWPALCFLNFCEWLCNSIYGEDMDNKVVIITGASSGIGEQIAYEYALRRANLTLVARREHRLRGIAENAKRLGARHVMIMAADVVKEDDCRRFVNETINVFGRVDHLVNTVSLGHTFCFEEATDTSVFPVLLDINFWGNVYPTFVALPYLHQSNGRIIINASVESWLPMPRMSLYAAAKAALVNFYETLRFELKDEVGITIATHGWIGSEMTRGKFMLEEGAEMQWKEEREVQVTGGPVEEFARLIVSGACRGDAYVKFPSWYDVFLLYRVFAPRVLNWAFRLLISPQGTRRASSYVGTGKHIEAVGMVRPMAMLEGTSPTHNAIGPLTFSGQLISQHKLD

SEQ ID NO: 92670 - protein, 562 aa, Oryza sativa Japonica Group
MELAVGAGGMRRSASHTSLSESDDFDLSRLLNKPRINVERQRSFDDRSLSDVSYSGGGHGGTRGGFDGMYSPGGGLRSLVGTPASSALHSFEPHPIVGDAWEALRRSLVFFRGQPLGTIAAFDHASEEVLNYDQVFVRDFVPSALAFLMNGEPEIVRHFLLKTLLLQGWEKKVDRFKLGEGAMPASFKVLHDSKKGVDTLHADFGESAIGRVAPVDSGFWWIILLRAYTKSTGDLTLAETPECQKGMRLILSLCLSEGFDTFPTLLCADGCCMIDRRMGVYGYPIEIQALFFMALRCALQLLKHDNEGKEFVERIATRLHALSYHMRSYYWLDFQQLNDIYRYKTEEYSHTAVNKFNVIPDSIPDWLFDFMPCQGGFFIGNVSPARMDFRWFALGNMIAILSSLATPEQSTAIMDLIEERWEELIGEMPLKICYPAIENHEWRIVTGCDPKNTRWSYHNGGSWPVLLWLLTAACIKTGRPQIARRAIDLAERRLLKDGWPEYYDGKLGRYVGKQARKFQTWSIAGYLVAKMMLEDPSHLGMISLEEDKAMKPVLKRSASWTN

SEQ ID NO: 92671 - protein, 573 aa, Vitis vinifera
MAVASNSRVFMQGVIGKSPGTGLGNLVSGVCFRTSGVRSGIKLGVRATMQVGLEEVKSSQLPNSVDGNLGFDVVSEGELREKGFLGMRKTKLVCTIGPACCLLEDLENLASSGMNVARLNMCHNTWEWHRDVIRKIKRLNEEKGYCVSVMIDTEGGQIHVVDHGAPFSVKAENESIWLFTTQKFEGSRPFTVQANYEGFSEGITVGDEVVIDGGMASFEVIEKIGNDLRCKCTDPGLLLPRAKLSFWRDGKLVEKNYELPTISTKDWADIEFGISEGVDFIAMSFVKDANAIKQLKSYLSNKSSKSIGVLAKIESLESLQHLEEIIEASDGIMVARGDLGVEIPLEQIPVVQAKITHVCRQLNRPVIVASQLLESMVEYPTPTRAEVADVSEAVRQYADALMLSGESAIGSYGQKALCVLRMASSRMELWSREENRQSALHQRQLGVSLPDRIAEQICNCAVEMADNLGVDAIFVYTKHGQMASLLSRNRPNSPIFAFTDNHSTRMSMNLQWGVTPLLVELSEDMEANITKTIDLIKMKGVLEEGDTVLVVSDITPSCATPKAFQSIQVKTIV

SEQ ID NO: 92672 - protein, 676 aa, Heliobacillus mobilis
MSHGWRLEGAMNLLVAENLTKTYGEKVLLQDVSVGIEEGERIGLVGVNGTGKSTFLKILAQLDKADGGTVTTGNAVRVEYLPQDPAFDERATVLQQVFKGNSPTMQLLREYEQALERQSADPHNQALQERLLALSQQMEAKQVWQIEAEAKTILAKLGIKDVSSPMGSLSGGQRKRVALAGALITPSELLILDEPTNHLDSETISWLEQYLLRRRGALLMITHDRYFLDRVVTRILELDKGRLYSYDGHYTEFLAAKAEREEQQRSSEQKRQNLYRNELAWIRRGAKARTTKQKARIDRFEKLVAEKVELRDESLEMPVGATRLGRKVIELSDVTKEYADQKVIDRFSYIFGRGERIGIIGPNGAGKSTLLKLIACRLAPDQGSVETGETVKVGWFGQENTEMKHEMRVIEYIREVAEFIPSPDGGVITAAQMLERFLFPPHLQWTPIGRLSGGEKRRVYLLHVLMGAPNVLILDEPTNDLDVQTLAVLEDYLDDFPGTVIAVSHDRYFLDRMAEKIFALKGEGTVNVSVGNFTDYEERLQEEAGAAKDRKDEPAQGAGKGKARIEKMDGKSGTVDAAQNDSRENSGTNEKSSRPLKFTYKEKIEYEQIEEQIAQAEQELQAVREKINAAGSNYVQLQELMQEQSQQELRVEELVERWAYLQELAERIAETNGKSG

SEQ ID NO: 92673 - protein, 1635 aa, Mycosphaerella graminicola
MATGGSASTPIVGDYNPERVEQLFDIPRPEQGNIYVEAENAARTPSGAQESQLSGSTPGINTADHADDSYLTANGREAAESINDDKKSSGFNSDDDQPINAEERNILRRLATNSRRSMNNTNEDPEALQRTGTLDGLGMDDPVFDPNSPRFDLYKWLKLTLKLVNDEDIKIKRSGLAFKDLHVSGSGSALNLQPTVSSMLSAPLRIGEMFSMAKKPHKQILRSFDGLMKSGELLIVLGRPGSGCSTLLKSLTGQMHGLTMDEKTTIHYNGIDQKQMIKEFQGEVIYNQEVDKHFPHLTVGQTLEHAAALRMSQQRPLGTSRQSAVEYLTQVVMAVYGLSHTYNTKVGNDFVRGVSGGERKRVSIAEMALAGSALAAWDNSTRGLDSATALTFIKALRLNADLVGSAHAVAIYQASQAIYDLFDKAIVLYEGREIFFGKASVAKKYFEDMGFYCPSRQTTGDFLTSVTNPAERQLREGYEDRAPRTGDDFEKYWHDSPEYQTLQKEIQGHTKEGSTPSATSSGTSKLSAASKNDNQAKHARPKSPYVVSVPMQIKLNTKRSWQRIWGDKAQTFTPMIFNVIIALIIGSIFFNSPPATSAFTARGAVLFFAILINALSAISEINSLYDQRPIVEKHKSYAFYHPATEAIAGIVMDVPLKFVVAVCFNLVLYFMSGLRREPAQFFLFFLIAFVSTFVMSAVFRTLAALTKTISQAMALSGVMVLALVIYTGFVVPTKYMKPWFGWIRWINPIFYAFEILVANEFHAREFECSQFIPTYTQFGGETFICSVVGAVAGELTVTGDAYIAEMYGYYYSHVWRNFGILLAFFFAFMVIYFVAVELNSSTFSTAEVLVFRRGHVPAYMQNIDKPGKEDGEAAAAEKGPEKGDEGGDVSAIPPQTDIFTWRDVDYDIEIKGEPRRLLDHVSGWVKPGTLTALMGTSGAGKTTLLDVLAQRTTMGVVTGNMFVNGAPLDDSFQRKTGYVQQQDLHLETSTVRESLRFSAMLRQPRTVSKQEKYEYVEEVIKMLNMEDFAEAVVGVPGEGLNVEQRKLLTIGVELAAKPKLLLFLDEPTSGLDSQSAWAICAFLRKLADAGQAVLCTIHQPSAILFQEFDRLLFLRKGGHTVYFGDIGKNSRTLLDYFESNGARDCGEEENPAEYMLEIVGDDSSDWVGTWNDSKEARRGTAGDRTHSQGTLLRGEELDRRQRRPLRPRRIRHAFRRPTQDGHSPRVPTILAYAELPVRENGSLHRRWSLHRFLLLLRDATLQGMQNVIYSLFMLTTIFSTLVQQIQPLFVTQRSLYEVRERPSKAYSWKAFLIANMVVEIPYQIIAGILVYATFYYPVVGIQSSERQVLVMLLCIVLFVYASTFAHMCIAAMPDAQTAGAIVTFLFFMALIFNGVMQPPSALPGFWIFMYRVSPFTYWVASMASAMLHDRQVTCSDTEISTFQPPQGQTCGQYMQPYLEGGAAGYLQNPDATADCGYCSIRVADTFLSGVGISWSNRWRDFGLVWVYVFFNLGMAVFLYWFFRVRSHSKKTSKKSKKSGDKKGAAAVAGTEKDDKKVKKTDTSSSSEGNTPAAASVDPEKDAEAQRSGSTTSAKAVKRQTSRTAGLTRTVSEMGQSVLTTNKGRSRANERNAHVY

SEQ ID NO: 92674 - protein, 388 aa, Xanthomonas campestris pv. vesicatoria str. 85-10
MNIPVPVVRLKNAWRSSHPWIFQKLVEKPAAKPKPGTIVDVVGVDGEWIGRGFYNGHSRIAVRILETDQSVPVDAGWFSRKIAAAVSLRRDWLKLDGVSDAWRVAHSEGDGLSGLVVDRYGDLVVVEFFAAGMFRHREWIYEALREQFPGCRFHSFADEHVQKQESFDFHSNTTTEAAVITEHGIKFRADPAGAHKTGFFADQRDNRQWLSEQVEGKSVLDLCCNTGGFAVYAAARGAAEVLGVDIDEDVIAIAKGNAKLNNVRPKFVQADIFPWLRDAANRGEQFDVVILDPAKMTRDRDQVIPALKKYLDMNKLALGVVKPGGLFATFSCTGLVAEQEFLDMLRRASYFSGRTIQILKVAGAGPDHPFMAHVQESRYLKAVFCRVM

SEQ ID NO: 92675 - protein, 508 aa, Brassica oleracea
MEKGSNGSAALEMQTSELDQPAALRKIISVSSIAAGVQFGWALQLSLLTPYVQLLGIPHKWASLIWLCGPISGMLVQPIVGYHSDRCTSRFGRRRPFIVAGAGLVTVAVFLIGYAADIGHSMGDQLDKPPRTRAIAIFALGFWILDVANNTLQGPCRAFLADLSAGNAKKTRTANAFFSFFMAVGNVLGYAAGSYKNLYKVVPFTMTKSCDLYCANLKTCFFLSITLLLLVTFMSLCYVTEKPWTPEPTADGKPSSVPFFGEIFGAFKELKRPMWMLLIVTALNWIAWFPFLLFDTDWMGREVYGGNSDATASVASKKLYNDGVRAGALGLMLNAIVLGFMSLGVEWVGRKMGGAKRLWGAVNFILAICLAMTVVVTKQAENHRRDHGGAKTGPPGNVTAGALTLFAVLGIPQAITFSIPFALASIFSTNSGAGQGLSLGVLNLAIVVPQMVVSVGGGPFDELFHGGNIPAFVLGAIAAAVSGILALTVLPSPPPDAPAFKTGAMGFH

SEQ ID NO: 92676 - protein, 223 aa, Streptococcus agalactiae 2603V/R
MDELKKLAGVTAAKYVKNGMIVGLGTGSTAYFFVEEIGRRVKEEGLQVVGVTTSNRTTEQARGLGIPLKSADDIDVIDVTVDGADEVDPDFNGIKGGGGALLMEKIVATPTKEYIWVVDESKLVETLGAFKLPVEVVRYGSERLFRVFKSKGYCPSFRETEGDRFITDMGNYIIDLDLKKIEDPKQLANELDHTVGVVEHGLFNGMVNKVIVAGKNGLDILEK

SEQ ID NO: 92677 - protein, 424 aa, Yersinia pestis biovar Microtus str. 91001
MLKHATMIKAKKFRGHSQDANNSMKVFNPMDFRREFPALSDKLTYLDSAATALKPRAMIDATQQFYQQDSATVHRSQHQSALSLTVRFENTRQQVADFINSSTAENIIWTRGTTEAINLIAQSYARPRLQPEDEIIVSEAEHHANLIPWLMVAEQTGAKIVKLPLGLDHLPDLQQLPQLLNEKTRILALGQMSNVTGGSPDLAQAIRLAHQYDCVVVVDGAQGIVHYPADVQALDIDFYAFSSHKLYGPTGIGVLYGKTELLEEMPAWQGGGKMLTHASFGGFTPHEVPYRFEAGTPNIAGVIGLSAVLKWLEHIDLEEAEVYSQGLATMAENKLAQLPGFHSYRCQQSSLLAFTFDGVHHSDLVALLAEQGIALRAGQHCAQPLMAALGVNGSLRASFAPYNTPQDVEMLCSALGKALELLRD

SEQ ID NO: 92678 - protein, 326 aa, Candida glabrata CBS 138
MKGNPSTHEVIGTMSTRRFYRWLITIDGDTEINYRNYEELPSRSNYIFFFGGRLRAVKTARPFSLVVLFLILSPMVLFSVFEAHRLWHTRYGYKALVVLFYYAWAWSLLSFTKTATSDPGVLPRNIHMHKDTPQEYFNNVTLPYGAGGSAGNASVTLKYCHTCKIWRPPRASHCSVCECCVLTHDHHCIWVNNCVGQRNYRYFLAFLLSSTLACALLIANCALHLHRALHEGIRVSHRPLPVAVLLCVYAAVLCVYPVILLGYHVAMSGTQQTTREYLRSIGFRNPVMHRIRRRRDNPYAEHGFLRNMLDLMAEPRGPRSCNYRYR

SEQ ID NO: 92679 - protein, 301 aa, Oryza sativa Japonica Group
MRVGFIGTTMEVQKDLRSEKAMYNNYGNSPGMQMPPIGQMPPAAGQMPSANPQPGQFGNPFYGASSGLIKTGLGAYGEKFLGSSSEFMQSNINRYFSNPQYYFHVNDQYVRNKLKVILFPFLHRGHWTRISEPVGGRLSYKPPIYDINAPDLYIPFMAFGSFIILAGFTLGFMGKFTPEAINLQFSRGLIGWALQIVILKGLLYSMGGGEVPLLDLVAYGGYLFAGLSLAVISRLLWAYSYFVMMPWMSLCMGVFLVRTMKRVLFTEMRSSERHSTRQHYFLLFLAISQFPLFFWLGNIGA

SEQ ID NO: 92680 - protein, 154 aa, Bacillus licheniformis ATCC 14580
MNKIEGHVIGTDLKIGIVVSRFNDFITSKLLSGAEDTLLRHGVKADDIDVAWVPGAFEIPLIAKKMAETKKYDAVITLGTVIRGATSHYDYVCNEAAKGIAASSMSTGVPVIFGVLTTDTIEQAVERAGTKAGNKGAEAAAAAIEMANLTRSLQ

SEQ ID NO: 92681 - protein, 402 aa, Synechococcus sp. CC9311
MAKRSLAKLNTSDLSGKRVLVRVDFNVPLNDAGAITDDTRIRAALPTINDLIGKGAKVILAAHFGRPKGQVNDKMRLTPVATRLSELLSKPVTKTESCIGPDAEAKVNAMANGDVVLLENVRFFAEEEKNDADFAKQLAGLADVYVNDAFGAAHRAHASTEGVTKFLKPSVAGFLMEKELQYLQGAVDEPKRPLAAIVGGSKVSSKIGVLEALIDKCDKVLIGGGMIFTFYKARGLAVGKSLVEEDKLELAKELEAKAKAKGVELLLPTDVLLADNFAPDANSQVADVTAIPDGWMGLDIGPDAIKVFQAALADCKTVIWNGPMGVFEFDKFAAGTNAIATTLAELSGKGCCTIIGGGDSVAAVEKAGLAEKMSHISTGGGASLELLEGKVLPGVAALDDAA

SEQ ID NO: 92682 - protein, 398 aa, Bacillus licheniformis ATCC 14580
MFHTIEEAIRDLKQGKVIIVVDDENRENEGDFVALAEYATPDVINFMASHGRGLICAPLNEEIASRLELQPMVDENTDSHHTAFTVSVDHRDTKTGISAQERSLTVMSLIADHAHPGDFKRPGHIFPLIAKKGGVLKRAGHTEAAVDLAEACGSAPAGVICEIMNEDGTMARVPELKKIADQHGLKMITIKDLIEYRYSKGTLINREVKITLPSEFGTFKVYGYTNEIDDKEHIALVKGDIPFGDEPVLVRVHSECLTGDVFGSYRCDCGPQLAAALAQIEQAGRGVLLYLRQEGRGIGLINKLKAYKLQEEGYDTVQANEKLGFLPDLRNYGIGAQILRDLGVKQMKLLTNNPRKIAGLEGYGLTIADRVPLQMETKKDNEKYLKTKKSKLGHMLHF

SEQ ID NO: 92683 - protein, 541 aa, Ustilago maydis 521
MISLVQHSFDFFETRLGLAVGFIITLALVYRDRAVFVAKCDHIKGPPGLPLLGNTLQVFKEAADPLQAMLSRSAVYGLPNTMTVLGMGRAINITRPDWIQHVQKTNFSNYVKGPKLHTCLKDLLGDGIFNADGHSWKAQRKVGSNIMTMSNLKNLVAGVLDAQSQRFSDLLQQAAKQGTPIDLQKAYFDFTIQTFLRIAFSTDLETVQSTRIATRSEQQKAAQHLSFADAFDLAQRLTVRRINRPWWKLTRRWEPSEKKLEHAIRTIDRYLYPLIERRSQNKSKADKRHADLLDLFLSYRDDQDQPLTPKQLRDALLNYLLAGRDTTAESLSWASFELLRHPEVVHDLRQELMSHSIWFDPHQKIDDDDAEQRSSSFELSHTKQLHHVRSIYHESLRLHPSVPRSSKIALQDDVLPGGVVVPKDTTVIWSDWLLARNKSVWGDDADEWKPRRWLNAEGEFINESPWKFHAFNGGPRTCLGIQLAQFQGMYMLSRIFSDFDLELESDRGLHFEPEVENTLTLPMKHPLMVRVYTRAKTSRAP

SEQ ID NO: 92684 - protein, 383 aa, Candida glabrata CBS 138
MTETETETGAKRYCAGLQCGKETSSELKCPVCLKAGIDAYFCDESCFKDNYKSHKATHFKEGEDGTLSQDAYDPFPKFKYTGGVRPQYPLTPKRHVPEHIPKPDWAENGLPITEQRNDRMNKILIYKKDEIKKIRKACMMGREILDIAAAAIRPGITTDELDAIVHEETIKRDAYPSPLNYYNFPKSLCTSVNEIICHGIPDKRPLKEGDIVNLDVSLFYQGFHADLNETYYVGENIEKDAINVVETARECLKTAIKQCKPGTTFQELGDYIEKHAKENKCSVVRTYCGHGVGAYFHCSPNIPHYAKNRTPGVMKPGMVFTIEPMINEGTWRDITWPDDWTSSTQDGKRSAQFEHTLLVTENGVEILTARNKKSPGGPRQRIK

SEQ ID NO: 92685 - protein, 386 aa, Oryza sativa Japonica Group
MERALMSLMRRRSLLQSGGRAPPAMAAAAGGSPFFSTLQQAAAADPVQSPGILPGLKIRDSASQLIGRTPMVYLNKVTEGCGARIAAKLEFLQPSFSVKDRPAISMLEDAEKKGLITPGKTTLIEPTSGNMGIGLAFMAALKGYELILTMPSYTSLERRVTMRAFGAKLVLTDPTKGMGGTVRKAAELYENHPSAFMLQQFENPANVKVHYETTGPEIWEDTLGQVDIFVMGIGSGGTVTGVGKYLKEKNPNAKIYGVEPAEANVLNGGKPDNEDLSFCSRSHLITGNGVGFKPEILNMDIMEKVIEVKGEDAVKMARELALKEGLLVGISSGANTVAALELAKKPENKGKLIVTVLPSLGERYLSSALFEELRAEAEAMQPVPVD

SEQ ID NO: 92686 - protein, 309 aa, Desulfovibrio desulfuricans G20
MNIAENMAALVGNTPLVRLNRLARGCHAEVVAKLEFYNPCASVKDRIARSMIESALESGEINADSLLVEPTSGNTGVGLAFICAVHGLRLTLTMPESMSDERKKLLRSFGTTLVLTPAAQGMRGAIAEAERIVRETPGAVMLQQFANPANPAAHYATTAEEIWRDTDGRVDAFVAGVGTGGTITGTGRRLRELNAGVRIIAVEPEASPVLSGGAPAPHPIQGIGAGFVPEVLDTGIYDEVFKVSGDDAMNTARDLLRQEGILCGISSGANAFAALEAARRPEMKGKRIVFIVCDTGERYLSTPLFSGQS

SEQ ID NO: 92687 - protein, 321 aa, Desulfovibrio desulfuricans G20
MRNCSKEPDNICADGMDWLDDVVETMCSPESCSKVFSKPLNNAPMPSLEELTEIVDRLKAALFPGYFGKSSIEMESMRYHLAANLDSIYRKLADQIRRGGCFTCAEFANDCHSCDVYSHDLAKRFIEQLPQIRGLLLGDVTAAFEGDPAAKTPGETVFCYPSITAMLHHRIAHALYDLDVPLIPRIISEMSHSRTGIDIHPGARIGEDFFIDHGTGVVIGETCIIGKGCRLYQGVTLGALSFPKDASGTLIKGNPRHPILEDNVTVYAGATILGRVTIGKGSIIGGNVWLTHDVPEGSKIVQQRSTRPQADEKMLGTKNGR

SEQ ID NO: 92688 - protein, 271 aa, Candida glabrata CBS 138
MSRVGLLVLGPAGAGKSTFCNSIISHMQTIGRRAHIVNLDPAAEPSKYEFTIDIRDLISLDDVMEELDLGPNGALIYCFEYLMKNLDWLDEEIGDYNDEYLIFDCPGQIELYTHIPVLPNIVRHLQGQLNFNLCATYLLEAPFVIDSSKFFSGALSAMSAMILLELPHINVLSKLDMIKDEYGKKKLKRFLNPDAMLLANEADQNLNPKFHHLNQCIANLVDDFGMVQFLPLEANNPESVATILSYVDDVTQWAEAQEQKEPKDQIDIEDL

SEQ ID NO: 92689 - protein, 145 aa, Bacillus licheniformis ATCC 14580
MAKKGYIQLTNGKKIEFELYPDAAPGTVANFEKLANEGFYDGLKFHRVIPGFVSQGGCPHGTGTGGPGYTIKCETEGNPHKHEAGSLSMAHAGKDTGGSQFFIVHEPQPHLNGVHTVFGKVTSGLDAVTSMEQGQGMEKVEVFDA

SEQ ID NO: 92690 - protein, 320 aa, Ustilago maydis 521
MSDAEAEAGPSTAPLFKKRAKSYAASRISTAAMDGVASRTEMRSDESAAQHGRDDDISVHDLVELRSLVRRPTGIELNRLNKGDKRRAPQHKPAHLQDERWQHHIQAAALRGSTSHTADNEQEESDDDNPTKPRRRVRKNHFQSETGTVDVDKHMMAYIEQEIKKRTGTNMQSDSNSDSVSKPIQNPDHQLYAVAEKYRELQRSIQPEQTQEEREGNVALSSAMLSSIPEVDLGIDNRMHNIQQTELARRKLHQHRTSNAHHQDAHAPQAARGDAADQALANARFQHSKQRPLSDPSARQQMATDQLVLDRFRKRQRNFR

SEQ ID NO: 92691 - protein, 218 aa, Glycine max
MMGSGDTSSSSDFFCRRHVFLCYKNPAVWPPRIEAAEFDRLPRLLHAAINARKPHIKKETCLTICEGHDGTETSNGDVLIFPDMIRYRRLTHFDVETFVEEVLVKEGEWLPGNPESLKASYVFVCSHGSRDRRCGVFGPILVSRFREEIELHGLQGKVLISSCSHIGGNKYAGNVIIFGSSNNREVTGHLYGYVTPDDVPLLFHQHIIKGEIFDSLWR

SEQ ID NO: 92692 - protein, 494 aa, Ammi majus
MKMLEQNPQYLYFFSLFLVTIFLYKWLTLKKTPLKNLPPSPPQYPIIGNLHQIGPDPQASLRDLAQKYGPLMFLKFGTVPVLVVSSADAAREALKTHDLVFADRPYSSVANKIFYNGKDMVFARYTEYWRQVKSICVTQLLSNKRVNSFHYVREEEVDLLVQNLENSHSKVANLTELLIEVTGNVVCRVSVGSGDKVDSYKILILEIMDMLGYSRSIEDFFPLLGWVDWLTGLRGKVAEAAKGVDTFLEGVLKEHLSTTGSKYNDFVSILLEIQEADAGSSMDNECIKSLIWDMLGAGTETISTALEWTLAALIKNPDAMFKLQNEVREIGKGKSKISEADLVKMNYLQAVMKESMRLYFTAPLLVPREARQDIKFMGYDISSGTQVLINAWAIARDPLLWDKPEEFRPERFLNSPIDYKGFHYEFLPFGAGRRGCPGIQFAMCINELVVANLVHKFNFELPDGKRLEDLDMTAASGITLRKKSPLLVVARPHV

SEQ ID NO: 92693 - protein, 267 aa, Zea mays
SQELLDPLRAMLAKTLAALTPGKLKYSFFCNSGTESVEAALKLAKAYQSPRGKFTFIATSGAFHGKSLGALSATAKSTFRKPFMPLLPGFRHVPFGNIEAMRTALNECKKTGDDVAAVILEPIQGEGGVILPPPGYLTAVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDMLLDGFRQLAREYPDLVQEA

SEQ ID NO: 92694 - protein, 509 aa, Ammi majus
MALFLYLIIPCTIILLHQLYHKLRFKLPPGPRPWPIVGNLYDIEPVRFRCFNNWSKTYGPIISVWFGSTLNVIVNNTELAKEVLKDKDQQLADRHRSRSAAKFSRDGQDLIWADYGPHYVKVRKVCTLELFTPKRLEAIRPVREDEVTAMVESIYKDCTNSDTIGKSLLVRQYLGGVAFNNITRLAFGKRFVNSEGVMDEQGKEFKSIIANGLKLGASLATAEHIQWLRWLFPLEEEAFAKHGARRDNLTRAIMEEHTLARQKSGGTKQHFVDALLTLQSKYDLSEDTIIGLLWDMITAGADTTAIVVEWGMAELIKNPRVQEKAQEELDRVIGYERVLTELDFSNLPYLQCVAKEALRLHPPTPLMLPHRANANVKIGGYDIPKGSNVHVNVWAVARDPAVWKNPLEFRPERFLEEDVDMKGHDYRLLPFGAGRRVCPGAQLGINLVTSMLGHLLHHYSWAPPSGLSSDEIDMSESPGMVTYMKTPLQAVPTPRLPSQLYKRLAVEDM

SEQ ID NO: 92695 - protein, 191 aa, Triticum aestivum
  misc_feature (92)..(92): Xaa can be any naturally occurring amino acid
NSLHKKAGWYRSGIPGISSTHASGAALKMVEEVRRQFNTIPGLMEGTAKPDDATCVKISTDASIKEMIPPGALVMLTPLIVGTFFGAATLAXVLAGALVSGVQIAISASNTGGAWDNAKKYIEAGASEHAKSLGPKGSDCHKAAVIGDTIGDPLKDTSGPSLNILIKLMAVESLVFAPFFATYGGILFKYL

SEQ ID NO: 92696 - protein, 541 aa, Aspergillus oryzae
MAETPELEPHNAFDTILTLDFGSQYTHLITRRLRELNVYSEMLPCTQKLADLKFKPAGVILSGGPYSVYEEGAPHVDPAYFDLGVPILGICYGLQEIAYRLDSTNVIAGTSREYGLAQLKAKKVGGHVDHLFDGLEDEFNVWMSHGDKLGKLPEGFHTIATTPNSEYAGIAHETKPIYGLQLHPEVTHTQNGTKLLKNFAVNICGCKQNWTMARFVDQEIARIRKLVGPTGQVLGAVSGGVDSTVAAKLMKEAIGDRFHAVLVDTGFMRLNECEQVKQTLAEHLGINLIVADASQVFMEGLKGISDPEQKRKFIGNKFIDVFEEEAKKIEDAAAHSETAGKIGFFLQGTLYPDVIESISFKGPSATIKTHHNVGGLPKRMTEGQGLKLIEPLRELFKDEVRDLGRQLGIAHEMVMRHPFPGPGIAIRILGEITPERVEMARKADHIFISMIREAGLYDKIGQAFAALDPSRAVGVMGDKRVYENIVLLRAVETTDFMTAIAYPFEHEFLTRVSTRIVNEVSGVCRVAYDYTSKPPGTIELE

SEQ ID NO: 92697 - protein, 478 aa, Roseovarius nubinhibens ISM
MYSYPELKLFINGEWRGAAEDMAVVNPATEEELGRLPKAGISDLQEALAAAEQGLRLWSRTPPRARADIILRAAALMRERQEEIAQSITAEHGKPLPQARLEVIRGVEFFEWDAGEAMRVYGRVIPAAPGSHISVHHHPIGVVAAFSPWNFPMSQPARKIAGALASGCSIILKAAEETPAGAIHIVRAFEDAGLPAGVLNLIFGTPSEISGYLIPQPSVRLVALTGSTAVGRQLTALAAQSDTRVLMELGGHAPVIVCEDTDVERAAISGAVRKMRNAGQVCTSPTRFFIHQDIFEQFAEAFTRRAAATVVGNGVEPGVEMGPLANDRRVPVLSALVEDAVAKGAELRCGGAAMGERGYFFAPTVLANVPDNARIMQEEPFGPIAILNPVRDLDEAIARANAVPYGLAGYGFTNRADYMARLVDEVEVGNLSINTLEASLPETPFGGVKASGYGREGGTEGLESYLTIKNVWHSAEIR

SEQ ID NO: 92698 - protein, 199 aa, Pisum sativum
LDEYSKFHGYSPAVVTGKPIDLGGSLGRDAATGRGVLFATEALLNEYGKSISGQRFVIQGFGNVGSWAAQLIDEKGGKIVAVSDITGAIKNSKGIDIPSLLKHTKETRGVKGFHGADSIDSNSILLEDCDVLIPAALGGVINRENANEIKAKFIVEAANHPTDPEADEILKKKGVVILPDIYANSGGVTVSYFEWVQNI

SEQ ID NO: 92699 - protein, 254 aa, Triticum aestivum
  misc_feature (96)..(96): Xaa can be any naturally occurring amino acid
MGRKFFVGGNWKCNGTVEQVESIVNTLNAGQIASTDVVEVVVSPPYVFLPTVKGKLRPEIQVAAQNCWVKKGGAFTGEVSAEMLVNLGVPWVILGXTSERRSLMGESSEFVGEKVAYALAQGLKVIACVGETLEQREAGSTMAVVAEQTKAIAGKIKDWTNVVVAYEPVWAIGTGKVASPAQAQEVHANLRDWLKTNVSPEVAESTRIIYGGSVTGASCKELAGQPDVDGFLVGGASLKPEFIDIINAATVKSA

SEQ ID NO: 92700 - protein, 396 aa, Pseudomonas syringae pv. phaseolicola 1448A
MTAQISRKRICILPGDGIGIEVMEAALPVIAALHLPFDLIPADIGWECWKREGETVPAQTWEVMASCDATLLGAITSKPLAEAEAELPLALQGRNRRYVSPVIQLRQNLDLYANVRPVTDMTGEDRFRFVVIRENTEGLYAGLDFGHVPDALVPLLEEREALGAPWQREGQEDATVTLRLQTRSGLTRIFEYAFDYARKNNFTRVTFVDKPMVLRHSSAFARGIFEEIAQRYPDITGVIENVDAVALWMVQRPERFGVIVAENMFGDILSDLGAGVMGGLGFAPSGNFGNSGAYFEPVHGSAPAHAGLNKANPSAMFMAIALMLEHLGYPAQAACITHAVSLVSQSGVRSYDLGGSHTTDQVGEAIVLQGIELQAGSVGYRAEQASVQGERYVSAL

SEQ ID NO: 92701 - protein, 429 aa, Arabidopsis thaliana
  misc_feature (26)..(26): Xaa can be any naturally occurring amino acid
  misc_feature (211)..(211): Xaa can be any naturally occurring amino acid
  misc_feature (262)..(262): Xaa can be any naturally occurring amino acid
  misc_feature (283)..(283): Xaa can be any naturally occurring amino acid
  misc_feature (329)..(329): Xaa can be any naturally occurring amino acid
  misc_feature (345)..(345): Xaa can be any naturally occurring amino acid
  misc_feature (408)..(408): Xaa can be any naturally occurring amino acid
MRGVTPNYYHSYTFFFFFVVLLALFXYVFSINTLSSTKTLTISSNRTIVSHGNVFELGFFKTTASSLNGDRWYHGICYKSISERTYVWVANRDNPLSKSIGTLKISYADLVLLDHYGTLVWSTNLTRTVKSPVVAKLLDNSKFVLRDSKSNYQNRFLWQSFDYPVETLLPEMKIGWDLKTGHETFLCSWRIPYDPSSKGLSFKLGTQGYMXLLYRSGPWNGFGFSGIPTMQNWSYFDVVNNFIENREEVACSFKVTDHSMHXRCTLTPEGLLHISRWDTISSXWNLFGVLPTEKCDLYQICGRDNYYDMKTSPTCNCIKGFVPKNVTGXDLGDIFEGCVRKSRLXCHGDGFFLLMKRMRMPETSTPIVDQTIGLNECKERCSKDCNCTRFANKDIRNSGSGYVIWTGXAHRYEELCRRRSRSICQNRPL

SEQ ID NO: 92702 - protein, 440 aa, Vitis vinifera
  misc_feature (308)..(308): Xaa can be any naturally occurring amino acid
  misc_feature (314)..(314): Xaa can be any naturally occurring amino acid
  misc_feature (434)..(434): Xaa can be any naturally occurring amino acid
MVSGENGEEERRRRIRGLLGLGFCVQGFRCFPWTAINFFLKDGLNAAPSTLQLLQSSANLPMVGKPLYGVVSDAIYIGGQHRIPYIAIGAVLQAVSWLAIAILPSSNISIFTITLYLLLSNLGASIVEVANDAIVAEIGRQPTSSSKKKQASSSGELQSFVWMASSMGGVLGNLLGGVTIDRFSSQAMFLTFGILLAIQFLITITFSESSLHLPKSPSNVGIRKQLSELTFALKKPEIAYSISWFAASYAIIPALTGTMFFYQTQYLKIDSSVLGISKVFGQAAMLLWSIIYNQYLKSVPPRKLISAXQVTMAXFMLSDILFMKGIYRNMGMPDSVYVVIFSGLLEVLYFFKILPFSVLIAQLCPRGCEGSLMAFLMSAIALAFIVSGYLGVALASYVGVTADDFSGMPQGLLIQAACTLVPLFWSSCIPEEKXRTEKKD

SEQ ID NO: 92703 - protein, 384 aa, Nicotiana tabacum
MGLLCSRNKGYNQADDEENTQTADIERRIEQETKADKHIQKLLLLGAGDSGKSTIFKQIKLLFQTGFDEAELKNYIPVIHANVYQTIKVLHDGSKELAQSELEASKYLLSAENKDIGEKLSEIGGRLDYPHLTKDLVQDIEALRKDPAIQETILRGNELQVPDCAHYFMENLQRFSDINYVPSKEDVLFARIRTTGVVEIQFSPVGENKKSGEVYRLFDVGGQRNERRKWIHLFEGVTAVIFCAAISEYDQTLFEDERKNRMMETKELFEWVLKQPCFEKTSFMLFLNKFDIFEQKALKVPLNVCEWFKDYQSVSTGKQEIEHAYEFVKKKLEESYFQCTAPDRVDRVFKIYRTTALDQKLVKKTFKLVDETLRRRNLFEAGLL

SEQ ID NO: 92704 - protein, 366 aa, Nicotiana tabacum
NQADDEENTQTADIERRIEQETKADKHIQKLLLLGAGDSGKSTIFKQIKLLFQTGFDEAELKNYIPVIHANVYQTIKVLHDGSKELAQSELEASKYLLSAENKDIGEKLSEIGGRLDYPHLTKDLVQDIEALWKDPAIQETILRGNELQVPDCAHYFMENLQRFSDINYVPSKEDVLFARIRTTGVVEIQFSPVGENKKSGEVYRLFDVGGQRNERRKWIHLFEGVTAVIFCAAISEYDQTLFEDERKNRMMETKELFEWVLKQPCFEKTSFMLFLNKFDIFEQKALKVPLNVCEWFKDYQPVSTGKQEIEHAYEFVKKKFEESYFQCTAPDRVDRVFKIYRTTALDQKLVKKTFKLVDETLRRRN

SEQ ID NO: 92705 - protein, 295 aa, Halobacterium sp. NRC-1
MSRVVAAGHVNWDVTLRVDALPEPDGEAEIVSQRRSGGGSAANVACALAGFDIDAGLVGSVGDDEHGLLAQRELQAAGVDLAGLRVVDGLETSVKYLLVDSRGEVMVLGNDGANEAVAPGDLDPAVVGADCEHVHLTSQRPATAARLTALAREHDATVSFDPGRRLRDRDYGDALARTDILFVNDNEAGAVLDDDGGPTAPDSDRVVVVKHGSEGATVHTPSGSVTHPGFAVDPVDTTGAGDAFAAGFVAVVLDGGDHERALEFGNACGALAAQHEGARTAPTRADAASFLDSQF

SEQ ID NO: 92706 - protein, 69 aa, Chlamydomonas sp. HS-5
MDESNATCGKRLDSIGVENTEENRRAYRDLLLSTPGLGQYISGAILFEETLYQCTKDGKTFVQVMNDQG

SEQ ID NO: 92707 - protein, 592 aa, Arabidopsis thaliana
MVVRFFRRQQAMEQIMFDRSHKNSFFVHFPLAPIALLDKNKLLLQGHGCMEEHIFEIRSESFVKSSLFKCYGLHRTLTGFSWNLSAKRDLKLRTIKEKKKGTLVPSGSKQLLSDKDLSTTIIDLPQALISEILNCLDPKELGLVSCVSTYLHRLASEHHAWKEFYRERWGLPVVFGAASSGLSDERSWKDLFVEREFRSRTFLGRYSIDTLYGHTEAVRTVFLLASAKLVFTSGYDSIVRMWDMEEGLSIAASKPLGCTIRALAADTKLLVAGGTDGFIHCWKSLDGLRNLFDLTGFQKEKTEFRLWGHEGPITSLALDMTSIFSGSWDMSVRIWDRSSMKCVKTLRHSDWVWGLAPHETTLASTSGSDVYIWDVSSETPLAIIPDAHEGTTYSLARSHTGDFLFTGGEDGGIKMFEIRRYGSETSVVLISQWMPHTSPVYSLSFEFPWLVSASGDGKLALIDVRKLLKTNRCAYSKRISSSTVEPPQRMLHGFGSNLFSVDVGYDRIVCGGEEGTVRIWNFTQALEIERRTRALKGMRHENRMRRRRMQMEMNAKNGRPDQCSIAAHKNPINGERNRAWHSKRRASGKAKA

SEQ ID NO: 92708 - protein, 195 aa, Brassica napus
MSRQDNGGHIFNMDGAGSGGSSTPLTAVYGSTKCGLRQFHGSVAKESQKTKVGLHTASPGMVLTELLLSGSSIKNKQMFNIICELPETVARTLVPRMRVVKGSGKSVNYLTPPRILLAIVTSWLRRGRWFDDQGRALYAAEADRLRNWAENRTRLSLTDAMEMYTENTWVSVFSLSVVCAFIIVSSTTPSSFPGT

SEQ ID NO: 92709 - protein, 654 aa, Xanthomonas campestris pv. vesicatoria str. 85-10
MLLICSFLFVLSDCPSMISLRNFSMRRGERLLLSNVDLTMHAGYRVGVVGRNGTGKSSLFAAVKGELEADKGDVDLPGKVRTASVSQETPSLPDPALSFVLGGDIEVSAVLQEEAAATAREDWEAVANAHQKMAEIGAYDAEARAGKLLHGLGFPADTHHRAVSSFSGGWRVRLNLARALMMPSDLLLLDEPTNHLDMDAVLWLEQWLLKYPGTLLLISHDREFLDNVATHTLHLHGGTAKLYVGGYTDFERQRIEHLRQQQIAHEKEQAERAHLQSFIDRFKAQASKATQAQSRMKRLAKMAGTEAVRAEREFRIQFAQPSRLPFSLIRLNHVEAGYAAAPRESGIGNGESQKRGSSDAITVLHDVGFGLEAGDRIGLLGPNGAGKSTLVKTLVGELAPLAGERSAHPDLRIGYFAQHTVESLHEGQSPMDHFRELSPDGSNQAFRDFLGKWNFAGDRAFEVVDGFSGGERARLALALIAWQQPNVLLLDEPTNHLDLEMREALAEALSDFEGAIVMVSHDRHLIGLVCDSFWRVADGVVEPFAGDLDEYAAWLRSRPAAQGTKQKMAEAAPTPPPPTKPLPPKKAVNPHKLASAEKRVGELEAALAALDRELANPGNYADSEKMAVLGRDREATAQQLAEAETAWMELIDGA

SEQ ID NO: 92710 - protein, 421 aa, Erythrobacter sp. SD-21
MKFGGTSMAGTERIRRVANIVRKQTAGGNEVAVVVSAMAGETDRLVNFCREANALYDPAEYDVVVASGEQVTSGLLALTLQSLGAKARSWLGWQLPVRTIEAHAKARVDSIDGEALGKSMAEGEIAVIPGFQGVSDEGRITTMGRGGSDTSAVAVAAAVGADRCDIYTDVDGVYTTDPRIVAKARKLKAVTYEEMLELASVGAKVLQTRSVGLAMKEGVRVQVLSSFVGDDAVPADELPGTMIVSEEEMNELVEKGLVERQHVTGIAHDKNEAKVILTRVPDKPGAVAHIFEPLAKASINVDMIIQNVGRDKGETDVTFTVPQADLARAQALLEDKRDDIGYNRLITDSKIAKISVVGVGMKSHAGVAATMFQALADRGINIQAITTSEIKVSVMIDEDETELAVRVLHTAYGLDAADEAA

SEQ ID NO: 92711 - protein, 340 aa, Solanum lycopersicum
MEKELLGYESFDLSSPKVPNEVRNFLQPHLLPLGKDSRTGITEMVASIGHSCVKSLDLLSQFMSYKVNGLCPDDWSLGQKLILSGCEPLPRRRCFAKTIPKVGLLKLPDSFWGNYSEKIYSWSGLGCKNVACLNVKKLNRDCAGCFDVVSSGGYEKQRYVKGRGKNDFLIDDVLGMLGNGGGIRIGFDIGGGSGTFAVRMAERNVTIVTATLNVDAPFNEFIAARGVFPLYLSLDHRFPFHDNVFDLVHVGNVLDVSGRPEKLEFLVFDIDRVLRAGGLFWLDNFLCSNEDKKTALTRLIERFGYKKLKWVVGEKINGSGKSEVYLSAVLQKPVLYVYDL

SEQ ID NO: 92712 - protein, 83 aa, Bacillus anthracis str. A2012
MVLLMTVNPGFGGQKFIHSVLPKIKQVAEMVKERNLEVEIEVDGGVNAETARLCVEAGANVLVAGSAVYNQKDRGEAIRVIRG

SEQ ID NO: 92713 - protein, 89 aa, Bacillus anthracis str. A2012
  misc_feature (56)..(56): Xaa can be any naturally occurring amino acid
MIKIAPSILSADFSKLGEEIKDVEKGGADYIHVDVMDGHFVPNITIGPLIVEAIRXITSLPLDVHLMMKIQITIFQLSQKRERILLLFM

SEQ ID NO: 92714 - protein, 561 aa, Herminiimonas arsenicoxydans
MNSAFDIKRFFPFLRWPRPTLATLKSDAWAGLSVGMVLIPQAVAYATLAGMPAATGLYAALIPSLVGVLWGSSALLAVGPAALSSLLVFGSLSPLAVPASGQWVALAIWLSIYSGGIQFLLGAFRLGRLSNLVSQPVIVGFINAAAIIIMMSQLPTLLGIADIFNSHPLQVLERVGAAPSHMLMTTAFGGGTLLLLVLGKRFFPRFPTILFVTILATALSWAFGYAAAGGEVVGDIARGLPPLVLPSAISFEQHRELWSAGLVLALISFTEAMSSCRVLARKRRERWDENQELIGQGLAKVASGFSGAFPVSGSFSRSALNLYAGATSAWATLFTLICVLVCLLFFTDMLYYVPRSVLAALIIMPVFSLFDFGAFKRLFSISRDDGAIAVVTFAVTIAAMPRLHWGVMVGITLTMVSYLYRHMQPRIIEVSQHADGTLRDRQRFHLPRLADDMLVVRIDAALNFLTGGVLDNFVVEQCSRDPQIRRLLLCVGSVNDIDATGVDTLESLQITLKSMGIDLYVSAIKKQVWDVLEDAGWLRGLSPEHIFMTDREAIAALATVR

SEQ ID NO: 92715 - protein, 529 aa, Oryza sativa Indica Group
MGNFVWMVAAAAAAVASWAFIAVVVKLVWRPRAISRRLRAQAVGGPGYRFFSGNLGEIRRLRAEGAGVVLDVSSHDFVPIVQPHFRKWVSLYGKTFLFWFGAQPNICLADINIVRQVLSDRTGMYPKDLTNPYFAHLLGKGLVLIDGDEWKRHYKVVHPAFDMDKLKMMTVTISDCTGSMMSEWESELGMKGGSAEIELSQRFQELTADVISRTAFGSSYSEGKQVFLAQRKLQFLAFSMFLTIQIPGFRYLPTKKNLKIWSLDKKVRSMLTNIIKIRLANKDTMGYGNDLLGLMLETCAPEHDESQQLSMDEIIAECKTFFFGGHDTTSHLLTWTMFLLSTHPEWMRKIRKEVTTMCGDEVPTGDMLNKMNLLNMFLLETLRLYGPVSLISRRTGTNAKFGGIKVPEGTILRIPIATIHRDKEVWGEDADEFKPARFENGVSKAAKHPNALLSFSNGPRSCIGQNFAMIEAKAVITMILQRFSFTLSPKYVHTPISVITLRPKYGLPMILRSLKNWDVNFSSLLVDWI

SEQ ID NO: 92716 - protein, 518 aa, Oryza sativa Indica Group
MGFEWTVATAAAAVARRGRSSRWWRLGAQGVAGPGYRFFSGNLSEIRRLRAEGANLVLDVSSHDFVPIVQPHIRTWIPLYGKTFLYWFGTRPNICLADMNMVRQVLSDRTGMFPKYIDNMQFARLLGKGLVLTDDDEWKRHYKVVHPAFDMDKLKMMTETISDCARSMMFEWESELGMKGGSTEIELSRWFEELTVDVISRTAFGSIYREGKQVFLAQRKLQFLAFSAFLTIQIPGFSYLLTKKNMKTWSLDKKVRSMLMNIIKSRLTNKETMGYGNDLLGLMLEACVPEHGGSQPQLSMDDIIAECKTFFFAGHDTTSQLLTWTMFLLSTHQHWMEKLRKEVRMVCNDEVPTGDMLNKLKLVNMFLLETLRLYGPVSLVTRRDGTDVKLGSIKVPKGTILTIPIATIHRDKEVWGEDADEFKPERFENGVLKAAKHPSALLSFSIGLRSCIGQNFAMIEAKTIIAMILQRFSFTLSPKYVHTPISVITLRPKYGLPMILRSLKNWDVNFSTLLVDWI

SEQ ID NO: 92717 - protein, 517 aa, Oryza sativa Indica Group
MGNLGWMVAAAVAAVVASWAFDAVVKLVWRPRAITRRLRAQGVGGPGYRFFSGNLGEIKRLRDEGAGVVLDVSSHDFVPIVQPHFRKWIPLYGKTFMYWFGARPTICLADVSMVRQVLSDRTGMYPKNVSNPYFARLLGKGLVLTDGDEWKRHRKVVHPAFNMDKLKMMTVTMSDCAQSMISEWESELGTKGDIVEIELSRRFEELTADVISHTAFGSSYKEGKQVFLAQRELQFLAFSTFLSIQIPGSSYLPTKKNLKTWSVDKKVRSMLTDIIKSRLNNKDVAGYGNDLLGLMLEACAPEHGESQPQLSMDEIIAECKTFFFAGHDTTSHLLTWTMFLLSTHPEWQEKLREEVAMECDGKVPTGDMLNKLKLVNMFLLETLRLYGPVAFIQRRVNAELELGGITVPEGTVLSIPIATIHRDKEVWGEDADIFKPERFENGVSKAGKYPNALLSFSSGPRACIGQNFAMIEAKAVIAMILQRFSFTLSPKYVHAPTDVITLRPKYGLPMILKSLKV

SEQ ID NO: 92718 - protein, 197 aa, Clostridium perfringens SM101
MKIKSSEFIISAVKREQYPDDNLPEIAFVGRSNVGKSSIINSLTNRRGLAKVSQTPGKTRLINFFLLNKDFYLVDLPGYGYAKVSKKEKASWGATIERYLLNRGPLKKVVLLVDCRHKPTADDVQMYEWIKHYGYEVVVIATKSDKISNNQIGKSEKLIKETLGLPKDYKLKFFSSLNKKGKDELVDYLFDDLVEEI

SEQ ID NO: 92719 - protein, 394 aa, Arabidopsis thaliana
MSSLSRFLLRGNFSFSTHTNRRFFSAVTAAAATPSPPKPSLITLVNDERDPKFITEKFKKACQAEWFRKNIAVYERTVRRLAAAKKFEWVEEILEEQNKYPNMSKEGFVARIINLYGRVGMFENAQKVFDEMPERNCKRTALSFNALLNACVNSKKFDLVEGIFKELPGKLSIEPDVASYNTLIKGLCGKGSFTEAVALIDEIENKGLKPDHITFNILLHESYTKGKFEEGEQIWARMVEKNVKRDIRSYNARLLGLAMENKSEEMVSLFDKLKGNELKPDVFTFTAMIKGFVSEGKLDEAITWYKEIEKNGCRPLKFVFNSLLPAICKAGDLESAYELCKEIFAKRLLVDEAVLQEVVDALVKGSKQDEAEEIVELAKTNDYLQCKLRLFPKE

SEQ ID NO: 92720 - protein, 365 aa, Bacillus cereus ATCC 10987
MKRQLILEDGTVLIGTGFGGEIEKSGEVVFTTGMTGYQETLSDPSYCGQIVTFTYPLIGNYGINRDDFESIHPSVNGLIVNEICDHPSNFRNEISLNDYLKERNIPGLAGIDTRKLTRKIRQYGTLRGRLCNMDADVEYIVSQLKATVFTDHVKRVSTKDPYPSPGRGHRVVLVDFGMKHGILRELNKRDCDVIVVPYNTTAEEILRLSPDGIMLSNGPGDPKDVPEAIEMLKDIIGKVPLFGICLGHQLFALASGANTSKLKFGHRGLNHPVKNLATGKVAITSQNHGYAVEEESVENTELEITHVALNDGTVEGLRHKKFPAFTVQYHPEASAGPEDANDLFEDFLTMIENFKKEGEELCQNA

SEQ ID NO: 92721 - protein, 528 aa, Sclerotinia sclerotiorum
MLGAIASIGGFMFGYESGQISFVQMSDFLDRFGENGELSAVRQGTIVAILCAGTLVGCLGSSYLCDTIGRRYTISSSAFFYIIGVIIEITSSTHWVQFAMGRFTAGLGIGALSTSVPMYQSESVPKNIRGAVVSSYQLLITLGIWTAYMINYGTHSAYTNSAQWRIPNGLSALWAIILGTAVLFMPESPRFAYRIGREDEARKNMALLNGVDPYSPLIDSEIQEIEQKLAAEREGGDHPWYEIFTGPRMLYRTLLGMVLQAGQQLTGANFFFYYGTTIFKSGGISDSYVTSIILGTVNVVATIGGLWIVKNCGRRKALMVGAAEMFVCMLIYSFVGHFKIQGQANAQAPGAVLICFTCIYIVGFATTWGPLVWAIVGELYPARYRASCMALATASNWLFNFLISFFTTFITNDIDYYYGLVFAGSLFALFWIVYFFVIETKDRSLEEIDTMYVLHVNPRTSSTWDPKSLGAEGVKGVDTDGMFLTTGGKDIKKSEMAGRPMLEHDERRFPETAGGAASQEHKPEIMNA

SEQ ID NO: 92722 - protein, 248 aa, Coprinopsis cinerea okayama7#130
MQLGQSAVAAGQQYVQKNFGTMFPTTTLKHHFNVSNSYVMHKIRLVLFPWTHKPWTRRVRRTEHGQHEWLPPRDDLNSPDLYIPVMAIVTYILLTGLHAGLKEAFRPQILGETLSRAALVVLFDFAFIRLGCYILNIQGSTQFVDFFAYSGYKFVGVILTLTAGFLGLSGPLWTIVFLYSYLANAFFLLRSLRSVVLPDPSISIAQNPSQTTTVSEVSRRRRVTLLFLVSVMQIIYMGALVRLPTVKK

SEQ ID NO: 92723 - protein, 468 aa, Clostridium perfringens SM101
MKDVKVLKKEYENAWTKYEEADLKQVFSLSDRYREFMSVAKTERECVKVLANMAESKGFKNFYEVIKNGEKVTAGDKLYSINMDKTITLIKVGSEPLENGLRIIGAHIDSPRIDVKQNPLYEDSGLALLDTHYYGGVKKYQWVTIPLAIHGVVVKKDGTRVDIKIGEDENDPVLGISDLLIHLSADQLDKKGAKVVEGEDLNILVGSMPLKGTEEKEAVKANILVLLNEKYGITEEDFVSAELEVVPAGKARDYGLDRSMILAYGHDDRICAYTSAEALMDLENVDKTCVALLVDKEEIGSVGATGMQSRFFENIIAELMDRKGEYSELKLRRCLQNSMMLSADVTAAFDPNYPSVCEKKNTAYFGHGVVFSKYTGARGKAGCNDANAEYIAHLRNIMDKNGVVWQTGELGKVDQGGGGTIAYILAQYNMEVIDCGVALQNMHAPLEVASKADLYETKKCYKAFFEEA

SEQ ID NO: 92724 - protein, 710 aa, Mycobacterium avium subsp. paratuberculosis K-10
MSDSIIGWDKDADGIVTLTIDDPDNSANMLTDAYVEQMGAMIDRLEAEVDETTGVVITSGKSTFFAGADLTQIRSAGPEHAQQLFDGSTAIKRDLRRLETLGKPVVAAINGAALGGGLELALATHHRIAANVAGSVIGLPEVMLGVLPGAGGVARSVRLLGIQNALMQVLLTGNRFKPAKAQQVGLVDELVESVDELVPAAKAWILANPGKHVQPWDVPGFEIPGGSPSTPAFAANLPAFPANLRKQLKGSPMPAPRAIMAAALEGAQVDFDTAQLIETRYFVNLVTGPIAKNMIQAFFFDLQAVQSGTSRPADAPERTIHKVGILGAGMMGAGIAYVTAKAGIDVVLKDVTLQAARKGKAYSENLEQKALAKGRTTEAKSRALLDRITPTADAADFTGVDFVIEAVFENTELKNKVFAEIENIVEPGAVLGSNTSSLPITELAAGVSRPENFVGIHFFSPVEKMDPIEIIRGAKTSDETLARVIDYTLAINKYPIVVNDGRGFFTTRVFSTYLLEAFNMLAEGIDPATIEQAALQAGYPAGPLQVADELSFGTIRKIMDETVQAAKADGVALDESVRVAAEVVTTLMDTFDRTGKRGGAGFYDYVDGTRAGLWDDLRKAFNTTRALSVPFDDLQDRYLFIQAIETQKAYDDGVISSDPDANIGSIFSIGYPPWTGGVRQFVTGYPGGIDAFRRRADELAARYGGRFRWI

SEQ ID NO: 92725 - protein, 387 aa, Geobacillus zalihae
SLRANDAPIVLLHGLTGWGREEMFGFKYWGGVRGDIEQWLNDNGYRTYTLAVGPLSSNWDRACEAYAQLVGGTVDYGAAHAAKHGHARFGRTYPGLLPELKRGGRIHIIAHSQGGQTARMLVSLLENGSQEEREYAKAHNVSLSPLFEGGHHFVLSVTTIATPHDGTTLVNMVDFTDRFFDLQKAVLEAAAVASNVPYTSQVYDFKLDQWGLRRQPGESFDHYFERLKRSPVWTSTDTARYDLSVSGAEKLNQWVQASPNTYYLSFSTERTYRGALTGNHYPELGMNAFSAVVCAPFLGSYRNPTLGIDDRWLENDGIVNTVSMNGPKRGSSDRIVPYDGTLKKGVWNDMGTYNVDHLEIIGVDPNPSFDIRAFYLRLAEQLASLQP

SEQ ID NO: 92726 - protein, 431 aa, Roseovarius nubinhibens ISM
MFDFDMLGLAPALNEALTRAGFSEPTPIQNQAIPLALEGHDILGLAQTGTGKTLAFGLPLINHLLAEPGKPAPKTAKALILAPTRELVNQIADSLRNLTDGTRLRVATVVGGQSINRQITFLARGTDILVATPGRLIDLMDRRAVDLGSVRHLVLDEADQMLDLGFIHALRKIAPRLGTPRQTMLFSATMPKQMEELSRAYLENPRKVQVSPPGKAADKITQSVHFLEKPAKPSKLREILSRDMDALTLVFSRTKHGAEKLMKGLVADGYNAASIHGNKSQGQRDRAIKAFRAGEINVLVATDVAARGIDIPGVAYVINYDLPDVPDNYVHRIGRTARAGREGEAIAFCSSEEADLLRQIQRLMKIDIPVASGTLPQGAADEARGAKPGGNRRRGGRGGPPAANRGGKPAHTKPGGQSKGRRPRRRSAAAS

SEQ ID NO: 92727 - protein, 211 aa, Oryza sativa Japonica Group
MSQGQPRRPPPDGSGARPVMYGDVFDVSGELAGQPVAPRDAAKLQSAEEAVLGEAQKGGPAAAMQSAAAINARAGHVGRAQVTGAIADEGVAVAVAETELPGRRVVTESVAGQVVARLATPPRVVATQPSGSLDKDAVTIGRALEWRPRPPRRRGARGKLPADKAATREDAERVPSAEVRNRPDMATTPGGVADAVTAAARLNQERPTRSF

SEQ ID NO: 92728 - protein, 152 aa, Brassica napus
  misc_feature (76)..(76): Xaa can be any naturally occurring amino acid
  misc_feature (97)..(97): Xaa can be any naturally occurring amino acid
  misc_feature (142)..(142): Xaa can be any naturally occurring amino acid
GLFAYISTLFSKTYQSSLSGFCVRKCKSVTKVVAEIKATKPLKKGKREPEDDIDTKVSLKMQNNDVIAACHTDKAXRKVLKKVRALMNDILDLRKSXKAKKVPAQKAASSSDESSDDSSSDDEPGPKKAAACTNRTGAKKAXDDSLSSDDES

SEQ ID NO: 92729 - protein, 121 aa, Triticum aestivum
  misc_feature (47)..(47): Xaa can be any naturally occurring amino acid
  misc_feature (66)..(66): Xaa can be any naturally occurring amino acid
  misc_feature (82)..(82): Xaa can be any naturally occurring amino acid
MAATIQSVKARQIFDSRGNPTVEVDVCCSDGTFARAAVPSGASTGCXYKLWELRDGGSDYLGQGCXSKAVNNVNSIIAPALXGKDPTAQTDSDNFKGQQLDGTKNEWGLVQAKLGAMQPAV

SEQ ID NO: 92730 - protein, 325 aa, Zea mays
CFSFVIFHGKSSVSKFLFQSADQDFRELVQKVPEGCLFTIVSDSCHSGGLLDSAKEQIGNSTKQNKTQSREPDEPRHSGSGSGFRSFLKETVRDVFESEGIHIPHSRRHGDDDQDDGYAQPTGNGRTKNRSLPLSTLIEMLKEQTGKDDIDVGSIRMTLFNIFGDDASPKIKKFMKVMLGKFHQGQSGEQGSGGGGVFGMVGALAQEFLKAKLEGKEEEAFKPALEQEVHSVDEVYAGSKAWAPNNGILISGCQTNQTSADATTPQGVSFGALSNAIQTILADKHGKVTNKDLVMKARELLSKQGYTQQPGLYCSDEHVHVAFIC

SEQ ID NO: 92731 - protein, 172 aa, Streptococcus agalactiae 2603V/R
MDLNNYIASIENYPQEGITFRDISPLMADGKAYSYAVREIVQYAADKDIDMIVGPEARGFIVGCPVAYALGIGFAPVRKPGKLPREVISADYEKEYGLDTLTMHADAIKPGQRVLIVDDLLATGGTVKATIEMIEKLGGVVAGCAFLVELDGLNGRKAIEGYDTKVLMNFPG

SEQ ID NO: 92732 - protein, 508 aa, Coffea canephora
MALLLILLPVAFIFLAYSLYERLRFKLPPGPRPKPVVGNIYDIKPVRFKCYAEWSKLYGPIFSVYFGSQLNTVVDTAELAKEVLKDNDQQLADRYRSRPSARMSRNGQDLIWADYGPHYVKVRKLCNLELFTPKRLEGLRPLREDEVTAMVDSIFKDCTIPENKGKSLLMRNYLGSVAFNNITRLTFGKRFMNSEGVVDEQGQEFKGIVSNGIRIGAKLSVADHIPWLRWMFVGENEDLDKHNARRDKLTRMIMEEHTLARQKSGNTKQHFVDALITLQKQYELSDDTVIGLLWDMITAGMDTTTISVEWAMAELVKNPRVQHKAQEELDRVIGSDRIMTEADFAKLPYLQCVAKEALRLHPPTPLMLPHRANANVKIGGYDIPKGSIVHVNVWAIARDPAAWKNPLEFRPERFLEEDVDIKGHDYRLLPFGAGRRICPGAQLALNLVTSMLGHLLHHFTWSPPTGVSPEEIDLEESPGTVTYMRTPLQAVATPRLPAHLYNRVPVEL

SEQ ID NO: 92733 - protein, 484 aa, Oryza sativa
MAAARSVGMEAEVAALRGRFAAGGTRGAEWRAAQLRGILRMAAEAEAEVCRALHADLAKPYTESYVHEIALVKSSCKFALKNLKKWMKPQKVTAPLMTFPSTARVAAEPLGVVLIISFCLSISVLSIDPIIGAIAAGNAVVLKPSEVAPATSSLLAELLPRYVDGSCIKVVEGGVAETTTLLEQKWDKIFYTGNGKVGRIVMASAAKHLTPVVLELGGKCPVVVDSNVNLHVTAKRIAAGKWGCNNGQACISPDFIITTKSFAPKLLEALEKVLEKFYGRDPLRSSDLSRIVNSNHFNRLKKLMDDENVSDKIVFGGQRDEHQLKIAPTIFMDVPLDSGIMKEEIFGPLLPIITVDKIHESFALINSMTKALAAYLFTKDSKLQEQYEAAISAGGMLVNDTAVHLTNQYLPFGGVGESGMGAYHGRFSFEAFSHKKAVLVRRFAGEAAARYPPYSPAKLKILRGVLKGNLGAMIKAILGFPRGK

SEQ ID NO: 92734 - protein, 140 aa, Synechococcus sp. CC9311
MIAVLQRLTSRLINLSLALCLGLSLLVTACGNESSTLTGDYVQDTVAVAHTIHDTLALPQDAANRREADGEARDLITDYVSRYRARPKVNGLSSFTTMQTALNSLAGHYNNYTNRPVPEALRARIDKELGKAEKAAVRGT

SEQ ID NO: 92735 - protein, 508 aa, Coffea canephora
MALFLLLLTFIFILPPYYLYQKLRFKLPPGPRPLPVVGNLYDIKPVRFRCFADWSRAYGPIISVWFGSTLNVVVSNAELAKEVLKENDQQLSDRHRSRSAAKFSREGQDLIWADYGPHYVKVRKVCTLELFSPKRLEALKPIREDEVTAMVESIYKDCTLREGSGQSLLVKKYLGTVAFNNITRLAFGKRFVNSEGVMDEQGKEFKEITANGLKLGASLAMAEHIPWLRWLFPLDEAAFAKHGARRDRLTRAIMEEHRLAREKSGGAKQHFVDALLTLKDKYDLSEDTIIGLLWDMITAGMDTTAISVEWAMAEVIKNPRVQQKVQEELDQVIGYERVMIETDFSNLPYLQSVAKESLRLHPPTPLMLPHRSNASVKIGGYDIPKGSNVHVNVWAVARDPAVWRNPLEFRPERFLEEDVDMKGHDFRLLPFGAGRRVCPGAQLGINLVTSMLGHLLHHFNWAPPHGLSPDEIDMGESPGLVTYMRTALRAVPTPRLPSHLYERVAVDM

SEQ ID NO: 92736 - protein, 187 aa, Zea mays
MCATRQSRWNCGYDPIRLICWLDEAHLCLARLGDCFHAIYGAPPYVNSSPSLACACAFELRLRLTVVMRRLVVAAGRVNLIREHIDYEGYSVLPMAIGQDMIIAIRRANDRYVWATDVDDKYLLCIYPADSNKVLHALPLSIYIDWYYNMVYHDTLFKYGCTVAIKCFGRFACPNSRQFLVRLPCSM

SEQ ID NO: 92737 - protein, 265 aa, Staphylococcus aureus subsp. aureus MRSA252
MTDKTLQQIDKLICSWLKQIDNVIPQLIMEMTTETKRHRFDLVTNVDKQIQQQFQQFLATHFPEHQLLAEEKSNEMITNEINHLWIMDPIDGTANLVKQQEDYCIILAYFYEGKPMLSYVYDYPHKKLYKAIRGEGAFCNGFKMEEPPSLKLEDAIISFNAQVMNLDTVQDLFDASFSYRLVGACGLDSMRVAKGQFGAHINTNPKPWDIAAQFLFAELLNLKMTTLDGKAIDHLKGAPFIISNKACHETVLKILNANGGYQKYR

SEQ ID NO: 92738 - protein, 422 aa, Halobacterium sp. NRC-1
MSYDKIEVPEGGAKVSYDEAADELDVPDTPIIPIIHGDGIGKDVGPIAQDVLSAAAEATGHDIEWMEVYAGESAREMYDENLPEETVEAIREHRVAIKGPLTTPVGAGFRSLNVALRQTLDLYANVRPTYYLDGVPSPMKAPEEMDMVTFRENTEDVYAGIEWEAGTDEAEQVRSFVEDEMDFDDVMHDGDIGIGLKPISEKGSKRLVREAIDYAIENDRDTVTLVHKGNIMKFTEGQFGDWGMEVAEEEYPDDEVFAAPDSLWEEQDEVDIPEDAVMVEERLADAMLQWMQLRTDEFDVLAMPNLNGDYLSDAAGAQIGGLGIAPGANFGAGRCLAEPVHGSAPKRAGQDKANPTALILSGRLLFEYIGWDDASTLVRDAVEDTIESGTVTYDLARQRDDAEEVSSTTYAEAVIDRIEDLA

SEQ ID NO: 92739 - protein, 460 aa, Herminiimonas arsenicoxydans
MGAFTGAFLRPNVANRLERLPMTNYQRSLFGIIATAWFFDSMDLGIMTFVLGSIKAEFGLSTAQAGLLASSSFLGMFLGAAIAGMLADKYGRKPVFQWSMVFWGVGSLACGFAQDVDQLMIFRVILGFGMGMEFPIGLSMVSEIVPAKSRGKYVAILEGFWPLGFIAAGILAYLTLPLIGWRGIFIALSVPAAFVFVIRRYVPESPRWLEEVGRNEEAEKVISTMEKSVIRANGGLALPEPAKQAAPSLLKGDKRALFAELWHGVYAKRTIMLWALWFFALLGYYGLTTWLGALLQQAGYEVTKSVTYTIYISLAGIPGFIFSAWLLEKWGRKPTCVLMLVGSAGAAYVYGQTASAQAPVEQLIASGLCMQFFMFGMWSVLYAYTPELYPTRSRATGAGFASSVGRLGSLLGPLAVGLILPFTGHTGVFTLGAVSFMIAAFVVIALGTETKGKSLEDVSG

SEQ ID NO: 92740 - protein, 453 aa, Arabidopsis thaliana
METVRPMVVAPKGNKLRRKFAKVLNIHKLTGVAPEGEMKKIKFDSKTAKLSESFYKLEEEYERSQGLEALLAKLFATVSSIKAAYAQLQHSQSPYDSIGIQKADNLVVAELKTLSELKQCFMKKQVDPNPERTLVLAEIQELRSLLKTYEIMGKKLESQYKLKDSEIIFLREKLDESMKQNKLTEKRLNQSGQLCNPLDNLHLSALNPTHFVTYLHHTVKSTRGFVKLMIEQMKLAGWDISSAANSIHPGVFYYKQDHKCFTFEHFVSNVMFEAFHLPYFSASSESRSYKKKKQSNADREMFFERFKELRSMKAKDYLTARPKSRFARFCRAKYLQLIHPKMEQAFFGHLHLRNQVSAGEFPETSLFSGFLEMAKRIWLLHCLALSFEREAEIFRVPKGCRFSEVYMKSVAEEAFFPAAESSPESEPRVAFTVVPGFRIGKTSIQCEVYLSLS

SEQ ID NO: 92741 - protein, 243 aa, Erythrobacter sp. SD-21
MSDTVSFGYEDIDASEKTGRVGEVFSNVAAKYDIMNDAMSGGMHRLWKDRFVRRVKPQPGEQILDMAGGTGDIAFRMAEKGASVTVSDINQDMLDVGIERAMERGIDGLVWSRQNAEELTFSSRTFDAYTIVFGIRNVTFIDKALREAHRVLKFGGRFYCMEFSQTDWPGFKEVYDLYSHQLMPKIGKAIANDEQSYRYLAESIRRFPKPPEFETMIRDAGFENTRVEKILGGAVNIHSGWKV

SEQ ID NO: 92742 - protein, 315 aa, Desulfovibrio desulfuricans G20
MEEFRLTVLLVDAFTRTPGRGNRAGVVLDAAGLSAAAMQAVAALVNVSETAFILPAPAQAGYAVHVRYFTPRAEVPVCGHATVGAHYARARALGISDTTVSALTGAGVLPVDIRGSGRGMKIVMTQGRVVFSPPCIPAVRQAVLNALGLDEDDLLSGLPVQEVSTGHSKIMVPLRRTALLDALKPDMTALTECSRVTGCNGFFVFGFNGGDDEALINGRMFAPAIGIDEDPVTGNANGPCGAYLSHYGRLPAQAAFTFCGRQGVAMGKEGMVEVTVHRDEDGPCRVQVGGHAAEAGRMEVALHVEDDGRITARSV

SEQ ID NO: 92743 - protein, 290 aa, Zea mays
MGKDDVVESGAGGGEFAAKDYTDPPPAPLVDAAELGSWSLYRAVIAEFIATLLFLYITVATVIGYKHQTDASASGADAACGGVGVLGIAWAFGGMIFVLVYCTAGISGGHINPAVTFGLFLARKVSLVRALLYIVAQCLGAICGVGLVKAFQSAYFDRYGGGANSLASGYSRGTGLGAEIIGTFVLVYTVFSATDPKRNARDSHVPVLAPLPIGFAVFMVHLATIPVTGTGINPARSLGAAVIYNKDKPWDDHWIFWVGPLVGAAIAAFYHQYILRAGAIKALGSFRSNA

SEQ ID NO: 92744 - protein, 251 aa, Heliobacillus mobilis
MRKTIIAGNWKMHKTIAEAVTLAEAIKSQNPNPTVEIVICPPFTALAEVAKAVQGSPVAVAAQNMHWEVQGAFTGEVSPAMVKDAGCKYVVLGHSERRQYFGETDETVNKKVKAAIAHELIPIVCVGETLEQREAGQTEDVVATQTKGGLAGLSAQEVADLVIAYEPVWAIGTGRTASDDDAQQVNAYIRSVVAEVFGKEAAEAVRIQYGGSVKPSNAENLLAKGDIDGALVGGASLKIEDFQGIIDGAKA

SEQ ID NO: 92745 - protein, 557 aa, Arabidopsis thaliana
MVGGGNRRDEGSMPIQNTNLFAALDTSRKKKKSDKAGKSKASSKREDSQKEPEPQVFWAPTPLKAKAWADIDSDDEDDDYYATTAPPQSLWSTSEASHSDAKDVPAEEIESEEDTLDDGDDDDVEEDHEQGTETQVHPEAEPEVKKAPEVRAPPKEAERQLSKKERKKKELAELEALLADFGVATKDENGQQDSQDKGEKKEVNDEGEKKENTTGESKASKKKKKKDKQKELKESQSEVKSNSDAASESAEQEESSSSIDVKERLKKIASMKKKKSSKEVDGASTAAAKEAAARKAKLAAAKKKSWYSIYFTLLRQFVVLLATLDDGEVEMWRRVIGNVAVRHQLQRALSSKAGGSGKSANVSAAVDSMLLRSLKEHYLEVSKMTPPPKVSPPSPFEIVKGSLEGSTGAVLKKSVGNEEINLFVMRLAHGGDEEDDGGINQLFLHVAVSKPNQPDSLHFLCGLYPDALGIHSVSMRPKLEALEMSDDPTQYTGPSFEELDEKMRDVFHGFLEERGVNESLFPFLQAWLYVKDHRNLLRWFKSVGTFVHENPSAENTA

SEQ ID NO: 92746 - protein, 288 aa, Arabidopsis thaliana
MARNSDNDMCKEERKRESFFKVLQRVDISSENMRALPYDFVRSFSNNELSRKMKIKARWGSSWEVEICKNPRFYFMEKSGWEKFVSDNALGASEFLTFTHKGNMRFTVNIFMQDGKEMLQPPQSMSFMASSRPPKREQGIPSLATTIAAESNGGGNYKRKLNFEKKKAEESHNSKRTDKVFSVQRESAGASSSSVAEFSMFIKKSYLIYMWFPKSVQSIHMPKQRTIFKIHHPNMKKSWNVVYVVSGTKSSFSAGWKGLAQEYPLAVGDTCKFSFIKQHELILFVSKP

SEQ ID NO: 92747 - protein, 134 aa, Triticum aestivum
  misc_feature (74)..(74): Xaa can be any naturally occurring amino acid
  misc_feature (86)..(86): Xaa can be any naturally occurring amino acid
  misc_feature (92)..(92): Xaa can be any naturally occurring amino acid
  misc_feature (102)..(102): Xaa can be any naturally occurring amino acid
  misc_feature (114)..(114): Xaa can be any naturally occurring amino acid
  misc_feature (116)..(116): Xaa can be any naturally occurring amino acid
  misc_feature (122)..(122): Xaa can be any naturally occurring amino acid
  misc_feature (124)..(124): Xaa can be any naturally occurring amino acid
GILMECKIDQKLPYVDLATMIRRQRQAIDEKIRELSNCHIVYSGIDFPKERSWVFQRRLDETKKIPWGLRELGXAPDQVGGIPKHXQHFPPXYTLSRQHFTXLKRCCLKIWAIXAXAWAIPXPXVHLFPNYNYI

SEQ ID NO: 92748 - protein, 476 aa, Glycine max
MENYQYPASYPDSGESSPRSREIDFENPPPWDEQQNQNYKAKFMCSYGGKIQPRTHDNQLSYVGGDTKILAVDRSVKFSAFLSKLSALCDSPPQDLTFKYQLPGEDLDALISVTNDDDLEHMMHEYDRLYRPNLKPVRMRLFLFTLSNSNPNSSFSSERDRFVEALNSGPVPSQPDPIKTPPVTPSNVDYLFGLDKAVAPPNLPPNFAAVKFHDPVPEPVAPTPVEYQSRVSDRVVGSDPNVNSMEIQRQMQQEMQRLQIAENEYRRRSEDGFATGYAAAAGGDYYMQKVQEKVPPQNAAVPPPAAYWSEKQFSGEGYQTTVTTAAPGGGDQPMYVMAAPGTFYHHSPVMRPPAAAQGYYAVQRMGSDGYREQQAVYGGMAAPKAGFSTAGMVKGPAYSEGYSGGVVRPAGLPDNAAYAQVAYDSASGRQVYYTAQGGVVHAPPQYQGGPPQDVRPGGVSVGQDGKVVNKVNQGSV

SEQ ID NO: 92749 - protein, 187 aa, Mannheimia succiniciproducens MBEL55E
MTMKLNFPTFLTLFRVALIPFLIIAFYLPFGWSAFLSTAIFFVASITDWFDGYLARKWKQTTRFGAFLDPVADKVIVATALVLIVEYYHVFWITIPAIVMISREIIISALREWMAEIGSRTTVAVSWIGKVKTTAQMFALGCLLWRYQYWMEALGIILLYIAAILTVWSMIQYLKAAKDYLLEEINS

SEQ ID NO: 92750 - protein, 470 aa, Lactobacillus casei
MPNSTGKIAQVIGPVVDVAFPINDNLPEINNALTITRKDGSQLVLEVALELGDGVMRTIAMDSTDGLQRGMAVEDTGGPISVPVGKDTLGRVFNVLGDPIDDGEALDLNHRRDSIHRDAPKFEDLNTSSEILETGIKVIDLLEPYLRGGKVGLFGGAGVGKTVLIQELIHNIAEEHGGISVFTGVGERTREGNDLYFEMKESGVMENTAMVFGQMNEPPGARMRVALTGLTIAEYFRDVEGQDVLLFIDNIFRFTQAGSEVSALLGRIPSAVGYQPTLATEMGQLQERITSTKKGSVTSIQAIYVPADDYTDPAPRTTFAHLDATTNLERRLTEQGIYPAVDPLESSSSALTPEIVGEEHYKVATEVQQVLQRYRELQDIISILGMDELSDEEKVIVARARRVQFFLSQNFNVAERFTGQPGSYVPVEETVKGFKQILEGKYDDYPEDAFRSVGRIEEVVEKAKKMGFAP

SEQ ID NO: 92751 - protein, 268 aa, Acinetobacter sp. M-1
MRIPQFGLGTFRLKDQAVIDSVKTALEVGYRAIDTAQVYENEAAVGQAIAESGVARQDLFLTTKIWVDNFAEDKFIPSLKDSLQKLRTDAVDLTLIHWPAPALGVSIPSVMQLLLEAKQQGLTKQIGISNFNIALTQQAIDSIGIEHIATNQIELSPYLQNRNLVNYLREQNIDVTSYMTLAYGKVLQDPTLIEIAAQHQATTAQVALAWALQNGFAVIPSSTKRENLISNLKAQDLTLSAEEMQLIAQLERNGREVSPEPFAPEWDK

SEQ ID NO: 92752 - protein, 182 aa, Populus trichocarpa x Populus deltoides
MGLLFSRMFSSLFGNQEARILVLGLDNAGKTTILYRLQMGEVVSTIPTIGFNVETVQYNNIKFQVWDLGGQTSIRPYWRCYFPNTQAVIYVVDSSDTERIGIAKEEFHSILEEEELKGAVVLIFANKQDLPGALDDAAVTEALELHKIKSRQWAIFKACATKGEGLFEGLDWLSNTLKSGGG

SEQ ID NO: 92753 - protein, 388 aa, Alteromonadales bacterium TW-7
MNLHEYQAKQLFAEYGLPVSQGFACDTPEEAAAAAEKIGGDMWVVKTQVHAGGRGKAGGVKLVKTIDEVKAFAANWLGKNLVTYQTDENGQPVAKILVESCTDIANELYLGAVVDRASRKVVFMASTEGGVEIETVAEETPELIHKAEIDPLVGPQAYQARELGFKLGLNPTQMKQFVKIFMGLGKMFNDFDFALLEINPLVITDEGNLHCLDGKIGIDGNALYRQPKIREFHDPSQEDAREAHAASFELNYVALDGNVGCMVNGAGLAMGTMDIVNLHGGKPANFLDVGGGATKERVSEAFKIILSDDNVKAVLVNIFGGIVRCDMIAEGIIGAVKEVGVNVPVVVRLEGTNAELGREVLKSSDLDIIAAESLTDAAEKVVAAAEGK

SEQ ID NO: 92754 - protein, 503 aa, Alteromonadales bacterium TW-7
MSTEIKVPVLPESVADATVATWHVSVGDKVTRDQNLVDIETDKVVLEVVAQHDGVITEISQEEGATVLGDQVMGLLGDADAAPSSESTSSSEAEKSEDAPSAPSAPASEGKEVDIKVPVLPESVADATIATWHVQPGDAVTRDQNLVDIETDKVVLEVVAQEDGIMGDIINAEGDTVLGEQVIGSVKAGGAPAASAAKEEAAPAADSTDSSDVLTPSVRRLIAEKGLDASKIKGTGKNGRVTKEDVDTFLKAPAPSAKKAEAAAPVAPMGDRTQKRVPMTRLRKTIANRLLEAKNSTAMLTTFNEVNMKPIMDLRKQYQEVFEKRHGIRLGFMSFYVKAVTEALKRFPDVNASIDGDDIVYHNYFDISIAVSTPRGLVTPVLKDCDKLSVAEIEKGIRELALKGRDGKLTLDDMTGGNFTITNGGVFGSLLSTPIINLPQSSILGMHKIQDRPMAVNGKVEILPMMYLALSYDHRQIDGKESVGFLVTIKELLEDPTRLLLDV

SEQ ID NO: 92755 - protein, 233 aa, Magnaporthe grisea 70-15
MPSTDSIPKSNFDAIPDVIQAFKNGEFVVVLDDPSRENEADLIIAAESVTTEQMAFMVRHSSGLICAPLTPERTTALDLPQMVTHNADPRGTAYTVSVDAEHPSTTTGISAHDRALACRMLAAPDAQPSHFRRPGHVFPLRAVAGGVRARRGHTEAGVELCRLAGKRPVAVISEIVDDGQEVEGRAVRAAPGMLRGDECVAFARRWGLKVCTIEDMIAHVEKTEGKLETNGSG

SEQ ID NO: 92756 - protein, 310 aa, Clostridium perfringens SM101
MNKICVLGSMNMDLVLKVKDMPKVGETILSKSFQKIAGGKGANQAVAAKRSGAEVFMISKIGKDENGRELRDKLVEDNIDVKYVFEDRIEPTGMALIMVNDNGNNSIIVNAGSNMTLTKDEIHSAENLIKESDIIISQFETPEDITIEAFKIAKENGKVTILNPAPAKKIKDQLLKYTDIIVPNETEAELLTGIEIKDIEDAKKAGDIFLDKGVKFIIITLGEKGAALIGKDFCEIVLAYRVNAIDTTAAGDSFIGGLSSKLDTKNLGRETLSSSIRFGNKVSSIAVQRKGAQPSIPYLHEVLEVYKGEE

SEQ ID NO: 92757 - protein, 424 aa, Prosthecochloris vibrioformis
MNIISVGVNHKTAPIEIRERIALSEVQNKEFVTDLVSSGLASEAMVVSTCNRTELYVVPGMPEVNCDYLKDYIISYKDARNAVRPEHFFNRFYCGTARHLFEVSSAIDSLVLGEGQILGQVKDAYRIAAEVGTAGILLTRLCHSPFSVAKKVKTRTKLMEGAVSVSYAAVELAQKIFSNLSMKKVLLIGAVKQSWQQSTCTPRTPGTSSSPTGRNPRPRACEELGTNRVLPYESYKEHLHEFDIIITAVSTKEYILNAAEMQQSMAKRRLKPVIILDLGLPRNVDPEVGALQNMFLKDIDALKHIIDKNLERRRAELPKVKSIIDEELIGFGQWINTLKVRPTIVDLQSKFIEIKEKELERYRHKVSEEELKRMEHLTDRILKKILHHPIKMLKAPVDTADNIPSKVNLVRNIFDLEEPNQSLQ

SEQ ID NO: 92758 - protein, 224 aa, Bacillus cereus ATCC 10987
MTVQTNLTTVNESIKQSCARAGRSLQDIKLVAVTKTVGIEKTNEVIEAGIIDLGENRNEGFLQKYEHFGSKVNWHFIGSLQTRKVKEIINEIDYLHSLDRLSLAKEIQKRADKKVKCFIQVKTSSEESKQGLAIEETVSFIQSLQELDKIEVVGLMTMAPFTEEEKEIRRCFKTLRMLQTEVQELELLHAPCKELSMGMSNDYTIAIEEGATYIRLGTILVGKA

SEQ ID NO: 92759 - protein, 264 aa, Eucalyptus globulus subsp. globulus
HFHDCFVKGCDASLLLDSSGTIISEKRSVPNTNSARGFEVLDEIKSALEKECPQTVSCADLLALAARDSTVLTGGPSWVVPLGRRDSTGASLSGSNNNIPAPNNTFQTILTKFKLKGLDIVDLVALSGSHTIGNARCTTFRQRLYNQTGNGQPDFTLDQSYAAQLRTRCPRSGGDQNLFFLDFVSPIKFDNSYFKNLLAKKGLLSSDEVLVTQSQATLQLVKQYAGNQELFFEQFAKSMVKMGNITPLTGSKGQIRKRCRQVNK

SEQ ID NO: 92760 - protein, 434 aa, Candida albicans SC5314
MSPRSIILSVVATAAVTIGLVEAFHCYERKKIHPQPPKETPAKRDHSKELIREQLARNYAFLTEDGMDKVRKQRVVVVGAGGVGSWVATMLARSGVESLRIIDFDQVSLSSLNRHAVATLKDVGIPKVECIKNHLLEIAPWIEIDTRNQLWNLESAEELIYGDDFQPTFIVDCIDNLDTKCDLLAYCHEKKLPIVSSGGAATKSDPTRINLADISKTEEDPLMKKIRVVLKKRGIINGIPVVFSAEKPDPRKAKLLPLPDDEFTKGNVDQLSALKDFRVRILPVLGTMPGMFGLAIATYILTTVAGYPMEPVEGKNRYKIYDDLLQSLAGQQTRIGKTDQRVQIAMHEVNYILEEVFRGKSPISNYSTRLTLSRWDPSKEISFQNVVVMTKDEQRNHEKRVLNGGEKIEDVYSKEVVDLVKSRFEDEKYFSQFR

SEQ ID NO: 92761 - protein, 308 aa, Cryptococcus neoformans var. neoformans JEC21
MSSYRTCTTMATAGPSRRPDGRTPAQLRPLHLSIGELDRADGSARFAFGSNAVLASCSGPIEVRLREELPDKATFEVNHRPLEGVGATPSRALVTTLETIFPPILSLEKHPRSLVQLVVQSLVPSTGRVVYGSVFGAEGVGAEQNTWPATDKDDYAYIPESRKDAARISPAAGYTFTARAASINASTLALLSAGTISILALPVAVALVVTTKGRVMLDPEADEEKQAKARLGFGWAWGAVFGTANEENNMGVAGQNDGGAELVWIESEGSFTRQEWSEALQMSKTASKAILEFIRIQLDAHLSSHQLS

SEQ ID NO: 92762 - protein, 258 aa, Eucalyptus globulus subsp. globulus
VELHFHDCFVNGCDASILLDDTPSFVGEKTAAPNNNSVRGFEVIDRIKASLEKECPGVVSCADIVALAARDSVVHLGGPSWTVSLGRKDSITASRSLANTSIPPPTSNLSALITSFAAQGLSVKNMVALSGSHTIGLARCTSFRGRIYNDSNIDTSFAHKLQNICPKIGNDSVLQRLDIQTPTFFDNLYYHNLLQKKGLLHSDQELFNGSSVDSLVKKYACDTGKFFRDFAKAMIKMSKIKPPKGSSGQIRKNCRKVN

SEQ ID NO: 92763 - protein, 430 aa, Synechococcus sp. CC9311
MLDSLDLVIDTIVAREVLDSRGNPTVEAEVLLEGGASGRAIVPSGASTGAHEAHELRDGGDRYMGKGVTKAVDHIEERIAPALCGLSALDQGSVDAAMLELDGSDNKSGLGANAILAVSMATARAAANGLGLPLYRYLGGPMATLLPVPLMNVINGGAHAANNLDFQEFMLVPHGAPNFREALRMGTEVFHTLKNLLSERGMSTSVGDEGGFAPDLGNEEAGEVLVQAIEKAGYKPGEQISLALDVASTEFYSDGRYAFSGGSYSSAEMVDQLEQLVNRFPIISIEDGLAEDDWEGWALLTERLGKRVQLVGDDLFVTNTKRLQRGIDANTANSILIKVNQIGSLTETLQAIDLAGRSGYTSVISHRSGETEDTTIADLAVATRAGQIKTGSLSRSERVAKYNQLLRIEDELGDQAVYAGATGQGPRGRD

SEQ ID NO: 92764 - protein, 352 aa, Synechococcus sp. CC9311
MQDWPGLIEAYRSWLPVSSATPVITLHEGATPLIPVPSIAERIGRGVKVFIKYDGLNPTGSFKDRGMTMAISKAKEAGCEAVICASTGNTSAAAAAYARRGGMRAFVLIPDGYVAQGKLAQALVYGAEVLAIRGNFDRALDIVREAAEKYPITLVNSVNPYRLQGQKTAAFEIVDALGDAPDWLCIPMGNAGNITAYWMGFQEYQQAGRSRRLPRMMGFQASGSAPLVNETTVSDPETIATAIRIGNPVNREKAIAARKASNGAFLDVTDEEIIDAYKLLGGQEGIFCEPASAASVAGLIKRGAEVPDGSTVVCVLTGNGLKDPDCAINNNDAAFYADLDPDLTTVAKVMGF

SEQ ID NO: 92765 - protein, 237 aa, Synechococcus elongatus PCC 7942
MRRRSLLAALGGSCIGWLGSSQPVWASADWDYSRRRGPRQWAKLDPAYAICQQGRQQSPINLTGQPDRTPLDYRDRPFKGILQQAPHSLRIDCPAGNGFWEAGTFYELLQFHFHTPSEHQHQGQRFPAEIHFVHRSDRDQLAVVGVFLAAGDRPLPILDNLLAVPPSTDNQLLSTAIQPTDLMPRDRTVWRYSGSLTTPPCSEPVLWRVCDRPLFVARQQLRQLRQRLGMNARPLQA

SEQ ID NO: 92766 - protein, 459 aa, Staphylococcus aureus subsp. aureus MRSA252
MENNELQRGLSARQIQMIALGGTIGVGLFMGATSTIKWTGPSVILAYLIAGIFLFLIMRAMGEMIYLNPTTGSFATFASDYIHPAAGYMTAWSNIFQWIVVGMSEVIAVGEYMKFWFPELPTWIPGVIAILLLMAANLFSVKAFGEFEFWFALIKVVTIILMIIAGFGLIFFGFGNGGHAVGISNLWTNGGFMPNGIVGFFFALSIVIGSYQGVELIGITAGETKDPQKNIVKAVNGVIWRILIFYLGAIFVIVSVYPWNQLGDIGSPFVATFAKIGITFAAGLINFVVLTAAMSGCNSGIFSASRMIYTLAHKGEMPKIFTKIMRNGVPLYTVVAVSLGILIGALLNVILPLYIDGAKSIFVYVYSASILPGMIPWFMILFSHLRFRKLHPEEVEGHPFKMPGGAVSNYLTILFLILVLVGMVFNVETRISVLIGVIFLTIVTIYYFIRYNKNNVKAK

SEQ ID NO: 92767 - protein, 368 aa, Methanosarcina mazei
MKAVLGLEDGTVIKGTGFGAEGTACGELVFTTQFTGYEEALTDPSYKGQILMFTYPLIGNYGVSGERFQSDNIHAEGLVVREACKKPYHYKSTRSIHKFLEDEGKPGIEGVDTRMLTIGAREHGTMRAALITGSDDGEEAVDMARNFPQVTDEELIARVTCKEPRFIPGAAGAWKGSGKPKHAVVVDLGIKRNIINNLHKRGIDLTLVPATTKPEEIAGYEPDMLFISNGPGDPEKATDAINAVKAFAGTIPVAGICFGHQIISLAMGARTYKLKFGHRGGNQPVKDLIENKIFISSQNHGYAVDADSLEGTGLYVKYLNANDKTVEGVSHKDLDIFSVQFHPEAQAGPLDTEETFFGKVVKVLGGGL

SEQ ID NO: 92768 - protein, 376 aa, Oryza sativa Japonica Group
MCSFFMPCGSNSFSDIIASTSSLLGISVLVLAVFLVYKKHKCLLPWQRSTTAPRLHSLLRSQLKSYTYSEVRKMTKSFTHTLGKGGYGTVYKGSLSDGSTIAVKILEDSNNDGEDFINEVSSIGRISHINVVTLLGLCQHGSKRALIYEYMPNGSLDKFAVGGNDTMQQEKFLISWEKLYDILVGVAQGLDYLHHWCNHRVVHLDIKPQNILLDQDFCPKISDFGLAKLCKPKESKISIGCARGTIGYMAPEVFWGHRGAVTTKSDVYSYGMLILHMVGERENINASTESGSKYFPEWLYDNLNQFCGVPSGGIDGSNSTSEVAHKLVIIGFWCIQSAPTDRPSMSEVIDMFDRSLTELQLPPRISCCGNYNESFG

SEQ ID NO: 92769 - protein, 528 aa, Synechococcus sp. CC9311
MAQTPMASSPAMGLQNWFSNPRRDVLSGLVVAFAMIPEAIAFSGIAGVDPRVGLFGAFCLSITIAFVGGRTAMITSATGSTALLMTGLVATGNARGEGLGLAYLMAAGILTGVFQILWGYLRLAYQMRFVPLGVLSGFVNALALLIFQAQLPQLGINLHFGEAGNDHAMHALSGSQIPVVWALVLLGLVIIYGLPRITRALPSQLVAIIVITAISMGLQLDIPKVVDLGELPNGLPFFNLPFGDVSNQRVPFNLETFGIVLPTALSISLVGLMETFLTQDILDERTDSNSNKNTEAKGQGIANIVSSLFGGMAGCALVGQSVMNIDNGGRTRLSTLSSGVSLLAMILLASTWLKQIPMAALVAVMIGIAVSTADVAGLRNIRNIPKSDTAVMVMTFAVTMLTTPHNLALGVLAGVALAGILFSRKVAKVISVEAIKINTDECRYVVRGQLFFVSKVYFLQGFDVHEHPARITIDMSQAHIWDQSGVGALNQLIRKLRLGGSVVNVEGLNKESLNLFERIGSQPEGSHG

SEQ ID NO: 92770 - protein, 472 aa, Synechococcus sp. CC9311
MSKSHFGLIGLGVMGENLVLNAESNGFSSVVYNRTYSKTEDFLKGRGAGKNIQGATDLQDFVNKLERPRRILMMVKAGGPVDAVIEQISPFLDEGDLLIDGGNSEYHDTERRVAELESKSFGFIGMGVSGGAKGALEGPSMMPGGTKASYDAIESLVTKMAAQVEDGPCVTYIGPGGSGHFVKTVHNGIEYGIEQILAEGYDLMKRVGGMNGTQMADVFAHWNSTEELASYLVEITEVCLRTKDPDDGSDLIEKIQDKAGQKGTGLWTVVSALQMGASVPTIYAALNGRVMSSMKDQRVKAETILKGPAVKAFDLGTPADGMAPLMDAMVLSCMASYAQGMELLRIASAEHDYNLNMPSIAQIWKGGCIIRARLLQRIQDAFTTDPQLNNLLIDPWFANQVNTRLPGLAQVVAGAAEAGIPVPCLSNTLDYINSYRTARLPQNAVQAMRDCFGSHTYQRVDKEGTFHTEWLD

SEQ ID NO: 92771 - protein, 527 aa, Medicago truncatula
MVTREDLYNVMCAMVPLYFAMLVAYGSVKCCKMFTPDQCSGINRFVAVFAVPVLSFHFISLNNPYQMDTKFILADTISKLLVLFFLTIWAIFFTKGSLDWVITLFSVATLPNTLVMGIPLLQAMYGDFTQSLMVQLVVLQCIIWYTLLLFLLEYRAAKLLIKSQFPGTTAASITKISLDDDVISLYSHDAPLTTQSETDENGRIKVRIRRSISSAPPESTSSLGKSFTPTRLSNLSNADIFSINTPGNFLDNMTSPQLSGYASTDAYSLQPTPRASNFNEMEIVGGGTPVWGRSPVAGGRVLDGGMVVWESPEKWRGDGGHGCKDITMSDKEISFRDSLKVSVAGEVVDPKDQIASSPKMPYAFVMLRLILIVAGRKLSRNPNTYSSLLGLLWSLISFKWNIEMPSLIKSSIKIISDAGLGMAMFSLGLFMALQPRIIACGTKRAAMGMAIRFLFGPLVMSLSSIAVGLRGKKLHTAIVQAALPQGIVPFVFAREYGLHPDILSTGVIFGMLISLPITLIYYIFLGL

SEQ ID NO: 92772 - protein, 470 aa, Pectinatus frisingensis
MAKGKIVQVIGPVVDIEFPAEELPSILNAITIKGKSGDIDINLTVEVMQHLGDGITRCIAMSSTDGLTRGMEAVDTGSPIKVPVGEETLGRVFNVLGQTVDHNPAPVGNKEFWPIHRPAPKFDEQETSTQILETGIKVVDLIAPYSRGGKIGLFGGAGVGKTVLIMELIHNIATQHGGYSVFSGVGERTREGNDLWSEMTESGVINKTALVYGQMNEPPGARMRVALTGLTMAEYFRDVQHQDVLLFIDNIFRFIQAGSEVSALLGRMPSAVGYQPTLTTDVGALQERITSTKKGSITSVQAVYVPADDLTDPGPAATFTHLDATTVLSRQIAELGIYPAVDPLDSTSRILDPHVIGEDHYEVARGVQAVLQKYKELQDIIAILGMEELSDADKLTVARARKIQRFLSQPFFVAEQFTGSPGKYVPLKETIRGFKEILEGKYDDLPESAFYMVGSIDEAVEAAKKIKQEA

SEQ ID NO: 92773 - protein, 369 aa, Erythrobacter sp. SD-21
MKTRAAVAFEAKKPLEVVELDLEGPKEGEVLVEIKATGICHTDAYTLDGLDSEGLFPSVLGHEGAGIVREVGKGVTSVKPGDHVIPLYTPECRQCKMCLSGKTNLCSAIRETQGKGLMPDGTTRFSYQGKPIYHYMGCSTFSNFTVLPEIAVAKIREDAPFHTSCYIGCGVTTGVGAVVNTAQVKPGDNVVVFGLGGIGLNVIQGARMAGADRIVGVDINPDKKSYATHFGMTDFINPKNEKDVVATIVEMLDGGADYSFDCTGNTDVMRQALECCHKGWGTSIIIGVAEAGKTIETRPFQLVTGRNWRGTAFGGAKGRTDVPKIVDWYMDGKIQIDPMITHVLKLEEINKGFDLMHAGESIRSVVVFD

SEQ ID NO: 92774 - protein, 232 aa, Oryza sativa Japonica Group
MASSSDPWMKEYNEASRLADDINSMIADRGSLPQSGPEIIRHTSAIRRKITILCTRLDSLEALLSKIPPKSLSDKELHKRQDTLSNLKSKTKQMATSFNMSNFANREDLLGQNKKAADDMSRVAGLDNQGIVGLQRQIMKEQDEGLEKLEETVLSTKHIALAVNEELTLHTRLIDDLEDHVDVTNSRLQRVQKRLAILNKRTKGGCSCMCLLLSVVAIVILAVIVWLLIKYM

SEQ ID NO: 92775 - protein, 448 aa, Herminiimonas arsenicoxydans
MNHTPGKQDDLVTRSLRSVWHPCTQMQHHETLPLIPVSHGRGAWLYDINGDRYLDAISSWWVNLFGHANPRINSALKLQLDLLEHAMLAGFTHEPVVQLSEQLAARTGHVLGHCFYASDGASAVEIALKMSFHTWRNHGKPAKREFVCLKGSYHGETIGALGVTDVPIFRDAYDSLLQHAHVVASPDARNAEPGESAADVARQAAGELEKLLQERASQIAAIIIEPLVQCASGMAMHDPVYLQEVRLLCDKYQIHMIADEIAVGCGRTGTFFACEQAAIWPDFICLSKGISGGYLPLSLVMTRDEIYQSFYDIDVRRGFLHSHSYTGNPLACRAALATLAIFEEDDVLNANRARAAQLTMALAPLASHEQVANFRHRGMIWAFDAVIDSPQAAATFSQRFFSTALEHELLLRPIGNTVYLMPPYILSDEEIAGLAARVQTVFARVMAA

SEQ ID NO: 92776 - protein, 508 aa, Halobacterium sp. NRC-1
MQAALVILDGWGLGDHDRRDAVRAADTPTFDEYAERGAFGTLTTSGRDVGLPDGQMGNSEVGHLTIGAGRVVKQAYTRIEDAIAAGDLCGNDAISGALDHVADTGGTLHVMGLVSDGGVHADQQHIHALVECAAGRGVEAAVHAFTDGRDTSPTGGEDYLADLEAVADEHGTGDVASVSGRYYAMDRDQNWARTKRAYDAITRSDGVAHHAAAAVDAVTDSYERGDTDEFVEPTTIEGGAALSDGDAVVFANFRADRARQLTRLLADIHPADWDADGIETNPPAVPVVTMTEYDETFDCPVAFPAAEPTDTLGAVLAAHDHTQLRVAESEKYAHVTYFLNGGREVAFDGETRTIVDSPDVPTYDEQPAMSAPAVTDTVLDALAGDDPDVLVLNYANPDMVGHTGDFDAAIEAVEAVDRELGRLVPALNDAGAHAFLTADHGNADDLGTPADPHTAHTFNPVPFVSLPPASGDTAAVRDGGALRDIAPTLLDVLGIDRPTVMTGASLLE

SEQ ID NO: 92777 - protein, 194 aa, Lactobacillus plantarum WCFS1
MNLPNKLTVFRIILIPVFILIMVLPLSWGQVVWAGTTIPVTQVVATVIFAVASLTDLADGKIARGQHLVTNFGKFADPLADKMLVMTAFIILVRLNAAPDWVVAIIMCRELAVTGLRLLIVENNGKVMAAAMPGKIKTTTQMIAIIFLLLNNVLFAAIHIPFAAIMLYICLFFVIYSGIDYFVQNRDVFADGFK

SEQ ID NO: 92778 - protein, 204 aa, Zea mays
MAEPDPDVIEVTFGNDVINTTVTSSGQAVERWIAEILALHRPGSNGYSIIVGLDVEWRPSFGPHQNPVATLQLCVGHSCLIFQLLYADYVPGALAEFLGDRGIRFVGVGVEADAERLSDDHGLVVANAEDLRGRAAERMNRPDLRQAGLRALVQVVMGVDLVKPQRVTMSRWDASCLSYDQIKYACIDAFVSFEVARRLLGGAY

SEQ ID NO: 92779 - protein, 408 aa, Alteromonadales bacterium TW-7
MPALEFDINKIRNDFPTLKQQINANPLVYLDSAATTQKPQSVIDAINEFYTSQNANVHRGRHTLSERATSLYEQARDKTAKYFNVSSKEIVWTKGATEAINLVSNGLRSRFNQNDTIIISVLEHHANIVPWQVLSEQTGAKLLALPVNDDGTLNIKQCCDFIKQSKPSMFAITQASNMLGNITNLKPLITAAKEVNSLVLIDGAQGAMHLKPDLHNLNCDFYVCSSHKMLGPTGLGVLYGKYQELNSLDVYQTGGEMIDKVYLTHSTYRPAPAKFETGTPNISGVVGFSAALDYINALQNEQLQKYEQKLFNYAAEKLVTIKGITIYSNLSDNIGTLSFNFKDEHPYDLATLLDGYGVAVRAGHHCTQPLMTHLGINGTLRASFCFYNTYEDVDIFINSLKECIALLD

SEQ ID NO: 92780 - protein, 486 aa, Mannheimia succiniciproducens MBEL55E
MNIQTSAPKVEVRLGFKLQGLLIAVLVGIAILLIPTPEGLSTKAWGMFALFVATIVAIIAKAMPMGAATLVALVISGLSGLTPLSPAKGEVGMLSGFSNGTIWLIAIAMFLSRAVIKTGLGKRIALYFVARFGKRMMGVAYGIALADVVIGPGIPSASARGGGIMYPIMQSIADAYNSKPGPTARRAGAFLAIAVSQIDTIVCTMFLTAMAGNPLIAELAKSQGVEITWMTWFLGAIVPGIVSLILLPYFVYLIYPPELKDTPKMAEMAREELNSMGKMSQAEWILALDFILLLLLWTVGDLVFHIPATVSAFVGLVILLLTNIMSWKNIISETAAWDTMFWFAVLVMMANALNKYGTISWISTHIADSVGSFSWPVAFTILVLVYFYTRYFFASAMAHISAMYLAFVAAAIAVGTPPIIAAIGLGYTSTLSMSLTQYAGGPGPALYGSGYNSTGQWWGVSFAVSILSLAIWFSVGGVWMKLLGWW

SEQ ID NO: 92781 - protein, 191 aa, Glycine max
  misc_feature (77)..(77): Xaa can be any naturally occurring amino acid
ASLLIVCILESGYVNGHFSSLKITLEVTAPPLQEQAVDAELNNVTVTCALNNTLPAVTDSAYYTIHLKLCYVPVTPXDRASTKTEDYLKRHTSCHHYIVNIPYYASYNTVQRFEWLHQRDAPKATYFVRAYAIHSNYDELAYGQTTDSKNSTNLFYIHAVYGRHASRDICSICFRAFYVESLYSLIYTAKR

SEQ ID NO: 92782 - protein, 265 aa, Alteromonadales bacterium TW-7
MSEKITDIRFGGIKRLYGHQQFDWLQEAHFCVVGIGGVGSWAAEALARTGLGRITLIDLDDICATNVNRQIHALSGTIGHAKVDAMKARCELINPECNIDVIDDFITLENIKEHIHGFDYVIDCIDAVKEKAALIAHCKRNKMPIITTGGAGGQTDPSQITFGDVAKTTQDPLLAKVRYILRKQYNFSNNPKRKFNVDCVYSTEQLVYPGSDGSVCHAKQSADGSMNMDCNNGFGSVTMITGSFGFFVAAKAIRKYLDKKQRLQV

SEQ ID NO: 92783 - protein, 111 aa, Triticum aestivum
  misc_feature (23)..(23): Xaa can be any naturally occurring amino acid
  misc_feature (27)..(27): Xaa can be any naturally occurring amino acid
  misc_feature (54)..(54): Xaa can be any naturally occurring amino acid
  misc_feature (64)..(64): Xaa can be any naturally occurring amino acid
  misc_feature (67)..(67): Xaa can be any naturally occurring amino acid
  misc_feature (70)..(70): Xaa can be any naturally occurring amino acid
MAPTVMASSTSVAPFQGLKSTAXLPVXSRRSNGASLGSVSNGGRIRCMQVWAIXGIKKFETLSXLPXLNXEGLLKQVDYPDPLQSGWPFPLSLNKRSGFQSFRAKNAVSPG

SEQ ID NO: 92784 - protein, 402 aa, Clostridium perfringens SM101
MIILYLEKIIKAKKNIEDVVIKTPLIYSEVFSRKSGNQVYMKCENLQLTGAYKIRGALNKIRSLSDEEKSKGVVCSSAGNHAQGVAFAASQANVKSTIVMPKTTPLLKIQSTKDLGGNVVLSGYVYDDAFNEAKRIEQEQGALFIHPFNDIDVICGQGTVALEIFEDLNDVDIILCPIGGGGLISGVTLAAKALNPNVKVIGVQGEGANAMVKSFKAGEIIALDAVDTIADGIAVKRPGDLTFKFIKEYVDDIITVSDHEIVEAFFTLSEKHKLLAEASGAVSLAASAKLNCKDKNIVSVISGGNIDMVTITSLINSALVAKGRLFGFSLEVPHKPGQILKIAKVLADTNANIVKLEHDHFKARDALKNMVIEVTLETNGHSHIEEIKKALTDQNYVIKQIY

SEQ ID NO: 92785 - protein, 446 aa, Cryptococcus neoformans var. neoformans JEC21
MSAIRALNMRKTASALKAPVAFKRTLATPVNSLYTSVLPAKIPAALHLKSGQSYFGSSFGSENSKFGETVFSTSITSYTDSMTDPSYLGQILVFTSPMIGNYGVPSNTSSQFPGIPFLESEKIQCTGVVVSDVALKYSHYQAVESLHEWCKRYDVPGITGVDTRAITSLLRDQGTTLGRLAVGDEAGKPAPQEAEYWDPSKENLVAQASTKKAYVLNEKGSGPRIAVLDFGTKANILRSLIRRDAVVTVLPWDFDFNTVRDQFDGLFLSNGPGDPKMIMDSAMRVRQTINEWNKPIFGICMGHQVLGLAAGLEAYRMTFGNRGHNQPVLALASSGSIKAGRVYVTSQNHQYALRLTEDFPEGWAPFFINCNDSSVEGIISTPESGKRIWGVQFHPESAGGPLDTIEMFTDFVNECDVSRKGFSGSAMIANEVKVDGHAAKAASVSA

SEQ ID NO: 92786 - protein, 646 aa, Cryptococcus neoformans var. neoformans JEC21
MSSHRGQPLFSGGMYELLNKGAAEHEEVEEEEEAPVETSPENPSGSQSQTATLSKSARKRLARQASKGLDGKSKSNKQSGSETESPGTPSVPGAEEFPETNIEAPIPQEAPKQQASSPAKTELEHSTTSPSQIPALEKQIPDIAPKKTKPVTAVPEKKEENKEQKKETPKKADAARSSSPPSSNFSPSLPATLPQPTGNALPANRKRKTPQDFTPAGPGNVMNSASPSKIAVKFEDGLAPGEGKEGEKTIAPKKNRNMIERTIWTFIMIGGFIVLLCMGHPYMILLVMLCQTLVYNEVTALFDLRDHGGSKAATPGEQGDSWNKTINWYFFVVANYFLYGESIIYYFKHIVFVDAYFIPFARNHRFISFMLYVVGFVGFVANLQRQYLRQQFALFCWVHISLLLIVVSSHFIVNNILEGLVWFFVPASLVICNDVMAYVCGKLFGKTPLIKLSPKKTVEGFVGAFICTLLFGIAWGTFWMRYPYMICPARDLGTNVFSQVTCRPNPVFMWHSFEFTGVARQALQTILGHPPPSIPYAPFQIHCLVMATFASLVAPFGGFFASGFKRAFNIKDFGHSIPGHGGMTDRMDCQFMMGLFSYVYYSSLIRIQNVTVGGIMQAVVTSLTQPEQIELLYDLKRFLAGQGVKV

SEQ ID NO: 92787 - protein, 260 aa, Mycobacterium avium subsp. paratuberculosis K-10
MAERLAGKVALVSGGARGMGASHVRSLVAEGAKVVFGDILDDEGKAVAAEVGEATRYLHLDVTKPEDWDAAVATALAEFGRIDVLVNNAGIINIGTLEDYALSEWQRILDINLTGVFLGIRAVVKPMKEAGRGSIINISSIEGMAGTIACHGYTATKFAVRGLTKSAALELGPSGIRVNSIHPGLIKTPMTEWVPEDIFQSALGRAAEPKEVSNLVVYLASDESSYSTGSEFVVDGGTTAGLGHKDFSNVETDAQPDWVT

SEQ ID NO: 92788 - protein, 383 aa, Zea mays
ECCLIYGGPSILRPNFSSRFQALPSPGAVQFSFRDAGLQFSKQGVAITQENSLLDNTARIEGWLVRFPMFDWVGGRTSEMSAVGLLPAALQGIDIKEMLAGAALMDEETRNTVVKENPAALLALCWYWASEGIGNKDMVVLPYKDSLLLLSRYLQQLVMESLGKEFDLDGNRVNQGLTVYGTKGSTDQHAYIQPSREGVQNFFVTFIEVLRDRPAGHDWELEPGVTCGDYLFGMLQGTRSALYANDRESISVTVQEVTPRAVGALIALYERAVGIYASLVNINAYHQPGVEAGKKAAGEVLALQKRVLTVLKEAICENPTEPLTLDEIADRCHCPEDIEMIYKIIQHMAANDRALIAEGSCGSPRSVKVYLGECSVDEDMQAA

SEQ ID NO: 92789 - protein, 352 aa, Cypripedium parviflorum var. pubescens
MENGNHEIPENAREHCPGPQSESAGKSDSCEGCPNQQICATAPKGPDPDLVGIAERMATIKHKILVLSGKGGVGKSTFSAQLSFALASKDYQVGLLDIDICGPSIPKMLGLEREDIHQSNLGWSPVYVDSNLGVMSIGFMLPNPDEADIWRGPRKNGLIKQFLKDVNWGEIDYLVVDAPPGTSDEHISIVQFLQASGIDGAVIVTTPQQVSLIDVRKEISFCKKVGIQVLGVVENMSGLKQPVLDLKFERLVAGDKVGAVEDVTEWAQRYIRQNAPELLSLFACSEVFDISGGGAAKMCTEMGVPFLGKVPLDPQLCKAAEDGRSCFQEDQKCRLSAPSLPRIAEQLIASHE

SEQ ID NO: 92790 - protein, 301 aa, Candida albicans SC5314
MSTKREDHLRKGADVTPTEALVAGSIAGAISRAFTAPLDTIKIRLQLQPKGFKHRKSVVTIVKNLLENEGIIALWKGNVPAEILYILYGGVQFGSYSIISKSVSKLENNYRINLSSANHSLIVGIGSGIVSTLVTYPFDLLRTRLIANKNRGLLSMTGTIKDIIKLEGIRGIYAGIRPAMLSVSSTTGLMFWSYELARELSNNYQRVPFIEAICGFIAGATSKGITFPLDTLRKRCQMCSVVHGRPYTASHIFVTILKNEGVFGLYKGFGISVLKTAPTSAISLFMYEYSLSFIRKIRVIE

SEQ ID NO: 92791 - protein, 450 aa, Lactobacillus plantarum WCFS1
MKVIKFGGSSLASSQQLQKVLAIVEADQKRKYVIVSAPGKRFDGDTKVTDLLIQYARQTIHHQDTQAVTAAIIDRYAEIGHGFNVPEAQLTPIFETIRNLPKQSYADNTYLMAAFKAHGERLNAQLVAAVFQQSGLNARYLDPKDAGMVVTDVPDDAQIIKSSYDQLAKWANSEQILVIPGFFAYNRNGQICTFSRGGSDITGAIIARGVHAERYENFTDVDAIYAVNPSLVAKPAAISEMTFTEMRELSYAGFSVFHDEALIPAIEDNITVNVKNTNHPEAPGTLIQSTREPNPHYPVTGIASSSSFCSLYLRKYLLNKEVGLGRKILTILENHHISYEHMPSGIDDLTIIFDEHQLTPELEKTLVAEISTAINPDEIYFTHDYSILMLVGENMRNRVGIMSRAATALANDNIKLIMVNQGASEISIMFGVHDNDADQAVIALYKEFFD

SEQ ID NO: 92792 - protein, 460 aa, Desulfovibrio desulfuricans G20
MTPERIYEVTEAQRAFFQSGATLDVDGRIASLRTLRGAVHDYTRRFIVAAAQDAGLSEHMVLAAEIAPVINDIDHMIKRLPALAKGRLVRRSRLHMWGWSRSVPRPAGIAVAVTAADMPVQRALMPVVSALAAGTPLLLALSPRTPAVNGIVERLVQQFFKPEQITVTTADNETTEAILGQRFDACLCSAPRETAVRFARAAAEHLVPAVIETAEHRNPAIVLEDADIRLAARRIVWAKTLAAGQTAAAPDYLVVHGAVRERLLAALRKELEAQHGAIPSASSAFGRMTDNAAYEEAAAFLTDGTPVIGGDTDPAGRFINFTVLENVQPDAPVMRSVTRSPVLPLFEVQSAEQAVELVNSRPAPLALYVFSTDVFTARKVLDATTSGTAAVNDVLVQTVYPALPFGDAAGGGMGSHRGEAGFFAFSRLRSVTRGTNFIDLPFRFSPDAGWKQKILRYIIR

SEQ ID NO: 92793 - protein, 692 aa, Triticum aestivum
  misc_feature (123)..(123): Xaa can be any naturally occurring amino acid
  misc_feature (581)..(581): Xaa can be any naturally occurring amino acid
MESCQLARESSSSSGRLEEAEEEAFFDTRQDLLPSPAPSPAPALPWSSGGLDGLDSVRDRKERFFRSMGLECGPSPRQAVDPACAAGEAEKQQEEEAVPETGRLSSHSENDCSMSSWSTEETXSYDEGGASDDNSVGGSSKDDGSSKVSRSSSSFSFIRRLMSRNGKPSGAPKTVEMRRSGWLERLGVAVCAVDNAADEPSTSSSDSEPIHGGRYERVKVRSYRKRSKELSALYQGQVIKGHDGAILTMKFSPDGQFLATGGEDGVVRVWGVSQSDDCKIPLDDPSCVYLKARRKNGLAPVSVDSEKLRKSKSMGMKKTGDSTCIVIPTMVFQISEEPLHEFYGHSADVLDLSWSNNKHLLSASTDKTVRLWEIGSANCIKVFPHSNFVTCVQFNPTNDNCFITGSIDGKVRVWDITRCSVVDWADVRDIVTAVCYRPDGKGAVVGTITGNCRFYDASDNLLRLETQIALSGKKSSLKRITNFQFCPNNPSKLMVTSADSKIRMLDGTNVIQNYSGLRSGSCQMSASFTPDGEHIVSASEDSNIYVWNRDNQDDSVWRQAKTTYSSERFLSNNAAIAIPWXGTKPRGHVSLASHIQFKYSSSKSFPSRPSAPGIFNLNQELFAEPSCKGASATWPEEMLPSGSIGASLDESQHKLLRNCSQSTANSWGRVIVTAGWDGRIRSFQNYGLPVHQ

SEQ ID NO: 92794 - protein, 442 aa, Arabidopsis thaliana
MDLQRTLMFSCWVLSLLIIKTTAYNEKQLFQPLETENANAMTAVMERGLKTQRRPEHKNAYATMMYMGTPRDYEFYVATRVLIRSLKSLHVDADIVVIASLDVPINWIHALEEEDGAKVVRVENLENPYKKQTNFDNRFKLSLNKLYAWSLSDYDRVVMLDVDNLFLKNTDELFQCGQFCAVFINPCIFHTGLFVLQPSMEVFRDMLHELEVKRDNPDGADQGFLVSYFSDLLNQPLFRPPPDNRTALKGHFRLPLGYQMDASYYSEMPWVLTQAVFYLGIILVTRLARPNMTKLCYRRSDKNLSMIQTAFKFVALLFILSAYIIPFFIIPQTIHPLIGWSLYLTGSFALSTIPINAFLLPILPVITPWLGIFGTLLVMAFPSYPDGVVRALSVFGYAFCCAPFLWVSFVKITSHLQIMIDKEVLFPRLGESGVTSGLSKLY

SEQ ID NO: 92795 - protein, 156 aa, Mannheimia succiniciproducens MBEL55E
MKVLEGGLAAPNAKVAVVVARFNSFINDSLVEGAVDALKRIGQVKDENITLVRVPGAYELPLAVRRLADSKKYDAIVALGTVIRGGTAHFEYVAGGASNGIGHVSLESNVPVAFGVLTTENIEQAIDRAGTKSGNKGAEAALVALEMVNLLAQINA

SEQ ID NO: 92796 - protein, 381 aa, Triticum aestivum
  misc_feature (192)..(192): Xaa can be any naturally occurring amino acid
  misc_feature (261)..(261): Xaa can be any naturally occurring amino acid
  misc_feature (274)..(274): Xaa can be any naturally occurring amino acid
AYLGDTIEQVCTKKQAGTGPEFPGYRRPTRPLKEVKLSEGYYVMDPEKAVEMVDENTICVAAILGSTLNGEFEDVKMLNDLLVKKNEETGWDTPIHVDAASGGFIAPFLYPELEWDFRLPLVKSINVSGHKYGLVYAGIGWCIWRSKEDLPDELIFHINYLGADQPTFTLNFSKGSSQVIAQYYQLIRPWFXGVQEHHGQLPGERDGAQGGAGAHGAVQHRVQGPGASPLGAFLPSKDKQPARRVRDLRVPCARFGLDRAXLHHAPRRAARSPXLRRRHPRGLQPHLRRAPRHRHREGAPRARRAPLAQQRARPAAPQRRHGEREGPRQAARGGVRLEEGRRRQEEDPGRLLSGGDAPLTMLCRSIFMVVFPNLSCYFSCP

SEQ ID NO: 92797 - protein, 293 aa, Zea mays
MGRHQAGRRAILFEETLYQSAVDGRKIVDILAEQGIVPGIKVDKGLVPLAGSNNESWCQGLDGLASREAAYYQQGARFAKWRTVVSIPNGPSELAVKEAAWGLARYAAISQDNGLVPIVEPEILLDGEHGIERTFEVAQKVWAETFYAMAENNVMFEGILLKPSMVTPGAEAKDRATPEQVAAYTLKLLHRRIPPSVPGIMFLSGGQSEVEATQNLNAMNQGPNPWHVSFSYARALQNTCLKTWGGQPDKVKAAQDALLLRAKANSLAQLGKYTSDGEAAEAKEGMFVKNYSY

SEQ ID NO: 92798 - protein, 481 aa, Oryza sativa Japonica Group
MLPYFDPEYENFSQRINPPRVCIDNSTCSDCTLVKVDSMNKNGILLEVVQVLSDLDLAISKAYITSDGGWFMDVFHVVDKQGQKVTDEKTIKHIEKALGPDSNLLGGAKGGSSPVRSVGMHSIGDHTAIELKGPDRTGLLSEVFAVLAELGCNVLAAEVWTHRARVACVVYVNDVASGQAVGDPCRLSRIEHRLRLVLRGHAGGDDGDGDDGPAHANFFSSGGAGSNTHVDRRLHQLMHADVDADDDDGLDSRAIVSGEAGNAAAAEERPVVTVEHCEEKDYSVVNVKCRDRSKLLFDIVCTLTDMHYVVSHASVSSDGIYGIQELYIRRKDGRTLQKDEAGRVIKCLEAAISRRVSEGFTLELCGRDRVGLLSDVTRVLREHGLTVTRADVTTVGGQAINVFYVRDASGEPVDMKTIEGLRVQVGHTVMLNVKKVPSSPSSSSAAAAAAANGKSPGQPASGALSRTSFFSFGNLFAKLRA

SEQ ID NO: 92799 - protein, 467 aa, Nocardia farcinica IFM 10152
MTSHYDVVVLGAGPGGYVAAIRSAQLGLRTAVVEQKYWGGVCLNVGCIPSKALLRNAELAHIFHKEAKTFGISGDVSFDFGAAFDRSRKVADGRVKGVHFLMKKNKIDEFDGKGTFVDANTLSVELSKGGTESITFDNVIIATGTVTKLLPGTSRSANVVTYEEQIMTRDLPGSILIVGAGAIGMEFGYVLKNYGVDVRIVEFLDRALPNEDADVSKEITKAYKKLGITITTGAAVQSIDDDGTKVTVAIKDNKSGSVETVTVDKVLQAVGFAPRVEGYGLENTGVALTDRGAIAIDDNMRTNVPHIYAIGDVTAKLQLAHVAEAQGVVAAETIAGAPTLTLGDYRMMPRATFCQPQVASFGLTEEQARAEGYDVKVATFPFTANGKAHGLGDPTGFVKLISDVRYGELLGGHLIGPDVSELLPELTLAQKWDLTVNELTRNVHTHPTLSEALQEAFHGLAGHMINF

SEQ ID NO: 92800 - protein, 201 aa, Mucor racemosus
TILKQDEGWIHDGGFTPEEKEAYKEIIFSNSVQSIHVLLEAMEILDIPLDDASNQGYFDYIMEQYQKMDYFSMPPELVKAIKQLWQDKGVQEAHSRRNEFQLNDSASYYFDSIDRIGDPNYLPTDQDVLRSRVKTTGIAESKFTFGTLTYRMFDVGGQRSERKKWIHCFEDVTAIIFLVAISEYDQVLIEDESVNRMQEAF

SEQ ID NO: 92801 - protein, 475 aa, Bacillus cereus ATCC 14579
MQQPTNEKLHRTMKSRHLFMIALGGVIGTGFFLGSGYTINQAGPGGAILSYLVGGFIMYLTMLCLGELTVAMPVSGSFQKYATKFIGPGTGFMIGWLYWLGWAVTVGLELTSIGLMMKRWFPNVDVWVWCLVFGVILYASNAISAKSYAELEFWFSSIKVITILAFVVLGGSALLGFISYDGKEAAPLFSNFVSNGGLFPNGLAAVLLTMITVNFSFQGTELIGIAAGESENPEKTIPRAIRNTVWRIMLFFILTMTILVGLISWKEAGVIESPFVVVFDKIGIPYAADIMNFVIITALLSVANSGLYAATRILWSLANEGMAPTSFQKVNKRGIPITALVVTIAVAGLSLFTSFLAEDTVYMYLLSIAGLSAVSSWIIIALSQLRFRSQYIKGGGKLEDLKYRTPLYPIVPILALITNSIVVISLAFIPEQRMALYCGIPFIIFCYIYYYISKKRQKPMKVEMEKTNETNNQTR

SEQ ID NO: 92802 - protein, 205 aa, Mucor racemosus
TILKQMKLIHDGGYSRDEREAFKEIIFSNTVQSMRVILEAMENMGVSYASSQNRLHSTVILDLPSQIERDSLPPEVTLALKSLWKDENLLSVFDRSREYQLNDSAKYYFDSIDRIGDINYIPTDQDVLRSRVKTTGITETTFVIGDLTYRMFDVGGQRSERKKWIHCFENVTAIIFLVAISEYDQVLIEDETVVNMHMQKRDDHR

SEQ ID NO: 92803 - protein, 191 aa, Mucor racemosus
TILKQMKLIHDGGYTRNERESFKEVIFSNTMQSMRVTLEAMNNLGIAFDNPENEGHKRLVLEAPPQIDYLGHELVEAIASLWDDQGVQECVQRSNEFQLNDSARYYFDSILRIGQSNYMPSDQDVLRSRVKSTGITETTFVIDSLTYRMFDVGGQRSERKKWIHCFENVTALVFLVAISEYDQVLFEDESV

SEQ ID NO: 92804 - protein, 300 aa, Robiginitalea biformata HTCC2501
MLGIKYLSREDLDLIFETADHFKEVLSRSIKKVPSLRDITIANIFFENSTRTKLSFELAEKRLSADVINFSAAQSSVRKGETLIDTVNNILSMKVDMVVMRHPNPGAGIFLSRHVNASIINAGDGAHEHPTQALLDSYSIREKLGEVAGKKVVIVGDILHSRVALSNIFALQLQGAEVQVCGPRTLIPKYVESLGVRVEPNLRKALEWCDVANMLRIQNERMDMSYFPSTREYTRQYGIDKKLLDSLGKEIVIMHPGPINRGVEITSDVADSSQSIILNQVENGVAIRMAVIYLLASRIK

SEQ ID NO: 92805 - protein, 334 aa, Pantoea agglomerans
NGIAGSYAEYVPVVHIVGAPRLTSQRKGELLHHTLGDGEFCHFMRMSAPVSVAQASLTPENALAEIDRVIEEVMYSSRPGYLLLPSDVPALPVSTRAHALPARQPPFSPSSLEAFTAAAQTQLRGANRVSLLADFLADRFKVKKALEQWMEEVPLGTSTLLMGKGLFNEQQAHFAGTYSGAASAPSTKEAIEGADVVITVGVKFTDTITAGFYQQRPSGNASTSALFAARAIRSSITGRSKNGQRDAPPPPLNLAFRPGRLILLNTTHCRWSRDNSLGQYAFWQQIQDSLQPGDVLVAEQGTACFAAAALNLPQDLQFVVQPLWGSIGYTLAAA

SEQ ID NO: 92806 - protein, 314 aa, Geobacillus kaustophilus HTA426
MKIVVTGGAGFIGSHLAARLHEQGHEVAAIDCFHPYYPVERKERQFHALTGGRVPLARFDLLDGEATKRWFSQFRPDVVYHLAALPGVPYSLAHPLAYIDYDIKATVNVLAAAGEAGVAHVLFASSSSVYGDRGNVPLREEMADGRVVSPYAAAKYGAESFCHAYAHLYGYQMTIFRYFTVYGPWGRPDMAIGTFLRRLLAGEEIVVYGKGTARDYTYIDDIVEGMIAALHRSGGRSEVFNLGAGAPVTMEQLLAELRKHFPDLKIVHAPERKGDVKATWADITKAERAFGYKPKVAFAEGLARTVAWAREYER

SEQ ID NO: 92807 - protein, 228 aa, Staphylococcus aureus subsp. aureus MRSA252
MKDVKALKLMTLNDVLSQINGDMTLGIGTGSTMELLLPQMAQLIKERGYNITGVCTSNKIAFLAKELGIKICEINDVDHIDLAIDGADEVDPSLNIIKGGGGALFREKVIDEMASRFVVVVDETKMVQYLGETFKLPVEVDKFNWYHILRKIESYADIKVERRVNEDVAFITDNGNYILDCKLPKGIDPYKFHEYLIHLTGVFETGYFLDMADQVIVGTQEGVKILEK

SEQ ID NO: 92808 - protein, 503 aa, Arabidopsis thaliana
MVIGLSTMLEKTEALFASDHASVVSMNLFVALLCACIVLGHLLEETRWMNESITALIIGSCTGIVILLISGGKSSRILVFSEDLFFIYLLPPIIFNAGFQVEKKQFFRNFMTIMLFGAIGTLISFVIISFGAKHLFEKMNIGDLTIADYLAIGAIFSATDSVCTLQVLNQDETPLLYSLVFGEGVVNDATSVVLFNAIQRFDLTNINSAIALEFAGNFFYLFILSTALGVAAGLLSAFVIKKLYIGRHSTDREVALMMLLAYLSYMLAELFHLSSILTVFFCGIVMSHYTWHNVTDKSKVTTKHTFAAMSFLAEIFIFLYFGMDALDIEKWDVVRNSPGQSIGVSSILLGLILLGRAAFVFPLSFLSNLTKSSPDEKIDLKKQVTIWWAGLMRGAVSMALAYNQFTTSGHTKVLGNAIMITSTITVVLFSTVVFGLLTKPLVKHLQPSSKQSSTTALQITLRSSFHDPILHEPLLSTQGQSEYDPEQHVSFRMFWKSPSRFTH

SEQ ID NO: 92809 - protein, 369 aa, Oryza sativa Indica Group
MDGAPVAEFRPTMTHGGRYLLYDIFGNKFEVTNKYQPPIMPIGRGAYGIVCSVMNFETREMVAIKKIANAFNNDMDAKRTLREIKLLRHLDHENIIGIRDVIPPPIPQAFNDVYIATELMDTDLHHIIRSNQELSEEHCQYFLYQILRGLKYIHSANVIHRDLKPSNLLLNANCDLKICDFGLARPSSESDMMTEYVVTRWYRAPELLLNSTDYSAAIDVWSVGCIFMELINRQPLFPGRDHMHQMRLITEVIGTPTDDELGFIRNEDARKYMRHLPQYPRRTFASMFPRVQPAALDLIERMLTFNPLQRITVEEALDHPYLERLHDIADEPICLEPFSIDFEQKALNEDQMKQLIFNEAIEMNPNFRY

SEQ ID NO: 92810 - protein, 519 aa, Candida albicans SC5314
MSDLVKSSEVIETTEVPPHNNNNNKRHFKYDSEQRKQRLAGGVKLKDALMILCAGFALISDGYQNNVMSMMNKVFALEYPKEYTASLSTQVSNASLVGTIFGQVIIGLTADYIGRKWSIVTATCFLIFGTMMCAASHGKTVNGMFWMLTIFRGVTGFGIGAEYPSSSVTASEAANESVKRRGGAFILATNLPLSFGGPFALCIFLIVRRICGNHLDAIWRTMFAIGCFWPLSVFYFRLKMVTSELYTKSAIKQRAPYWLALKYYWPRLIGTCVAWFLYDFVTFPNGIFSAGIISNVIPKSEKNNLEKIAEWNLLLGAIALPGVFVGAYVVDILGRKYTMMIGFCGYIVFGLIVGCGYHQIKPITGLFIVFYGLMMSCGNFGPGNNMGLTSSESFATPIRGTAYGISAAIGKVGAVVGTKTFSPIQKNLGDKWTFIIAAICGLAGVLVTFIFIPHLKDEDLLEEDVKFKNYLIDNGWKGKFGIQEYDEEEDLEGSSEDSSDGEIVKNNTKNDVEKVDALK

SEQ ID NO: 92811 - protein, 160 aa, Desulfovibrio desulfuricans G20
MKHTISALVQNRVGVVAEATDVFRKYNVNIKSVSCGETEDFDVSRLVITVEGQSAEVERICAELSGLDFIREVEDLARKDFVDRELALLRVSITRDTMSQVMQIFEVFRANVVGMGQETITVELTGDQEKVDGFIKMLRPHGIRSLCRTGVIALRRGDED

SEQ ID NO: 92812 - protein, 459 aa, Oryza sativa Indica Group
MEFFTEYGEASQYQIQEVVGKGSYGVVAAAVDTHTGERVAIKKINDVFEHVSDAIRILREIKVLRLLRHPDIVVIKHIMLPPTRREFRDIYVVFELMESDLHQVIEANHDLSPEHHRFFLYQLLCALKYIHSANVFHRDLKPKNILANSDCKLKICDFGLARVAFNDSPSTIFWTDYVATRWYRAPELCGSFFSKYTPAIDIWSIGCIFAEILTGRPLFPGRNVVHQLDLITDLLGTPSSETLSRIRNENARGYLTGMQRKHPIPFSHKFHNADPLALRLLERLLAFDPKDRPTAEEALADPYFRGISKLSREPSRLPVSKFEFEFERRKLTKDDVREMIYREILEYHPQMLQEYIRGGEQISFLYPSGVDRFKRQFAHLEENYSRGERSTPLRRQHASLPRERVCSSVDSNNQDSDNEERRAISSIARTMISPPRSQEKGKNRASAYPNGIINLNSNP

SEQ ID NO: 92813 - protein, 893 aa, Saccharomyces cerevisiae
MSREGYPNFEEVEIPDFQETNNTVPDLDDLELEYDQYKNNENNDTFNDKDLESNSVAKHNAVNSSKGVKGSKIDYFNPSDVSLYDNSVSQFEETTVSLKEYYDHSIRSHLTVKGACSYLKSVFPIINWLPHYNFSWFTADLIAGITIGCVLVPQSMSYAQVATLPAQYGLYSSFIGAYSYSFFATSKDVCIGPVAVMSLQTAKVIADVTAKYPDGDSAITGPVIATTLALLCGIISAAVGFLRLGFLVELISLNAVAGFMTGSAFNILWGQVPALMGYNSLVNTRAATYKVVIETLKHLPDTKLDAVFGLIPLFLLYVWKWWCGTYGPRLNDRYNSKNPRLHKIIKWTYFYAQASRNGIIIIVFTCIGWAITRGKSKSERPISILGSVPSGLKEVGVFHVPPGLMSKLGPNLPASIIVLLLEHIAISKSFGRINDYKVVPDQELIAIGVSNLLGTFFNAYPATGSFSRSALKAKCNVRTPLSGLFSGSCVLLALYCLTGAFFYIPKATLSAVIIHAVSDLLASYQTTWNFWKMNPLDFICFIVTVLITVFASIEDGIYFAMCWSCAMLILKVAFPAGKFLGRVEVAEVTDAYVRPDSDVVSYVSENNNGISTLEDGGEDDKESSTKYVTNSSKKIETNVQTKGFDSPSSSISQPRIKYHTKWIPFDHKYTRELNPDVQILPPPDGVLVYRLSESYTYLNCSRHYNIITEEVKKVTRRGQLIRHRKKSDRPWNDPGPWEAPAFLKNLKFWKKRENDPESMENAPSTSVDVERDDRPLLKILCLDFSQVAQTDATALQSLVDLRKAINQYADRQVEFHFVGIISPWVKRGLISRGFGTLNEEYSDESIVAGHTSYHVARVPQGEENPEKYSVYTASGTNLPFFHIDIPDFAKWDI

SEQ ID NO: 92814 - protein, 1014 aa, Candida albicans SC5314
MLAIDNSPSNPNTHHSHSSYPPQMEDFSTEVISLANSEMTIESRYQAAAAATTPSTPPQLQEQLQLQEQPPLTKISSQSKASTPSVSTSALKKASSLFKLNTNSQSRNKKHTNKQQQQSQPSPTSPKTLTNITSRQSTPTPTPTPSNSTSRPNLRSLLRIGSFSNNQPHIHSNNPHVKNPSITALEGEIEVKIDEEDIEEEDNIEEEDDEIAYLSDSESDLNYDPKAEESHEDYRTGGYHPVSKGEIYYSKKLPNREYIILRKLGWGHFSTVWLAKSRYNGNLSLEKEEEDDEEEEVEESLLDSVDINEYYVAIKFVKSNKNYMEAARDEIKIMNVLNDPINNNHHIPKENISYFKNDNKLHPGYNHVMQLKDDFEISGPNGIHICMVFEILGENVLNLIYRYKRLYRSINSEIKRKESAEENICLQQQSQMKFSKWDTKNWKKSTKSMLSLGLHNKKDTHKHDSTSNNNNNDTNNNFTINHNNNTNTNGQASINTTAISTASSSSLNSNPHEDSFIESSGSGSNSVSGSGSGSGQDNESTTTVDSWEDDLDKKIKSLNSQSLIKLIETSKTVGGIPLYIVKQIVKQMLLAIDYMHHCGIIHTDLKPENILIDIKDINKLIRTIEDEKLSKFRANNNNNLSRSRKASLLSNCSRTRRRRSSSKQLNQHYQSQQQQQQQKSNCCSSSCHIRTLSTTSNSSQSSYFYKKSKNSIVGKYESPIRCSKPLSSSISSDSIFKDVNFNGNDSNNHSNSKPRKKSISKAISPRNFSFFDYNKKDQEMIDDNIEEEEQQQRECEGNIRGGISIKIADLGNATFVDEHFTNQIQTRQYRSPEIILKYKHWGSSTDLWSIGCIIFELITGDFLFDPHDGKCFDKDEDHLAQIVELLGDFPNDEYLLDCKLTGKFFKLNPNPDLKGNSQIMFKNIDQLKIWKLKDVLIEKYKFNKNDYEVDLICDLILKCLKYDLNERYDANSLLKHPWFDSDNNSTISPGLEDRLKNLPNCHDDLPGYTCECKI

SEQ ID NO: 92815 - protein, 455 aa, Streptomyces avermitilis MA-4680
MAQVLEFKLPDLGEGLTEAEIVRWLVQVGDVVAIDQPVVEVETAKAMVEVPCPYGGVVTARFGEEGTELPVGSPLLTVAVGAPSSVPAASSLSGATSASSASSVSSDDGESSGNVLVGYGTSAAPARRRRVRPGQAAPVVTATAAAAATRVAAPERSDGPVPVISPLVRRLARENGLDLRALAGSGPDGLILRSDVEQALRAAPTPAPTPTMPPAPTPAPTPAAAPRGTRIPLRGVRGAVADKLSRSRREIPDATCWVDADATALMHARVAMNATGGPKISLIALLARICTAALARFPELNSTVDMDAREVVRLDQVHLGFAAQTERGLVVPVVRDAHARDAESLSAEFARLTEAARTGTLTPGELTGGTFTLNNYGVFGVDGSTPIINHPEAAMLGVGRIIPKPWVHEGELAVRQVVQLSLTFDHRVCDGGTAGGFLRYVADCVEQPAVLLRTL

SEQ ID NO: 92816 - protein, 249 aa, Medicago sativa
MPIRNIAVGTPQEATHPDTLKAGLAEFISTFIFVFAGSGSGIAYNKLTNDGAATPAGLISASIAHAFALFVAVSVGANISGGHVNPAVFGAFVGGNITLLRGIVYIIAQLLGSIVCSALLVFVTASSVPAFGLSEGVGVGPALVLEIVMTFGLVYTVYATAVDPKKGNIGIIAPIAIGFIVGANILVGGAFTGASMNPAVSFGPAVVSWSWSNHWVYWAGPLIGGGIAGLVYEVLFINSTHEQLPTTDY

SEQ ID NO: 92817 - protein, 165 aa, Zea mays
  misc_feature (104)..(104): Xaa can be any naturally occurring amino acid
MAWIFHRTVGRHSDVDGAGDDEQVLLLITARCLLGKEVRERMLDKVDEVREKITDLTSLLFLYTPTPVLRQCDSVRAALASIFAEVIRSRRRSSIRAGDDDVLXSLMEARYRDGRDTTEPEVMGLVVAIIFSGKHTSSATSTWTGAQLLRHAECIEAALDEQWRV

SEQ ID NO: 92818 - protein, 67 aa, Zea mays
MTTSRRLADRKISRFEKNITKRGSVPETAKKANDYPFGPILLGFFVFVVVGSSLFQIIKTASNAGLF

SEQ ID NO: 92819 - protein, 198 aa, Brassica napus
MATEDVNEALGAAEVPIESTTEKQPHKLERKWCFWFDNQSKPKQGAAWGASLRKASTFDTVEDFWGLHETIFIPSKLTPNADIHLFKAGVEPKWEDPECAHGGKWTFVVTNNRKQALDKAWLETLMALIGEQFDEADEICGVVASVRLKQDKLSLWTRTKSNEAVLMGIGKKWKALLDVTDKITFTNHDDSRRSRFTV

SEQ ID NO: 92820 - protein, 439 aa, Oceanobacillus iheyensis HTE831
MIDQYRDVIAKVDTYKRYGKVIRVVGLMIESEGPTANIGEVCNIKTSANTDHALLAEVVGFRNEKIILMPYTEVTEVGPGCLVEATGKPLTVKVGRGLVGKVLNSLGKPLNDTEELPKGLANFMTEQTPPNPLERPPIRTPLQVGVKAIDSLLTMGEGQRVGLFAGSGVGKSTLLGMIARNSSAEINVIALIGERGREVREFIENDLGPEGLKKSIVVVATSDQPALMRIKGAYTATAISEYFRDLGYKVNLMMDSVTRVAMAQREIGLAVGEPPTTKGYTPSVFSILPKLLERTGTNANGTITGFYTVLVDGDDMNEPIADAVRGILDGHFILDRKLAERGQFPAINVLKSISRVMNVIADEEHKEQSQTLRKLLSTYEENQELITIGAYKKGTNHEIDQAISFQPYILEFLKQGIHEKRTFDETIQMMKNLLHGGVS

SEQ ID NO: 92821 - protein, 263 aa, Pseudomonas putida GB-1
MSNCPPPMSQVIIKTPAQLDLMRRAGQLLAQVFADLDSFIRPGVTTMQINDRAEAFIVNTLKARPASKGQYGFPYSLNTSVDHVVCHGIPKVDEVLKEGSIINVDITLEQGGYIADSSKMYGIGAISDEARRLVDTTYDALWKGIEQVRPGATLGDIGHAVQAHAEAAGYSVVREYCGHGIGQQMHEGPEVLHIGQRGMGMKLKPGMVFTIEPMINQGKRGTREMKDGWTVITRDHSLSAQWEHTVAVTEQGFEVLTLREEER

SEQ ID NO: 92822 - protein, 282 aa, Oenococcus oeni PSU-1
MSEKIWFVTGTSSGFGQALVNELIAQKQKIVATARHLDQIVHWQKEYKNVYTTSLDVTNHDDVVRAVNEAIKHFGKIDILVNNAGWGYFGSVEESDESTVREMMDTNFWGAADVTRTVLPFFRKQRSGRIINITSVGGLVSSPAFGFYNASKFALEGLSSALAKEVAPLEIYVTNIEPGPYRTKWAGSSHKAAIETIDDYQKTAHANANNTESISGKQDGSPELAAKAIFKLANMTEPPFHFLTGINAYQRGTALYQETLTEFKNNEADSTHLNYGDEDYWK

SEQ ID NO: 92823 - protein, 324 aa, Pseudomonas putida GB-1
MRALAALSRFVGNTFALWVLVFAVLAFLQPQWFIALKVAIVPLLGLVMFGMGLTLKLDDFAALARQPWRVMLGVVAHFVIMPGMAWLLCQLFHLPPEIAVGVILVGCCPSGTASNVMVWLSRGDLALAVAIAAVTTLLAPLLTPALIWFLASAWLPVSFMDMFWSILQLVMLPIVLGVLAQRLLGARVQAAVQVLPLVSVVSIVMIVCAVVAASQAKIAESGLLIMAVVMLHNSFGYLLGYLTGKLCKLPLAQRKSLALEVGMQNSGLGAALAAAHFSPLAAVPSALFSVWHNISGALLSTWFRRMNEPAVETEAVEPARTGLP

SEQ ID NO: 92824 - protein, 331 aa, Bacillus anthracis str. Ames
MNLAKFPRKKYTESYTPIEKLNNFSEALGGPTIYFKRDDLLGLTAGGNKTRKLEFLVADAQAKGADTLITAGGIQSNHCRLTLAAAVKEKMKCILVLEEGLEPEEKPDFNGNYFLYHLLGAENVIVVPNGADLMEEMHKAAKEVSEKGNTPYVIPVGGSNPTGAMGYVACAQEIIAQSFDQGIDFSSVVCVSGSGGMHAGLITGFAGTQSNIPVIGINVSRGKAEQEEKVAKLVDETSAHVGIPNFIPREAVTCFDEYVGPGYALPTPEMVEAVQLLAKTEGILLDPVYTGKAVAGLIDLIRKGTFNKEDNILFVHSGGSPALYANTSLFA

SEQ ID NO: 92825 - protein, 483 aa, Bacillus cereus ATCC 14579
MFQTIKNDWFSNVKGDVLSGIVVALALIPEAIAFSVIAGVDPTVGLYAAFCIAVTISFVGGRTGMISAATGAMALLMVTLVKDHGLQYLFATTILTGIVQIIFGVFKLSSFMKFVPKSVMSGFLNSLGILVFTAQLPHFKNATWQMYALVVLGLAIIYLFPRITTAVPSTLISIIIVTSIALMSGLQLKTVGDMGSLPKELPFFSIPDVPFTLETLGIILPYAVMLAIIGLLESLLTASVLDDMTHTESNKHKEARGQGIANIVAGFFGGMAGCAMIGQSVINIKSGGRGRLSTFVAGGFLIVLLFVLGDYVVHIPMAALVAVMIMVSIGTFDWNSVATIHKVPKGNAFVMIVTVVVVLITHNLGLGVIIGTVISAVLFAFNMAKIHVKHLYIENKKIYEIHGQLFFASTADFINAFSLDEGIKEIEMNFTHAHVWDDSAVASIDKVIMKYEQSGVKVSITGLNERSSKLVANLATYNKRIAS

SEQ ID NO: 92826 - protein, 569 aa, Oryza sativa Indica Group
MDFFSEYGDANRYKIQEVIGKGSYGVVCSAIDQHTGDKVAIKKIHNIFEHLSDAARILREIKLLRLLRHPDIVEIKHIMLPPSRRDFKDIYVVFELMDTDLHQVIKANDDLTKEHHQFFLYQMLRALKYIHTANVYHRDLKPKNILANANCKLKICDFGLARVAFNDTPTTVFWTDYVATRWYRAPELCGSFFTKYSPAIDIWSIGCIFAEILTGKPLFPGKNVVHQLDLMTDLLGTPSMDTVTRIRNEKARRYLSSMRKKQPVPFSERFPKADPAALKLLQRLLAFDPKDRPTAEEALADPYFKGLAKAEREPSCQPITKMEFEFERRKVTKEDVKELIFREILEYHPQLLKDYMNGTEKTNFLYPSALDNFRRQFANLEENGGKNGDAVPSDRKHVSLPRTTTVHSAPIPPKDHQNITSQVPQRIPGRTGRGACPVIPFENLSAMGPYNQRRVVRNPVLPPATTNLSAHAYHRKSDSSERELQQELEKDRMRYQPSEHFMDAKVVSHMSHDLRASSYYVSKAKSDVADRAALQSNMMQGIGPFNGIAAVGGNYNKVSTVQYGVSRMY

SEQ ID NO: 92827 - protein, 336 aa, Salmonella enterica subsp. enterica serovar Typhi str. CT18
MKAAVVTQDHQVDVTEKTLRPLRHGEALLKMECCGVCHTDLHVKNGDFGDKTGVILGHEGIGVVAEVGPGVTSLKPGDRASVAWFYEGCGHCEYCNTGNETLCRNVKNAGYTVDGGMAEECIVVADYAVKVPEGLDSAAASSITCAGVTTYKAVKISHIKPGQWIAIYGLGGLGNLALQYAKNVFNAKVIAIDVNDGQLKLAEEMGADLTINSRTEDAAKIVQEKTGGAHAAVVTAVAKAAFNSAVDAVRAGGRVVAVGLPPEAMNLDIPRLVLDGIQVVGSLVGTRQDLTEAFQFAAEGKVVPKVALRPLEDINVIFKEMEQGQIRGRMVIDFRR

SEQ ID NO: 92828 - protein, 577 aa, Salmonella enterica subsp. enterica serovar Typhi str. CT18
MPGTVIRKRVSNMETTTKKARSLYIPYAGPVLLEFPLLNKGSAFSVEERRNFNLSGLLPEVVESIEEQAERAWLQYQGFKTEIDKHIYLRNIQDTNETLFYRLVQNHLEEMMPVIYTPTVGAACERFSEIYRRARGVFISYPNRHNMDDILQNVPNHNIKVIVVTDGERILGLGDQGIGGMGIPIGKLSLYTACGGISPAYTLPVVLDVGTNNQQLLNDPLYMGWRHPRITDDEYYAFVDEFIQAVKQRWPDILLQFEDFAQKNAMPLLTRYRDEICSFNDDIQGTAAVTVGTLIAASRAAGSQLSEQKIVFLGAGSAGCGIAEQIIAQTQREGLSEDAARQNVFMVDRFGLLTDRMPNLLPFQAKLVQKCDNLQHWDTENDVLSLLDVVRNVKPDILIGVSGQTGLFTEEIIREMHKHCPRPIVMPLSNPTSRVEATPQDIIAWTEGNALVATGSPFSPVIWKDKVYPIAQCNNAYIFPGIGLGVIASGASRITDEMLMSASETLAKHSPLVNNGEGLVLPALKDIQVVSRAIAFAVGKMAQQQGVAVKTSAEALQQAIDDNFWKPEYRDYRRTSI

SEQ ID NO: 92829 - protein, 336 aa, Ostreococcus tauri
MVATRWSARSGDYDARIDRWGRASIIAVRSSAENGGEIVRDHAVDACLREPIDDDKLVHVAKIPAYYAGFGKTGHPVYLEHTAAVPWGDILANMKDDEFLKSQVQTLEWQAKVVYPEASYRAGEPITQVINVWDLKGLTMSGFTSDVRALVKKGSALAQDNYPEGLYAAYIVNAPRIFSFIWAIVKQFLDAKTVSKVHIYGSGTKMWEKLMDKLGDSTTLTKDMVCCDKKDIGKAEAKKGLIPAHGATQIWIKNQIAGVESSLGAAPGVLRRESSVRDMYDVFFDAQEELPSPVGKDLERFTTMRTEFEVDGLSANQPDANDTVEAVEPTKKCCAC

SEQ ID NO: 92830 - protein, 215 aa, Triticum aestivum
SRLVISLVRAGAKPDSARCSPLVSRRRTPGDPSSKPPSSSPPARLRLLHHSTQLSSKAADGRMMGSNNPGGAGGGGGMAPGTGAGGSDGRHDDEAVLTEFLSSLMDYNPTIPDELVEHYLGRSGFHCPDLRLTRLVAVAAQKFISDIASDSLQHCKARVAAPIKDNKSKQPKDRRLVLTMDDLSKALREHGVNLKHPEYFADSPSAGMAPSTREE

SEQ ID NO: 92831 - protein, 631 aa, Robiginitalea biformata HTCC2501
MPEYTGRRPIRMEPFIVSARKYRPQQFEDVVGQQAITRTLLNAIENDHLAQALLFCGPRGVGKTTCARILAKKINEDGNQRDGEDFAFNIFELDAASNNSVDDIRNLIDQVRIPPQVGKYKVYIIDEVHMLSQAAFNAFLKTLEEPPRHAIFILATTEKHKIIPTILSRCQIFDFRRITVGDAASYLKYIAEQQGIEADEEALHMIAQKADGAMRDALSIFDRVVSFAGNKLTRKAVAENLNVLDVDVYFESTDHILKGDIPALLIYFNEILAQGFEGHHYINGLASHFRDLMVCTSQETVALLETSESVRQRYLEQASHCSGEFLLAALDLANQCDLDYKTSKNHRLLVELCLMKLASLTQRQKKKARNGEDAWLIPAAAFHNQTPPPETVSEPESTSKPAAGAQEGAESSPETVGSAHQTTESIPESKDMPESKDIREPEGAEQSQSPDNQKETSAPAGPKETPAPTLPVGKKKSGQKVSGLSLSSIRAKKAHKASRHHAAPNPEDLPRDPFEESELQALWKEFAEQTEKRGRKILAASLGTDLPKLIGDHVIWIELPNSTMKKEVERDQFELMDFLRTQLNNHHIQLKITVNEETAKQFAFTPEEKYQKLREKNPAIDLLRKTFDLEL

SEQ ID NO: 92832 - protein, 340 aa, Erythrobacter sp. SD-21
MDALRHGWPLAIEGAPLLQPVETAFSDVSGEAMLLSATRAATLKLANQREAAVPRTPVLMRGADAFDLPAALAVADPALDLQSPLKGPFKALALEWEAQARAALELARIAGILPAFLVDPQGAGEAAHLAASDVDAFTDPQRLRIATRAKLPVAAAEDARIVAFRSPDDTREHVALVIGEQRAELAPLVRLHSECLTGDILGSLKCDCGPQLDAALRAMAEEAGRGGWGVLLYMRQEGRGIGLVNKLRAYRLQDQGFDTVDANTRLGLPDEARDFPTAARMLDLLVVKDIRLMTNNPAKVEALVAEGVHVSERVSHSLPDNPHNARYLATKRDRAGHILP

SEQ ID NO: 92833 - protein, 307 aa, Arabidopsis thaliana
  misc_feature (99)..(99): Xaa can be any naturally occurring amino acid
  misc_feature (206)..(206): Xaa can be any naturally occurring amino acid
MRGMVSFAVWALFAALLSQQLFASVASVRFEDAKTYYLSPPSGSHGTPPSHTPPSSNCGSPPYDPSPSTPSHPSPPSHTPTPSTPSHTPTPHTPSHTPXPHTPPCNCGSPPSHPSTPSHPSTPSHPTPSHPPSGGYYSSPPPRTPVVVTPPSPIVDPGTPIIGGSPPTPIIDPGTPGTPFIPAPFPPITGTCDYWRNHPTLIWGLXLGWWGTVGGAFGTVSIPSSIPGFDPHMNLLQALSNTRSDPIGALYREGTASWLNSMVNHKFPFTTPQVRDHFVAGLSSNKAATKQAHTFKLANEGRLKPRV

SEQ ID NO: 92834 - protein, 605 aa, Synechococcus sp. CC9311
MALLVQKFGGTSVGSVERLQTVARRIADCKEDGNDLVIVVSAMGHTTDELTAKAKAISSDPPQREMDMLLSTGEQVSIALLSMALHELGVPAVSMTGAQVGIVTESAHGRARILDVRTDRLRARLAEGQVVVVAGFQGTSLSSGGTAEITTLGRGGSDTSAVALAAALGADACEIFTDVPGVLTTDPRKVANAQLMPQVSCDEMLELASLGAAVLHPRAVEIARNYGVKMVVRSSWSDAPGTTLTSRNAKPIGREGLELGRPVDGVELLEDQAVLALSHVPDQPGVAARLFESLSAGGVNVDLIIQATHEGSSNDITFTVAETDLEQARSICTTLVDSLGGILSSDGGMSKLSIRGAGIMGRPGIAAGLFDTLSREGINLRLIATSEVKVSCVVEASMGSKALQAAQQAFELSTQQQHINPPASGEGEPEVRGVALDRDQAQLSVRHVPDRPGMAGSLCSALADAGISLDAIVQSERQHGDGSRDISFIVKREDRAASDQALAPLLAQWPGAVLEDGPAIARVSAIGAGMPATAGTAGRMFRFLAEADVNIELIATSEIRTSCVVAESDGIKALEAVHAGFQLGGSESHQAQGTESPLELEAFKP

SEQ ID NO: 92835 - protein, 286 aa, Bacillus subtilis
MRNICVIGSCSMDLVVTSDKRPKAGETVLGTSFQTVPGGKGANQAVAAARLGAQVFMVGKVGDDHYGTAILNNLKANGVRTDYMEPVTHTESGTAHIVLAEGDNSIVVVKGANDDITPAYALNALEQIEKVDMVLIQQEIPEETVDEVCKYCHSHDIPIILNPAPARPLKQETIDHATYLTPNEHEASILFPELTISEALALYPAKLFITEGKQGVRYSAGSKEVLIPSFPVEPVDTTGAGDTFNAAFAVALAEGKDIEAALRFANRAASLSVCSFGAQGGMPDKK

SEQ ID NO: 92836 - protein, 447 aa, Marinobacter sp. ELB17
MNITIFGTGYVGLVTGACLADVGHNVLCMDVDQAKIAKLENGQIPIFEPGLENIVRHTVEAGRLSFTTDAEKAVKHSSLQFIAVGTPPDEDGSADLQYVTAVARSIGQYMDDYTVVVDKSTVPVGTADKVKAAVRAQLDNRGLELEFDVVSNPEFLKEGAAINDFMKPDRIIIGCDSDRAADMLREVYYPFNRNHDRMVYMDIRSAELTKYAANALLATKISFMNEIANLAERLGADIEAVRRGIGSDPRIGYHFIYPGCGYGGSCFPKDVQALARTADGIGYEAKLLNAVESVNYAQKHVLFDKISHYFRGDLKGKVVGLWGLAFKPNTDDMREASARTLMEDLWKAGATVQAFDPEAMEETQRIYGDEARLTLCGTKEQAIKGADVLAICTEWKEFRSPDFKAIAENIKHPVVFDGRNLYEPEMLERHGLMYYAIGRGRNQFHSE

SEQ ID NO: 92837 - protein, 185 aa, Haemophilus influenzae R2866
MKFNIPIFLTIFRVILIPFFVIAFYLPIESSPFITTLIFFIAGVTDWLDGYLARKWKQTTRFGAFLDPVADKVMVVAALVLIVEHQHTFWITIPAIIMISREIIISALREWMAELGERSKVAVSWWGKWKTTAQMLALGGLLWRYNNYMEIAAIILLYIAAILTIWSMIQYLQVAKGSLLDNIQL

SEQ ID NO: 92838 - protein, 446 aa, Shewanella sp. MR-4
MSEAKLLLVEDDASLREALLDTLMLAQYDCIDVASGEEAIIALKQHQFDLVISDVQMQGIGGLGLLNYLQQHHPKLPVLLMTAYATIGSAVSAIKLGAVDYLAKPFAPEVLLNQVSRYLPLKQSSDQPVVADEKSLALLSLAQRVAASDASVMILGPSGSGKEVLARYIHQHSSRANQAFVAINCAAIPENMLEATLFGYEKGAFTGAYQACPGKFEQAQGGTLLLDEISEMDLGLQAKLLRVLQEREVERLGGRKTIKLDVRVLATSNRDLKAVVAAGQFREDLYYRINVFPLTWPALNQRPADILPLARHLLAKHAKALNVLDLPEFDEAACRRLLSHRWPGNVRELDNVVQRALILRAGAVITANDIIIDAQDVPLLSDDAEYVNEPEGLGEELKAQEHVIILETLAQCQGSRKLVAEKLGISARTLRYKMARMRDMGIQLPN

SEQ ID NO: 92839 - protein, 202 aa, Haemophilus influenzae R2866
MTMVLVTRQAPDFTSSAVLSNGEIVDNFNFKKHIAGKAAVIFFYPLDFTFVCPSELIAFDHRYEEFKKRGVEVVGVSIDSQFTHNAWRNTPTENGGIGQVKYALAADVKHEIAQAYGIEHPEAGVALRASFLIDKNGVVRHQVVNDLPLGRNIDEMLRMVDALQFHEDHGEVCPAQWEKGKEGMKDNPEGVAKYLKQNADKL

SEQ ID NO: 92840 - protein, 176 aa, Saccharomyces cerevisiae
MSDLVNKKFPAGDYKFQYIAISQSDADSESCKMPQTVEWSKLISENKKVIITGAPAAFSPTCTVSHIPGYINYLDELVKEKEVDQVIVVTVDNPFANQAWAKSLGVKDTTHIKFASDPGCAFTKSIGFELAVGDGVYWSGRWAMVVENGIVTYAAKETNPGTDVTVSSVESVLAHL

SEQ ID NO: 92841 - protein, 329 aa, Marinobacter sp. ELB17
MKVLVTGGAGYIGSHVVRQLAAAGHDIVVFDNLSTGYRWAVTAGELVVGDLADAEAIDAVFSQHQFEAVLHFAANIVVPESVSNPLKYYANNTRNTLNLLQAVDRHQIPYMVFSSTAAVYGTPEQTVLTEDLPLVPINPYGASKMMSERMIMDLAAASSLNYVILRYFNVAGANPDGLLGQATPEATHLIKVACECATGQREDMSVFGTDYDTRDGTCVRDYIHVEDLAKAHVMALDYMARGGQSQVMNCGYGRGFTVDEVISVVKRLSGVDFPVQRGGRRAGDPAALMADNQLIKHTLGWQPDHDNLDTIVGTALAWEGIWQTRKREQ

SEQ ID NO: 92842 - protein, 462 aa, Arabidopsis thaliana
MASLMLSLGSTSLLPREINKDKLKLGTSASNPFLKAKSFSRVTMTVAVKPSRFEGITMAPPDPILGVSEAFKADTNGMKLNLGVGAYRTEELQPYVLNVVKKAENLMLERGDNKEYLPIEGLAAFNKATAELLFGAGHPVIKEQRVATIQGLSGTGSLRLAAALIERYFPGAKVVISSPTWGNHKNIFNDAKVPWSEYRYYDPKTIGLDFEGMIADIKEAPEGSFILLHGCAHNPTGIDPTPEQWVKIADVIQEKNHIPFFDVAYQGFASGSLDEDAASVRLFAERGMEFFVAQSYSKNLGLYAERIGAINVVCSSADAATRVKSQLKRIARPMYSNPPVHGARIVANVVGDVTMFSEWKAEMEMMAGRIKTVRQELYDSLVSKDKSGKDWSFILKQIGMFSFTGLNKAQSDNMTDKWHVYMTKDGRISLAGLSLAKCEYLADAIIDSYHNALLYWETPIEL

SEQ ID NO: 92843 - protein, 712 aa, Mannheimia succiniciproducens MBEL55E
MSRTIILIPISAGVGLTSVSLGLIRALEQKGTKIGFMKPISQPRSGEDMLDRTTSIVRTSTTIETTEPVMLSEAENLIGQNQTDVLLEKIVAQHQQISKDNDIVIVEGLIPSRKNSYANSVNYDIAQALDAEIILVSAPATETPAQLKERVEAAAASFGGKSNPNLLGVVINKFNAPVDESGRTRPDLTEIFDSFQHSHNNIKEIYKLFENSPIKVLACIPWSADLIATRAIDLVKHLGASILNEGDMNRRIRSITFCARTLPNMIEHFKAGSLLVVSADRPEILTAAALAATTGIELGGILLTGGYKIDCEIKKLCNPTFENTKLPVFRIEGNTWQTALSLQSFNLEVPVDDKERIENIKQYTSGQFDADFIHSLASASVRARRLSPPAFRYQLTELARAAKKRIVLPEGDEPRTIKAAVLCAERGIAECVLLAKPEDVKRVADSQGVKLGNGITVIDPASVRENYVARLVELRKAKGMTEMAAREQLEDTVVLGTMMLEAGEVDGLVSGAVHTTANTIRPPMQIIKTAPGSSIISSIFFMLLPDQVLVYGDCAVNPDPTAEQLAEIAIQSAESAKSFGIDPRVAMISYSTGTSGSGADVEKVKEATRIAQEKRPDLLIDGPLQYDAAVMEDVARSKAPNSKVAGKATVFVFPDLNTGNTTYKAVQRSADLVSIGPMLQGMRKPVNDLSRGALVDDIVYTIALTAIQATQC

SEQ ID NO: 92844 - protein, 445 aa, Shewanella sp. MR-4
MLNRRHQLLNKLNHCIDKVPPFRAIASGQLVRVVGLTLEASGCRAPVGSLCSIETMAGELIAEVVGFDDELLYLMPIEELRGVLPGARVVPLGEQAGLSVGLSLLGRVLDGNGVPLDGLGALSTEQQAPRHSNAINPLSRRAITEPLDVGVRAINAMLTVGKGQRMGLFAGSGVGKSVLLGMMTRGTTADIIVVGLVGERGREVKEFIEEILGEKGRARSVVVAAPADTSPLMRLRACETSTRIAEYFRDLGYNVLLLMDSLTRYAQAQREIALAVGEPPATKGYPPSVFAKLPRLVERAGNGGPGQGSITAFYTVLTEGDDQQDPIADASRAILDGHIVLSRSLADSGHYPAIDIEASISRVAPMVISNEHLEAMRRVKQTYSLYQQNKDLISIGAYAQGSDPRIDNAIRLQPAMNAFLRQTMRDAFSFADSQVMLGQLAAQCK

SEQ ID NO: 92845 - protein, 464 aa, Mycobacterium sp. MCS
MRIAQHVSELIGNTPLVQLNSVVPEGAGTVAAKIEYLNPGGSSKDRIAVKMIDAAEASGELKPGGTLVEPTSGNTGVGLALVAQQRGYKCIFVCPDKVSEDKRNVLRAYGADVVVCPTAVAPDDPDSYYSVSNRLVTEIEGAWKPDQYSNPMGPESHYETTGPEIWRDTDGKVTHFVAGVGTGGTITGAGRYLKEVSGGKVRVIGADPEGSVYSGGTGRPYLVEGVGEDFWPSAYDPAVPDEIIAVSDADSFDMTRRLAREEGLLVGGSCGMAVVAAIEVAQKAGPDALVVVLLPDGGRGYLSKIFNDSWMSSYGFLRNRLDGSIEQPTVGDVLRGKSGELPDLVHTHPSETVRDAIGILREYGVSQMPVVGAEPPVMAGEVAGSVSERELLSAVFEGRAKLADAVAEHMSPPMPLIGAGELVSTAAKTLRECDALMVVEEGKPVGVVTRHDLLGFLSDGSTRR

SEQ ID NO: 92846 - protein, 316 aa, Bacillus halodurans C-125
MANYGDPNLKVFTLNSNKGLAYEITERIGVPMGKSSVTRFSDGEVQINIEESIRGCDVFLIQSTAAPANEHIMELLIMIDAVKRASAKTINVVIPYYGYARQDRKARAREPITAKLVANLLETAGATRVLTLDLHATQIQGFFDIPVDQLMGVPILAEFFEKKGLDDVVVVSPDHGGVVRARKLADRLKAPIAIIDKRRPKPNVAEVMNIVGHIEGKTAIIIDDIIDTAGTITLAANALVEHGAKEVYACCTHPVLSGPAIERIKNSKIKELVVMNTIELEEEKLIDKITTLSVAPLMAEAIVRVHEHSSVSLLFD

SEQ ID NO: 92847 - protein, 119 aa, Streptococcus pyogenes M49 591
MDKIVLEGCRFYGYHGAFKEEQTLGQIFLVDLELSVDLQAASLSDQLTDTVHYGMVFDSVRQLVEGGKFILIERLAGAICEQLFNEFPPIEAIKVAIKKENPPIAGHYKAVGIELERQR

SEQ ID NO: 92848 - protein, 302 aa, Cryptococcus neoformans var. neoformans JEC21
MPSPAVDLLKQKTASLPNAPISVVAANTFVPPTQPVTAGNQLPTSVPLPVLPAVEAAKRLAAYAAVDRHIAHEHKVIGIGSGSTVPYVVDRILAQGFEANKDRVFLPTGFQSKELIVKAGLTLGDVDQYARIDVTIDGADEVDNELNSIKGGGACQLREKVLAEAADTWIIVADYRKNSEVLGTSWTKGIPIEVVPFAYAKVLTNLAHMGSPHVLPNGQPGLSLRMGKMKAGPVVSDNGNFIIDAPFAEELMRQPEELLHKIKMLTGVVEVGLFCGMAKAAYFGNEDGSVTIRSDDGTISQL

SEQ ID NO: 92849 - protein, 316 aa, Durio zibethinus
MATFPVIYMDKLNGEERAATMEKIKDASENWGFFELLNHGIPHDFLDTVERLTKEHYKKCMEQRFKELVASKALEGPQAEVTDMDWESTFFLRHLPESNMAEIPDLTDEYRKVMKEFVLKLEKLAEELLDLLCENLGLEKGYLKKAFYGARGPTFGSKVSNYPPCPTPDKIKGLRAHTDAGGIILLLQDPKVSGLQLLKDGEWIDVPPMRHSIVINLGDQLEVITNGKYKSVEHRVLAQTDGARMSIASFYNPGRDALIYPAPALVEKEAEEKKQLYPKFVFEDYMKLYAGLKFQAKEPRFEAMKARETTFPIATA

SEQ ID NO: 92850 - protein, 162 aa, Solanum commersonii
MAAEVEYSCFVGGLAWATTDRTLSDAFSTYGEVVDSKIINDRETGRSRGFGFVTFKDEKSMKEAISGMNGSELDGRNITVNEAQARGSGGGGGGGGGFGGGRRREGGGGGYGGGGGYRGGGGGGYGGGRREGGGGGGYGGGRREGGGGGGYGGGGYGGGDRY

SEQ ID NO: 92851 - protein, 298 aa, Bacillus cereus ATCC 14579
MPNIAVVGSISMDLVAVSKKRPKAGETVIGEAFHTIPGGKGANQAVAAARLGANVAMVGAVGNDDYGTVVRKNLENERIFIDYVVPVTDRTTGIAHIVLAEEDNSIVVVQGANALVNKSVVDRSKDLLVKADMVVLQLEIPLETVKYVLAICEEHNIPVMLNPAPAQVLSEEILEKATYITPNEHECRIVLDDFTSPIEDLLAKYPNKLLMTEGSNGVRFHNGTEIVHVPSIAVDVVDTTGAGDTFNGALAVALSEGETLQKAIRFANIAGGLSVTKLGAQGGMPTRDRVREVQVIVG

SEQ ID NO: 92852 - protein, 335 aa, Shewanella oneidensis MR-1
MLKNNINDSKNLDRTFSIAPMLDWTDRHYRYFARLMSANALLYTEMVTTGAILHGRGDYLTYNQEEHPLALQLGGSNPVELARCAKLAAERGYDEVNLNVGCPSDRVQNGRFGACLMAEPELVAECVDAMKQVVDIPVTVKTRIGIDEQDSYEFLTHFIDTVMAKGCGEFIIHARKAWLQGLSPKENREIPPLDYDRVYQLKRDYPALNISINGGITSLEQAQTHLQHLDGVMVGREAYQNPYMLAQVDQVLCGSTKAVMSREAVIEAMLPYIEAHLQVGGRLNHITRHMIGLFQGLPGARAWRRYLSENAHKNGAGIEVVKLAYQSVQTDLVAQ

SEQ ID NO: 92853 - protein, 490 aa, Durio zibethinus
MEFTRKNKQLLSRKATNDGHGENSPYFDGWKAYDSDPYHRSQNPNGVIQMGLAENQLCFDLIKKWILENPDASICTAEGVDKFKDIAIYQDYHGLKEFIEALAKFMGRVGGNRVTFDPNRIVMSGGATGANETVMFCLADPGDAFLVPSPYYPAFARDLRWRTGLEIVPVDCKSSNNFRITRAALEEAYEKAQRSNINVKGVIIANPSNPLGTILDRETMRSIVSFINEQNIHLVFDEIYAATVFSSPRFISIAEIIQDMDCNRDLIHIVYSLSKDMGFPGFRVGIVYSFNDVVVNCARKMSSFGLVSSSQTQYLLASMLSDEDFVGNFLRESSKRLAKRHHVFTKGLEQVGISCLKSNAGLFFWMDMRPLLKEQTVKGEMELWRVIIDEVKLNVSPGSSFQCSEPGWFRVCFANMDGETVEVALDRIRKFVLQGKEEDHAAPETSKRWQKKNLRLSFSSSRLYDESTMSPPMISPHSRIPHSPLVPAMT

SEQ ID NO: 92854 - protein, 335 aa, Thermotoga sp. RQ2
MKALILAGGSGERFWPLSTPETPKQFLKLFGNKSLIRWTFERVLEEMDPKDVIVVTHKDYVERTKKELPELPDENIIAEPMKKNTAPACFIGTKLADDDEPVLVLPADHRIPDTKKFWKTVKKALDALEKYDGLFTFGIVPTRPETGYGYIEIGEELEEGVHKVAQFREKPDLEMAKKFVESGRFLWNSGMFLWKAREFIEEVKVCEPSIYENLKDVDPRNFEELKKAYEKVPSISVDYAVMEKSKKVRVVKADFEWSDVGNWSSVREIEGYTEESDEVILVDSDRVFVKTHNKPIAVVGLSDVIVIDTPNGILICKEEYAQKVREVVKKLFRTS

SEQ ID NO: 92855 - protein, 526 aa, Pseudomonas putida GB-1
MTSARTRPSTRTRQPVNACSRRKPRARRTCVPSPGSGARSRPVSEHCPTIPAKELPMATPSKAFVIAHDPLVEADKAHYMHGYHVFDEHRAQGALNIVAGEGAYIRDAHGNRFLDAVGGMWCTNIGLGREEMALAIADQVRQLAYSNPFSDMANDVAIELCQKLAQLAPGDLNHVFLTTGGSTAVDTAYRLIQYYQNCRGKPHKKHIIARYNAYHGSTTLTMSIGNKAADRVPEFDYHHDLIHHVSNPNPYRAPDDMDEAEFLDYLVAEFEDKILSLGADNVAAFFAEPIMGSGGVIIPPEGYFLRMWQLCQTYDILFVADEVVTSFGRLGTFFASEELFGVTPDIITTAKGLTSAYLPLGACIFSERIWEVIAEPGKGRCFTHGFTYSGHPVCCTAALKNIEIIEREQLLDHVKDVGSYLEQRLQSLRELPLVGDVRCMKLMACVEFVADKASKALFPDEVNIGERIHSKAQAKGLLVRPIMHLNVMSPPLIITHAQVDEIVETLRQCIIETARELTALGLYQGR

SEQ ID NO: 92856 - protein, 301 aa, Vibrio cholerae O1 biovar eltor str. N16961
MKRAASQPCCWLCVFFRRESHAFGVTMSTPQDLSHLLPDVINIARAAGQLILDIYQNKSYEAFTKSDSTPVTSADLAAHKFLCEQLRELTPDIPILSEEEANIDLATRETWQRYWLVDPLDGTQEFIARSGDFATIIALVENNHPVMGVVYGPVSGVTYYAYAGKGAWKIPDMAQSLKIQTHKHELPSSSIAIAISRRQDINKITRRLSSAWNYDLVPLGSAALKACLVAEGAVDCYLRLGPTGEWDTAATQCIVEEAGGRILSTQLSPLSYNERETLENPNFIVLGDADLPWNEILKIKD

SEQ ID NO: 92857 - protein, 508 aa, Synechococcus sp. CC9311
MDHYLPRILRARVYDVARETPLELANNLSRRLNNSVLLKREDLQPVFSFKLRGAYNRMAQLSEAELKLGVIASSAGNHAQGVALSASHLGCRAVIVMPVTTPGVKVDAVRQLGAEVVLHGETYDEAYAEARSRSEAEQLCFIHPFDDPEVIAGQGTVGMEILRQCHQPPDAIYVAVGGGGLIGGIAVYVKSLWPDVQIIGVEPHDAAAMTLSLEAGERIRLPQVGLFADGVAVREVGEHTFELAQKYVDDIVTVSTDEICAAIKDVFEDTRSILEPAGALAIAGLKADVSRRSLQNQNLVAVACGANINFARLRFVAERAELGEEREAMLAVEIPERPGSLRSLCELLADRSLTEFSYRMGAGDQAHIFMGVQVSGPDDRATLIGHLKTHGYACLDLSDDELSKVHLRHMVGGRLPESSIASNVQELLYRFEFPERPGALMRFVTALHRDWSISIFHYRNHGADVGRIVVGVLVSTDDLKEWQSFLRELGYSSWEETSNPAYQLFLGG

SEQ ID NO: 92858 - protein, 310 aa, Populus tremula x Populus tremuloides
MAIPVIDFSKVNGTGEERAKTMAQIANGCEEWGFFQLMNHGIPEELLEKVKKVCSEYFKLEREEIFNNSTVANTLNALAEKNSGEKLENVDWEDVITLLDDNEWPSKTSGFKETMTEYRAELKKLAEKVMEVMDENLSLPKGYIKKAFNDGEGHSAFFGTKVSHYPPCPHPELVNGLRAHTDAGGVILLFQDDVVGGLQILKDGQWIDVQPMKNTIVINTGDQIEVLSNGRYKSTWHRVLASPDGNRRSIASFYNPSLKATIAPAPGLVEKDGEEIDQTYPKFLFGDYMSIYAKQKFLPKEPRFQAVRAL

SEQ ID NO: 92859 - protein, 282 aa, Arabidopsis thaliana
ERGGESGAERGGDRGDFGRGFGGGRGGGRGRDRGPRGRGRRGGRASEETKWVPVTKLGRLVADNKITKLEQIYLHSLPVKEYQIIDHLVGPTLKDEVMKIMPVQKQTRAGQRTRFKAFVVVGDGNGHVGLGVKCSKEVATAIRGAIILAKLSVVPVRRGYWGNKIGKPHTVPCKVTGKCGSVTVRMVPAPRGSGIVAARVPKKVLQFAGIDDVFTSSRGSTKTLGNFVKATFDCLQKTYGFLTPEFWKETRFSRSPYQEHTDFLSTKAVSATKVITEGEDQA

SEQ ID NO: 92860 - protein, 462 aa, Streptomyces avermitilis MA-4680
MTEASVREFKMPDVGEGLTEAEILKWYVQPGDTVTDGQVVCEVETAKAAVELPIPYDGVVRELRFPEGTTVDVGQVIIAVDVAGDAPVAEIPVPAQEAPVQEEPKPEGRKPVLVGYGVAESSTKRRPRKSAPASEPAAEGTYFAATVLQGIQGELNGHGAVKQRPLAKPPVRKLAKDLGVDLATITPSGPDGVITREDVHAAVAPPPPAPQPVQTPAAPAPAPVAAYDTARETRVPVKGVRKATAAAMVGSAFTAPHVTEFVTVDVTRTMKLVEELKQDKEFTGLRVNPLLLIAKALLVAIKRNPDINASWDEANQEIVLKHYVNLGIAAATPRGLIVPNIKDAHAKTLPQLAESLGELVSTAREGKTSPTAMQGGTVTITNVGVFGVDTGTPILNPGESAILAVGAIKLQPWVHKGKVKPRQVTTLALSFDHRLVDGELGSKVLADVAAILEQPKRLITWA

SEQ ID NO: 92861 - protein, 256 aa, Haemophilus influenzae R2866
MARIDNYEQRFGGIGRLYTPDGLARLRQAHICVIGIGGVGSWVVEALARSGICELTLIDMDDICVTNINRQLPAMSGTIGKLKTEVMSERVKLINPECTVNIIDDFISPENQSDYLNRGYDYVIDAIDNVKTKASLIAYCKRNKINVITIGGAGGQTDPTQIQIADLSKTIQDPLLAKVRSVLRKDYNFSQNPKRKFSIDAVFSTQPLIFPQMTEGCSTSATMNCANGFGAATMITATFGFFAVSRVIDKLLKKKS

SEQ ID NO: 92862 - protein, 435 aa, Saccharomyces cerevisiae
MTTNEEFIRTQIFGTVFEITNRYNDLNPVGMGAFGLVCSATDTLTSQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFAEMIEGKPLFPGKDHVHQFSIITDLLGSPPKDVINTICSENTLKFVTSLPHRDPIPFSERFKTVEPDAVDLLEKMLVFDPKKRITAADALAHPYSAPYHDPTDEPVADAKFDWHFNDADLPVDTWRVMMYSEILDFHKIGGSDGQIDISATFDDQVAAATAAAAQAQAQAQAQVQLNMAAHSHNGAGTTGNDHSDIAGGNKVSDHVAANDTITDYGNQAIQYANEFQQ

SEQ ID NO: 92863 - protein, 343 aa, Marinobacter sp. ELB17
MKALAFHGPGKRSWEDKPQPAIEKPTDAVVRITHTTICGTDLHILKGDVPAVEVGRILGHEGLGVVTEIGDGVSNIQIGDEVLISCVTSCGRCDYCKRGVYSHCRDGGWILGHLIDGTQAEYVRIPHADNSLYVLPEDMDRAAAVMLSDILPTGHEIGALNGEVKLGDTVAIVGAGPIGLAALMTSRFYSPARIIMIDPDENRLAMAKLLGATDTIARDPIEAIHKMTDGEGVDVAMEAVGVPETFDICQSIVRAGGHIANIGVHGKSVEFKLQDLWIKNITLRTGLVNTNTIPVLMRVVESGGVKPEELVTHRFKLDDIEKAYDIFSEAAKEQAIKMLLTVE

SEQ ID NO: 92864 - protein, 370 aa, Triticum aestivum
LHRTSLYKKACWYRSGIPGISSTHASEFQLSKLFDDGPAISGNGSPNGSSASTVNTSSSKNEKTEKSEAAPKEKPSKKNRRKDKEVTESVSVKPKREKRLSVLPLEASIVCTLLLIALGGFYVVHCVWAAAEAYSAPSIVLTSRSREGLHVFDDFREAYAWLSHNTDVDDKVASWWDYGYQTTAMANRTVIVDNNTWNNTHIATVGTAMSSPEKAAWEIFDSLDVKYVLVVFGGLVGYPSDDINKFLWMVRIGGGEFPHIKEPDYLRDGQYRVDAQATPTMLNCLMYKLCYYRFVETDGKGFDRVRGYEIGKKHFKLTHFEEVFTTHHWMVRIYKLKPQKNRIRGKLKKSKSSSKTSSTLAAGRKKNPWQ

SEQ ID NO: 92865 - protein, 358 aa, Oryza sativa
MSAYCGKYKDELIKNAAYIGTPGKGILAADESTGTIGKRFASINVENVEENRRSLRELLFTTPGALQHLSGVILFEETLYQKTKDGKPFVDVLKEGGVLPGIKVDKGTVEVAGTNKETTTQGHDDLGKRCAKYYEAGARFAKWRAVLKIGPNEPSQLSIDLNAQGLARYAIICQENGLVPIVEPEILVDGSHDIERCAYVTEKVLAACYKALNEHHVLLEGSLLKPNMVTPGSESKKVSPQLIAEYTVRALQRTVPAAVPAIVFLSGGQSEEEATVNLNAMNKLSTKKPWALSFSFGRALQQSTLKAWGGKTENVVKAQKAFITRCKANSEATLGTYQGDAVLGEGASESLHVKDYKY

SEQ ID NO: 92866 - protein, 233 aa, Oenococcus oeni PSU-1
MTELDAQKIIDFIANSKKQTAVKVTYKGHLNGRIPTSIQNFSNSDFGILYGDWSDIKPLLSGLNKKDYLIENNARNSAVPLLNIKDINARIEPGAIIRDQVKIADNAVIMMGAVINIGAEIGEATMIDMGAVLGGRAIVGKHSHIGAGAVLAGVVEPASAQPVRVGDNVLIGANAVIIEGVQIGDGAVVGAGAVVINDVPAHTVVAGVPAKVIKQIDEKTENKTALIDALRSL

SEQ ID NO: 92867 - protein, 200 aa, Pseudomonas fluorescens PfO-1
MSVLVGKQAPDFTVPAVLGNGEIVDSFTLSSAIKGKYGLVFFYPLDFTFVCPSELIALDNRMADFKARNVEVVAVSIDSHFTHNAWRNTPVNNGGIGQVKYTMAADMKHEIAKAYDVESEGGVAFRGAFLIDDKGVVRSQIINDLPLGRNMEELIRLVDALQFHEEHGEVCPANWKKGDKGMNASPEGVAAYLTENAAAL

SEQ ID NO: 92868 - protein, 755 aa, Nocardia farcinica IFM 10152
MAELALTARLNPSAADARRGVVRLHPEALTALGLREWDGVALAGSRRTAAVAGLAPAGTPAGVALLDDVTLSNAGIRENQTVVVAPATVYGARQVSVSGSVHATRSIPAATLRQALLGKVVTVGDTVSLLPRDLGPDIPSSAASQALSRTFGIAWTTELLTVTATDPARGPVSVQPNTAVSWAAGAMAAREAADRAATGAPVAAGETARGAAEAAAFAGAGANGAATGQWAVREAEARVPIEDLAGVHAQAAKLAEWLSLALDEPELLRALGANAHLGVLITGPAGVGKATLARSVAAPRRVIELDGPTVGAAESGTRLREVASAVAEVGSGQGGVLLVTDIDALLPAQPEPVATLILDQLRAAVAGPGVAFLATTAHPTEVDARLRAPDLCDRELALPLPTAPVRRALLEQLLRKVPTGDLALDEVAARTPGFVISDLAALCREAGLRAASRASREGAPPRLTQEDLLGALAVIRPLSRSGTEELAIGSLGLDDVGDMAETKQALTEAVLWPLRHPDSFARLGVDPPRGVLLYGPPGCGKTFLVRALAGSGQLSVHAVKGAELMDKWVGSSERAVRELFQRARDSAPSLIFLDEVDALAPRRGQSSDSGVADRVVAALLTELDGVEPLRDVVVLGATNRPELIDPALLRPGRLERLVFVPPPDAEARLAILRTAGRSVPLAADVDLAALAADLTGYSAADCAALLREAALAAMRRDVDTADVTAADVAAARAAVRPSLDPDQVESLRRYAESRT

SEQ ID NO: 92869 - protein, 350 aa, Bacillus cereus ATCC 14579
MKALLWHNQRDVRVEEVPEPTVKPGTVKIKVKWCGICGTDLHEYLAGPIFIPTEEHPLTHVKAPVILGHEFSGEVIEIGEGVTSHKVGDRVVVEPIYSCGKCEACKHGHYNVCEQLVFHGLGGEGGGFSEYTVVPEDMVHHIPDEMTYEQGALVEPAAVAVHAVRQSKLKEGEAVAVFGCGPIGLLVIQAAKAAGATPVIAVELSKERQELAKLAGADYVLNPATQDVLAEIRNLTNGLGVNVSFEVTGVEVVLRQAIESTSFEGQTVIVSVWEKDATITPNNLVLKEKEVIGILGYRHIFPAVIKLISSGQIQAEKLITKKITVDQVVEEGFEALVKDKTQVKILVSPK

SEQ ID NO: 92870 - protein, 390 aa, Oenococcus oeni PSU-1
MPELKEGVINSVRSDVRNITTNKIRAVDMEFRKIDGLLRLTLGEPDFNAPELVKKAMIKSIEDNESHYSTARGSIEFLKAAADFLKRNYDLNYDPRTEILSTVGSTEAIFSSLSTILEEGDELLAPSPAYPLYEQLAHVNHTKMVYIPTNDTNFVLTPSKLQNAIEQHPRAKAIVLTYPNNPTGVDYSVEQLKELATVIAKTNLLVVSDEIYSTLNYVGKHVSIASLLPEQTIVLNGVSKSHAMTGDRIGFVAAPRDLISQIVKIHQFAITAVSNPAMAGAVAALNQGDALTEKMRQEYMKRRNYLIPEFKKIGFDVAAPDGAFYLFLKIPADQNQDDFAFARELAHKALVGLIPGSCFGPGGEGYLRLSYAASEETLHEALRRLQNYLA

SEQ ID NO: 92871 - protein, 396 aa, Pseudomonas putida GB-1
MRYAKLTQRIAGDGAAAWDIHYRALALQAEGKDILLLSVGDPDFDTPAPIVEAAIDSLRAGHTHYADVRGKLALRQAIANRHRKRSGQAVGADQVTVLAGAQCALYCVAQCVLEAGDEVIVAEPMYVTYEAVFGACGAKVVPVPVKPENGFRVCPRDVAERITPRTRALALNSPHNPSGASLPRATWEALAELCIAHDLWLISDEVYSELLYEGEHVSPASLPGMAERTATLNSLSKSHAMTGWRMGWVVGSAELATHLENLALCMLYGSPDFIQDAAVVALEQQLPELDAMREAYRQRRDLVCEQLAGCPGIKALKPDGGMFVMVDIRDTGLSAQAFADRLLDSQGVSVLAGEAFGPSAAGHIRLGLVLGSEALADACQRIARCAGELMQEQADA

SEQ ID NO: 92872 - protein, 307 aa, Pseudomonas fluorescens PfO-1
MMSARHFLSLMDCTPEELVSVIRRGVELKDLRNRGVLFEPLKNRVLGMIFEKSSTRTRISFEAGMIQLGGQAIFLSPRDTQLGRGEPIGDCAIVMSSMLDAVMIRTFAHSTLTEFAANSRVPVINGLSDDLHPCQLLADMQTFLEHRGSIQGKTVAWIGDGNNMCNSYIEAAIQFDFQLRVACPEGYEPNPEFVAKAGDRVTIVRDPKDAVRGAHLVSTDVWTSMGQEEETAKRLKLFAPFQVNRALLDLAADDVLFMHCLPAHRGEEISLDLLDDPRSVAWDQAENRLHAQKALLEFLVEPAYHHA

SEQ ID NO: 92873 - protein, 479 aa, Cryptococcus neoformans var. neoformans JEC21
MLSFAQVAKRSAAVSFRRQAVASRTLRTSAPSNVLSKFAMPAMSPTMTEGGVAQWKKKEGESFSAGDVLIEIETDKATIDVEAQDDGIMAKIIAQDGTKNIAVGTPIAIIGEEGDDLSQADALAAESQSESAPSQKEAAPKEEKTAPKEEKSESSTTPAVGVPGEQKSGAGDAQTSPAKAPEHPSKGDRPKFFASPLARKIALENGIPLAEIKGTGPNGRIVEADVKNYKPSAAAASTPAAGKSAAVPADYEDIPTSNMRRTIGKRLTESKQQLPHYYVTVEVNMDRVLKLREVFNKAGESKTKLSVNDFIVKAASLALADVPEANSAWLGETIRTYKKADICVAVATPNGLITPIIKDVGAKGLATISAETKALASRARDGKLKPEEYQGGSFTISNLGMFGVDEFTAIINPPQSCILAVGKTTTKLELAPEDPKGFKAVQVMKVTLSADHRTVDGAVGARWLKAFREYMEQPLTFML

SEQ ID NO: 92874 - protein, 206 aa, Yarrowia lipolytica CLIB122
MSEIKTVTVEKPVPVTYDLGNLAVFDTNPVEVDLNDLNVDGQAREEALQAVSRDNAQLLINQLLSQPIKNTTDSNSSSGNQNSTMSLIMLPQPSTRLPREKPIPKPKAMTKWQEFALKKGIKSKARDGKLVYDEATGKWVPKWGFNGKNKELDQQWCVEVDDGKGSKKNQEDVMLDPRALDRASRKKLVKKNQKQHERNLKRGVSK

SEQ ID NO: 92875 - protein, 468 aa, Pseudomonas putida GB-1
MTDTVEKIQLTRALKSRHIFMLSLGGVIGTGLFMGSGVTINQGGPVGAILAYLVAGLLMYLVMVCLGELSVQMPVSGSFQAHATKFIGPATGFMIGWVYWMSWATTVGLEFTAAGMLMTRWFPDVPIWYWSALFVVVLFGLNALATRAFGEAEYWFSGIKVATILGFIIIGLLVIFGAIPLTSGAPAPMLDNLVGESLFPHGLSAVFAVMMTVVYAFQGCEIMGVAAGETEHPEKSIPRAVRNVVFRVLIFYVLAIAVLSAIVPYEQAGLMESPFVQVFDMVGIPFAADVMNFVILTAILSVGNSGLYASTRILWAMSKSGMAPKSLSPLSKRGVPLRALSITLCFALISLMTSFIAADTLFMVLMAVSGMSGTVTWIVIALAQYRFRKAYLRDGGQLQDLKYRAPLYPLVPLLCITLCSSLFVFLALDETQRPSLYWGFGFIALCYAAYYFVNRRRQGAFEPSVPGV

SEQ ID NO: 92876 - protein, 416 aa, Thermotoga sp. RQ2
MPEKSLYEMAVEQFNRAASLMDLESDLAEVLRRPKRVLIVEFPVRMDDGHVEVFTGYRVQHNVARGPAKGGIRYHPDVTLDEVKALAFWMTWKTAVMNLPFGGGKGGVRVDPKKLSRNELERLSRRFFSEIQVIIGPYNDIPAPDVNTNADVMAWYMDTYSMNVGHTVLGIVTGKPVELGGSKGREEATGRGVKVCAGLAMDVLGIDPKKATVAVQGFGNVGQFAALLISQELGSKVVAVSDSRGGIYNPEGFDVEELIRYKKEHGTVVTYPKGERITNEELLELDVDVLVPAALEGAIHAGNAERIKAKAVVEGANGPTTPEADEILSRRGILVVPDILANAGGVTVSYFEWVQDLQSFFWDLDQVRNALEKMMKGAFNDVMKVKEKYNVDMRTAAYILAIDRVAYATKKRGIYP

SEQ ID NO: 92877 - protein, 177 aa, Pisum sativum
ASVFNGKLNILVNNAGTFTPKSILDHTHEDVTTIMSTNFVSGYHLCQLSHPLLKESGYGSIVFISSIAGLKALDISSAYAASKGAMNQFTKNVALEWAKDNIRANVVAPGPVKTLLLENAMKDLAGVDKAVENIVSQSPVGRMGESEDISGLVAFLCLPASSHITGQIIAADGGFTM

SEQ ID NO: 92878 - protein, 521 aa, Burkholderia mallei
MSFSRSEAAPAAPLPDLAATLAALRDDAFQQLGAAFVTRLPAAPLPAPYVVGFSDDAARMLGLEPALRDAPGFAELFCGNPTRDWPQASLPYASVYSGHQFGVWAGQLGDGRALTIGELAHDGRRYELQLKGAGRTPYSRMGDGRAVLRSSIREFLCSEAMHHLGIPTTRALAVIGSDQPVVREEIETSAVVTRVAQSFVRFGHFEHFFANDRPEQLRALADHVIERFYPACRDADDPYLALLAEATRRTAELVAQWQAVGFCHGVMNTDNMSILGLTIDYGPFGFIDAFDAKHVCNHSDTQGRYAYRMQPRIAHWNCFCLAQALLPLIGLHRDAPSEDARAERAVEDAHAVLGRFPEQFGPALERAIRAKLGLALEREGDAALANQLLEIMDASHADFTLTFRHLARVSKHDARGDAPVRDLFIDRDAFDRWANLYRARLSEEARDDASRAAAMNRVNPKYVLRNHLAETAIRRAKEKDFSEVERLAAVLRRPFDEQPEHDAYAALPPDWASTLEVSCSS

SEQ ID NO: 92879 - protein, 341 aa, Salmonella enterica subsp. enterica serovar Typhi str. CT18
MKVKAVFINKPGEVETRWVDYPHKKENEVLIKVDAAGICGSDIGAFRGTNPLVTYPRIIGHEVTGIVLQEGTGMPDNIKKGDRVIVDPYIYCGHCYPCSVGRTNCCENLNVIGVHIDGAMQEVVTHPAHLIHKIPDNVPSEMAPLAEPLTIALHALHRANVKAGEYVAIIGAGAIGLMAALSARHYKATPILIDIVEERLRYAQKLGVPYVLNAADDQVIDAIKNITHGTMAQVVIEASGANSAIRNTLDLASFAGRISFTGWPKQETSLPTNLITYKELDLRGSRTSAGEFDEALRMLSTLEINPQDVVSKVVNLDEIPDAVKELDRYPERYLKINAVFH

SEQ ID NO: 92880 - protein, 406 aa, Yarrowia lipolytica CLIB122
MAARKSKKRTHVQISEEDMDKIPKSMIFKMGSKKVGSVAASPASQHALTQLVRDTRCAMEPHTAGKLRERKGNKLRDFVTMAGPLGVSHLMIFTKGESGMTSLRMARVPRGPTLHFKVSQYSLIKDVRKFVRSPKSNDGKLYKQPPLLVMNNFSLKSDDATNPHETLVTQMFQNMFPPLSAQNTRIPSIRRVVMLNKDKETGSIEFRHYAIDTRPVDVTRGVKKLTKLKHKLRKKIPNLSKKQDMADYLLDPDAGAFTSDSDMSEVEEDAIVDLNPDDDDEMPLEEGPSKRAVKLVEIGPRMTLDLIKIEDGVCSGKVLHHTRIKKSEAEIKKLEKRHSSAAKIKADRKAEQLANVKAKTEKKGRMARGKEKAKLKGDDGDEENEAGDDEDEENEADQEDDDEDDE

SEQ ID NO: 92881 - protein, 1207 aa, Solanum peruvianum
MKAHKTVFNQHPLSLNKLFFVLLLIFFLPPASPAASVNGLYKDSQQLLSFKAALPPTPTLLQNWLSSTDPCSFTGVSCKNSRVSSIDLSNTFLSVDFSLVTSYLLPLSNLESLVLKNANLSGSLTSAAKSQCGVTLDSIDLAENTISGPISDISSFGVCSNLKSLNLSKNFLDPPGKEMLKGATFSLQVLDLSYNNISGFNLFPWVSSMGFVELEFFSIKGNKLAGSIPELDFKNLSYLDLSANNFSTVFPSFKDCSNLQHLDLSSNKFYGDIGSSLSSCGKLSFLNLTNNQFVGLVPKLPSESLQYLYLRGNDFQGVYPNQLADLCKTVVELDLSYNNFSGMVPESLGECSSLELVDISNNNFSGKLPVDTLLKLSNIKTMVLSFNKFVGGLPDSFSNLPKLETLDMSSNNLTGIIPSGICKDPMNNLKVLYLQNNLFKGPIPDSLSNCSQLVSLDLSFNYLTGSIPSSLGSLSKLKDLILWLNQLSGEIPQELMYLQALENLILDFNDLTGPIPASLSNCTKLNWISLSNNQLSGEIPASLGRLSNLAILKLGNNSISGNIPAELGNCQSLIWLDLNTNFLNGSIPPPLFKQSGNIAVALLTGKRYVYIKNDGSKECHGAGNLLEFGGIRQEQLDRISTRHPCNFTRVYRGITQPTFNHNGSMIFLDLSYNKLEGSIPKELGAMYYLSILNLGHNDLSGMIPQQLGGLKNVAILDLSYNRFNGTIPNSLTSLTLLGEIDLSNNNLSGMIPESAPFDTFPDYRFANNSLCGYPLPLPCSSGPKSDANQHQKSHRRQASLAGSVAMGLLFSLFCIFGLIIVAIETKKRRRKKEAALEAYMDGHSHSATANSAWKFTSAREALSINLAAFEKPLRKLTFADLLEATNGFHNDSLVGSGGFGDVYKAQLKDGSVVAIKKLIHVSGQGDREFTAEMETIGKIKHRNLVPLLGYCKVGEERLLVYEYMKYGSLEDVLHDRKKTGIKLNWPARRKIAIGAARGLAFLHHNCIPHIIHRDMKSSNVLLDENLEARVSDFGMARLMSAMDTHLSVSTLAGTPGYVPPEYYQSFRCSTKGDVYSYGVVLLELLTGKQPTDSADFGDNNLVGWVKLHAKGKITDVFDRELLKEDASIEIELLQHLKVACACLDDRHWKRPTMIQVMAMFKEIQAGSGMDSTSTIGADDVNFSGVEGGIEMGINGSIKEGNELSKHL

SEQ ID NO: 92882 - protein, 77 aa, Glycine max
AYALQQGLKVIACIGETLEQREAGTTTAVVSEQTKAIAAKISNWDNVVLAYEPVWAIGTGKVATPAQAQEVCLPIFC

SEQ ID NO: 92883 - protein, 331 aa, Neisseria meningitidis FAM18
MNLKNRHFLKLLDFTPEEITAYLDLAAELKAAKKAGREIQRMKGKNIALIFEKTSTRTRCAFEVAARDQGAGVTYLEPSASQIGHKESIKDTARVLGRMYDGIEYRGFAQETVEELTKYAGVPVFNGLTNEFHPTQMLADALTMREHSGKPLNQTAFAYVGDARYNMGNSLLILGAKLGMDVRIGAPQSLWPSEGIIAAAHAAAKETGAKITLTENAHEAVKNVDFIHTDVWVSMGEPKEVWQERIDLLKDYRVTPELMAASGNPQVKFMHCLPAFHNRETKVGEWIYETFGLNGVEVTEEVFESPASIVFDQAENRMHTIKAVMVAALGD

SEQ ID NO: 92884 - protein, 124 aa, Synechococcus sp. CC9311
MSRPPLHWSCLSQCGACCRLAPAERPEALEALSDEQQTIYLGMVGKDGWCRHFDQGGRRCRIYEDRPDFCRVSGLADLFAVPAEEVNAFAIDCCRQQIRSVHGGRSLELRKFERLIRSPQNSDD

SEQ ID NO: 92885 - protein, 432 aa, Streptomyces avermitilis MA-4680
MSNPVRFDRGHTDDLMSFLAASPSPYHAVTNAAERLEKAGFRQVAETDAWDSTSGGKYVVRGGALIAWYVPEGADPHTPFRIVGAHTDSPNLRVKPRPDSGAHGWRQIAVEIYGGPLLNSWLDRDLGLAGRLSLRDGSTRLVNIDRPLLRVPQLAIHLDRSVSTDGLKLDKQRHLQPIWGLGGDVRDGDLIAFLEAELGLSAGEVTGWDLMTHSVEAPSYLGRDNELLAGPRMDNLLSVHAGTAALTAVAAADASLAYIPVLAAFDHEENGSQSDTGADGPLLGSVLERSVFARSGSYEDRARAFAGSVCLSSDTGHAVHPNYAERHDPTHHPRAGGGPILKVNVNNRYATDGSGRAIFAAACEKANVPFQTFVSNNSMPCGTTIGPITAARHGIRTVDIGAAILSMHSARELCATDDPFLLANSLVAFLEG

SEQ ID NO: 92886 - protein, 146 aa, Triticum aestivum
  misc_feature (106)..(106): Xaa can be any naturally occurring amino acid
  misc_feature (121)..(121): Xaa can be any naturally occurring amino acid
MYQAIPYSAGRLPAWPRRSEQAEADGAAGQEGGLADAAARGDGGEAVRRAVAESPVLVVGRRGCCLSHVVKRLLQGLGVNPAVHEVADEAELAAVVTGDAGGEAAXALPAVFVGGRLLGGXLDRLMAVHISGELVPILKDAGALWL

SEQ ID NO: 92887 - protein, 236 aa, Gibberella zeae PH-1
MASSSTPSTPLLYSCIAHNTTILSECTTSASSQTSSLASLILPKIEHTNPQKLTYTHGQHQIHYVAESPSEHRDYPSAGGLTFLVIADSSLGRRVPFGYLFEIRKRFLQQFPESTDFSDMPNYGAASFNSELKNLMVDYGTTTGGRDDAIGNAKREIDDVRGIMTKNIESLLERGERLDLLVDKTDRLGGSAREFRVRSRGLKRKMWWKNVKLMGLLALVIFLIIMAIVIAVKNGS

SEQ ID NO: 92888 - protein, 422 aa, Saccharomyces cerevisiae
MVDLIARDDSVDTCQASNGYNGHAGLRILAVFIILISSGLGVYFPILSSRYSFIRLPNWCFFIAKFFGSGVIVATAFVHLLQPAAEALGDECLGGTFAEYPWAFGICLMSLFLLFFTEIITHYFVAKTLGHDHGDHGEVTSIDVDAPSSGFVIRNMDSDPVSFNNEAAYSIHNDKTPYTTRNEEIVATPIKEKEPGSNVTNYDLEPGKTESLANELVPTSSHATNLASVPGKDHYSHENDHQDVSQLATRIEEEDKEQYLNQILAVFILEFGIIFHSVFVGLSLSVAGEEFETLFIVLTFHQMFEGLGLGTRVAETNWPESKKYMPWLMGLAFTLTSPIAVAVGIGVRHSWIPGSRRALIANGVFDSISSGILIYTGLVELMAHEFLYSNQFKGPDGLKKMLSAYLIMCCGAALMALLGKWA

SEQ ID NO: 92889 - protein, 617 aa, Oryza sativa
  misc_feature (24)..(24): Xaa can be any naturally occurring amino acid
  misc_feature (50)..(50): Xaa can be any naturally occurring amino acid
  misc_feature (267)..(267): Xaa can be any naturally occurring amino acid
  misc_feature (293)..(293): Xaa can be any naturally occurring amino acid
MKKKKNGMGAAADRGRLLALAHQXHDKLNPTDPGLRNRRRFKPSSSYPSXLLLLLGSSLPRLVPPLPSSFLPGVIKQTEFHQRWLVGDLNPPPPPCHLLPIQGQGQMQMQQRRKPPPAAAPVAAKQPSPRRTPGPLSFAGALLSLLVVATFLYINDHGNMMPPHASPDPDLRLLQEAAHQKVNSILLSRHAPAPPPRTNTNTSSSDQHLRLINIPMSSDLDLELGGNSTSSSGVEIQFEQQQQQEEKNLRGCELYKGRWVYDAAGRXEAPLYRESECGFLTEQGNVMPNGPRXDNSYPRWPGAARRGGNLPNFDARALLERLRNKRMMFVGDSLNRNQWESMVCLVQSAIPYGQKTLTKFVNNGSLNVFRAHEYNATVEFYWAPFLVQSNSDDPQVHSVRDRVIAWRSIAKHAANWKGVHYLVFNTYIWWLNNFQIKVLKSRGAPFAGSGGWSSRYALVDRAIAYREVLKTWAKWVDRRIDPNKTHVFFMAMSPNHFMPEAWGGSAGAVKCAMETQPIVNRTSGGLDIGTDWRLHGVARGVLRSMRRVGVRFVDITALSELRKDAHTSVHTLRQGKLLTPEQQADPRTYADCIHWCLPGLPDTWNHFLYAHIVAHAA

SEQ ID NO: 92890 - protein, 235 aa, Triticum aestivum
  misc_feature (51)..(51): Xaa can be any naturally occurring amino acid
  misc_feature (64)..(64): Xaa can be any naturally occurring amino acid
  misc_feature (150)..(150): Xaa can be any naturally occurring amino acid
VGYARVSQSRRVKRRPVNVIRLTIGRNGPDVACSRPPPRISVVAAEGDAGXPKAKGPHKLQRQXPFWYDIQTKPQPGAPWGTSLKRGYTFDTVEEFWCWYDQIFRPSKRVGSADFHFFKAGVEPKWEDPECANGGKWTVISSRKANLDTXMWLETCMALIGEQFDESQEICGVVASVRQRQDKLSLWTKTASNEAVQVDIGKKWKEVIDYNDKMVYSFHDDSRSQKPSRGGRYTV

SEQ ID NO: 92891 - protein, 260 aa, Pseudomonas fluorescens PfO-1
MQLEFHQVDAFSDRPFSGNPAMVYRLDAWLADELMQKIAAEHNLAETAFLVREGQVWHIRWFTPTTEVPLCGHATLASAYVLFEIYKETAERLDFTCKSGPLSVSREGDRLWLDFPAIEAVEKGVTLEIERALNVQAVDVLSSNELFVVLESEQAVLDCTPDMIALAKLPWLGAIVTARGNQHDFVSRYFAPAIGINEDPVTGSTHCSLIPYWSKRLGKSSLTACQRSARGGELFCRLEGERVKIGGNATLVASGTLMLG

SEQ ID NO: 92892 - protein, 165 aa, Aegilops speltoides
VMASSATTVTPFHGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNLRQVQCVSFIAFRPPGCE

SEQ ID NO: 92893 - protein, 387 aa, Streptococcus pyogenes M49 591
MNKLYIDSFVEKKLTAGVQLLDEKDFSNIKEKNQLVQLVTKSNRPIGTAYISKQNKGIGWYLGPEKIDLSISYFVSLFSVAKAKRQDFAQSDETNAYRLFNQEGDGFGGVTIDLYKDFAVFSWYNAFVYDKKEMIMEAFQQVFPEVKGAYEKCRFKGPDTETAHLYGELAQETFSILENGIAYQVFLNEGLMTGIFLDQHDVRRALVDGLAMGESLLNLFSYTAAFSVAAAMGGAIETTSVDLAKRSRELSLAHFEHNQLNLASHHFVVMDVFEYFKYAKRKKLIFDVIVIDPPSFARNKKQTFSVSRDYHRLITEALDILSPKGTIIASTNAANMTVSQFKKQIIKGFGSRRPESMTLQQLPSDFTINKADERSNYLKVFTIKVRE

SEQ ID NO: 92894 - protein, 223 aa, Oenococcus oeni PSU-1
MSVIVAPSILAADYLNLGEQIKLVEGAGAKYLHIDIMDGDFVPSISYGPQWVKQIKASGSKLVLDVHLMVNHPEKLIDSFVSAGADIIGVHVEATAHIHRALQMIKNAGVHPEVVINPGTPVSAILPILYMVDQVLVMTVNPGFGGQKFLPEEISKISELHEYKKEHGLDFDIEIDGGVNNQTLVKAYEAGATVAVAGSYVYDKVDPAAKVKKLLEVTNFEVD

SEQ ID NO: 92895 - protein, 512 aa, Pseudomonas fluorescens PfO-1
MSTSTLRTPPISEIYDIAVIGGGINGVGIAADAAGRGLSVFLCEKDDLASHTSSASSKLIHGGLRYLEHYEFRLVREALAEREVLLAKAPHIVKPMRFVLPHRPHLRPAWMIRAGLFLYDHLGKREKLAGSKSLKFGADSALKSEISKGFEYSDCWVDDARLVVLNAMAAREKGAHIHTQTRCVSARRAKGLWHLNLERADGSLFSITAKALVNAAGPWVAKFIRDDLKMESPYGIRLIQGSHIIVPKLYEGDHAHILQNEDQRIVFTIPYLNNLTLIGTTDREYTGDPAKVAITDGETDYLLKVVNAHFKKQISRGDILHTYSGVRPLCNDESDNPSAVTRDYTLALSGSTEEAPLLSVFGGKLTTYRKLAESAMAQLMPFFTQMRPSWTATATLPGGEDMTTPQALSALIRDKFDWVPTEIARRWATTYGSRTWRMLEGVDTLADLGEHIGGGLYTREVDYLCTEEWATTARDILWRRSKLGLFTTPAEQERLAAYLNKVEQNRSKIEAA

SEQ ID NO: 92896 - protein, 455 aa, Pseudomonas putida GB-1
MIDALNHLPRPRAGADQLAERFSDLAPPLTARQAAVESARCLYCYDAPCVNACPSDIDIPSFIHRISDENLQGAAERILSANILGGSCARVCPTEILCQQACVRNNAQECAPVLIGQLQRYALDNAQFSEHPFKRSPATGKRIAVVGAGPAGLSCAHRLAMHGHDVVVFEASDKAGGLNEYGIARYKLVDDYAQREVEFLLGIGGIEVRHGQRLGGNLSLGELRDQYDAVFLGLGLNAVRQLGLPDEEAPGVLAATEYIRELRQADDLSQLPLADRCLVIGAGNTAIDMAVQMSRLGARDVNLVYRRGHADMGATGHEQDIAKANQVRLHTWARPDAVLLDDAGKVRGMRFARTELADGRLRDTGETFELAADAIFKAIGQRFDEASLGDPVAAQLARDGERIRVDETMQTSLPGVYAGGDCTALGQDLTVQAVQHGKLAAEAIHAQLMLNVEAA

SEQ ID NO: 92897 - protein, 289 aa, Thermotoga sp. RQ2
MLTCRFQKFTLNNGVEMPILGYGVFQIPPEKTEECVYEAIKVGYRLIDTAASYMNEEGVGRAIKRAIDEGIVRREELFVTTKLWVSDVGYESTKKAFEKSLKKLQLEYIDLYLIHQPFGDVHCAWKAMEEMYKDGLVRAIGVSNFYPDRLMDLMVHHEIVPAVNQIEIHPFYQRQEEIEFMRNYNIQPEAWGPFAEGRKNIFQNGVLRSIAEKYGKTVAQVILRWLTQKGIVAIPKTVRRERMIENISIFDFELTQEDMEKIATLDEGQSAFFSHRDPEVVKWICSLKR

SEQ ID NO: 92898 - protein, 1021 aa, Daucus carota
MGVLRVYVILILVGFCVQIVVVNSQNLTCNSNDLKALEGFMRGLESSIDGWKWNESSSFSSNCCDWVGISCKSSVSLGLDDVNESGRVVELELGRRKLSGKLSESVAKLDQLKVLNLTHNSLSGSIAASLLNLSNLEVLDLSSNDFSGLFPSLINLPSLRVLNVYENSFHGLIPASLCNNLPRIREIDLAMNYFDGSIPVGIGNCSSVEYLGLASNNLSGSIPQELFQLSNLSVLALQNNRLSGALSSKLGKLSNLGRLDISSNKFSGKIPDVFLELNKLWYFSAQSNLFNGEMPRSLSNSRSISLLSLRNNTLSGQIYLNCSAMTNLTSLDLASNSFSGSIPSNLPNCLRLKTINFAKIKFIAQIPESFKNFQSLTSLSFSNSSIQNISSALEILQHCQNLKTLVLTLNFQKEELPSVPSLQFKNLKVLIIASCQLRGTVPQWLSNSPSLQLLDLSWNQLSGTIPPWLGSLNSLFYLDLSNNTFIGEIPHSLTSLQSLVSKENAVEEPSPDFPFFKKKNTNAGGLQYNQPSSFPPMIDLSYNSLNGSIWPEFGDLRQLHVLNLKNNNLSGNIPANLSGMTSLEVLDLSHNNLSGNIPPSLVKLSFLSTFSVAYNKLSGPIPTGVQFQTFPNSSFEGNQGLCGEHASPCHITDQSPHGSAVKSKKNIRKIVAVAVGTGLGTVFLLTVTLLIILRTTSRGEVDPEKKADADEIELGSRSVVLFHNKDSNNELSLDDILKSTSSFNQANIIGCGGFGLVYKATLPDGTKVAIKRLSGDTGQMDREFQAEVETLSRAQHPNLVHLLGYCNYKNDKLLIYSYMDNGSLDYWLHEKVDGPPSLDWKTRLRIARGAAEGLAYLHQSCEPHILHRDIKSSNILLSDTFVAHLADFGLARLILPYDTHVTTDLVGTLGYIPPEYGQASVATYKGDVYSFGVVLLELLTGRRPMDVCKPRGSRDLISWVLQMKTEKRESEIFDPFIYDKDHAEEMLLVLEIACRCLGENPKTRPTTQQLVSWLENIDVSS

SEQ ID NO: 92899 - protein, 217 aa, Brassica napus
SKYRAMPLIIDPALYMLNKSNIIWVRPDRSLPNAFKLHTGSAWMVLSRPFVEYIIWGWDNLPRTLLMYYTNFVSSPEFYFHTIICKVPEFSKTALNHDLHYIAWHRPPRQHPRLLSLTNMRPMIASGAAFARKFSRNDSVMDRIDKELLMRTNQEGFTPGGWCGGKPECSVVEDVARINPGSGAERLKGLVDRLVSEAKSGKSCGNVNLLQWDKGYL

SEQ ID NO: 92900 - protein, 102 aa, Acinetobacter baumannii
RGATGEVIQDVVNIGVGGSDLGPHMVTHALADFKVKTAKPLNVHFVSTMDGSQLSDLLHQLRPETTLFIISSKSFGTIDTLSNAQTVRQWLEKALGKHDRVV

SEQ ID NO: 92901 - protein, 469 aa, Vibrio cholerae O1 biovar eltor str. N16961
MSVENVLSLIQENEVKFVDLRFTDTKGKEQHISIPAHQIDADFFEDGKMFDGSSVAGWKGINESDMVMMPDPSSAVLDPFTEDATLNIRCDILEPATMQGYDRDPRSIAKRAEEYMRSTGIADTVLVGPEPEFFLFDDVKFATNMSGSFFKIDDVEAAWNTGTEYEDGNKGHRPGVKGGYFPVAPVDSSQDIRSAMCLIMEEMGLVVEAHHHEVATAGQNEIATRFNTLTTKADEIQIYKYVVHNVAHAFGKTATFMPKPLVGDNGSGMHVHQSLAKDGVNLFAGDKYGGLSETALYYIGGIIKHARALNAITNPSTNSYKRLVPHYEAPVMLAYSARNRSASIRIPVVPSPKARRIEVRFPDPAANPYLAFAAMLMAGLDGIKNKIHPGEAMDKDLYDLPAEEAAEIPKVAESLQQALQYLDADREFLTAGGVFSDDFIDSYIALKTKDVERVNVAVHPLEFELYYSV

SEQ ID NO: 92902 - protein, 115 aa, Cryptomeria japonica
  misc_feature (26)..(26): Xaa can be any naturally occurring amino acid
AGPAQGWSTLSQSKPIGSLPLMNTGXLMKQWKMGLKAKRSVKAAYKVKLVTPDGETEIECPDDQYILDAAEDAGIDLPYSCRSGSCSSCAAKVIEGEIEMEDQSFLDDDQIGSGF

SEQ ID NO: 92903 - protein, 102 aa, Acinetobacter baumannii
RGATGEVIQDVVNIGVGGSDLGPQMVTHALCDFKVKTAKPLNVHFVSTMDGSQLSDLLHQLRPETTLFIISSKSFGTIDTLSNAQTVRQWLEKALGKHDRVV

SEQ ID NO: 92904 - protein, 72 aa, Marinobacter sp. ELB17
MKSVGVVGDARRYEGVIALRAVETIDFMTARWAHLPYELLETVSNRIINEISGVSRVTYDVSSKPPATIEWE

SEQ ID NO: 92905 - protein, 584 aa, Oryza sativa
MRTSVGSPEMDFFSEYGDANRYKIQEVIGKGSYGVVCSAIDQHTGDKVAIKKIHNIFEHLSDAARILREIKLLRLLRHPDIVEIKHIMLPPSRRDFKDIYVVFELMDTDLHQVIKANDDLTKEHHQFFLYQMLRALKYIHTANVYHRDLKPKNILANANCKLKICDFGLARVAFNDTPTTVFWTDYVATRWYRAPELCGSFFTKYSPAIDIWSIGCIFAEILTGKPLFPGKNVVHQLDLMTDLLGTPSMDTVTRIRNEKARRYLSSMRKKQPVPFSERFPKADPAALKLLQRLLAFDPKDRPTAEEALADPYFKGLAKAEREPSCQPITKMEFEFERRKVTKEDVKELIFREILEYHPQLLKDYMNGTEKTNFLYPSALDNFRRQFANLEENGGKNGDAVPSDRKHVSLPRTTTVHSAPIPPKDHQNITSQVPQRIPGRTGRGACPVIPFENLSAMGPYNQRRVVRNPVLPPATTNLSAYAYHRKSDSSERELQQELEKDRMRYQPSEHFMDAKVVSHMSHDLRASSYYVSKAKSDVADRAALQSNMMQGIGPFNGIAAVGGLSELTAPLTTEMYLVNGYRLTA

SEQ ID NO: 92906 - protein, 563 aa, Saccharomyces cerevisiae
MSEITLGKYLFERLSQVNCNTVFGLPGDFNLSLLDKLYEVKGMRWAGNANELNAAYAADGYARIKGMSCIITTFGVGELSALNGIAGSYAEHVGVLHVVGVPSISSQAKQLLLHHTLGNGDFTVFHRMSANISETTAMITDIANAPAEIDRCIRTTYTTQRPVYLGLPANLVDLNVPAKLLETPIDLSLKPNDAEAEAEVVRTVVELIKDAKNPVILADACASRHDVKAETKKLMDLTQFPVYVTPMGKGAIDEQHPRYGGVYVGTLSRPEVKKAVESADLILSIGALLSDFNTGSFSYSYKTKNIVEFHSDHIKIRNATFPGVQMKFALQKLLDAIPEVVKDYKPVAVPARVPITKSTPANTPMKQEWMWNHLGNFLREGDIVIAETGTSAFGINQTTFPTDVYAIVQVLWGSIGFTVGALLGATMAAEELDPKKRVILFIGDGSLQLTVQEISTMIRWGLKPYIFVLNNNGYTIEKLIHGPHAEYNEIQGWDHLALLPTFGARNYETHRVATTGEWEKLTQDKDFQDNSKIRMIEVMLPVFDAPQNLVKQAQLTAATNAKQ

SEQ ID NO: 92907 - protein, 525 aa, Marinobacter sp. ELB17
MAHDIHDHRILILDFGSQYTQLIARRVRDIGVYCEVRAFDITAEELDAFNPKGILLAGGPESVTELGGPRAPDGLFDREIPVLGICYGMQTMAEQLGGRVASSEKREFGYAQIKVRAKGPLLQDITDHLTATGESLLDVWMSHGDKVVAMPEGFELLASTESAPIAAMQDLSRNLYGLQFHPEVTHTLQGKRILEHFVMNICGCEALWTPAKIVDDAVQKIREQVGTDKVLLGLSGGVDSSVTAALLHKAIGDQLTCVFVDNGLLRLNEGDQVMDMFGSSMGVKVIRADAEERFLTNLKGVSDPEQKRKVIGNTFIDVFDEEATRIQNVNWLAQGTIYPDVIESAASKTGKSHVIKSHHNVGGLPETMKLKLVEPLRELFKDEVRRIGLELGLPYDMVYRHPFPGPGLGVRILGEVKKDYADILRRADAIFLEELHRADYYHKTSQAFAVFLPVKSVGVVGDARRYEWVIALRAVETIDFMTARWAHLPYELLETVSNRIINEISGVSRVTYDVSSKPPATIEWE

SEQ ID NO: 92908 - protein, 3316 aa, Arabidopsis thaliana
  misc_feature (2400)..(2400): Xaa can be any naturally occurring amino acid
  misc_feature (2410)..(2410): Xaa can be any naturally occurring amino acid
MRSLTLVATPRCVSGIPNSAAILDAAVIPAIKIANFDKDLTGANQVVDVAYLCPNLYRPRSSIGSLARTWSERRRSSDSLARAAGRVTVKLEAPGRVTVELKVTGRLSDQLGGYPDGYLGGYGRMAACPKGGEGRAVKGEEIQLFGKVQLFGKLDYRIRSTEQREGRSCASYTRLGPGKGSAEAGTRLSGGPAGLGIGLRGITTRRLENLAVSQMGKSSKTGKSKKDKGIVEETLVEEETMINEKTRIGTMLDGTDSAEPETGKKSINEEASESSGARDSTYNRNNTPTTQEEWDLMKGLMAQLATLTKAVVADPVVQRVDNQNDDDSEVVEVNLQPNHGRKRGDYLSLLEHVSRLGTRHFMGSTDPIVADEWRSRLKRNFKSTRCPEDSQRDIAVHFLEGDAYNWWLTVKKRRGDEVRSFTDFENEFNKKYFPPEAWDRLECVYLDLVQGNRTVREYDEEFNRLRRYVGRELEEEQAQVRRFIRRLRIEIRNHCLVRTFNSVFELVERAVMIEEGIEEERYLNREKAPIQNNQPTQPADKKRKFDKVDNTKSDAKTGECVTCGKSHSGTCWKAIGACGQCGSKDHAIQSFPRMEPGQSKVLGEETRTCFYCGKVGHLKRECPKLTAEKQGGQRDNRGGNVLPPPPKRQAVAPRVYELSEEANDAGNFRAITGTLRVGDVETHTLFDYGATHCFVSLELVQSAGFRKEPNTDYGMVRAAGRKAMYPTGLVRGISVVVNLIIVPLKKHDVILEMDWLGKYKAHIDCHRGRIQFKRDEGCEAYLATITTKEVGASAKLKDIPIVNEFSDVFAAVSGVPPDRSDPFTIELKPGTTPISKAPYRMAPAELAELKKQLEELLDKGFIRPSSSPWGAPVLFVKKKDVDGSTWRRTVVFKNRLGLGISLNSHRPTDVRKTAFRTRYDHFEFVVMPFGLTNALAAFMKMMNGVFRDFLDEEHELFAKLSKCSFWQRSVGFLGHIISDQGVSVDPEKIRSIKEWPRPRNATEIWSFLGLAGYYRRFVMSFVSMAQPMTRLTGKDTLFNWSEDYEKSFLELKAILTNAPVLVLPEEGEPYTVYTDASIVGLGCVLMQKGSVIAYASRQLRKYEKNYLTHDLEMAAYSVGPRHKVHVKVLEGFSKGLRNSKEPKYGLTPTDGRTIRTNDSNPRGMLRACILDWGGNWEKYLRLVEFAYNNNFQASIGMSPYEALYGRACRTPLCWTPEAQDRQKSYANKRRKELEFQVGDFVYLKAMTYKGAGQFTSRKKLSPRYVGPYKVIERVGAVAYKLDLPPKLNAFHNVFHVSQLRKCLSDQEKSMEDVPPGIKENMTVEARLVRIMDRIKKGTRGKSWDLLKVLWNCRGREEYTWETENKMKANFPEWFKEMDRWLGLGPREEGGVSDKSSDILAWAAGRLTVELEAAGRVTIELEVAGRLSDQLGGYPDGYLGGYGRTVACPKDKGEQLRAKRCNSSERKGAQDHLGYHNTQKNTGNSPINSRPLGRINSRRFGSRTVADKEEEASDRPNNVKEVRMTQLIRGQGEDAWTVVEEGWEPPFDLTEDGAMSAIFNGVDEDEFKLIQGCKSAKQAWDTLQKSHERTSSVKRTRLDHIATQFEYLKMERDETIVKFSSKISDLANEAEVMGKTYKDQKLVKKLLRCLPPKLAPHKTVMRVAGNTNKISFVDLVEMLKSEEMEVDQDKINPSKNIAFNVDQGSEQFHEIKDGMALLARNIGKAQKRVERGQNRDSTSWSIKDGERSRGRFSKSKNDDSGKKKEIQCYECGGFGHIKPECPVTKRKEMKCLECKGVGHTKFECPNKSKLKEKSLISFSDSESDDEGEELLNFVAFMASSDSSKFMSDTDSDCDEELNPKDEYRVLYDSWVQLSKDKLQLVKEKLTLEAKLANVSIEDKQKLSETTTVGTSPDYYQKNLERLREECHRERDRAKLLERELNDKHKQMRMLNKGLESLDKILAMGRTESQQRGLGYQGYTGKINKEEGRIINFVSGGTTSEPVMLGVICCDHCGKRYHMREQCHKFKEKVRTMWNLAKCYIEPSRSCTMWIKKKDLYGDMEAERYNHKQICVATGIAEVDDCTPQAKVAYTSAVSQDNRAWYFDSGCSRHITGEQAVLNDFTVITNGKVTFGDGGKGSIKGKGKIKIDDQPHLSNVYFVERLTANLISISQLCDDDLTVMFTKTGCVALDIAGNNVISRVWLGNNCYMWKESEVCLSAFTSKLDLWHQRLGHMNTQSLVKIVNDEVVRGIPKLEGSTGALCKACSQDKQVKVQHKKVGHIGTTSLLELVHMDLMGPVQTESLSGKRIQGIRHQFSTPRTPQHNGVVERKNRTLQEMARAMIHGNNVSPRFWAEAVNTACYIVNRVYVRPGTSTTPYEIWKGRSPNLCYFHTFGCVCYVLNDXIILESLMQEXDEGIFLGYATNSIAYKVYNKRLKRVEELVNVVFDDKRPTRLFPVEQDDDKHTMMTTEPHTSSSRLTVPKSHSETDVIGKLDGDRTTRGIKMNYRDMILFTCFVSSIEPTNIEIALEDEFWYHVCHEELNQFCRHEVWDLVPRPVHVNVVGTKWIFKNKTDEEGNVTRNRTRLVAQGYSQVEGIDFDETFAPVARLESIRLLLGISCLLKSKLFHMDVKSAFLNGVIQEEVFVSQPKGFEDSAFPDHVYKLKKALYGSKQAPRAWYERLTLFLIEKGFKRGSKLVTDFVESMTKKFEMSMVGEMNYFLGLQIKQTDEGVHISQSTYAKGLIQRFGMQTAKTSKTPMSVTAKLSTDEAGLSVDENCIANPKKSHLNAVKRILKYVKGNLDDRRSTTGGCFFLGNNLVSWHSKKQSCVSSSTAEVEYIVLGSCCTQLLSMKQMLLDYGVSGAGQPSAATPSDPPPPSSVPMFIPKTEPGIYMSKKTKSKVSAPSQSKRQCTAATSKTRSKAPALRRLSSKKSTRSASAAGQTEEHVFESSDLQDGDVTQIAPPLFLSGYQENRRLLSARDRLGRYKLIGGRYFNDMRFLSLDGNNTASTLQLLSTAGLLLTVTEIDSYVQEVVMEFYANLPDGEEGDQLAYFVFVRGNMYEFSPAIINQIFQLPNPPYPLNMSKIKVPESMDEVDVARSNSKANSWKMLTSQLLSPEIALLNKIYCHNWMPTVNRSVLKPERACSNAVANPSSTLHLVLPNLIDQMLRFQRIVRSGEGDTTSSAPLKFTMEVKPILVLQTDSPTLDAGLENLIVSLTTMRLCLAGAEYSDVSYSVPDDVGDENVEEEDDVVSHSDKKGEIEETECLKFNRHRDVLVGVKKRRITLDKGDEVVSEQREYTAVVVFVNWVALGSDRSKSGS

SEQ ID NO: 92909 - protein, 307 aa, Bacillus halodurans C-125
MRVANSITDLIGQTPLVKLNRLVSDKHADVYLKLEFFNPGSSVKDRIALAMIEAAEKSGALKPDDTIVEPTSGNTGIGLAMVAAAKGYKTKLVMPETMSLERRNLLRAYGAELVLTPGPEGMGGAIRKATELAQENGYFMPQQFENEANPEIHRETTGRELLEQVDGQLDGFVSGIGTGGTITGAGGLLKENFPNLHIAAVEPADSPVLSGGNPGPHKIQGIGAGFVPKILDTDIYDEVIKVSTEQAFEYARRAAKEEGILGGISSGAAIYAALQVAEKLGPGKKVVAVIPSNGERYLSTPLYQFED

SEQ ID NO: 92910 - protein, 565 aa, Arabidopsis thaliana
MGSASIGYQFGISARFYGNFNLSSDITVSSLPCKLDVSIKSLFSAPSSTHKEYSNRARVCSLPNTDGYCDEKFETPILDSIETPLQLKNLSVKELKLLADEIRTELHSVLWKKTQKSMNPSFAAIELTLALHYVFRAPVDNILWDAVEQTYAHKVLTRRWSAIPSRQNSGISGVTSRLESEYDSFGTGHGCNSISAGLGLAVARDMKGKRDRVVAVIDNVTITAGQAYEAMSNAGYLDSNMIVILNDSRHSLHPNMEEGSKASISALSSIMSKIQSSKVFRKFRELAKAMTKRIGKGMYEWAAKVDEYARGMVGPTGSTLFEELGLYYIGPVDGHNIEDLVCVLREVSSLDSMGPVLVHVITEGNRDAETVKNIMVKDRRTYSDCFVEALVMEAEKDRDIVVVHAGMEMDPSLLTFQERFPDRFFNVGMAEQHAVTFSAGLSSGGLKPFCIIPSAFLQRAYDQVVHDVDRQRKAVRFVITSAGLVGSDGPVQCGAFDIAFMSSLPNMIAMAPADEDELVNMVATAAYVTDRPVCFRFPRGSIVNMNYLVPTGLPIESRSEEEEFS

SEQ ID NO: 92911 - protein, 198 aa, Bacillus halodurans C-125
MILMIDNYDSFTYNLVQYLGEMGHELVVKRNDEVSVAEIEQMSPDFLMISPGPCSPNEAGVSLDAIRAFAGKLPIFGVCLGHQSIAQAFGGDVIRAERLMHGKTSEVTHDGKTIFKEVANPFTATRYHSLIVKRQTLPDCFEISAETAEGEIMAIRHKELPIEGVQFHPESIMTDAGKRLLRNFIETYGKETNDVHVR

SEQ ID NO: 92912 - protein, 165 aa, Aegilops speltoides
VMASSATTVTPFHGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFSAFRPPGCE

SEQ ID NO: 92913 - protein, 629 aa, Arabidopsis thaliana
MALSVFAFPSYINRNPSLKYLKPSSMSSTKYSKVRATTFSEKGEYYSNRPPTPLLDTINHPMHMKNLSIKELKVLSDELRSDVIFNVSKTGGHLGSNLGVVELTVALHYIFNTPHDKILWDVGHQSYPHKILTGRRGKMKTIRQTNGLSGYTKRRESEHDSFGTGHSSTTLSAGLGMAVGRDLKGMNNSVVSVIGDGAMTAGQAYEAMNNAGYLHSNMIVILNDNKQVSLPTANLDGPTQPVGALSCALSRLQSNCGMIRETSSTLFEELGFHYVGPVDGHNIDDLVSILETLKSTKTIGPVLIHVVTEKGRGYPYAERADDKYHGVLKFDPETGKQFKNISKTQSYTSCFVEALIAEAEADKDIVAIHAAMGGGTMLNLFESRFPTRCFDVGIAEQHAVTFAAGLACEGLKPFCTIYSSFMQRAYDQVVHDVDLQELPVRFAIDRAGLMGADGPTHCGAFDVTFMACLPNMIVMAPSDEAELFNMVATAAAIDDRPSCFRYHRGNGIGVSLPPGNKGVPLQIGRGRILRDGERVALLGYGSAVQRCLEAASMLSERGLKITVADARFCKPLDVALIRSLAKSHEVLITVEEGSIGGFGSHVVQFLALDGLLDGKLKVYRTWITNGSTS

SEQ ID NO: 92914 - protein, 165 aa, Aegilops speltoides
VMASSATTVTPFHGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYSDAYVRVIGFDNLRQVQCVSFIAFRPPGCE

SEQ ID NO: 92915 - protein, 435 aa, Lactococcus lactis subsp. lactis Il1403
MFDYIIIGAGPGGLGLAYRLKTKDNKIGIIENDKWGGTCPNYGCDPTKMMMAVVEAKSRVEQLKGQGISGELNIDWKGLKSRKLNITDPYEKSTFTGLKNAGIETIYGSAAFNDQGKLEVEGKTYQAKTYIIATGSRPRLLDIDGKEFLKTSNDFLALEEFPAQISFLGSGPISLELAQIAKAAGSDVTIISRKKARVAHFDEEMGQEFINYLKAQGIKFIEDISVDKVEKVADGFLLTDGTDFEHKTDLVIAGVGRQPNSDKLNLEKVGVETDAKGIKVNEYLQTSNSKIYAMGDVLSKNQPHLTPVSSFEGAYLGENLVKDEPQKIAYPAIPTIIFGTAKLAEVGHLAGEGIHTKTLDLSSWYTYKRINDPLAKLKVALNEKREIVGASTVSSVADEVINLINILIQQKMTLADVEKMIFTYPTVASDLEYFY

SEQ ID NO: 92916 - protein, 114 aa, Bacillus halodurans C-125
MNRMEFYGYHGVYAEENKLGQRFYVDLTLELDLKRAGESDALVHTINYADVYKITKEVVEGESYKLVESVAETIAAKLLASFEPLQFVTVTVTKPDPPIPGHYDSVAVEITRSK

SEQ ID NO: 92917 - protein, 779 aa, Sulfitobacter sp. EE-36
MSVSEIYETMDYGTAPENAADALAWLVDQGSRFGHFIDGAFTEARDDFESRNPANGNVLATLTQASQAEVDTAVAAARKAQPKWAKLGGHGRARFLYALARLLQKHSRLFAVLETLDNGKPIREARDVDVPLAQRHFYYHAGMAQLMESELPDAEALGVCGQIIPWNFPLLMLAWKVAPALAMGNTVVLKPAEYTSLTALLFADICVQAGLPKGVVNIVTGDGAVGEMIVQAEVDKIAFTGSTPVGRRIREATAGSGKALTLELGGKSPYIVFDDADLDSAVEGLVDAIWFNQGQVCCAGSRLLVHEPVADRFYAKLRARMAKLRVGDPLDKSVDVGALVDPVQVHRVTEMVAANTSGEVFTAGDVPATGCYYPPTLITGMNPADPLMQDEIFGPVLVSTTFRTPAEAVELANNTRYGLAATVWSENINLALDIAPKLVSGIVWVNGTNMMDAAAGFGGVRESGFGREGGWEGLAAYTRPKTTQKPLKEITAFSGSGTPADPIDRTAKLYIGGKQSRPDSGYSAPVWGKSGDLLGHVSLASRKDVRNAVEAAHAAKGWSKTTGHLRAQILYYVAENLAARGDEFARRLDAMQGTKAGKSEVDLAVKRLFTYAAWADKYDGQVHGVPIRGVALAMKEPVGVIGALCPAEAPLLGLISCMAPAIAMGNRIILSASGPFPLAATDFVQVLETSDVPAGVVNILTGPQKDIAETLARHMDVDAVWSFGDKAQSETVERASAQNLKRTWVNNGMARDWDGAEGEGKAFLHAATEVKNIWIPYGE

SEQ ID NO: 92918 - protein, 165 aa, Aegilops speltoides
VMASSATTVTPFHGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNLRQVQCVSFIAFRPPGWE

SEQ ID NO: 92919 - protein, 463 aa, Bacillus cereus ATCC 14579
MQHTNKSGTLNRGLKERHITLMSLGSAIGVGLFLGSASAIKLAGPSILLGYMIAGLVIFFIMRALGEMAIEQPVAGSFSKYAYDYIGPLAGYITGWNYWFLWVVTCMAEITAAGIYMQYWFPDIPRWTWALLALLLMSAFNFLSVKVFGELEFWFALIKIVTIICMIVVGAGIILFGFGNGGIATGISNLWSHGGWFPNGFSGLLLSMQMVLFAYLGVELIGVTAGEAQNPKKTLAKAIDNVFWRILLFYVGALFVMMAIYPWNELGEKGSPFVLTFQQIGIAKAAGIINFVVLTAALSSCNGGLFSTGRMLYTLAQQKKAPERFGRLNKNGIPSQGIVATAIVLLIGVILNYLVPAKVFTWLTSISTFGAIWTWGIILVAQIKFRKSLPTQNKQKLSYKMPLYPLSSYFSLVFLVLVLGIMAYSEDTRIALIVGPIWLIGLAIVYYMKGFHKIDETPNSKIS

SEQ ID NO: 92920 - protein, 165 aa, Aegilops longissima
VMASSATTVAPFQGLKSTAGLPVSRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCE

SEQ ID NO: 92921 - protein, 351 aa, Clostridium beijerinckii
MKGFAMLGINKLGWIEKERPVAGSYDAIVRPLAVSPCTSDIHTVFEGALGDRKNMILGHEAVGEVVEVGSEVKDFKPGDRVIVPCTTPDWRSLEVQAGFQQHSNGMLAGWKFSNFKDGVFGEYFHVNDADMNLAILPKDMPLENAVMITDMMTTGFHGAELADIEMGSSVVVIGIGAVGLMGIAGAKLRGAGRIIGVGSRPICVEAAKFYGATDILNYKNGHIEDQVMKLTNGKGVDRVIMAGGGSETLSQAVKMVKPGGIISNINYHGSGDALLIPRVEWGCGMAHKTIKGGLCPGGRLRAERLRDMVVYNRVDLSKLVTHVYHGFDHIEEALLLMKDKPKDLIKAVVIL

SEQ ID NO: 92922 - protein, 615 aa, Bacillus cereus ATCC 14579
MKGENAMEHHTSVLSLMVVVAIAFFVPLLLQRFKLKALPVVVAEIIAGIFVGKSGFNIIEPDIWLQVLSTLGFIFLMFLSGLEIDFSIFKQKGKKNTTNEPNTFQAASIIFLFIFILSYALSLLFVWLGFVDNAMFMTLIISTISLGVVVPTLKENNLGKTAIGQIILLVAVIADLVTMILLAVFVGLNSESGQSMWLLLLLFGAGIVIYFVAKRFKNIPYLDSLKAGSVQIDTRAVFALILILVGLSESVGAENILGAFLAGVLVSLLSPNEDMVEKLDSIGYGFFIPIFFVMVGVNLEVWSIFKEPSSMLMIPILIVGLFISKLLPSLVLRKWYPRNIVLGSAILLTSTLSLVIAAAQIGEKLEIISPSLSVSLILSAVITCIFAPILFKKMFPKVETPKPKVAIIGASRITLPLSLDLKREDYDVTLYMMRQNKINDEEATSHDFPIVKLDDITIASLTEQTAFDADRVVVATSDDEQNLLLAEHAKELGVEHVIASVEDPLLQEKATQEHIAVFSTINSTRILLRALIDKPSLVRLITTANETVREVELRSNKYNGVALRRLPFLGDVLVIQIYRGNKALIPHGDTRLQHGDTLLVTGSKEHIDTLKNILE

SEQ ID NO: 92923 - protein, 342 aa, Geobacillus kaustophilus HTA426
MKAKVAINGFGRIGRMVFRRAINSPDLDIVAVNASYPPETLAHLVKYDSNHGKFDGEVIALEDGLLVNGKKVRLLNSRDPKQLPWKELDIDIVIEATGKFNDREKASLHLEAGAKRVILTAPGKNEDVTIVVGVNEHMLDIDRHFIISNASCTTNCLAPVVKVLDEAFGIENGLMTTVHAYTNDQKNIDNPHKDLRRARSCAQSIIPTTTGAAKALGLVLPHLKGKLHGMALRVPTPNVSLVDLVVDLKRDVTVDEVNEALIRAANGPLKGILDFTMEPLVSIDFNTNPHSAIIDGLSTMVMEGRKVKVLAWYDNEWGYSCRVVDLAHLVAAKMNERLSVNA

SEQ ID NO: 92924 - protein, 176 aa, Triticum aestivum
  misc_feature (28)..(28): Xaa can be any naturally occurring amino acid
MAPTVMASSATSVAPFQGLKSTAGLPVXRRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 92925 - protein, 354 aa, Chlamydomonas reinhardtii
MANTVPIHDFSNVTELNEEQKRQLSELERAQGVASDAGYRIVAPQPTAKLLSGYTIPLVGLGTWKSAKGEVGAAVATALRAGYRHIDCARIYQNEHEVGEALAAVLAEGVVKREEVFITSKLWNTDHDPARVEAACRKSMEDLRVSYLDLYLMHWPVTGTPGPEVQPPLADTWAAMEQRVDKGLVRTIGVSNFSAKKLEALMARARIQPAVNQVEAHPYWRNEELRSWCAARGVHLTAYSPLGSPDSAAVIGRAADVPSPLKDETVAAVAAELGKSPAQVLIRWAVQRGTSVLPKSVNPQRIAANLEVLVGGWQLAPEQVARLDALPVQRRMVDGSFWVDARGPYRSTAELWDE

SEQ ID NO: 92926 - protein, 381 aa, Burkholderia mallei ATCC 23344
MMRDAANFEPADSRVTRPAFWQALPERWTSDVEETLVCCHVRQETHDVKSFFFRSPQGRAFSFEPGQFVTLELDIDGETINRCYTISSSPARPHTISITVKRVPGGKVSNWLHDNLQPGAPLRVLGPAGEFTCARHPARKYLFLSAGSGITPLMSMSRAHHDLAEDRDIVFVHSARTPDNIIFARELDLIASTHANFRTAFVCERLGARTNWHGVTGFLSLPLLKLVAPDFMEREIFTCGPAPYMKAVRELLAEAGFDRSRYHEESFSFETLAQGEAPADAPAGEDAAARGAQVRQYTIAFAKSHREIACGADQHVFDAARRAGVRLPASCTQGMCGTCKVKLVSGQVDMKHNGGIRQREIDQGMVLLCCSKPLSDLVVDK

SEQ ID NO: 92927 - protein, 500 aa, Rickettsia montanensis
MSTSKSENYLSELRKVIWPIERYENKKFLPMAFMMFCILLNYSTLRSIKDGFVVTDIGAEAISFLKTYIVLPSAVIAMVIYVKLCDILKQENVFYVITSFFLGYFALFAFVLYPYPDLVHPDPETIESWSFAYPNFKWFIRIVGKWSFASFYTMAELWGTMMLSLLFWQFANQITKTDEAKRFYSMFGLLANLALPVTSVIIGYCLHEKTQIVAEHLKFVPLFVIMITSSFLVILTYRWMNKNVLTDPRLYDPALVKEKKAKAKAKMSLIDSFKMIFTSKYVGYIALLLIAYGVSVNLVEGVWKSKVKELYPTKEAYTIYMGKFQFYQGWVAIAFMLIGSNILRKVSWLTAAMITPLMMLITGAAFFAFIFFDSVIAMHLTGILASGPLALAVMIGMIQNVLSKGVKYSLFDATKNMAYIPLDKDLRAKGQAAVEVIGGRFGKSGGAIIQSTFFILFPAFGFVEATPYFASIFFVIVILWIYAVKGLNKEYKVLVNKNEK

SEQ ID NO: 92928 - protein, 286 aa, Ostreococcus tauri
  misc_feature (1)..(1): Xaa can be any naturally occurring amino acid
XSRACTHDLATAMKSWENVDASKRKVMYEGYQGGWYTANTPLGVPVYIERLGMMNAQKLLDCVSEEELYVHRLRMQGYTMKTLLPEMAKRPGVIARDKIVHVIDMKGAGMSLMGNRSVQLFKLLQEIDANFPEFLYRTYVVNVPIGARAVWMTFSAMFPARVRAKIRVLGNTRGSNADKLAVIFGGRDRVPDFLGGSCERRLDECPPWCLKSMKETAFVPWEKNVDLTKLTTAQPASFKNSKSESELSAHSLREMSPALTTSSTEARGDVKRTSSLGRLFSKKKRD

SEQ ID NO: 92929 - protein, 468 aa, Burkholderia mallei ATCC 23344
MSTLETAIAGAPAADAAAGAATPGAIIARIERLPANAMQIRARVLIGTATFFDGFDVITIAATLPLLIHKWGLSPNQIGMLIASGAIGQLLGAFLFPALAQKHGRVRAIAWSSAVIGVTSIACGFASTFETFVLLRIVQGLGLGGELPVAATYINEITRAHGRGRFVLLYEIVFPIGLLASMAFGAWLVPRFGWEVMYFIGGMPLLLALVLTRLVPESPRWLASRGRLDEAGRALHAFEASVKEPLPPVAHAGEFDTLVLSHPKRRMVDLFGPAYLKRTLAVATLWATCGFIQYGLSTWLPTIYKNFYHAPLQLALNLAVIGSVMGVAGSLVSALAVDVVGRKPVIVWSFVLCALSLVFAGVYHASSVYVVAAFCSLALGLMASGFITSYVYTPEQYPTSIRAAGCGLGSAWLKIASFVAPMVVPRAIVGGDLSPAFYLLAAVPLIAALTVHSVGIETKGQVLEKLEA

SEQ ID NO: 92930 - protein, 554 aa, Saccharophagus degradans 2-40
MYVYDEHDHKIIQERVAQFRDQTNRYLAGELKDEEFLPLRLQNGLYIQRLAPMLRIAVPYGLLSATQVRKLAHISRVYDKGYCHMTTRQNVQFNWPNLEDVPDILAELAEVEMHAVQTSGNCIRNVTSDQFAGVATDEIVDPRPYCEIIRQWSTFHPEFAFLPRKFKIAVSGSVDDRAAIHFHDIGLQIVKSENGSVGFKVLVGGGLGRTPVIGSVIREFLAENDLLTYLEAILRVYNLHGRRDNKYKARIKILVKAMGPEEFAKRVEAEWEHIRDSQTLLTDKEIKRAKSFFTAPDYEAIDVQAAEAELANAASENKAFSNWLARNVTAHKVDGYKAVTLSLKPTGIAPGDVTDKQLEIIADLADKYSFGELRATHEQNIVLADVKVSELFNLWQEAKAAGFATANIGTLTDIICCPGGDFCSLANAKSIPIAEAIQREFDDLDYLYDLGDLDLNISGCMNACGHHHIGHIGILGVDKKGAEFYQVQLGGNAGNNAALAKVLGPAFSAEDMPTVVRKLVDVFVEKRVEGEQFFETYNRVGIEPFKERIYAKAS

SEQ ID NO: 92931 - protein, 101 aa, Saccharomyces cerevisiae
MTMNGIPVKLLNEAQGHIVSLELTTGATYRGKLVESEDSMNVQLRDVIATEPQGAVTHMDQIFVRGSQIKFIVVPDLLKNAPLFKKNSSRPMPPIRGPKRR

SEQ ID NO: 92932 - protein, 279 aa, Gluconobacter oxydans 621H
MSSQVPSAEAQTVISFHDGHTMPQIGLGVWETPPDETAEVVKEAVKLGYRSVDTARLYKNEEGVGKGLEDHPEIFLTTKLWNDEQGYDSTLRAYEESARLLRRPVLDLYLIHWPMPAQGQYVETWKALVELKKSGRVKSIGVSNFESEHLERIMDATGVVPVVNQIELHPDFQQRALREFHEKHNIRTESWRPLGKGRVLSDERIGKIAEKHSRTPAQVVIRWHLQNGLIVIPKSVNPKRLAENLDVFGFVLDADDMQAIEQMDRKDGRMGADPNTAKF

SEQ ID NO: 92933 - protein, 227 aa, Neisseria meningitidis FAM18
MELVFIRHGQSEWNAKNLFTGWRDVKLSEQGLAEAAAAGKKLKENGYEFDIAFTSVLTRAIKTCNIVLEESDQLFVPQIKTWRLNERHYGQLQGLDKKQTAEQYGDEQVRIWRRSYDTLPPLLDKDDEFSAHKDRRYAHLPADVVPDGENLKVTLERVLPFWEDQIAPAILSGKRVLVAAHGNSLRALAKHIEGISDKDIMGLEIPTGQPLVYKLDDNLKVLEKFYL

SEQ ID NO: 92934 - protein, 326 aa, Methanosarcina barkeri str. Fusaro
MYQKVLQKFTSLFPLWAVLLSAVAYVYPDYFAPHQGLIVPFLSLIMLGMGITLSVNSFLAVLKRPSAVFLGTLMQYTVMPLIAWIVCLVLKLPSDLAAGVILLGCCPGGTASNVISYLAKADVALSIVLTSVSTLIAFLATPFLTWVLIGQSVEVDVMGMLVSVVKVVIVPVVLGLVINYFFEKQISAIKEVFPAISAAAIVIIIAVIIGTNSANLGKSGPLVLLAVILHNGLGLAGGYGVSKVLGFSETEARTIAIEVGMQNSGLSVALAIKHFTAVAALPGAIFSIWHNLSGAFLAGHWSKQSVSVPDESKMPSKKGIHSKKLG

SEQ ID NO: 92935 - protein, 114 aa, Populus tremula x Populus tremuloides
MAEEGQVIACHTVDTWKEHFEKGKGSQKLIVVDFTASWCPPCKMIAPIFAELAKKFPNVTFLKVDVDELKAVAEEWNVEAMPTFIFLKDGKLVDKTVGADKDGLPTLVAKHATA

SEQ ID NO: 92936 - protein, 325 aa, Ensifer adhaerens
IGGWKAINESDMVLMPDPETAHMDPFFAQSTMVIICDILDPVSGEAYNRDPRGTAKKAEAYLKASGIGDTVFVGPEAEFFVFDDVKYKADPYNTGFKLDSSELPSNDDTDYETGNLGHRPRVKGGYFPVPPIDSCQDMRSEMLTVLSEMGVTVEKHHHEVAAAQHELGVKFDALVRNADKMQIYKYVVHQVANAYGKTATFMPKPIFGDNGSGMHVHLSIWKDGKPTFAGDEYAGLSESCLYFIGGIIKHAKSLNAFTNPSTNSYKRLVPGYEAPVLLAYSARNRSASCRIPFGTNPKAKRVEVRFPDPTANPYLAFAAMLMAGL

SEQ ID NO: 92937 - protein, 165 aa, Aegilops longissima
VMASSATTVAPFQGLKSTAGLPVSRRSSASLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCE

SEQ ID NO: 92938 - protein, 285 aa, Lactococcus lactis subsp. lactis Il1403
MDTKILKLEDFLTEFYESAEFPTGLAESAKYSLLAGGKRIRPLLFLNLLEAFDLELSKAHYHVAAALEMIHTGSLIHDDLPAMDNDDYRRGQLTNHKKFDEATAILAGDTLFFDPFFILSTADLSAEIIVALTRELAFASGSYGMVAGQILDMAGEGKELTLAEIEQIHRLKTGRLLTFPFVAAGIVAQKSTDEVEKLRQVGQILGLAFQIRDDILDVTATFAELGKTPGKDILEEKSTYVAHLGLEGAKKSLTGNLSEVKKLLTDLSVTDSSEIFKIIEQLEVK

SEQ ID NO: 92939 - protein, 406 aa, Oceanobacillus iheyensis HTE831
MIERHTCNNGLRIVHEQIPAVRSVTIGIWVLTGSRNESQQNNGISHFLEHMFFKGTDKRSAQDIAEEFDSIGGQINAFTSKEYTCFYAKVLDTHKEYALEILADMFFNSTFDPEEMEREKKVVLEEIKMYEDTPDDIVHDLLAKASYGTHPLGYSILGTEEQLLSFDSAQLNDYIEHAYSPDRVVISVAGNVDSSFMKTIESSFGSYKGKSNSVEIIKPTFLAESIDRHKDTEQAHLCLGYQGLEQGHPLLYSLTIMNNVLGGSMSSRLFQDVREKQGLAYAVFSYHSTFIDSGLLTIYGGTGKEQLSVLEDTIQLTVDTLIQNGLTDKELRNSKEQLKGGLMLSLESTNSRMSRNGRNELLLKRHRTLDEMIQEIDAVSHETIQQVINEVFKEKAARALIAPKAI

SEQ ID NO: 92940 - protein, 553 aa, Alkalilimnicola ehrlichei MLHE-1
MRRVALVVGLLLCWAGEALATPPPAVASAHPRASAAAMEVMAQGGNAFDAAVTLTATLAVVEPYGSGIGGGGFWLLHRAADGHEVMLDGRETAPGAAYPDMYLDDSGELDRERSLQGGLAAAIPGTPAAMVHLAREYGALPLAESLAPAIRLARQGFQVDSQYRRMALFRVRALNADPEARRIFLRDRIPPPQGSLLRQPDLADSLERIAEHGLAGFYEGPVAEALVAGVRATGGIWTLDDLAGYRVVEREPVRGRMGDLRITAAAPPSAGGVGLVGFLQMLADDDWQALSRADRVHLTSEAMRRVYRDRAAWLGDPDFTEIPMDRLLSAEYARALRAEIDMAQATPSTELPVPVAGGEGRQTTHFSVVDGQGNRVAATLSINYPFGATTVPPGTGVLLNNEMDDFATALGEGNVYGLLGTEPNRIEPGKRPLSSMTPAFLEDECRTLIYGTPGGSRIVTMVMLGALGFLEATPLDELVAAPRYHHQYLPDEIQHEPGAFSRSTRADLQGRGHRLRNVNRRYGDMQALLWDHCEGRLHAASDPRGIGAARVAE

SEQ ID NO: 92941 - protein, 325 aa, Sinorhizobium terangae
ISGWKAINESDMVLMPDPETAHMDPFFAQSTMVILCDILDPVSGEAYNRDPRGTAKKAEAYLKASGIGDTVFVGPEAEFFVFDDVKYKADPYNTGFKLDSSELPSNDDTDYETGNLGHRPRIKGGYFPVPPIDSCQDMRSEMLTVLAEMGVTVEKHHHEVAAAQHELGVKFDALVRNADKMQIYKYVVHQVANAYGKTATFMPKPVFGDNGSGMHVHLSIWKDGKPTFAGDEYAGLSETCLYFIGGIIKHAKALNAFTNPSTNSYKRLVPGYEAPVLLAYSARNRSASCRIPFGSNPKAKRVEVRFPDPSANPYLAFAAMLMAGL

SEQ ID NO: 92942 - protein, 471 aa, Bacillus cereus ATCC 14579
MNQQIEQTDLKRTMKSRHLFMIALGGVIGTGLFMGSGQIVHNAGPGGAILAFLVGGFVMYLTMLCLGELSVAMPEAGSFQSYASKFISPGFGFVVGWMYWLNWAVTVGVELTTVSILMKRWFPDVSSWIWCVTFAAALFLVNALSAKAYAEAEFWFASVKVATIVIFIVLGGAVMFGLLDFNGKPAPMLHNFTENGGLFPNGALAVLLTMITVNYSFQGTELIGIASGESENPEKTIPKAIKNTIWRTLFFFVLAISVVVGLLPWQEANLVESPFVLVFDVAGVPYAADIMNFVIITAVLSVANSGLYANSRMLWAMAKQGMASPAFTKLTKKGVPLNALIFSLIFASLSLLTSVFAADTVFLVLTSIAAMAAVVVWMSIAASQFFFRRNFVKNGGNINDLKYRTPLYPLVPIVAFSLNFITFVSLAFIPDQRIALYCGIPFMIICYILYQVKYKKIVTLEQPRTVIREIN

SEQ ID NO: 92943 - protein, 165 aa, Aegilops searsii
VMASSATTVAPFQGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCE

SEQ ID NO: 92944 - protein, 411 aa, Oceanobacillus iheyensis HTE831
MQVMVQKFGGTSVQSSENREHVIRHIREALVQEYKLVVVVSALGRKPDPYATDSLLGLVDFPTNTNSSRELDLLMSCGEVISSVVLSNELQKNHISAVALTGAQAGFVTNEDFNRAKIKEVNPTRILKELETHDVVVVAGFQGQSESGEITTIGRGGSDTSAAALGVALSAERIEIFTDVEGIMTADPRVVKNARPLDVVTYTEICNLAYQGAKVIHPRAVEIAMQGKIPMRIRSTYSEQLGTLVTSSRVHELGMDIPDRMITGIAHISPVTQIKVQTKESAYRVQSEVFKAMAEAGISVDFINISPTGVVYTVPDTLTTKAIEILEMLGFHPEVTKGCAKVSAVGAGMSGVPGVASKIVQALTDSGVQILQSADSHTTIWVLVHNDDLITAVNALHDVFGLSITEELLES

SEQ ID NO: 92945 - protein, 89 aa, Populus trichocarpa
MDSFSSHSSMGSGSPQISAEDLKDQLKNQLAQAYAQEFLETVREKCFEKCITRPGSSLSGSESSCTSRCVERYIEATGIISRALFSAPR

SEQ ID NO: 92946 - protein, 441 aa, Pseudomonas fluorescens PfO-1
MARLQRTLSLGSVVLFGIAYMTPIIVLGTFGILAQSTAGMVPAAYLAALVAMFFTAMSYGRMAAAFPVAGSAYSYVRKAISPKLGFIAGWAVLLDYLFLPMAIWLIGAAYLASAFPSIPQWIWVLAFIGITSAINIIGLKLANGINALLMLVQFLVLIAFVGLCVHYVGGDASQPLWSIKPFFNGDMQMPLIMSGAAIACYSFLGFDAVSTLTEETRDPRRTIPRAIMLITLIGGLIFVGVSYFVQIAHPSFQFDSVDSAAYEIARNIGGDLFVSIFLIGLIVGQFASGLSAQASGSRLLFAMGRDGVLPKSFFGTLHERFGTPVNSILLCAVVALLALKLDVTTSTSFINFGAFLAFSLVNLSVIFHYWIGGEKKGLRELILFLIFPFIGLAADLWLMVSLDHLAVYLGLSWLAIGVVYLAVLTGGFRRQPPEMDFQEAA

SEQ ID NO: 92947 - protein, 723 aa, Vibrio cholerae O1 biovar eltor str. N16961
MIYQAKTLQVKQLANGIAELSFCAPASVNKLDLHTLESLDKALDALAADSSVKGLLLSSDKEAFIVGADITEFLGLFAKPEAELDEWLQFANRIFNKLEDLPFPTLSALKGHTLGGGCECVLATDFRIGDATTSIGLPETKLGIMPGFGGTVRLPRLIGADSAMEIITQGKACRAEEALKVGLLDAIVDSDKLIDSAITTLTQAIEEKLDWQKRRQQKTSALTLSKLEAMMSFTMAKGMVAQVAGKHYPAPMTSVVTIEEAARLPRDAALDIERKHFIKLAKSTEAQALVGIFLNDQYIKGLAKQSAKAASQDTQHAAVLGAGIMGGGIAYQSALKGVPVLMKDIAPHSLELGMTEAAKLLNKQLERGKIDGFKMAGILASITPSLHYAGIDQADVIVEAVVENPKVKAAVLSEVEGLVDTETILTSNTSTIPINLLAKSLKRPQNFCGMHFFNPVHRMPLVEIIRGEHTSEDTINRVVAYAAKMGKSPIVVNDCPGFFVNRVLFPYFAGFSLLMRDGANFTEIDKVMERQFGWPMGPAYLLDVVGIDTAHHAQAVMAEGFPTRMAKSGREAIDALYEAKKFGQKNGSGFYQYTVDKKGKPKKAFSDDVLAILAPVCGAPQSFDPQTLIERTMIPMINEVVLCLEEGIIASAQEADMALVYGLGFPPFRGGVFRYLDTIGIANYVAMAEKYADLGALYQVPQLLKNMAQQGTSFYSAQQVSAL

SEQ ID NO: 92948 - protein, 1091 aa, Ostreococcus tauri
MIDSPSIASMGENDAHSECSRARRNKRHNSGRHQSKHSWKKHKTSDDASVREMFGARVRAGLKTGLGVGNKRTRAMRARQAREANRASVLAERRHARATPRVTAVLCFNEVEQGAEDVRAFCEGLVRAVRGDGASEGEIEDVVRGMFEDASTPRTATSARHRARASFMLMNPNNALASLEILKACDVLLVVASVTSPEPSEAVARCLPTLKALGIPQTLLALRGLEDVKQAKRQEVKKAMMNLVANEFQMTTDRVKALPASSRAELTELARQTLEIRVDQPRWRLQRPYVLAHRREVVPNAEDDRFATVIVEGYVRGDSGNANQLWNLPGVGDFPVAKIESILEPPEARLNARADKDDTMEGDEVLMTWTRDDSIAQPVMRENEPDEMAGEQTWPTATELQNAELESMRKARPAGMSAYQASWLLDGKGADDEDEADDDDDDADMDDRCAREVPRLRRARDQMRKTRRNLDAAQRDSSKRAMLQDAENEDLKFPDEMDTPDHMPARDRFAKYRGLKSFRSSPWDPKESLPYDYSRVFAFENFRRAHKRALEVREEDAVAGVQVGTYVRITFANVPRVPVIALFEGLGRYKAPNPSECPRGDDGTIGAGVGPSGLMQYESCLSVMNYVVTKSTNYDAPLKSKDALWFHVGWRRERAAPVYNTDNLGDKHKLERFLRARVPTIASVFAPITYGPAPVIAFKETFNAQGVSVDLCLTGSVRDANPDRIILKRVILSAVPFRTHKHKSVARFMFHNPDDIRWFKPLELWTKYGLRGKIVEPVGTHGRMKCIFNNVIHQHDTICATLYKRVYPKFSLSERHIGSGHSSCIIIHKKIEQLELRRASRAPSRALPSEHEPSPPSRRPSDESSTTTRLIIILKLSSVQVPRRSQFLDLLRRHLLPSRLERRPIQLPNLLQAFLIPLLLLHEEDRDSQPRAEAQHRRRRRRERLAVQLQRHLREALRAASRANAALLRKVRARERDARWTADDALRMSAMLKHVLALYVGILFGMYGAYGFDWTMWGSALVNGLAFWMLNSGCEMDLESIGESQRFVLDGFVSSYGLMILTWCGVSAALGRPWFTSEERFPRSFPAFFVH

SEQ ID NO: 92949 - protein, 498 aa, Rickettsia typhi
MSTSKSENYLSELRKIIWPIDQHENKKFLPLAFMMFCILLNYSTLRSIKDGFVVTDIGTESISFLKTYIVLPSAVIAMVIYVKLCDILKQENIFYVITSFFLGYFALFAFVLYPYPDLVHPDHKTIESLSLAYPNFKWFIKIVGKWSFASFYTIAELWGTMMLSLLFWQFANQITKITEAKRFYSMFGLLANLALPVTSVVIGYFLHEKTQIVSEHLKFIPLFVIMITSSFLIILTYRWMNKNVLTDPRLYDPTLVKEKKAKAKLSFIESFKMIFTSKYVGYIALLIIAYGVSVNLVEGVWKSKVKELYPTKEAYTIYMGQFQFYQGWVAIAFMLIGSNILRKVSWLTAAMITPLMMFITGAAFFSFIFFDSVIAMNLTGILASSPLTLAVMFGMIQNVLSKGVKYSLFDATKNMAYIPLDKDLRVKGQAAVEVIGGRLGKSGGAIIQSTFFILFPAFGFIEATPYFASIFFIIVILWIFAVKGLNKEYQVLVNKNEK

SEQ ID NO: 92950 - protein, 255 aa, Zea mays
RYYDPKTVGLDFEGMIADIEAAPEGSFVLLHGCAHNPTGIDPTPEQWEKIADVIQEKKHMPFFDVAYQGFASGSLDEDAFSVRLFVKRGMEVFVAQSYSKNLGLYSERVGAINVVCSAPEVADRVKSQLKRLARPMYSNPPIHGAKIVANVVGDPTMFGEWKQEMELMAGRIKNVRQKLYDSLSAKDKSGKDWSFILRQIGMFSYTGLNKAQSDNMTDKWHIYMTKDGRISLAGLSLAKCDYLADAIIDSFHNVN

SEQ ID NO: 92951 - protein, 507 aa, Rickettsia montanensis
MDSVDSHFAIWNKARNSKFRHIVWPIRSYELTKFIPMALLMFFILLNQNLVRSIKDSFVVTLISSEVLSFIKLWGEMPMGILFVIFYSKLCNIMTTEQVFRIITGTFLFFFAIFGFILFPYREFFHPDPELIKYYITVLPHLKWFLIIWGQWSLVLFYIMGELWPVIVFTLLYWQLANKITKVEEAPRFYSFFTLFGQTNLLISGTVIIYFAKSEHFLLPLFSHLNDTNEILLKSFITVILISGLICLALHKLIDKSVVEADKNIKFKNQRTDILKLSLIESAKVIFTSRYLGFICLLVMSYSMSISLIEGLWMSKVKQLYPTTKDFIAYHGKVFFWTGILTLVSAFLGSSLIRICGWFWGAIITPIMMFGAGVMFFSFTVFENHLGNIVNTLGYSTPLVVIVFIGGLWHVLSKSVKYSLFDATKEMVYIPLDSEMKTKGKAAVDVMGAKIGKSIGAIIQFISFSIFPNAVHNDIAGLLMFSFIIVCLLWLYGVKVLSKYYNKMIKR

SEQ ID NO: 92952 - protein, 587 aa, Geobacillus kaustophilus HTA426
MKRKTKIVCTIGPASESVDKLVQLIEAGMNVARLNFSHGDHEEHGRRIANIREAARRTGQTVAILLDTKGPEIRTHNMENGAVELKEGAKLIISMSEVLGTPEKISVTYPGLIDDVSVGSKILLDDGLIGLEVNAVDKQAGEIATTVLNTGVLKNKKGVNVPGVRVNLPGITEKDRADILFGIRQGIDFIAASFVRRASDVLEIRELLEANDALHIQIIAKIENEEGVANIDEILEAADGLMVARGDLGVEIPAEEVPLIQKMLIKKCNMLGKPVITATQMLDSMQRNPRPTRAEASDVANAIFDGTDAVMLSGETAAGQYPVEAVRTMHQIALRTEQALEHRDILSQRTKESRTTITDAIGQSVAHTALNLDVAAIVTPTVSGKTPQMVAKYRPKAPIIAVTSNEAVSRRLALIWGVYTKEAPHVNTTDEMLDVAVDAAVRSGLVKHGDLVVITAGVPVGETGSTNLMKVHVISDLLAKGQGIGRKSAFGKAVVAKTAEEACRKMVEGGILVTISTDADMMPAIEKAAAIITEEGGLTSHAAVVGLSLGIPVVVGVENATSLFKDGQEITVDGGFGAVYRGHASVL

SEQ ID NO: 92953 - protein, 467 aa, Vibrio cholerae O1 biovar eltor str. N16961
MATGKIVQIIGAVVDVEFPQSEVPSVYDALNVVDSKERLVLEVQQQLGGGVIRAIVMGSSDGLRRGMTVQNTGAPISVPVGTKTLGRIMNVLGDAIDERGDIGAEEVYSIHRPAPSYEEQSSATELLETGVKVIDLICPFAKGGKIGLFGGAGVGKTVNMMELINNIALQHSGLSVFAGVGERTREGNDFYHEMQEAGVVNVEQPELSKVAMVYGQMNEPPGNRLRVALTGLTMAEKFRDEGRDVLLFIDNIYRYTLAGTEVSALLGRMPSAVGYQPTLAEEMGVLQERITSTKKGSITSVQAVYVPADDLTDPSPATTFAHLDATVVLNRNIAAMGLYPAIDPLDSTSRQLDPLVVGQEHYDVARGVQATLQRYKELKDIIAILGMDELSEADKQVVARARKIERFLTQPYHVAEVFTGDPGVYVPLKETLRGFKGLLAGDYDDIPEQAFMYCGTIDDAIENAKKL

SEQ ID NO: 92954 - protein, 507 aa, Rickettsia rickettsii
MKIVDSNCTIWNKARNSKFRDIVWPIRSYELTKFIPMALLMFFILLNQNLVRSIKDSFVVTLISSEVLSFIKLWGEMPMGILFVIFYSKLCNIMTTEQVFRIITSTFLFFFTIFGFILFPYRDFFHPDPELIKHYITVLPHLKWFLIIWGQWSLVLFYIMGELWPVIVFTLLYWQLANKITKVEEAPRFYSFFTLFGQTNLLISGTVIIYFAKSEHFLLPLFSHLNDTNEILLKSFITVILISGLICLALHKLIDKSVVEADKNIKFKNQRTDILKLSLVDSAKIILTSRYLGFICLLVMSYSMSISLIEGLWMSKVKQLYPATKDFIAYHGKVFFWTGILTLVSAFLGSSLIRICGWFWGAIITPIMMFGAGVMFFSFTVFENHLGNIVNTLGYSAPLVVIVFIGGLWHVLSKSVKYSLFDATKEMVYIPLDSEMKTKGKAAVDVMGAKIGKSIGAIIQFISFSIFPNAIHNDIAGLLMFSFIIVCLLWLYGVKVLSKYYNKMIKR

SEQ ID NO: 92955 - protein, 90 aa, Zea mays
  misc_feature (64)..(64): Xaa can be any naturally occurring amino acid
MPNVKSAGGAGASAIPAGGDGEVEAGFAKLQGEDFEYYMQTYSIMLGRNSKKSTVDVDLSSLGXGGMNISRHHARIFYDFQRRRFRARRH

SEQ ID NO: 92956 - protein, 507 aa, Rickettsia typhi
MNIVDSNCTIWHKARNSKFRHIVWPIRSYELTKFIPMALLMFFILLNQNLVRSLKDSFVVTLISSEVLSFIKLWGEMPMGVLFVILYSKLCNIMTTEQVFRIITGTFLFFFTIFGFILFPYKEFFHPDPELINQYITVLPHLKWFLIIWGQWSLVLFYIMGELWPVIVFTLLYWQLANKITKVEEAPRFYSFFTLFGQTNLLFSGTVIIYFAKSEHFLLPLFAHLNDTNEILLKSFITVILLSGLICLALHKLIDKSVVEADKNIKFKNQRTDILKLSLIESAKIILTSRYLGFICLLVMSYSMSINLIEGLWMSKVKQLYPATKDFISYHGEVLFWTGVLTLVSAFLGSSLIRIYGWFWGAIITPIMMFVAGVIFFSFTIFENHLGNIVNTLGYSSPLVIIVFIGGLWHVFSKSVKYSLFDATKEMVYIPLDNEIKTKGKAAVDVIGAKIGKSIGAGIQFISFSIFPNAVHNDIAGLLMFTFIIGCILWIYGVKVLSQYNNKMIQN

SEQ ID NO: 92957 - protein, 388 aa, Saccharophagus degradans 2-40
MEGGVFESFFLIFCGAAVVASVALYTRQPLLVAYIAVGAILGPFGLEIIKDVHYVAEMSHIGIIFLLFLLGLDMQPSALLNVLKKATSIALISSAIFGALGYGFGVIIGFSHMESLVLAMASMFSSTIIGIKLLPTTVLHHKHSGDLMVGLLLFQDFIAILCLLVLLSGGGDTVEPMKLIKAIAALPLLAAGAFLFVRFVLLKLIQKFDRFHEYIFLLAIGWCLGLAHLSESVNLSAEIGAFIAGISLATSPISQYIALNLRPLRDFFLVLFFFALGAQLNIPLLPSVLLPALIFAAVVLAAKPTVFFLLLKQQSEKTSLAWDLGFRLGQISEFSILIVFVAATNNLIGEQASLLIQTTAILTFIVSSYIVIFNFPNPIAVSDKLRRD

SEQ ID NO: 92958 - protein, 381 aa, Ostreococcus tauri
  misc_feature (1)..(1): Xaa can be any naturally occurring amino acid
XTRRRDLLAGGVGVGASVWLPGSAEARVDASRANARAVPTTETPLRGTRLTPSRVIKGCWQLSGGHGGDRDSDRTKGDAAVEDFERFVEAGVTTFDTGPEACGYGPSELIIGEYLKSPAGRRRANEVKVFTKLCCVGREQYGMTKEWVEANVDRPRKRLGVDKLNMVQMYWNDYGSKGYVDAALYLTDLKHKGKIDAVVAHEISTRNASQTWWILGGISTNQIQYSLLDRRPEKYMTKYCKDTGIGLLPYGVVAGGLLADKYLDAPKGEFRINTSSLRKYSSVLAEVGGFEWYQSLLKTLRAVGDKHGGASISNVASKWVLDSPVVPAIIIGARNASHIDDHRALFDFDLDDSDRRDIESVLEKGYQAKEDAYTWERGGRW

SEQ ID NO: 92959 - protein, 501 aa, Rickettsia montanensis
MLPPKIFFKKIKEIMWPIERKELKLFIPMALMMLCILFNFGALRSIKDSLVVPSMGAEIISFLKLWLVLPSCVIFTVLYVKLSNKLNFEYIFYIIVGSFLLFFLLFAYIIYPNQDIYHPNDKMINNLIASYPNFKWFIKIGSQWSYALMYIFAELWSAVVINLMFWQFANHIFDTSKAKRFYPVLGMVGNIGLIIAGSVLVFFSSGQDVIDSELLPDSFNSSAGNAIMLQPIMSIIVTAGIIAMLLFRIINRFILTDSINVLDAKKVTVKMKTKLSVIESIKLVIHSKYIGRIALLIICYGLLINIVEGPWKAKIKELHPNTIDYVNFMGRFNIWMGISCVTFMIIGSNILRRLGWLISALLTPIMLSITGLMFFIFIIFIEEIGACFCDFNLLYAAIIVGAIQNILSKSSKYSLFDSTKEMAYIPLSLELRTKGKAAVEVIGTKFGKSLGAFIQSLIFIIIPKTTFDSIIIYLLVTFIVMMSLWIWNVIKLNKEYIKLCQ

SEQ ID NO: 92960 - protein, 531 aa, Brassica napus
  misc_feature (209)..(209): Xaa can be any naturally occurring amino acid
MASSCLSFNASLSSLSPNQDLFRRHPSSPLLRHRPVLVSCTSPADGNNTTTPIETITKPRRTENTIRDDARLQRSTAANPFSARYVPFNAPPGSSEHYSLDEIVYRSRSGGLLDVEHDMEALKRFDGAYWRDLFDSRVGKSTWPYGSGVWSKKEWVLPEIDDDDIVSAFEGNSNLFWAERFGKKFLGMNDLWVKHWGISPIPESFKDLXGIEPVLVSQVNRLRKMKRPVVGVGCASTGDTSAALSAYCASAGIPSIVFLPANKISMAQLVQPIANGAFVLSIDTDFDGCMKLIREITAELPIYLANSLNSLRLEGQKTAAIEILQQFDWQPPEWVIVPGGNLGNIYAFYKGFKMCQELGLVDRIPRLVCAQAANANPLYLHYKSGWKDFKPMTASTTFASAIQIGDPVSIDRAVYALKQCDGIVEEATEEELMDAMAQADSTGMFICPHTGVALTALFKLRKQGVIAPTDRTVVVSTAHGLKFTQSKVDYHSKAIPDMACRFSNPPVEVKADFGAVMDVLKSYLGSQKLRS

SEQ ID NO: 92961 - protein, 370 aa, Zea mays
  misc_feature (254)..(254): Xaa can be any naturally occurring amino acid
  misc_feature (299)..(299): Xaa can be any naturally occurring amino acid
MEDLSVEELASNLSTYKEQLREVKKLIKEKKDDAGISEYIDMEKELQEVITLTEEILATAKQTESAQNVAGLSPPSYSAGVQSEGLDDLSHSHKFAVGTRVQAVWSEDGEWYNATVEALTPNGYYVAYDGWGNSEEVDPDNVRLLGEEAADALGQAEKEAEATKMAIKRKIEQAATSDFQARSLPAKLRIEPSDPEDVKAAKRKKIHAFKSKSRFEQLEFAQNKRQNAWQQFQTKGKAKKVASWPPRNFFLLSXKWLGTLPLSWNSESQGTTYGHPQHSCYDGGPKWNKLSDLSQHSSXSRNRLCEFRWFVCQVGFFSGRKKESIFKSPDDHRGKVGVTGSGKGLTDFQRREKHLHLKGGSGDAADDDEE

SEQ ID NO: 92962 - protein, 326 aa, Coccidioides immitis RS
MPIGSYPAVLGHEGVGIVRQVGSQAQDKSLKEGDTVLLGFRTCRKCPSCLEGRCGACPRMTEYNFMSARLGEGAKPIYSLTDGTPVHGQFFGQSSLSKMAIVAEQSVVKCDVDADSLQYLPPLGCGYLTGAGTIFNVLQPKPTSTVAILGMGAVGVAALLAAKAMGVRQIIAVDIVDSKLDLAVSLGATHTINTKQVPDLCTGIRNLLPDGVDQIVDTTGVSPLLQASMKALGHEGVLALVGVPRPGDSIQVDALDLLVSCKRVVGVIEGFADPKELIPRLVKLYREGNFAIDRISTVYAAERLDEAMEDLKAGRVIKPVLSWDGI

SEQ ID NO: 92963 - protein, 362 aa, Saccharomyces cerevisiae
MRSLNTLLLSLFVAMSSGAPLLKIREEKNSSLPSIKIFGTGGTIASKGSTSATTAGYSVGLTVNDLIEAVPSLAEKANLDYLQVSNVGSNSLNYTHLIPLYHGISEALASDDYAGAVVTHGTDTMEETAFFLDLTINSEKPVCIAGAMRPATATSADGPMNLYQAVSIAASEKSLGRGTMITLNDRIASGFWTTKMNANSLDTFRADEQGYLGYFSNDDVEFYYPPVKPNGWQFFDISNLTDPSEIPEVIILYSYQGLNPELIVKAVKDLGAKGIVLAGSGAGSWTATGSIVNEQLYEEYGIPIVHSRRTADGTVPPDDAPEYAIGSGYLNPQKSRILLQLCLYSGYGMDQIRSVFSGVYGG

SEQ ID NO: 92964 - protein, 472 aa, Shewanella sp. MR-4
MKNILPVIMAGGSGTRLWPLSRGNFPKQFLSLSGNATMLQNTISRLNGIEHAPAMLICNEEHRFIAAEQVRLLGVKHNGILLEPVGRNTAPAIALAAFKAVELGQDPLLLVLAADHVIEDVAAFQQSVSKAAELAATGKLVTFGIVGDKPETGYGYIKRGDACQHGYVVDCFVEKPNLATAEVYVSSGDYYWNSGMFLFKASRYLDELRVYRPDIYAACELAMQVQNNDSDFIRIDKAAFEACPDDSIDYAVMEQTKDAVVVPMDAGWSDVGGFAALWEVSGKDADGNVFNGDVKAVDTKNTLVFGGNKLITTVGVEDLVIVNTKDAVLVAHKDQSQHVKAIVGQLKAEQRSEVTFHREVYRPWGKYDSIDNGDRFQVKRITVKPGAKLSVQMHHHRAEHWIVVSGTAKVTNGDKDILLTENQSTYIPVGVIHALENPGKVDLELIEVQSGSYLGEDDIVRFEDRYGRVEGK

SEQ ID NO: 92965 - protein, 157 aa, Bacillus halodurans C-125
MIRVGQGFDVHQFAEGRLLIIGGVEIPYEKGLLGHSDADVLLHTIADAALGAIGEGDIGKHFPDTDPHFKDADSAKLLSAVWELVKEKGYTLGNVDCTIIAQKPKMAPHIPAMRARIAELLEAEEAQVNVKATTTETLGFTGRGEGIASQAVILLVK

SEQ ID NO: 92966 - protein, 487 aa, Staphylococcus epidermidis
MKKFNIKHSFMLTGFAFMVTTSLFSHQAHAEGNHPIDINFSKDQIDRNTAKSNIINRVNDTSRTGISMNSDNDLDTDIVSNSDSENDTYLDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSGTSSGKGSHTGKKPGNPKGNTNRPSQRHTNQPQRPKYNQTNQNNINNINHNINHTRTSGDGAPFKRQQNIINSNSGHRNQNNINQFIWNKNGFFKSQNNTEHRMNSSDNTNSLISRFRQLATGAYKYNPFLINQVKNLNQLDGKVTDSDIYSLFRKQSFRGNEYLNSLQKGTSYFRFQYFNPLNSSKYYENLDDQVLALITGEIGSMPELKKPTDKEDKNHSAFKNHSADEITTNNDGHSKDYDKKKKIHRSLLSLSIAIIGIFLGVTGLYIFRRKK

SEQ ID NO: 92967 - protein, 388 aa, Shewanella sp. MR-4
MKIAIAGTGYVGLSNAVLLAQYHQVTAVDVIAGKVELINARKSPIVDAEIEEYLAQRELNLTATLDKQLAYEDADFVIIATPTDYDPKTNYFNTSTVESVIQDVLAINPNAVMVIKSTVPVGFTAKVKQKFQCENILFSPEFLREGKALYDNLHPSRIIVGERSERAKIFADLLVQGAVRKDIEVLFTDSTEAEAVKLFSNTYLAMRVAYFNELDTYAETHGLDSRQIIEGVCLDPRIGNHYNNPSFGYGGYCLPKDTKQLRANYADVPNSIIGAIVESNTTRKDFIADSILSRNPKVVGIYRLIMKSGSDNFRASSIQGIMKRLKAKGIEVIVYEPVLKEKEFFHSRVVTDLTAFKAVADVIVSNRMAKELADVADKVYTRDLFGSD

SEQ ID NO: 92968 - protein, 229 aa, Bacillus halodurans C-125
MKRIFKTLLNDIDVVFEQDPAARSRLEVIFTYSGVHAIWAHRLAHWLWRKKLYFVARFLSQVSRLITGIEIHPGAKIGQRLFIDHGMGVVIGETCEIGDNVTIYQGVTLGGTGKEKGKRHPTVEDHVLIASGAKVLGSFTIGKNSRIGAGSVVLNEVPPNSTVVGIPGKVVIRDGIKVNRDLDHHLLPDPVSDKFRELEKQLEALQKEIEELRKNNLPKSASNHSVKEG

SEQ ID NO: 92969 - protein, 573 aa, Coccidioides immitis RS
MDGDDIRHAAVSSPEHLSSLPFAANGTPGKKRRKADLKPIITNDPPSAAAAANPSSTSINMTSSQSSNPLASAQYPVSTTYASPLSRSPSSSSSAEDLAETAADEEDSEDYCKGGYHPVQVGETYNNGRYVVIRKLGWGHFSTVWLSRDTTTGKHVALKVVRSAAHYTETAIDEIKLLKRIVDARPDHPGRKHVVSLLDSFEHRGPNGVHVCMVFEVLGENLLGLIKRWNHRGIPMPLVKQITKQVLLGLDYLHRECGIIHTDLKPENVLIEIGDVEHIVKTYVKEEEAQKEKDNHRNGRRRRRTLITGSQPLPSPLNTSFSAADPFKAHTPTLSSHSSLNQVLQEPTEAKREDNREVSGITLETGSTPEVDDPQVDLISVKIADLGNACWVGHHFTNDIQTRQYRSPEVILGAKWGASTDVWSMAAMVFELITGDYLFDPQSGTKYGKDDDHIAQIIELLGSFPKSMCLSGKWSQEIFNRKGELRHIHRLRHWALPDVLREKYHFPAEESKAISDFLLPMLELVPDRRANAGGMANHPYLKSTKGMDHIQLNVPVGSRGEGIAGWASEVKKR

SEQ ID NO: 92970 - protein, 165 aa, Triticum timopheevii subsp. armeniacum
VMASSATTVAPFQGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNLRQVQCVSFIAFRPPGCE

SEQ ID NO: 92971 - protein, 196 aa, Escherichia coli W3110
MSYYAFEGLIPVVHPTAFVHPSAVLIGDVIVGAGVYIGPLASLRGDYGRLIVQAGANIQDGCIMHGYCDTDTIVGENGHIGHGAILHGCLIGRDALVGMNSVIMDGAVIGEESIVAAMSFVKAGFRGEKRQLLMGTPARAVRNVSDDELHWKRLNTKEYQDLVGRCHVSLHETQPLRQMEENRPRLQGTTDVTPKR

SEQ ID NO: 92972 - protein, 331 aa, Gluconobacter oxydans 621H
MSKKVPLSPAPFEGYAAPRGHVFNSFLETVGGTPLVALPHLTQREHLNGRLLLKLEFFNPLGSVKDRIGVAMLRDAEARGLITPGRTVLIEPTSGNTGISLAFAAVALGYRLIVTMPENASTERRKMLRLMGADTELTPASRGMAGAIERAEQLNRTLPDAWMPSQFENDANPAVHEATTAREIWEDTAGKVDMVVAGLGTGGTASGIAHGLKKHRKSIKVYGVEPRESAVLHGDEPGPHGIQGIGPGFEPDTLDLKALDGVFEVSEQEAVATARLCAAVEGIPIGISSGAALFAGMELARKPSSRGKTIVAIVPSFAERYLSTQLFDGLA

SEQ ID NO: 92973 - protein, 325 aa, Mesorhizobium loti
IAGWKAINESDMVLMPDPETVHMDPFFAQSTMVILCDILDPVSGESYNRDPRGTAKKAEAYMKAEGIGDTIFVGPEAEFFVFDDVKYKADPYNTGFKLDSTELPSNDDTDYETGNLGHRPRVKGGYFPVPPIDSAQDMRSEMLTVLAEMGVRVEKHHHEVAAAQHELGIKFDALVRNADKMLIYKYVVHQVANAYGKTATFMPKPIFGDNGSGMHVHMSIWKNGKPTFAGNEYAGLSESCLFYIGGIIKHAKAINAFTNPLTNSYKRLVPGYEAPVLLAYSARNRSASCRIPFGSSPKAKRVEIRFPDPGANPYLGFAALLMAGL

SEQ ID NO: 92974 - protein, 428 aa, Methanosarcina barkeri str. Fusaro
MSYIGLQQDSGEYKIQKIHAREILDSRGNPTVEVDVFTPKGFGRAGVPSGASTGTNEALELRDADPNRYGGKGVLTAVKNVNTIIQKELLGLDVRNQREIDELMIELDETDNKSNLGANAILGVSMAVARAAADSLNVPLYRYLGGSNAFTLPVPTMNVLNGGKHAGNDLAIQEFMIQPKGAETFYEALQIGAEIYHVLGKILEKKYGRSSTNVGYEGGYAPKMSESTEALDALAQAIEEAGYTDTEVTIGLDAAASEFYEDEAYAIDGKKLSAPELMDYYVELVNSYPILSIEDPFYEEAFEDFEALTNELWDTIIVGDDLFVTNIERLSKGVDMGAANALLLKVNQIGTISEAFDAANMASRNGYTVIVSHRSAETEDTTIADISVAIGAEMIKTGAPARGERTAKYNQLLRIEEDLGEVAHYVQL

SEQ ID NO: 92975 - protein, 2121 aa, Coccidioides immitis RS
MGLPEIAHDSIIEEEQPYVYSEYKSEKGYGWAEALPQRQGLYDPELEKDACGVGFTAHIKGKPSHKIITDARYLLCNMTHRGAVGSDARDGDGAGVMTSIPHKFFIKHFARDVGVELPPLGQYAAGNLFFKPDPEALKESKAIFEDLARSLDLRVLGWREVPRDSTLLGPAALSREPYIIQPFVVLHSAYGDGSTPDRRHAELFDERTFERQLYVLRKRATHVLGLANWFYICSLSNKNIVYKGQLAPIQVYEYYHDLLSVDYEGHFALVHSRFSTNTFPSWDRAQPLRWAAHNGEINTLRGNKNWMRAREGVLRSDIFGDELEHLYPIVEEGGSDSAAFDNVLELLTINGVLSLPEAVMLMVPEAWQDNPAMDSKKAAFYEWAACLMEPWDGPALFTFSDGRYCGANLDRNGLRPCRYYVTDDDRIICASEVGTIAIDPERVIEKGRLQPGKMLLVDTAAGRIIDDRELKRTVANRQPFQDWIETHLLSLPKIHKKAAEKGSLAPALDDTTIQQDPRLKAFSYSFEQVSLLLGPMAADSKEALGSMGNDAPLACLAQQPRLLYEYFRELFAQVTNPPIDPIREAIVMSLECYVGPQGNLLEIDPSQCDRLHLPSPILSIDEFNALKMLPTLHREWTVKTIDITFEKSKSIQGYIDALDDICAAATEGIANGDRILVLSDRATSADRVAVSALLATGLVHHHLVRNKWRSLAAIVVETAEAREVHHMCVLVGYGADAICPYLAMECILKMNRENLIRKELSDEQVITNYKASCDGGILKVMSKMGISTLQSYKGAQIFEALGIDDSVIDRCFAGTPSRIRGMTFKQIAQDAFAFHERGYPTRQITQIPGLPESGEYHWRDGGEAHINDPVSIANIQDAVRTKNDKSYEAYARSEHEQIRNCTLRGLLDFDFEQRTPVPIEQVEPWTEIVRRFVTGAMSYGSISYESHSTLAVAMNRLGGKSNTGEGGENAERSKILENGDTMRSAIKQIASGRFGVTSAYLADADELQIKMAQGAKPGEGGELPGSKVTGPIAQTRRSTPGVGLISPPPHHDIYSIEDLKQLIYDLKCSNPQARVSVKLVSEVGVGIVASGVAKAKADHILISGHDGGTGASRWTGIKYAGLPWELGLAETHQTLVLNDLRGRVIVQTDGQLRTGRDVAIACLLGAEEWGFATAPLIAMGCIMMRKCHLGTCPVGIATQDPALREKFEGTPEHVINFFYYVANELRAIMAKLGMRTINEMVGRAELLRIRDDLPSPKLENIDLSLILTPAHSLRPGVATYSVRKQDHRLHVRLDNKLIAEAELALEKGLPCRVECDIVNTDRAMGATLSYHVSKRYGDTGLPQDTIHANIKGSAGQSFGAYLAPGITLELEGDANDYVGKGLSGGRLIVYPPRGAVFKAEENIIIGNVCLYGATGGSCYFRGVAAERFAVRNSGATAVVEGVGDHGCEYMTGGRVLILGSTGRNFAAGMSGGIAYVLDVNGDFHTRVNTEMVELSGIEDPAEVASVRSLIEDHHHYTGSEIAARILSDFTRALSHFVKVLPTDYKRVLEEEATKKAGAKKIAFTPAQSPNLASKEHREEAKKSDILDIEDSITDSKTEKKRTTLILDKTKGFMKYHRRNEKYRSSKTRTRDWAELSQRLNEDELKYQSARCMDCGVPFCQSDTGCPISNIIPKWNELVFQNQWQDALNRLLMTNNFPEFTGRVCPAPCEGACVLGINEDPVGIKSIECAIIDRGFEMGWMVPKPPPVRTGKTVAVIGSGPAGLAAADQLNRAGHSVVVYERADRIGGLLMYGIPNMKLDKKIVQRRVDFMAAEGIKFVASTPVGPDCDVTLQSLRKGNDAVIIATGATVARDLKIPNRELQGIHFAMEFLHKNTKSLLDSELADGAYISAKGKNVIIIGGGDTGNDCVGTSVRHGAKSVTNFELLPQPPPERAGDNPWPQWPRVYRVDYGHSEVKAHFGQDPREYCVMSKEFVGDEHGNVKGINITRVEWTRSASGGWDMKTVEGSEQFFPADLVLLSMGFLGPEERVLGSEVELDARKNIKTPAGQYSTNVPGVFAAGDCRRGQSLIVWGINEGRQAAREVDSYLMGSSSHLPVTGGIVRRSAIDSVPVTPQPQVQPVFA

SEQ ID NO: 92976 - protein, 473 aa, Pseudomonas fluorescens PfO-1
MPVGNHPPHGETAQGGPLKRELGERHIRLMALGACIGVGLFLGSAKAIEMAGPAIMLSYIIGGLAILVIMRALGEMAVHNPVAGSFSRYAQDYLGPLAGFLTGWNYWFLWLVTCVAEITAVAVYMGIWFPDVPRWIWALAALVSMGSINLIAVKAFGEFEFWFALIKIVTIIAMVLGGIGIIAFGFGNDGVALGISNLWAHGGFMPNGVTGVLMSLQMVMFAYLGVEMIGLTAGEAKNPQKTIPNAIGSVFWRILLFYVGALFVILSIYPWNEIGTQGSPFVMTFERLGIKTAAGIINFVVITAALSSCNGGIFSTGRMLYSLAQNGQAPAGFARTSSNGVPRRALLLSIFALLLGVLLNYLVPEKVFVWVTSIATFGAIWTWVMILLAQLKFRKGLSASERAGLKYKMWLFPVSSYLALAFLVLVVGLMAYFPDTRVALYVGPAFLVLLTVLFYVFKLQPKDSVQGAMRSAS

SEQ ID NO: 92977 - protein, 323 aa, Mesorhizobium mediterraneum
GWKAINESDMVLMPDTETVHMDPFFAQSTMVILCDILDPISGESYNRDPRGTAKKAEAYMKAEGIGDQIFVGPEAEFFVFDDVKYKADPYNTGFKLDSTELPSNDDTDYETGNLGHRPRIKGGYFPVPPIDSAQDMRSEMLTVLAEMGVRVEKHHHEVAAAQHELGIKFDTLVRNADKMLIYKYVVHQVANAYGKTATFMPKPVFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFPDPGANPYLAFAAMLMAGL

SEQ ID NO: 92978 - protein, 260 aa, Triticum aestivum
  misc_feature (10)..(10): Xaa can be any naturally occurring amino acid
  misc_feature (41)..(41): Xaa can be any naturally occurring amino acid
  misc_feature (53)..(53): Xaa can be any naturally occurring amino acid
AFFSLKPIFXRPRDSDQPPGVVFPGHPPMRFPDARPQLFKXAPKSVRDLYEIXASTNYTGKPTVPVLWDKQLKTVVNNESSEIIRMLNAEFNDIAENPGLDLNPAHLQVSIDEVNGLVYDAINNGVYKCGFAKKQGPYDEAVTTLYEALDKCEEILGKQRYMCGNQLTEADVRLFVTLIRFDEVYAVHFKCNKKLLREYPNLFNYTKDIYQIPGINSTVNMEHIRKHYYGSHPSINPYGIIPQGPNIDYNAPHDRERLFL

SEQ ID NO: 92979 - protein, 325 aa, Bradyrhizobium japonicum
IAGWKAINESDMCLMPDPVTATIDPFFAETTMVITCDVLEPTTGEPYNRDPRGIAKKAEAMVKSMGVGDSVFVGPEAEFFVFDDVRFSSSPYNTGFRLDSSELPTNTDTEYEGGNLGHRIRTKAGYFPVPPQDSVQDMRSEMLGAMAKMGVKVEKHHHEVASAQHELGMKFDTLTLMADHLQIYKYCIHQVAHIYGKTATFMPKPVYGDNGSGMHVHQSIWKDGKPVFAGNKYADLSETCLHYIGGIIKHAKAINAFTNPSTNSYKRLVPGYEAPVLLAYSARNRSASCRIPYTASPKAKRVEVRFPDPLANPYLGFAAMLMAGL

SEQ ID NO: 92980 - protein, 165 aa, Secale cereale
MMASSATTVAPFQGLKSTAGLPVSRRSSGSLGNVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCE

SEQ ID NO: 92981 - protein, 223 aa, Streptococcus pyogenes M49 591
MDLLTNKKKIFETIRLSTEAANRTNDSVSVIAVTKYVDSTIAGQLIEAGIEHIAENRVDKFLEKYDALKYMPVKWHLIGTLQRRKVKEVINYVDYFHALDSVRLALEINKRADHPVKCFLQVNISKEESKHGFNISEIDEAIEEMGKMEKIQLVGLMTMAPANASKESIITIFRQANQLRKNLQLKKRKNMPFTELSMGMSNDYPIAIQEGSTFIRIGRAFFH

SEQ ID NO: 92982 - protein, 283 aa, Oenococcus oeni PSU-1
MVLSRSVPNIVLNDGHSLPAIGLGTYLVRGGQGVDQILSAIEDGYRLIDTSTNYDSEGAVGEAIRRSGIPRSEFIVTSKLPGKYHHYQDALMMIQESIFRMGIDYLDLYLIHWPLPKRDHYVKAWKALVDAQKLGLIRSIGVSNFLPEHLDRIINESGVTPAVNQIEVHPYWVQEDMLAANKSRGIVSEAWSPLGRGSAALKEDIIKNLADKYGKNTGQIILRWHTQRGIIPLPKSSSLIHQRSNIDIFDFSLTSSEIEQINALNRSDGRVDGQDPNTYEEFD

SEQ ID NO: 92983 - protein, 192 aa, Oceanobacillus iheyensis HTE831
MNLPNKLTFSRILMIPIFILLLSIPFPWGAWDIGNSELPVAHFLAALIFIIAAATDWVDGYYARKYQLVTNLGKFMDPLADKLLVSAALILLVEMEIAPAWIVIIIISRELAVTGLRLVAAGEGIVLAAGSMGKLKTATQMISIAVLLLHNFPFSYIDFPFGIIMLYIALIFTIISGVDYFIKNWHVMRDSK

SEQ ID NO: 92984 - protein, 139 aa, Bacillus cereus ATCC 14579
MTRVRDLMSTHIVHCTPLDNVYEAAVKMKEESIGLIPVVENEQVVGLVTDRDLVVRGIAEKHPGSNKITNVMTTNIISVSPNDSIEKATELMAQHQIRRLPVVDSGQLIGMLALGDLAIRESADDQAGFALSEISERTE

SEQ ID NO: 92985 - protein, 496 aa, Burkholderia mallei ATCC 23344
MTAFDSSLVPSGDILIGGEWRRGRGATTPSFYPADGSLNTEIHMADAADAREAVQAADAAWRRADWAGLKPHQRADVLYRVADLIHAHREALAQLQRRDNGKPINETRALVASAASTFRYFAACAQTLDEALTPSRGDYLSMSVHEPLGVVAAITPWNSPIASDAQKLGPALAAGNAVVLKPAEVTPLASLALARLCEQAGVPRGVISVLPGKGSVIGDALVRDPLVKKVSFTGGTEVGRGIARLAAEKLMPLSLELGGKSPTIVFDDAELDHAVNGVLYGIFSSSGESCIAGSRLFVQRSIYGAFVARLVEAARKLRVGDPASERTQMGPLITARHRDTVERYVALGRDEGARVLCGGERPTGEGRDAGFFYLPTILDGLSNHARICREEIFGPVLVALPFDDEAALVADANDSVFGLAAGIWTRDYKRAWRVARVLDAGTVWINTYKQFSISTPFSGRKESGMGREKGSLGIREYMQQKSLYWGLNDSPLPWAN

SEQ ID NO: 92986 - protein, 598 aa, Debaryomyces hansenii CBS767
MGDMVNEKRSSEVGVKEQDKNGQYSSQNGCSAVKMSMGDDSEEEDGVLYGDLPTEYRLVHKLGEGAFSAVYKAVYEPTGRPVAIKIINKANLSGKQIANIHNEINIMKRLSHPNVLRLVDLFNNDVHCYIVLEYCDGGEIFNKIIEYTYFSEDLSKFIFSQLLSSVDYLHSIDIAHRDIKPENLLFSTIPYNERSVEEFEKHKRASDDNTKVDEGEFVGGVGGGGIGIIKLADFGLAKQLRPSNTMGSNLKTPCGTAGYTAPEVITCNGTKMKRFPNKQSQRHFYSKAVDIWSLGCFLYTILCGFPPFYDDDHHQLTMKILNGDYVFLKPWWDEVSLDAKDLICKMLTINPDDRITIKEIWNHPWIKDYYDPQSPSYFDSCDAEHVEYSGETDHLKPMDIISNGSNSHFNADLMSPRAEAIKKVFNNPAMSNSRTSKFKQPASSVQFSIDDLQDLLIHDKKTLPKSPLPAKKEFGKFAFKDVFDGNKTVINENDEYEEDSEDSINDLDESSDELHDELTSLDKFSVKQLESQRSSIKSNSSDDDNSLHDDYNEDYQTRSSSIISGINGDYKFTLNLNDSNLLRRRSSTVKSNKSLATD

SEQ ID NO: 92987 - protein, 362 aa, Ustilago maydis 521
MADEIQCTGPVDNGSGSIGLRIGAIFIIWASSTALTLFPIVTRRIPRLSINREAFDFAKYFGSGVIIATAFIHLLAPAASDEELGSPCLSSDFQNYPFAFAFAMIAMFAVFVVEVLAFRVGSQYANKLAYDSHAGGHHHAMEHGGNPNLAQEEQHNHNAIKSVSSDDVENAAAVPGADSAAEAKMVADSSSTASTKLDLTTQASEILGVMILEFGVVFHSIIIGITLGTTSDFTVLFIVIIFHQMFEGLGLGTRLAFLPLGMKSWIPTLGAILYGLVTPIGIAIGLGVRHTYNGDSATAAYVTGIFDSVSAGILLYTGTVELLAHEFIFNDKMRNAPLKKVVISILEMLTGAGLMALLGRWA

SEQ ID NO: 92988 - protein, 399 aa, Burkholderia mallei ATCC 23344
MSSNRGVVYQGPGKVEVRKIDYPKMVDPSGRAIGHGVILKVVSTNICGSDQHMVRGRTTAPVGLVLGHEITGEVIEVGRDAETLKIGDLVSVPFNVACGRCAMCKEQHTGVCLNVNPARAGGAYGYVDMGGWIGGQAEYVLVPYADFNLLKFPDRDRAMAKIRDLTCLSDILPTGYHGAVTAGVKPGSTVYVAGAGPVGMAAAASARLLGAACTIVGDMNAERLAHAKAMGFEVVDLSKDATLGEQIEQILGKPEIDCAVDCVGFEAHGHGSSGHAQEAPATVLNSLMEITRPAGAIGIPGLYVTDDPGAVDVAAKHGSLSIRFGLGWAKSHSFHTGQTPVLKYSRNLMQAILFDRLPIAEIVNVAVISLDDAPEGYKKFDGGAPRKFVIDPHGMLKAA

SEQ ID NO: 92989 - protein, 102 aa, Acinetobacter baumannii
RGATGEVIQDVVNIGVGGSDLGPQMVTHALCDFKVITANPLNVHFVSTMDGSQLSDLLHQLRPVTTLFIISSKSFGTIDTLSNAQTVRQWLEKALGQHDRVV

SEQ ID NO: 92990 - protein, 467 aa, Xylella fastidiosa Dixon
MNDILPVILSGGSGTRLWPLSREAYPKQFLPLVGHHSMLQATWLRAAPVTTHSPIVVANEEHRFIAAEQLQHLGVYPSAILLEPTGRNTAPAIAVAALEATRTGNDPLLLVLPSDHVIRDETAFQTAVHVATEAAAQGKLVTFGIIPNTPEIGYGYIKATGNDTIRPVERFIEKPDLATAQSYLSSGDYFWNSGMFLFRASRYLAELSTFQPAIAEACQRAWSAAKRDTDFIRLDKEAFESSPADSIDYAVMEHTADAVAVPLDAGWNDVGSWSALHEVSKQDNDGNAHQGDVIQIDCRNTYAYGSRLIAMVGLENVVVVETDDALLVGHRDSIQTVKEIVGKIKANGRPEATRHRKVYRPWGAYDSIDTGQRFQVKRITVKPGGTLSLQMHHHRAEHWIVVSGTAEVTRGSEILLLTENQSTYIPLGVTHRLRNPGKLPLELIEVQSGSYLGEDDIVRFEDTYGRT

SEQ ID NO: 92991 - protein, 509 aa, Geobacter metallireducens GS-15
MELPLCDFPFTLQLDLQKTTKESSEMMILKNSSLLKQQCYLDGHWCCADGGATIDVTNPATGEILGVVPKMGTQETRRAIEAANGALDGWKARTAKERSAILRRWFELIMENLEDLAVIMTAEQGKPLAESRGEIAYAASFIEWFAEEGKRIYGDTIPSYARDKRIVVIKEPIGVCAAITPWNFPAAMITRKAGPALAAGCTMVVKPATATPFSALALALIGEQAGIPAGVFSVITGSSKEIGDEMTGNPIVRKLTFTGSTEVGKQLTAQCAGTMKKVSMELGGNAPFIVFDDADLDAAVEGAIASKYRNTGQTCVCTNRILVQESVYEAFSAKLVAAVSKMTVGDGLKGEVQQGPLIDMTALEKVEEHIADAVAKGARVVLGGKRHALGGTFFEPTIITDVTPGMLVAREETFGPLAPLFKFSTDEEAIRMANDTEFGLASYFYSRDIRRVWKVSEALEYGMVGINTGLISSEVAPFGGVKESGVGREGSKYGIEEFVEVKYLCMGGI

SEQ ID NO: 92992 - protein, 274 aa, Anabaena variabilis ATCC 29413
MNIAIIGCGYVGCAIAQHWQQNPHLFITATTTTSERVTALQKVAHKVVLTQGDDLDKLTNILQNQDVVLLSVGAKGGDLYEAAYLNTAKTLVSALQQNSHVKQLIYTSSYSVYGNKNGEWVDEETPTMPVSRNGEILQETEDILLSASSVNLRVCILRLGGIYGAGRELVKIFSRVPGTTRPGDGSDTTNWIHLDDIVGAIEFVRNNSLQGIYNLVDDAHLPSRELLDTLLSKYNLTQVIWDEILKSNRPYNAKVSNRKIKEAGYQLIHPYTVF

SEQ ID NO: 92993 - protein, 222 aa, Anabaena variabilis ATCC 29413
MISSINERITHIRASLPPSVRLIAVTKQMPTEVIRAAYAAGVRDFGENRIQEAASKQAQLQDLPDITWHFIGHLQANKAKKALEQFQWIHSVDNLKLAQRLDQLAQQLGVNPQVCLQVKILPDPNKSGWSVPELLADLPALNQCKTLQIQGLMTIPPFGLNDAKILHVFNSTSKLAEDIAEQNWDHIHMEQLSMGMSGDYQLAVQAGATMVRLGTILFGQRT

SEQ ID NO: 92994 - protein, 347 aa, Xanthomonas oryzae pv. oryzae KACC10331
MPGMTDRLRFPAEWEPQSAVLLAWPHAGTDWAERLADVEETYIALVTAIARFEPVVICVADDDLQIYAEARLRSARVDMTRVRFVIAAYNDTWLRDSGPITLRQGTGFRLMDFRFTGWGGKFDASLDDQLVSSLDAAQVFVPAQVGTIDFALEGGAIETDGAGTLLTTWKCLHERHPQRTRESLSSDLATWLAQERVLWLDHGYLEGDDTDAHIDTLARFAGPDAIVYQGCDAADDSHYTELQAMGAELAALRTADGQPYRLFVLPWADPILDEGRRLVASYANFLIVNGAVLMPAYGDPADATAQAVLAQAFPQHEIVPVPCRALIWQNGSLHCLTMQLPAGLLAG

SEQ ID NO: 92995 - protein, 165 aa, Hordeum vulgare subsp. vulgare
VMASSATTVAPFQGLKSTAGLPVSRRSSASLGSVSNGGRIRCMQVWPIEGIKKFETLSYLPPLTTEALLKQVDYLIRSKWVPCLEFSKVGFVFREHNSSPGYYDGRYWTMWKLPMFGCTDATQVLNEVEEVKKEYPDAYVRIIGFDNLRQVQCVSFIAFRPPGCE

SEQ ID NO: 92996 - protein, 602 aa, Gluconobacter oxydans 621H
MTFPSRSRGGLTRRRFVTGLGAGSLLASLPRTSHAFSSKASSGIIPPMPSDRWDLKIGHTRISLDGKTMHAPTAGGTVPGPILRWKQGDTVSINVTNTLNEPTSIHWHGIRTPSNMDGVPGMSFGGIAPGETFTYRFKLHQSGTYWYHSHSGMQEAMGLYGALVIDPRRPDPNACDRDYVIFLGEWTDVMPDDIVSNLKMQDDYYVFRQRTAASFPKEAREAGSAGAALADRLAWSKMRMAATDIADVSGAIYTYTLNGHAPDMNWSGLFRPGEKVRLRFINGSTMTFFDVRIPGLEMLVVQADGNDIEPVPVDEFRIGVAETYDVIVQPKDERAYAIFAQSEDRTGYARGTLAPREGMIAPLPPMDPRPVRTMVDMGMGNMKPGESMKDMDMSGDMSGMKMDGDMAGMDMHGMDMKGMDMSHMAMPKMEVDDPGPPPINVENQMRAMMPIDRTGSPGDGLENNGRRVLNYKQLRATRPGADLRPPTREIILHLTGNMERYIWGMNGRKFSESGPIRLKLGERVRFTLINDTMMEHPIHLHGLWSELENGQGDYRPYKHTIISQPGSKLSYLVTADTPGMWAYHCHLMYHMDLGMFRTVIVA

SEQ ID NO: 92997 - protein, 165 aa, Avena sativa
VTASSATSVAPFQGLKSTAGLPVGRRSNAGLGNVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCE

SEQ ID NO: 92998 - protein, 1229 aa, Methanosarcina barkeri str. Fusaro
MGPEFQAYVGPRPFEQEDKFIFFGRDREARDLLSLVIAHNLVLVYAQSGAGKTSLLNAGLIPLLEENQFEVFPIVRVKGTILENITTDEISNIYVFNTLASWDEGDYDVESLAKMKLVDFLNEQEHMLDEDGMPLPRAVIFDQFEEIFSLYQDRWKDREGFFEQVSAALEADPLLRVIFVMREDFIAQLDPYVYLLPERLRTRFHMERLRSEAALLAIKEPLRYTGRSFAEGVAEKLVEDLLKIRVETAPGETAEVTGEFIEAVQLQVVCQNLWRELPPDITQITFQHLKTYGNVEQELYRFYEEAIEVATEKTRVDEEGLRRLCGEVLITTMGTRGMVYRAPEYTYGVPNTAIDVLESMHLIRAEWRAGARWYELTHDRFIEPILSSNKVFNDKLAEKKRVEKERAEKERAEKEWAEKEQLEKERLEKEWAERKRAEKERSRNRVIKGLAAISIIILILALSTTYLWIQTEQNKKGALASYLNAKSQNLQEYPTTLDESILLAIESFRISETLHDERLRQELSLDADKLIRQELLSIPHRVVVLNHNGWVNNVVFSPDGKYAATASNDNTARLWDADTGKQIFVLNHSGWVNNVVFSPDGKYAATASNDNTARLWDADTGKQIFVLNHGDWVNNVVFSPDGKYVATASNDNTARLWDADTGKQIFVLNHNGSVNNAVFSPDGKYIATASNDNTARLWNADTGKQIFVLNHNGSVNNAVFSPDGKYIATASNDNTAGLWDADTGKQIFVLNHGSWVNNVVFSPDGKYIATASFDNTARLWDIATGNSIFALNHDSWVYDVMFSPDGKYVATASGDNTARLWDTDTGNPILIMNHNGSVNNVVFSRDGKYIATASDDKTAGLWDIAATEVLNHNGPVYGVVFSRDEKYVATASGDNTARLWDTDTGKQIFVLNHNGPVYNVVFSPGGKYVATASKDNTARLWNADTGKQIFVLNHNGRVYNAVFSPDGKYIATASGDDTARLWDTDTGKQIFVLNHSGWVYDVVFSPDGKYIATASFDNTARLWNAATGEQIFVLRHSDKVLSAVFSPDGKYVATASNDNTARLWDADTGKQIFVLNHGSWVNNVVFSPDGKYIATASNDNTARLWDADTGKQIFVLNHSGWVNNVVFSRDGKYIATASYDKTARLWNADTGKQVFVLNHNGPVYKVVFSSDGKYVATASDDNKARLWIHNKTEDLIHEAGNRLTRNLNKEEWKNYMFDEPYDKTFPNLP

SEQ ID NO: 92999 - protein, 165 aa, Aegilops speltoides
VMASSATTVAPFQGLKSTAGLPVSRRSSASLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNLRQVQCVSFIAFRPPGCE

SEQ ID NO: 93000 - protein, 335 aa, Alkalilimnicola ehrlichei MLHE-1
MKHLITGAAGFIGYHTAQALLARGDEVVGLDNLNDYYDPRLKRARLARLEGQPGFRFVKLDLADRAGMAELFRAERFQRVIHLAAQAGVRHSLTDPYSYVDSNVSGTLNVLEGCRYNDVEHLTYASTSSVYGAHEDMPFTEHRHTDHPLAIYAATKKATEHMAHSYAHLYGLPCTGLRFFTVYGPWGRPDMALFLFTRKILAGEPIDIYNNGDHGRDFTYVDDIVDGVIRASDRVARRNPEWDPKRPDTATSNAPWRIYNIGANRPVRLMHYVEVLEEALGRKAEKNFLPLQPGDVPETHADVSALAQDTGYSPKVSVEEGIRRFVDWYREYHHV

SEQ ID NO: 93001 - protein, 297 aa, Xanthomonas oryzae pv. oryzae KACC10331
MSQRIRKAVFPVAGLGTRFLPATKTVPKEMLPIIDKPLIQYAVDEAIQAGCDTLIFVTNRYKHSIADYFDKAYELEQKLERAGKLEQLELVRHALPEGVRAIFVTQAEALGLGHAVLCAKAVVGDEPFAVLLPDDLMWNRGDAALTQMADVAEASGGSVIAVEDVPQEKTASYGIVSTDAFDGRKGRITAIVEKPKPEVAPSNLAVVGRYVLSPKIFEFLEATGAGAGGEIQLTDAIAELLKKEQVDAFRFQGRRFDCGAHIGLIEATVHFALEHEKHGGPAKEILRNALAQADARG

SEQ ID NO: 93002 - protein, 154 aa, Aegilops speltoides
VMASSATTVAPFQGLKSTAGLPVGRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNLRQVQCV

SEQ ID NO: 93003 - protein, 615 aa, Oryza sativa Indica Group
MAILVTGGAGYIGSHTVLSLLERGEDVVVLDNLSNSSAESLQRVEKLTGKAAVFYQGDVQDAECLHRIFGAHDITAVIHFAGLKAVGESTRKPLEYYQNNVTGTLVLLDAMRRAGVHDFIFSSSATVYGANSPVPYVETTPIGGTTSPYGTSKLMVEQILQDFAKAEPQFSIIALRYFNPVGAHESGLIGEDPNGIPNNLLPYISQVAIGKLEKLGIFGGDYPTKDGTGERDYIHVMDLADGHLKAMDHLAKISGFKAYNLGAGVGHSVLAMVQAFEKASGVTIPYQILPRRDGDLPAFWANADLAYQELGWKSLGAPTDMLKAVIPVAGLGTRMLPATKAIPKEMLPVVDKPLIQYIVNECVAAGIKEIILVTHSSKNAIENHFDTSFELESMLESRVKRQLLEEVQSICPKGVTLMHVRQGQSKGLGHAVLCARPLIGDAPFAVLLPDVLMDDIASDLTKDNLASMIAEFEAHGRSQIMVEPVPEKDVSKYGVVDCRGVAVAPGQSVPMHAIVEKPSQEEAPSNLAVVGRYVLAADIWPLLEKTPYGAGGEIQLTDAIAMLMEQKPVEAFAMVGRSHDCGDKLGYMKAFVEYGLRHPTQGEAFSEWLKGMLQA

SEQ ID NO: 93004 - protein, 637 aa, Oryza sativa Japonica Group
MPAAKPFLETLGGNMKETFLPDDPFRVVRRERGCGRRAAAALRYVFPFMEWAPSYTLGTLKSDLIAGITIASLAIPQGISYAKLANLPPVLGLYSSFVPPLVYAMMGSSRDLAVGTVAVASLLIGSMLSEEVSAAEDPALYLHVALTATFFAGVFQALLGVLRLGFIVDFLSHATIVGFMGGAATVVCLQQLKGMFGLDHFTTATDLVSVMSSVFSQTHLWRWESVVMGCGFLFFLLITRFFSKRRPRFFWVSAAAPLASVIIGSLLVYLTHAENHGIQVIGYLKKGLNPPSATSLNFSSPYMMLALKTGIITGVIALAEGIAVGRSFAMFKNYHIDGNKEMIAFGTMNIVGSLTSCYLTTGPFSRSAVNYNAGCKTAMSNVIMSVAVMITLLFLTPLFHYTPLVVLSAIIMSAMLGLIDYPAAVHLWQVDKVDFCVCLGAYLGVVFGSVEIGLVVAVGISILRVLLFVARPRTTVLGNIPNTMIYRRMDQYTAAQRVPGVLVLRVDSPIYFTNASYLRERIARWIDDEEDQCKEKGEMGIQYVVLDMGAVGSIDTSGTSMLDELRKTLDRRGLQIVLANPGSEIMKKLDSSKVLEAIGHEWIFPTVGEAVAECDFVMHSQKPGMVMGSGAPHENLV

SEQ ID NO: 93005 - protein, 401 aa, Ostreococcus tauri
MARFADVPEAPKDPILGISELFLADTSSDKMNLGVVRGAYRDDNGKPQVLKCVREAEKRIAGNFNMEYLPTNGFKDFIKHSLDLAYGEDSEAVKSGSIAAVQSLSGTGSCRLLAEFQKRFMPGCTVYISVPTWSNHHNIWRDAGCEQTTYRYYKESTRGLDFEGMMEDINNAPNGSMFLLHACAHNPTGVDPSAEQWREISKAMKAKNHFAFFDMAYQGFASGDCVRDAQSIRIFAEDGHKFALAQSFAKNMGLYGQRIGTVSVMCEDKAEAVRVESQLKVIARAMYSNPPMHGALIASTILGDPALKAQWYVEVKEMADRIITMRTLLRKHLEDSGSKLPWQHVTDQIGMFCYSGMAPEQVDKLRTDHHIYMTRNGRISMAGVTSGNVERLAKAMHEVTK

SEQ ID NO: 93006 - protein, 355 aa, Frankia sp. CcI3
MPATMQALAFLGIGKAGVIEKPIPKPGPTDAIVRTTSALICTSDVHTVRGAIPVPEGRALGHEAVGVVHDLGAAVTGFEAGERVAVGALTPCFHCGPCQRGFSTQCQGMLGGYKFTTQRDGNMAEYFLVNNAAANLARIPADLPDEKAVYATDMLSTGFGGAENAQLRLGESVAIFAQGPVGLSATIGCRLLGAGLIIAVEGRPERQELARRFGADVVVDPAAGDVVNQILDLTGGVGVDGAIEALGHPQTFEDCIRVTKPGGRISNIGYHGENPAPLQIPLEPFGLGMSDKKILTSLCPGGSDRLERIFTLMRSGRVDPTPMTTHEFGFDEIERAFSMMETKEDGVIKPLIRFA

SEQ ID NO: 93007 - protein, 467 aa, Oryza sativa Japonica Group
MAKSTPAAAAAAPEEATAAALRFRLRRLVAAVTAGGFGGGKAFDEAASALAALRDAELGPPPKDRPGAGVERRRSGHAEAAAVPEQFLCPISSEIMRDPVVLASGQTYDRRFIQEWLSAGNRTCPQTQQVLSNTILIPNHLVRSMIAQWCTENGIALSPLENQEEDLVTNNERKSFSELFDRISSSSNISEKRQAIKDLRLLTKRNSSFRAVIGENPDSISQMISAVSNPELESNSEVLEDTVTTILNLSIHESNKKIIGDDTKAITFLISALQSGTMEARSNAAAAIFSLSALDSNKAKIGESGAMRPLVDLLEHGSMTAKKDAASAIFSLCKLHENKSRATKSGVIDVVLKAISDESLTDESLTILALLSSDHETVEEIGETGGVPCMLHIIKDDQCKRNKENAVAVLFSICMYDRTKLREVVEDENLNGSLAWLAQNGTSRARRKAAGILDKLKRTIHKTHYSC

SEQ ID NO: 93008 - protein, 609 aa, Xylella fastidiosa Dixon
MSNPSSTPLLFADLGLSDAVMQAVTKIGYETPSPIQAATIPALLAGRDVLGQAQTGTGKTAAFALPLLTRTVLNQVKPQVLVLAPTRELAIQVAEAFQRYAASISGFRVLPVYGGQSYGQQLAALKRGVHVIVGTPGRVIDHLERGTLDLSELKTLVLDEADEMLRMGFIEDVEEVLRKLPASRQVALFSATMPPQIRRIAQTYLQDPIEVTIATKTTTAANIRQRYWWVSGLHKLDALTRILEVETFDAMIIFVRTKAATEELAEKLQARGLTAAAINGDMQQAQRERTIHQLKDGKLDILVATDVAARGLDVERISHVLNYDIPYDVESYVHRIGRTGRAGRSGEAILFVTPREKGMLRQIERATHQPIEAMQLPSVDAVNDTRVTKFFGRISNALVVGAEIDFYRKLLQRFESEHNVPAIEIAAALARLLQGDSPFLLSVPTRPQRERSELASEHHVKRPSSFKQTERPNNTEHPKRPQRNAPARNVPEFGMESYRIEVGRMHGVKPANIVGAIANEAGLESRYIGRIDIRDDHSVLDLPAEMPHEILQHLKKVWVSGQQLQMHRIDTTETTAPAREFKSKPGGAGKFPPKPHHNKSTKPKPPYSG

SEQ ID NO: 93009 - protein, 315 aa, Bacteroides thetaiotaomicron VPI-5482
MEKIARKLTDLVGNTPLLELSNYNKSNGLKARLIVKIESFNPAGSVKDRVALAMIEDAEMKGVLTPGATIIEPTSGNTGVGLAFVAAAKGYKLILTMPDTMSVERRNLLKALGAELVLTPGADGMKGAIAKAEELKAATPGSVILQQFENPANPAMHLRTTGLEIWRDTEGKVDIFVAGVGTGGTISGVGEALKMRDPSVKAVAVEPADSPVLSGGKPGPHKIQGIGAGFVPKTYNASVVDEIIQVQNDDAIRTSRALAEEEGLLVGISSGAAVYAATELAKRPENEGKMIVALLPDTGERYLSTILYAFEEYPL

SEQ ID NO: 93010 - protein, 270 aa, Anabaena variabilis ATCC 29413
MTIKFGLIGGGVMGEALLSRLIARGIYQPSEVIVSEPQTARQAFLQQKYHVGVTTDNSLVFTQAQDVVFLAVKPQVFSAIAQELADTVFTDHSPLVVSILAGVSLSQLEAAFPQSPVIRAMPNTPATVGAGMTAICSGAYTYAQHQKLAQQIFSAVGEVVEVSESLMDAVTGLSGSGPAYVALLVEALADGGVASGLPRGIANQLALQTVLGTAQLLHESKLHPAELKDRVTSPGGTTIAGIAQLEKAGFRSALIEAVKAATWRSQELGK

SEQ ID NO: 93011 - protein, 470 aa, Geobacter metallireducens GS-15
MSQNFGRISQVIGAVIDVEFEPGKLPPIYNALRVTNPAIDDKEYNLVLEVAQHLGENSVRTIAMDSTDGLVRGQAALDTGKQISVPVGRKTLGRILNVIGEPVDEMGPVNAEKEYGIHRESPSFVDQSTKVEAFTTGIKVVDLLAPYARGGKIGLFGGAGVGKTVLIMELINNIAKQHGGFSVFAGVGERTREGNDLWMEMKESGVLDKAALVYGQMNEPPGARARVALSALSIAEYFRDEEGQNVLLFIDNIFRFTQAGSEVSALLGRIPSAVGYQPTLATEMGELQERITSTTKGSITSVQAIYVPADDLTDPAPATAFAHLDATTVLSRQIAELGIYPAVDPLDSTSRILDPQVIGEEHYAIARQVQYVLQKYKDLQDIIAILGMDELSEEDKLVVARARKIQRFLSQPFHVAEAFTGSPGKYVELKDTIKGFQEIVAGKHDDIPEQAFYMVGTIEEALEKAKKLAA

SEQ ID NO: 93012 - protein, 373 aa, Debaryomyces hansenii CBS767
MTSLSNGHKSSSSLTITDKVIKSFEPVKTFNYHKGASITSLDFDDSGQYLISAGIDKSIQLYDVHKGVHHNDIQSQKYGAHLARFTHLELNCLYASTPAADKNIDNAIRYLSLSNNLYLRYFKGHKDQVTSIEVHPVLDLFLSASLDRTVKLWDLRSTSPVGNLDMGQPTVIAFDPRGIVFCVGKCPCPSTGAGVGVVAFYDTASFDKKPFLEVEIQILAGQSWNKLEFSNNGKLLLISTDSYEHYVLDAFLGQLLTTLQIGPDTSHTEYNGDWMTFKYPYSGSASFSPCGKFVLVGSPQMNVLAFDLTNLKHTDGNTRSVSDLDNPKTLRPFQTLSTNQGIPKIVAFNQKLLTFATADSTVSLWQPKLPDPI

SEQ ID NO: 93013 - protein, 364 aa, Arabidopsis thaliana
MTTISDLSDDLVGDILSRVPFTSLISVRSTCKKWNALSKNQIFGRKTAARNQFLEFMILDSRVCSLRLDLQGIRNEDKEDFVDPSMKLISIPSNDDQVEISQVYHCDGLLLCIAKENSNVFVWNPYLGQTKWIRPRNTFHRYDRFALGYDNNRNHKILRFLYDEESNESSRRTHIDVYDFSSDSWRVLDVNPDCDIPFYQTGVSLKGNTYFFERFGPCLPLLFYPPCPSFETVTLSWVRDEKLAVLYNHYVTAEIIEIRISTKIEPNAVSWSSFLTVDMSLVNGLPDHFSMYFEAKSFFIDEEKKVVVLFDSKEIKTCRYQMAYIVGDDGYFKSVNIGVSPNSQRKPGRLVCSSYVPSLVQLQD

SEQ ID NO: 93014 - protein, 102 aa, Acinetobacter baumannii
RGATGEVIQDVVNIGVGGSDLGPQMVTHALCDFKVKTANPLNVHFVSTMDGSQLSDLLHQLRPETPLFIISSKSFGTIDTLSNAQTVRQWLEKALGKHERVV

SEQ ID NO: 93015 - protein, 297 aa, Arabidopsis thaliana
MGGGRAMATAAKVAGIGVGKGGFKGFGFPPATEQFRVKTAAAAASSKPVSASITSAVHPSVEEDGMIMQRPVWDDWEFAEEEPIPRVVFSKPPSLEEAKEATEDLKEAINLVYMSSPKSSAAMEGSNDGGSVSKMLSGFQSSENRAVESAVPQVALQAFAFLSENTAAQTVVASIASDPKVWDAVMENKDLMKFLQTNKTAVSSQVESDNDDQSERSSTTECEVVETKPMELLEILQDMKLKAVRLMENVSSYFGDLFGLGSVTEDGKDKKQTLFNDPRSLFGLAVVVIFMVVLKRA

SEQ ID NO: 93016 - protein, 418 aa, Arabidopsis thaliana
MSSFNGDSMDDFKGLRITQLDDDDDDETAVEPINMDEFDDDDEEDDEDYEPVMLGFVESPKFAWSNLRQLFPNLAGGVPAWLDPVNLPSGKSILCDLCEEPMQFVLQLYAPLTDKESAFHRTLFLFMCPSMSCLLRDQHEQWKRAPEKAMRSTKVFRCQLPRANPFYSSEAPKHDGTDKPLGHGAPLCTWCGTWKGDKLCSGCKNARYCSPKHQALHWRLGHKTECQQLRTVSETSDSGPVNNGVAPTEKQKVASKSLWKEFVLINEDESEYDTEMSGDDEVAKPLVSKREVDDQMKSLMNDFEGDADKKNWVNFQQRVDKAPEQVLRYSRSSGAKPLWPIASGRVSKSELPSCKSCGGPRCFEFQVMPQLLFFFGGKNERESLDWATIVVYTCENSCDSSLSYKEEFVWVQLYSQTT

SEQ ID NO: 93017 - protein, 41 aa, Nicotiana tabacum
GVEPKDIELVMTQAGVSRAKAVKALKAADGDIVSAIMELTN

SEQ ID NO: 93018 - protein, 484 aa, Mycobacterium avium 104
MTVQAVLDDIRKRPGTGDVIAVIDPATEEKITEFTDCGAEAVDEAAARAKASFESGVWSQLPGRERAKILWRIGDLIDEHAEEFAQLDSLNTGMPLLQAQLQMSTCSEFFRYYAGWCSKINGTAYDVKTDGIATDTFVNMHAYTLKEPYSVVGLIFPWNGPIFNASAKLAPALAAGCSLLVKPAEETPLSALLLDRLVHEAGVPEGVVNLLTGYGHTAGAAITAHPDVEKVAFTGSTEVGKEIVRASAGNLKKVTLELGGKSPVLIFDDADLDKAILMASLGIFVHSGQGCVCGSRIFVQRGVYDRVVEGIAMMANTFKLGAPSEEGCVSGPLISQKQLNRVMGFIDEGKNDGVEVVTGGYRLDRKGYFVHPTVLTNVDPGMRLYQQEIFGPVVAILPFDDEDEAVAMANDTTYGLAATAWTENLGRAHRIVKRLQAGSVQVNCQLVFDHDVPFGGYKQSGWGHEFGKEGLEIYLKTKSVWAQL

SEQ ID NO: 93019 - protein, 537 aa, Xanthomonas oryzae pv. oryzae KACC10331
MCSCESPIPTPQSRLSMTNIHTDKILILDFGAQYTQLIARRIREIGVYCEIWAWDHDPSEIAGFGAKGIILSGGPESTTLPGAPVAPQEVFDSGLPVFGICYGMQTLAAQLGGATEAADQREFGHAEVDVIAADALFAGLTDHAGAPRLNVWMSHGDHVSQVPPGFTITATTDRIPVAAMSNEDKRWYGVQFHPEVTHTLQGQTLLRRFVVDICGCQTLWTAANIIDDQIARVREQVGDDDVILGLSGGVDSSVVAALLHKAIGDKLTCVFVDTGLLRWQEGDQVMAMFAEHMGVKVIRVNAADRYFAKLEGVSDPEAKRKIIGNLFVEIFDEESNTLANAKWLAQGTIYPDVIESAGSKTGNAHVIKSHHNVGGLPQHMKLGLVEPLRELFKDEVRRLGVELGLPRTMVYRHPFPGPGLGVRILGEVKREYAELLAKADAIFIDELRKADLYDKISQAFAVFLPVKSVGVVGDARAYEWVIALRAVETIDFMTAHWAHLPYDFLGTVSNRIINELRGVSRVVYDISGKPPATIEWE

SEQ ID NO: 93020 - protein, 821 aa, Alkalilimnicola ehrlichei MLHE-1
MRLIAPPFRLLSVGLILLLMALLTACGGGSSSTDDTSEDTYAVGGTLTGLEQGHTITLQLNGASDLTLDHTANDNPYSFAVKLPHGSAYEVTLPAEPPQHHCTIHNATGTVDGAVMNVDVECTAFPVLAAGGVHTLAMKADGTLWAWGQNNVGQLGLGDTEKRDTPAQVGSDTDWAAVSAGGAYTLAVKDDGTLWAWGENYFGQLGLGDTDDRHAPEQVGSDSDWVAVSAGRHHTLALKADGTLWAWGRNYFGQLGLGGTTNRNAPEQVGSHSDWAGVIGGDRHSLAVREDGTLWSWGQNNVGQLGLGDTVERRRPEQVGNDSDWATVSAGLLHTLAVKNDGTLWAWGGNGFGQLGLGDTDNRDAPVQVGSDNDWAALNAGQRYSLAVKNDGSLWSWGWNDFGELGLGDTDDRHAPEQVGGGMEWAAVTAGMYHTLGVKADGTLRAWGRNDFGELGLGVMVYITSPLQTVTEADWAAASAGQYQTQAVKADGSLWGWGRNHSGQLGLGDTDDRHAPVQVGGDSDWTSLSVGREHTLAVKADGTLWGWGQNYNGQLGLGDTDDRKTPERVGSDSDWATVSAGTGYTLAVKDDGTLWAWGRNSHGQLGLGDTNNRDAPVQVASDNDWAAVSAGSRHTLAVKNDGTLWAWGRNSDGQLGLGDTDNRDVPEQVGSDTDWAAVSTGSGHTLAVKTDGTLWAWGRNSDGQLGLGDTDERHAPEQVGGDSDWAAVTAGWQHTLAIKNDGTLWGWGLNLYGQLGLGDTDGRHAPMQVGSDSDWATVAAGRYHTLAVKDDGTLRAWGRNRFGQLGQRTYRFDQPQEVPGW

SEQ ID NO: 93021 - protein, 468 aa, Prochlorococcus marinus str. MIT 9215
MYLIKKICCIGAGYVGGPTMAVFAKNCPDIEIEVVDINQIRINAWNSDDLTKLPVFEPGLPQIIKKVRGRNLNFSTNVSNSIREADMVFISVNTPIKEKGVGAGETSDLRWVESCARQISEIAEGHTIVVEKSTLPVKTAQTIKDILFSSNYQTSEKSFSVLSNPEFLSEGTAIRDLEEPDRVLIGGDDDEAIKALNDIYLNWIPQEKLIFTNLWSSELSKLTANAFLAQRISSINSISAICEVTGADIKDVSFAIGKDNRIGSKFLKSGPGFGGSCFKKDILNLVYLAKFYGLNEVAGYWRKVIEINSWQQKRIYEIVVEKLFGNLVDKKIAILGFSFKENTNDTRESPAISICRNLINEGAFLSINDEKVTEEDIEKSLKKDNFVYGFNKNEPCWEFQSNLYSAFENAHAVIILTSWDKYKAIDWERVSLSVKSPFWVFDTRSILDIKNIQDLGFNFWQLGFGNNN

SEQ ID NO: 93022 - protein, 818 aa, Alkalilimnicola ehrlichei MLHE-1
MRLIAPPFRLLHVGLILLLMALLTACGGGSSSTDAPSEDTYPVGGTLTGLEQGHTVTLQLNGANDLTLDHTANDNPYSFAVKLPHGSAYEVTLPAEPSQHHCTIHNATGTVDGAVMNVDVECTAFPVLAAGDDHTVAVKADGTLWAWGRNGYGRLGLGDTDDRDVPEQVGTDSDWTAVSAGRDHTVAVKANGTLWAWGRSGRIGLGDSGDRDEPEQVGVDNDWIALSAGGSHTVAVKADGTLWAWGRNNAGQLGLGDTNHHYTPTQVGTDTDWAKKISAGRRHSLAVKADGSLWAWGDNEYGQLGLGDTDERHAPEQVGSNTDWAAISAGRRHSLAVKADGSLWSWGYNDSGQLGLGDTADRNAPEQVGADTDWDLVSAGGEHSLAVKADGTLMVWGLNHLGQLGLGDTVSRDAPVPIASGIALVAGRNHTVAVNPDGTLRAWGDNEYGQLGLGVMRYIVTPSQTVTGSAWAAVNGGSFNHSLGLRDDGTLWAWGRNNYGQLGLGDTDDRATPEQVGSHTDWAAVNAASYHTLAVKNDGTLWAWGRNSSGQLGLSDTNDRHTPERVGSDTDWATVSVGQSHTSAVKPDGTLWAWGWNHYGQLGLGDTSDRLSPEQVGGESNWLAVSTGLHHTVAVKTDGTLWAWGWNVRGQLGLGHTSDRHAPVQVGSDTDWAAVSASGYRTLAVKADGTLWAWGENNNGQLGLGDTDNRNTPAQVGNDADWAAVSTGLFHTLAFKEDDTLWAWGRNHDGQLGLGDTDNRDAPVQVGNETDWSTVSGGGYHTLATMSDGTLRAWGLNTSGQLGQRTMWFDQPQEVPGW

SEQ ID NO: 93023 - protein, 545 aa, Mycobacterium avium 104
MITATDLEVRAGARILLSPDGPDLRVQPGDRIGLVGRNGAGKTTTLRILAGETEPYAGTIARSGEIGYLPQDPKEGDLDVLARDRVLSARGLDVLLTDLEKQQALMAEVADDDARDRAIRRYGQLEERFVALGGYGAESEASRICASLGLPERVLTQQLRTLSGGQRRRVELARILFAAAEGGATGSGSATTLLLDEPTNHLDADSIGWLRDFLRAHTGGLVIISHNVELLADVVNRVWFLDAVRGEVDVYNMSWQKYLDARATDEQRRRRERANAERKAAALRTQAAKLGAKATKAVAAQNMLRRADRMMAALDEERVADKVARIKFPTPAACGRTPLTATGLSKSYGSLEVFSGVDLAIDRGSRVVVLGLNGAGKTTLLRLLAGAETPDTGRIEPGHGLRIGYFAQEHDTLDNDATVWQNIRHAAPDSGEQDLRGLLGAFMFSGPQLDQPAGTLSGGEKTRLALAGLVASTANVLLLDEPTNNLDPASREQVLDALRSYTGAVVLVTHDPGAAEALDPQRVVLLPDGTEDYWSDEYRDLIELA

SEQ ID NO: 93024 - protein, 122 aa, Populus trichocarpa
MALRAAVLRHIRVPVQTLRLKTNPCAPSGSVRLMSSHDDHLTKEEVVDRVVSVVKSFPKVDPSRVTPEVHFQKDLGLDSLDNVEIVMALEEEFKLEIPDKEADKIDSCNLAIEYIHNHPLAS

SEQ ID NO: 93025 - protein, 334 aa, Prochlorococcus marinus str. MIT 9215
MGRILLTGGFGYIGSHTAAQLAEKGEDFIIYDNFCNCNSNIVNQLEKTIGEKINFIEGDIRDISKLEAIMSTNKITSVAHFAALKYVGDSVKSPLDYYDVNVLGTINLLKIMQKYGVNKFLFSSSASIYGEPEYLPIDEMHPLKAINPYGETKLMVEKVLEDLSRSDDSWSIISLRYFNPLGAHQFGFIGDDPFSKNSQNLLPSIIRAALGLSRKIKIYGDDYDTKDGTGVRDYIHIIDLANAHLKALIHLNSNKGINVFNLGTGRGFSVLEVINTFEMVTGKHVPKQIIKRRKGDVSSCYADPSRANTFLDWKTKLDLKEMCLSAWNFSNKKD

SEQ ID NO: 93026 - protein, 293 aa, Alkalilimnicola ehrlichei MLHE-1
MTDARPDPIREAIARVLGVPAAELRLQGVGGGCVSDTARVHAGGRTAFLKREPASRGWQLAAEAEGLEALAAAGALRVPRPLSQDEADGQAWLLMEYLEIERAGDWAAMGRALAATHAATADRHGWHRDNALGGTPQDNTREADWALFFRDRRLRPQLALAAANGHDGPWLERGARLAERLPSLLDHAPAPSLLHGDFWGGNAGFCAGRPATWDPAVHYGDRECDLAMAALFGGFGPAFRHAYQAEWPLPPGHELRQELYQLYHILNHLNLFGAAYLGSARRLIDRLLAAGNG

SEQ ID NO: 93027 - protein, 401 aa, Yersinia pestis KIM
MKVFNPMDFRREFPALSDKLTYLDSAATALKPRAMIDATQQFYQQDSATVHRSQHQSALSLTVRFENTRQQVADFINSSTAENIIWTRGTTEAINLIAQSYARPRLQPEDEIIVSEAEHHANLIPWLMVAEQTGAKIVKLPLGLDHLPDLQQLPQLLNEKTRILALGQMSNVTGGSPDLAQAIRLAHQYDCVVVVDGAQGIVHYPADVQALDIDFYAFSSHKLYGPTGIGVLYGKTELLEEMPAWQGGGKMLTHASFGGFTPHEVPYRFEAGTPNIAGVIGLSAVLKWLEHIDLEEAEVYSQGLATMAENKLAQLPGFHSYRCQQSSLLAFTFDGVHHSDLVALLAEQGIALRAGQHCAQPLMAALGVNGSLRASFAPYNTPQDVEMLCSALGKALELLRD

SEQ ID NO: 93028 - protein, 451 aa, Shewanella oneidensis MR-1
MSLVVAKFGGTSVADYGAMNRCAEIVLGNPDCRLVVVSASSGVTNLLVELTQESINDDGRLQRLKQIAQIQYAILDKLGRPNDVAAALDKLLSRMAVLSEALVSARSKATMDELLSLGEQCSSALFAAVLREKGANSSAFDVRRVLRTDSHFGRAEPQVEQIALLSREHLLPLLSEQVIVTQGFIGADEAGQTTTLGRGGSDYSAALLAEALTASAVEIWTDVAGIYTTDPRLAPNAHPIAEISFNEAAEMATFGAKVLHPATILPAVRQQIQVFVGSSKEPEKGGTWIRHQVEDAPVFRAVALRRDQTLLNLHSLQMLHAQGFLAETFATLARHKISVDLITTSEVNVSLTLDKTGSDSSGQGLLSEALLQELSQHCRVRVEDGLALVAIIGNRIATTAGICRRVFEVLEPHNVRMICQGASPHNLCVLVAESEAAQVVKALHENLFEGA

SEQ ID NO: 93029 - protein, 349 aa, Zea mays
MASPALISDTDQWKALQAHVSAIHKTHLRDLMTDADRCKAMTAEFKGLCPYSRADPAHRDLVVRVLPLSLQYGFPIVQKFLEGASSIDNHFYSSSFEKNIPVLLGLLSVWNVSFLGYPARAILPYSQALEKLAPHIQQLSMESNGKGVSIDGAQLSFETGEIDFGEPGTNGQHSFYQLIHQGRVIPCDFIGVVKSQQPVYLKGETVSNHDELMSNFFAQPDALAYGKTPEQLHSEKVPENLIPHKTFKGNRPSLSLLLPTLSAYEVGQLLSIYEHRIAVQGFIWGINSFDQWGVELGKSLASQVRKQLHGTRMEGKPVEGFNHSTSSLLARYLAVKPSTPYDTTVLPKV

SEQ ID NO: 93030 - protein, 104 aa, Zea mays
MQRLASSRRLLQAALAPARANSSLSAAACQGQATEAAARASASRCSSCRKRVGLTGFRCRCGELFCGAHRYSDRHGCSYDYRGAARDAIARENPVVRAAKVVRF

SEQ ID NO: 93031 - protein, 325 aa, Shewanella oneidensis MR-1
MQTLAQHLTSKAVNESLAQLILTLADTSKAISHAVRHGALAGVLGATEQENVQGETQKKLDIITNDMLKDALKADGTVRGLASEEEDHVVEVSANGQYLVCFDPLDGSSNIDINSLVGTIFSVLPAPQGELTEASFLQSGRNQLAAGYVLYGPSTMLALTTGQGVQLFTLHPETNEFLLTNATMSISPDTSEFAINMSNQRFWEAPMQTYIADLLLGKIGPREKSFNMRWIAAMVGDVHRVLSRGGIFTYPTDNKDPKKPYKLRLMYEANPMAFLVEQAGGKASTGYETILDIQPTQIHQRVAVILGSANEVDACLSYHGIDSRK

SEQ ID NO: 93032 - protein, 264 aa, Haloarcula marismortui ATCC 43049
MVGVGTWDIDGDTVQKSVRAGLNVGYAHVDTAEGYKNESEIGEALADYDREDVFLTSKVLPKHLDYESVIEACEASLDRLGTDYLDLYLVHWPNPATSIRETMNAMATLHDQGKIRNVGVSNFSAYQLGAAQHVADVPIAVNQIEYHPWNTQDQVVEFCRDTDTVVEAAAPLGRTKVFADDIIQDLSEKYDRSPAQIVLKWAVENNVVVLPKSSSPEHVRQNFDLFDWELDATDRERIDAIEREQAVYDTGINDWDNDTYGISQ

SEQ ID NO: 93033 - protein, 743 aa, Ostreococcus tauri
MASEDGPRTWDGSTPPVIVNNVPGTWAHDTVSRRLREDILARVFRDNASVIEGEAEINLRQLEDELRTASTSVIKHIADDGGPDCETWRELLEPWVGISWLDAPWLIVEFYFYRRILSAIGYFDESSPTFLHDPFAQMRSRNGRRGARTEPISLDELRLFVMVALWGNRMDLSIWPESDEGGNRASEAFTEALQAGEKYLLWDDSKVVASALAEGMRDVSIVVDNAGFELTCDLALADALVVSGVGRVILRVKAHPVFVSDAMDKDCRDTIDAMIDSADDETAAMGRRWASHLASGKWAIVPDFAWCQPQPFWALPKDTRDELKSSDLVVIKGDANYRRLLNDCLWELSTPFADVSSYFPAPLLALRSLKAELGCGIPMDRLAAVENEKDWMVTGKYGVVQYNARPARQYRVSSQIDGCKTFAGRDLPPVERLSLKKVLVALANASEELADALAVAPMRSSTLLGSVGGAKNASGDSQQKLDVVANDIFKQHLAECGGVRYYASEEEATPACLNESGKFVVCIDPLDGSRNIACNVPVGSIFGVYRVREDEDAVTNATQAGSEQVAAGYAHYSGATTLVLACGDDGPAIEYTLHEGNFEVANARMSCPPRGQVYSLNDARFDDWPEGLKEYVTDVRNGRGDTKKQYSARYICSLVGDFHRTLIYGGWAGNPRPHLRVVYEAAPLAFVARAAGAASSDGLVDVLTKKPAELHERSPLFLGSTEDIAELVRRGDVRQDDSKTYAV

SEQ ID NO: 93034 - protein, 629 aa, Ustilago maydis 521
MVAPQRRTVMPALGLLASSLCSLLLTANAATVEQHWNINWVPDVNPDGLYPRHVIGVNGSWPPPIINVNASDTVRITATNKLETGVGASLHSHGMFFNRTGYYDGAVAITQCPIPPGQSFTYETLNSPASPADRRKQMGTFWIHAHNNDQYTDGLRSPVIIHPDDPADIHYNYDDDYTVILGDWYHSNYTDLVKNEFMNRKNPTGAEPVPKSGLIYFAHTSNKTSAATYLPGFSENATLPFEAGKTYRLRVINMSALAAFYFYLSGHDMQVIEVEGVDVLPQPVDFLSVAVAQRFSVLVTARNDTDPQNWKLHANMDEDMFDVVPEDLQLNVSATISYPNAPKDKFGPEKILEEYTYFDDLQFVPVNAEPMVTPDAVHRLDVSFDTMSDGENYAAFNNISYVAPQVPALFSAESMGALASNPAIYGPNSNAFVIKHNEMIEVQLFNWDAGKHPFHLHGHHFQVVHKSQDVTSDDPTINPPFNSSQVNPMRRDTVMVPPGGSAYLRFRADNPGAWFFHCHIDPHLVSGLASIFIEAPDVLSDSFLNVPSYIKNQCQAQGIATTGNAVGLNSTSDFDGLAKGPTYLESGWTGRAIAAFTGCIITGLLGLATVVVYGWHSGEEDDDEEEEDK

SEQ ID NO: 93035 - protein, 360 aa, Brassica napus
MQAVSPTFSCDLKPMIQTNLTAKIARYSHVNRNRVSVRCSYKSESFSFPNGVGSSRADWQSSCAILASKVASAENSSSITGSLADQVAAVNGHSNDSVNLSLVPSNTQNGKPGLIQPLTNTDLSPAPSHGSTLRVAYQGVPGAYSEAAAGKAYPKSEAIPCDQFDVAFQAVELWIADRAVLPVENSLGGSIHRNYDLLLRHRLHIVGEVQIPVHHCLLALPGVRPDCVRRVISHPQALAQTEGSLNKLTPKAAIEAFHDTAAAAEYIAANNLRDTAAVASARAAELYGLQILADGIQDDAGNVTRFLMLARDPIIPRTDRPFKTSIVFAAQEREGTSVLFKVLSAFAFRNISLTKIESRP

SEQ ID NO: 93036 - protein, 489 aa, Burkholderia mallei ATCC 23344
MSVYGLQRLYIAGAHADATSGKTFDTFDPATGELLARVQQASADDVDRAVASAREGQREWAAMTAMQRSRILRRAVELLRERNDALAELEMRDTGKPIAETRAVDIVTGADVIEYYAGLATAIEGLQVPLRPESFVYTRREPLGVCAGIGAWNYPIQIACWKSAPALAAGNAMIFKPSEVTPLSALKLAEIYTEAGVPAGVFNVVQGDGSVGALLSAHPGIAKVSFTGGVETGKKVMSLAGASSLKEVTMELGGKSPLIVFDDADLDRAADIAVTANFFSAGQVCTNGTRVFVQQAVKDAFVERVLARVARIRAGKPSDPDTNFGPLASAAQLDKVLGYIDSGKAEGAKLLAGGARLVNDHFASGQYVAPTVFGDCRDDMRIVREEIFGPVMSILSFETEDEAIARANATDYGLAAGVVTENLSRAHRAIHRLEAGICWINTWGESPAEMPVGGYKQSGVGRENGITTLEHYTRIKSVQVELGRYQPVF

SEQ ID NO: 93037 - protein, 289 aa, Oryza sativa Japonica Group
MAVAARLRSAGARLVVGPAAMAVGRGGGGEGRWMGTATAEAAAGIASVDVLSDPSLWIDLDCVRLSEIYLCVLQVYRTIGEKYGVNYSEDEILMRYRRAYAQPWGRSRLRYVDDGRPFWQHIVSSSTGCSDLQYFEELYQYYTTAKAWQLCDPDAKYVFEALRKAGVKTAVVSNFDTRLRPLLQALNCDHWFDAVAVSAEVAAEKPNPTIFLKACEFLGVKPEEAVHIGDDRRNDLWGARDAGCDAWLWGSDVYSFKENQAHIIKSGLLCRSQKGSELRCKESFVRWVT

SEQ ID NO: 93038 - protein, 325 aa, Magnetospirillum magnetotacticum MS-1
MKTNAIRIHQPGGPEVMVWEEVDLAAPGAGQVLLRHTAVGLNYIDVYHRTGLYPAPLPFTPGLEGAGIVEAVGDGVTELKAGDRVAYANPPLGAYSVSRLMPADRLVKLPDHIHDRTAAAMMLQGMTAQYLLRRTYRVQPGDTILIHAAAGGVGLLVCQWAKHLGATVIGTVGSEEKAALAKAHGCDHTILYKSEDFVARVKEITKGEGVPVVYDSVGKDTFLNSLDCLRPLGMMVLFGQSSGKVEPFDTGLLGAKGSLFLTRPSLMAYTAKRSDMVASASELFEVVGKGVVKVEINQTYSLKDAAQAHRDLEARKTTGSTLLLP

SEQ ID NO: 93039 - protein, 270 aa, Debaryomyces hansenii CBS767
MLRYLGLRIPFTSTIRTLRVKMSTFPQPTEVRQKEISSAYDKISEQVSNLSAEHSSKPVRLVAVSKLKPSSDIMALYNHGVRHFGENYVQELIGKSQELPKDIKWHFIGGLQTGKCKDLSKGVENLYAVEAIDSLKKCKKLESCRKNAEGNSINIYLQINTSGEDQKSGYSLEVLDELYETVEFLLDPKQCTLLNIQGLMTIGSFSESISEEGNADFKRLLTLKQKLDDKYRLDLELSMGMSNDFKEAIKQGSSSVRVGSSIFGARPTKS

SEQ ID NO: 93040 - protein, 729 aa, Escherichia coli
MLYKGDTLYLDWLEDGIAELVFDAPGSVNKLDTATVASLGEAIGVLEQQSDLKGLLLRSNKAAFIVGADITEFLSLFLVPEEQLSQWLHFANSVFNRLEDLPVPTIAAVNGYALGGGCECVLATDYRLATPDLRIGLPETKLGIMPGFGGSVRMPRMLGADSALEIIAAGKDVGADQALKIGLVDGVVKAEKLVEGAKAVLRQAINGDLDWKAKRQPKLEPLKLSKIEATMSFTIAKGMVAQTAGKHYPAPITAVKTIEAAARFGREEALNLENKSFVPLAHTNEARALVGIFLNDQYVKGKAKKLTKDVETPKQAAVLGAGIMGGGIAYQSAWKGVPVVMKDINDKSLTLGMTEAAKLLNKQLERGKIDGLKLAGVISTIHPTLDYAGFDRVDIVVEAVVENPKVKKAVLAETEQKVRQDTVLASNTSTIPISELANALERPENFCGMHFFNPVHRMPLVEIIRGEKSSDETIAKVVAWASKMGKTPIVVNDCPGFFVNRVLFPYFAGFSQLLRDGRDFRKIDKVMEKQFGWPMGPAYLLDVVGIDTAHHAQAVMAAGFPQRMQKDYRDAIDALFDANRFGQKNGLGFWRYKEDSKGKPKKEEDAAVEDLLAEVSQPKRDFSEEEIIARMMIPMVNEVVRCLEEGIIATPAEADMALVYGLGFPPFHGGAFRWLDTLGSAKYLDMAQQYQHLGPLYEVPEGLRNKARHNEPYYPPVEPARPVGDLKTA

SEQ ID NO: 93041 - protein, 524 aa, Erysiphe necator
MYIADILSDLLTQQTTRYGWIFMVTSIAFSIILLAVGLNVLSQLLFRRPYEPPVVFHWFPIIGSTISYGIDPYKFYFDCRAKYGDIFTFILLGKKVTVYLGLQGNNFILNGKLKDVNAEEIYTNLTTPVFGRDVVFDCPNSKLMEQKKFMKTALTIEAFHSYVTIIQNEVEAYINNCVSFQGESGTVNISKVMAEITIYTASHALQGEEVRENFDSSFAALYHDLDMGFTPINFTFYWAPLPWNRARDHAQRTVARTYMNIIQARREEKRSGENKHDIMWELMRSTYKDGTPVPDREIAHMMIALLMAGQHSSSSTSSWIMLWLAARPDIMEELYEEQLRIFGSEKPFPPLQYEDLSKLQLHQNVLKEVLRLHAPIHSIMRKVKNPMIVPGTKYVIPTSHVLISSPGCTSQDATFFPDPLKWDPHRWDIGSGKVLGNDAVDEKYDYGYGLTSTGASSPYLPFGAGRHRCIGEQFATLQLVTIMATMVRFFRFRNIDGKQGVVKTDYSSLFSMPLAPALIGWEKR

SEQ ID NO: 93042 - protein, 270 aa, Triticum aestivum
  misc_feature (42)..(42): Xaa can be any naturally occurring amino acid
  misc_feature (185)..(185): Xaa can be any naturally occurring amino acid
  misc_feature (192)..(192): Xaa can be any naturally occurring amino acid
  misc_feature (224)..(224): Xaa can be any naturally occurring amino acid
MSAYCGKYKDELIKNAAYIGTPGKGILAADESTGTIGKRFAXSINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAVLKIGATEPSQLSIDQNAQGLARYAIICQENGWVPIVGXEILVDGXPHDIDRCAYSPKIVLAACYKASNDQHSSSKGXLLEPNMVTLGSDPRSGPEVMLIHVAPPKDVLLPSRNVSPGGKTRGT

SEQ ID NO: 93043 - protein, 176 aa, Vibrio sp. Ex25
MSLNHVPAGKSLPEDIYVVIEIPANADPIKYEVDKDSGAVFVDRFMSAPMFYPCNYGYVNNTLSLDGDPVDVLVPTPYPLMPGSVIRCRPVGVLKMTDESGEDAKVFAVPHTKISKEYDHIQDVDDIPELLKAQITQFFERYKELEAGKWVKVDGWADVAAAKAEILESYERAQKK

SEQ ID NO: 93044 - protein, 302 aa, Debaryomyces hansenii CBS767
MTDFVYQGPDFEEKVKKQVEFYFSDSNLQTDKFLWRIYEANDGWVELKTILTFGRMRQYRPEDKVIAALKTSEKLVLSPKEDMVRRKDPLKEFNELKNTRKRNSVHIEGFPNEITQEDLEEFFNTKIIPNLPKEKVICSIRRIKTRSTKEFFGVVDIEFKTQEDTDYFLKEIEISYPQGIVAKDSADVGEKSVLRKMSLLTFQEMRESSKRFGVNEVTKRRNSFNDSRGNKKFGKGFKGKKNNRRPSKGQEDSNDEESANISKVVEEPSNDSENAESVPSKSTNDEEKKSEAPEDKKNEAEN

SEQ ID NO: 93045 - protein, 338 aa, Vibrio sp. Ex25
MSGLRTLGEFIVEKQADFPHASGDLSSLLASIRLAAKIVNREINAAGLGDITGAVGTENVQGEDQQKLDVYANDKFKAALEARDQVCGVASEEEDEAVAFNKELNQNAKYVVLMDPLDGSSNIDVNVSVGTIFSIYRRVSPIGTPATEEDFLQPGHKQVAAGYVIYGSSTMLVYTTGNGVNGFTYDPSIGSFCLSHENMMIPEEGKIYSINEGNYIRFPQGVKKYIKYCQENVPEDGRPYTSRYIGSLVADFHRNLLKGGIYLYPSTQSHPQGKLRLLYECNPMAFLIEQAGGIASDGVNRIMDIKPTELHQRVPFFVGSKNMVRKVEEFLELHRDEE

SEQ ID NO: 93046 - protein, 502 aa, Xylella fastidiosa Dixon
MHNGFDALQLHANRLRGVTIPDLLAAELKRPEQYARQVGPLYFNFARQKYDCVALEALFALARNHNVTGAFQRMFCGEQVNVTEGRAVLHTALRGDLSGTSVAVAAYTAAAKVRERMYALIAGLDASEVTDIVSVGIGGSDLGPRLVVDALRPISQGRFRVHFVSNVDGAAMRRTLDMLDPSRTAGILISKTFGTQETLLNGRILYDWLGGSERLYAVSANPERAVHAFDIVPTQVLPIWDWVGGRYSLWSAVGFPIALAIGSQRFEELLAGAAEFDAYALRVPLEENVAVLHGLTAVWNRNFLGCATYAVMAYDQRLALLPAYLQQLVMESLGKRVKCDGTPVDRDTVPVWWGGVGTDVQHSFFQALHQGTNIVPADFIGTIRNDDLYTENHFALNANLLAQIEVLANGQLSDDPHRVYPGGNPSTLILLDALTPQALGGLIAMYEHSVYVQSVIWGINAFDQFGVELGKHLAVQLLPALKGESVEVVDPVTRAVLVRLRG

SEQ ID NO: 93047 - protein, 499 aa, Candida albicans SC5314
MFKKALPLVSKLTTPKGITYNQPLGLFINNEYVHPKQQKTFEVISPSTEEKITDVYEALEEDIDTAVAAAQAAYHNGWAQGPPEQRSKVLFKLADLIEENAELLAQIETWDNGKSLQNARGDVALTAAYFRSCGGWADKILGSQINTGNTHFNYTQRVPLVCGQIIPWNFPLLMASWKLGPVLATGSTTVLKTAESTPLSALYLSQLLVEAGMPKGVINIVSGFGATAGAAIAKHPKIEKVAFTGSTATGKIIMKLAAESNLKKVTLELGGKSPNIVFNDADLDKTIQNLIVSIFYNSGEVCCAGSRLLIQSGVYDQVVEKFKEAAESVKVGNPFDEDTFMGAQVSDVQLSKILKYVESGKSQGATVVTGGARADGKGYFVKPTIFADVKKDMDIVREEIFGPVVTLIKFDTVDEAVELANDSDYGLAAGIHSADVNKCIDVANRVKAGTVWVNTYNDFHPMVPFGGFSASGIGREMGEEVLHEYTQVRAVRMKINPPN

SEQ ID NO: 93048 - protein, 182 aa, Glycine max
MGDYTIRISTSLIDQLSRDDEKVKRRTRKPKPKKVVEQQEEPRDNGRELPSEPKSSPAPAPGWALPPPMYLPVTPAPPPPPPAIQEVETIHAVVAESEKVLEKLQKQEATMHEELTKRAKELHEKEFKLPYQNPSPCTDERAGCAECYQSNIQDPLKCAEAVKRFEACVSMARRSGTMGAAQ

SEQ ID NO: 93049 - protein, 185 aa, Saccharophagus degradans 2-40
MFNIANQLTLGRILFIPLLVVVYYSPLEWKYWYSAALFGLAGITDWLDGYIARKYGMDTPFGAFLDPVADKLMVAVALAVLIEAHADVWFTLPATVIIGREIVISALREWMAELGARAKVGVSMIGKVKTTLQIIAIVLLLAFNPASYPLFNKVGYITLYVAAILTLWSMIVYLRAAWPSLKGAK

SEQ ID NO: 93050 - protein, 306 aa, Gluconobacter oxydans 621H
MMTRLFPFWAILVSGFALLVPGPFLTLVPVITPLLAFVMFTMGVSLTPADFGRILRRPAPVLAGVGLHYLVMPLAAWGIAHLLSMPPALATGMVLVGCVSSGTASNVMIYLSRGDVALSVSISAFSTLVGIVATPLLVRFYVSAGVAVDSWALFRSILTMVALPVLAGVTLNTLCHRAVKRVEPALPLVAMVSILLIIGAIVAGVGPSLKEVGPVMLLAVILHNGIGLLGGYWGGRLLGFDESICRTLAIEVGMQNSGLAATLGRLYFSPLAALPGAVFSIWHNVSGSILASLWTSRPIARKDPSC

SEQ ID NO: 93051 - protein, 196 aa, Lactococcus lactis subsp. lactis Il1403
MTYPQLELENYKGTTAIINTNHGKMTVKLFDNLAPKTVKNFIELSKEGYYDGVIFHRIIKDFMVQGGDPTGTGMGGSSIYGEKFEDEFSMDLFNLRGALSMANAGPNTNGSQFFIVQNKNLPYPKDSLIQGGWPEEVAETYTGGGTPHLDGRHTVFGQLVDEESYKVLDEIAAVRVGAQDKPVDDVVIESVEIIEP

SEQ ID NO: 93052 - protein, 325 aa, Anabaena variabilis ATCC 29413
MSNPRVLCLGEVLFDCLADQLGLKLEEVKSWTAYPGGAPANVACALVKLGTPAGFIGAVGEDEPGNALVKLLQEVGVDTTGVQRHSTAPTRQVYVVRDLAGDRTFAGFGQYDTSEFADTHLQAKQLPESVFQEADFLILGTLELAYPDSEKAIHRALELAEQYDLKIVLDVNWRPVFWHDENIARQKIQEIFKRVDFLKLAKEEAEWLFDTSDPGAITYRLGSIEGVLVTDGENGCGYCLGENEGKIPAFAVSVVDTTGAGDSFLAGFIHQLSQHGIHNLNDAETAKRIITYASAVGALTTTKAGAIASQPTAVEVETFLASHKI

SEQ ID NO: 93053 - protein, 443 aa, Citrobacter freundii
IGVVGMAVMGRNLALNIESRGYTVSIFNRSREKTEEVVAENPGKKLVPYYTVKEFVESLETPRRILLMVKAGAGTDAAIDSLKPYLDKGDIIIDGGNTFFQDTIRRNRELSAEGFNFIGTGVSGGEEGALKVPSIMPGGQKEAYELVAPILTKIAAVGKDGEPCVTYIGADGAGHYVKMVHNGIEYGDIQLIAEAYPLLKGGLNFSNEELATTFTEWNEVRLSSYLIDITKDIFTKKDEEGKYLVDVILDEAANKGTGKWTSQSSLDLGEPLSLITESVFARYISSLKDQRVAASKVLSGPRLKLAGDKAEFVEKVRRALYLGKTVLYAQGFSQARAASDEYHWDLNYGEIAKIFRTGCIIRAQFLQKITDAYAEKKGIANLLLAPYFKNIADEYQQALRDVVAYAVQNGIPVPTFSAAVAYYDSYRFAVLPANLIQAQRDYF

SEQ ID NO: 93054 - protein, 479 aa, Prochlorococcus marinus str. MIT 9215
MSSDQIVPVILCGGAGSRLWPLSRESYPKQFLKLHFTDSKSLLQNTHLRTKKIKNLEPPILICNEEHRFIVAEQMREINANPNSIILEPCGRNTAPAIVISALKALEIYEDPSILILSSDHQIVDENKFVEVIERGLKYSREGKLVTFGIIPKSPEVGYGYIKSQKAIDVESLNGSVIESFIEKPDKDTAKKFLLDKRFSWNSGIFLFKASSILKEIKNFAPEILEICSCALKKNLYDLDFQRIDEKFFSKCPNISIDVAVMEKTKNAFVLPLDAGWSDVGSWDFVWKISKKDENGNVIEGNVIAENTQNSLLSSNKRLVAVIGLKDLVVIETNDAILVADKKECQKVKDIVKKLNHKNIPEGVEHQKCYRPWGDYESLVKGGKWQVKLINVKSGEKLSLQKHKYRTEHWVVVSGTAKVEIDGKEMILNQNQSSYIPLGCKHRLSNPGNNDLKIIEVQSGSYLGEDDIERFDDNYGRIG

SEQ ID NO: 93055 - protein, 290 aa, Arabidopsis thaliana
MKLKQEEEVAVERERKWRNHMERARLSTKVGVATALLRASLPSLSDRQVYRSALVEDMGEEDTATVDQNSFGGGKDSLLRNRHSSPLPSPTQLSSKVITLPTVLTLGRVAAVPILVATFYVDCWWGRTATTSIFIAAAITDWLDGYIARKMRLGSEFGAFLDPVADKLMVAATLILLCTKPMVAVVLGPVPWLVTVPSIAIIGREITMSAVREWAASQNGKLSEAVAVNSLGKWKTATQMIALTILLASRDSSFERLLPSGIGLLYVSAGLSIWSLVVYMRKIWRVLLKK

SEQ ID NO: 93056 - protein, 443 aa, Salmonella enterica
IGVVGMAVMGRNLALNIESRGYTVSVFNRSREKTEEVIAENPGKKLVPYYTVKEFVESLETSRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYF

SEQ ID NO: 93057 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNCELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKANRVAASKVLSGPKAQPAGDKAEFIEKVRRALYLGKIVSYAQGFSQLRAASDEYHWDLNYGEIAKIFRAGCIIRAEFLQKITDAYAENAGIANLLLAPYFKKIADEYQQALRDVVAYAVQNGIPVPTFSAAVAYYDSYRAAVLPANLIQAQRDYF

SEQ ID NO: 93058 - protein, 501 aa, Sulfitobacter sp. EE-36
MAAKTAVNILERGGNAMDAAIAGAVLLGICEPQMTGIGGDCFVLYSPAGSDEVHALNGSGRAPAALDAAHLRDAGEKTVPLRSAHAVTIPGAIDAFCHLSDTIGTMGLDTILAPAIRYAEEGVPVAARVAFDWGNDASTLQGAARDFYLTGGEAPKTGDIFRAPGQAEVLRRIAKDGRDAFYAGEVAEDIVASLNAMGGKHTAEDFAATACTPGEPLASTYQGVEVLEHAPNGQGATALLMMNMLSHFDVASMDPWGAERVHIEAETAKLAYDARNRFLADPDHTARLAHMLALETAQELAALIDPKKAMPDPVALSEAVHKDTIYITVVDKDGMSVSLIYSIFHGFGSGIASDKFGILLQNRGAGFTLDQGRANELKGGKRPMHTIIPGMIKRDGKVIMPFGVMGGAYQPNGHARFVSNLTDFGLDPQAAIDAPRAFSDNGILKVERGYSDAVRAELAEMGHKVEIPATAIGGAQAIQLHDNGLLEGASDARKDGCALGY

SEQ ID NO: 93059 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGGGHYVKMVHNGIEYGDMQLIAEAYSLLKGGLNLSNEELANTFTEWNNGELSSYLIDITKDIFTKKDEDGNYLIDVILDEAANKGTGKWTSQSALDLGEPLSLITESVFARYISSLKAQRVAASKVLSGPKAQPAGDKAEFIEKVRRALYLGKIVSYAQGFSQLRAASDEYHWELNYGEIAKIFRAGCIIRAQFLQKITVAYAENAGIANLLLAPYFKKIADEYQQALRDVVAYAVQNGIPVPTFSAAVAYYDSYRAAVLPANLNQAQRDYF

SEQ ID NO: 93060 - protein, 347 aa, Oryza sativa Indica Group
MERRRWLQAAVLCCLLVLCSGRELKTKHTPIYNSTLARTLAEYTSAVYTADLTQLFSWTCERCCDLTEGFEVIELIVDVKNCLQAYVGYASDMNAVVVVFRGTQETSIQNWIEDLFWKQLDLDYPGMPQAKVHSGFYSAYHNTTLRDGVVNGIKKTREAYGNIPIMVTGHSMGGAMASFCALDLVVNYRLKDVTLITFGQPRIGNAVFASHFKCHLPNAIRVTNAHDIVPHLPPYYHYFPQKTYHHFPREVWVHNVGLGSLVYSIEQICDDSGEDPTCSRSVSGNSVQDHINYLGISMHAEASGSCRIVTGDNKLQYKMDSDGNIVFSKQPGLSVDQLHSSQHGIGS

SEQ ID NO: 93061 - protein, 764 aa, Methanosarcina barkeri str. Fusaro
MADREKITAKLKVAEADQRDVGKGIVRVDDSFREKLGLKPFDVVEIRGGKSTSALLGRPYPSDSGLDIIRMDGLIRTNAKTSIGEYVDIRKADWKEARSVTLAPVAKGMQIYAPSETLKAIFMNRTVSKGDFISTTSLRRSRERETLGKGIMFEDFFQDFFGPGMGQSFGLGEIKLQVVSTSPSGIVKITDMTEVELLPEAAEITPEQNVPTVMYEDLGGVKEAITKIREMIELPLKHPELFDRLGIDAPKGVLLYGPPGTGKTMLAKAVANETDAYFISVNGPEIMSKYYGESEKGIRDVFEDAEKNAPAIIFLDEIDSIAPKRAEVTGEVERRVVAQLLSLMDGLKARKNVIVIGSTNRPEAIDMALRRPGRFDREIELRVPDTEGRLEIFQIHTRGMPLAENVNLMDFAQITYGFVGADIAALCREAAMSSLRRILPKINLNEPEIPSEILDTLRVTREDFENALKDVQPSAIREILIEIPNVSWEDVGGLEGVKQLLKEAVEWPLKSPESYRDIGVEAPKGVLLYGPPGTGKTLLAKAIAHESEANFITAKGSDLLSKWYGESEKRIAEVFSRARQVAPSIIFLDELDSLAPIRGAAIGEPQVTARILNQLLSEMDGLEELRAVVVIGATNRPDIIDPALLRPGRFDELILVPVPDAGARKEIFRVHTAKMSLAEDVDIDKLVSMTDQYTGADIAAVCKKAGRDALREDLHAKEVKQKHFLQAIAETGPSVTPDTMKYYQAVQSGLRKRQSKEIETPFYT

SEQ ID NO: 93062 - protein, 355 aa, Prochlorococcus marinus str. MIT 9215
MAYPKIICTIGPSSDSKENLLNLKNCGVHVARVNLSHATIDDLQRYIEITKSIDLELGIDTEGAQIRTKISNCEKISIYKNNNLKIYREFESNSTVPNISLSPKILFSLIKKGSLLRLDFNGALVKVIEIKENFIECECINEGIVGNNKGVDVLDQLIELPDFSEKDIKALELARSLGIKEIFISFCKSKQAIQRVKSIIPDSIVTSKIESKYSIHNLIEICEYSDAILIDRGDLTREINIMDIPFAQRGIIKVAKENNVPCYVATNVLESLIEGNLPTRAELNDIVSTIEMGAGGIVLAAETAIGKKPILCAEIVKELIHRYNLHKNQLLFADLERNEINDKEMKLWLNRHNKY

SEQ ID NO: 93063 - protein, 468 aa, Xanthomonas oryzae pv. oryzae KACC10331
MSLPILNRIALAISSLSPRPDVLSMSADTTASAPSSATATGSLGDHHASVAVPKGGHWWFRLLAFLGPGYMVSVGYMDPGNWATDLAGGSQFGYLLLSVILLSNLMAIVLQGLSARLGIATGLDLAQACRARYPRGVNLALWGICELAIIACDLAEVIGTAIALKLMFGIPLTMGAIITAVDVVLVLLLMNRGFRALEAFVIALLLIIFVCFGLQMALAAPPIAAVLGGFIPRAQVVTDPQALYLAIGIIGATVMPHNLYLHSSIVQTRAYPRTDVGRKSALRWAVTDSTVALMFALFINASILILAAAVFHAQGRTDVQEIEQAHALLAPMLGVGLASTLFAVALLASGINSTVTATLAGQIVMEGFLQLRLPPWVRRLLTRGIAIVPVVIVTWLYGEAGTARLLVLSQVVLSMQLPFAVIPLVRFVSDRQLMGALVAPAWLVRIAWGIAAVIVCLNLKLLWDTALH

SEQ ID NO: 93064 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKKQPAGDKAEFIGKVRRALYPGKIVSYAQGFSQLRAASDEYHWDLNYGEIAKIFRAGCIIRAQFLQKITDAYAENADIANLLLAPYFKKIADEYQQALRDVVAYAVQNGIPVPTFSAAVAYYDSYRAAVLPANLIQAQRDYF

SEQ ID NO: 93065 - protein, 444 aa, Mannheimia haemolytica
  misc_feature (122)..(122): Xaa can be any naturally occurring amino acid
MATGKIVQIIGAVIDVEFPQDAVPKVYDALKVESGLTLEVQQQLGGGVVRCIALGSSDGLKRGLKVENTNKAIEVPVGTKTLGRIMNVLGEPIDEAGPIGEEERWTIHRAAPSYEEQANSTXLLETGIKVIDLVAPFAKGGKVGLFGGAGVGKTVNMMELIRNIAIEHSGYSVFAGVGERTREGNDFYHEMKDSNVLDKVSLVYGQMNEPPGNRLRVALTGLTMAEKFRDEGRDVLFFVDNIYRYTLAGTEVSALLGRMPSAVGYQPTLAEEMGVLQERITSTKTGSITSVQAVYVPADDLTDPSPATTFAHLDSTVVLSRNIASLGIYPAVDPLDSTSRQLDPLVVGEEHYNVARGVQGTLQRYKELKDIIAILGMDELSEDDKRLVARARKIERFLSQPFHVAELFKGVPGKFVPLKETIRGFKGILEGEYDHIPEQAFYMA

SEQ ID NO: 93066 - protein, 231 aa, Glycine max
  misc_feature (118)..(118): Xaa can be any naturally occurring amino acid
MSEEDKTAASAEQPKRAPKLNERILSSLSRRSVAAHPWHDLEIGPDAPAVFNVVVEITKGSKVKYELDKKTGLIKVDRVLYSSVVYPHNYGFVPRTLCEDNDPMDVLVLMQEPVVPGXSFLRARAIGLMPMIDQGEKDDQIIAVCADDPEYRHYNDISELSPHRLQEIKRFFEDYKKNENKEVAVDAFLPATTAREAIQYSMDLYAQYILQSLRQEIASTILSGVLRSVIL

SEQ ID NO: 93067 - protein, 444 aa, Bibersteinia trehalosi
MATGKIVQIIGAVIDVEFPQDAVPKVYDALKVESGLTLEVQQQLGGGVVRCIALGTSDGLKRGLKVENTHKAIEVPVGTATLGRIMNVLGEPIDEAGPIGEEEAWAIHRAAPSYEEQSNSTELLETGIKVIDLICPFAKGGKVGLFGGAGVGKTVNMMELIRNIAIEHRVYSVFAGVGERTREGNDFYHEMKDSNVLDKVSLVYGQMNEPPGNRLRVALTGLTMAEKFRDEGRDVLFFVDNIYRYTLAGTEVSALLGRMPSAVGYQPTLAEEMGVLQERITSTKTGSITSVQAVYVPADDLTDPSPATTFAHLDSTVVLSRDIASLGIYPAVDPLDSTSRQLDPLVVGEEHYNVARGVQDTLQRYKELKDIIAILGMDELSEEDKLVVARARKIERFLSQPFFVAEVFTGSPVNMFHLKDTIRGFKGILEGEYDHIPEQAFYMA

SEQ ID NO: 93068 - protein, 444 aa, Actinobacillus lignieresii
  misc_feature (8)..(10): Xaa can be any naturally occurring amino acid
  misc_feature (12)..(12): Xaa can be any naturally occurring amino acid
  misc_feature (110)..(110): Xaa can be any naturally occurring amino acid
MATGKIVXXXGXVIDVEFPQDAVPKVYDALKVESGLTFEVQQQLGGGLVRCIALGTSDGLKRGLKVENTGNPIQVPVGTKTLGRIMNVLGEPIDEKGPIGEEARWDIHRXAPSYEEQSNSTELLETGIKVIDLICPFAKGGKVGLFGGAGVGKTVNMMELIRNIAIEHSGYSVFAGVGERTREGNDFYHEMTDSNVLDKVSLVYGQMNEPPGNRLRVALTGLTMAEKFRDEGRDVLFFVDNIYRYTLAGTEVSALLGRIPSAVGYQPTLAEEMGVLQERITSTKTGSITSVQAVYVPADDLTDPSPATTFAHLDSTVVLSRNIASLGIYPAVDPLDSTSRQLDPLVVGEEHYNVARGVQGTLQRYKELKDIIAILGMDELSEDDKLVVARARKIERFLSQPFFVAEVFTGSPVKYVPLKETIRGFKGILNGEYDHIPEQAFYMV

SEQ ID NO: 93069 - protein, 356 aa, Clostridium difficile 630
MNCNIAVIKGDGVGPEIIDEGIKVLNKICCKFNHRFDCEYVLAGGCAIDETGEPLPNKTVEICRKNEAVLLGAVGGPKWDKCKGDKRPESGLLKLRESLGLFANLRPATMYESIKEASPLRTDIVEKGIDFVVVRELTGGIYFGERGRKIIDGIENAYDVEIYNENEIRRIGKRAFEIARNRNKKLISVDKANVLESSRLWRSIMEDLAKEFEDVELSHMYVDNAAMQVVKDPSQFDVIVTNNIFGDIISDEASMITGSIGMLPSASLREDSFGMYEPIHGSAPDIAGKDIVNPIATILSVSMMLRHSFNLEEEAKCIEDAVQSVLNKGYRTIDIYNGVGNVVGTRAMGELIVNEI

SEQ ID NO: 93070 - protein, 444 aa, Pasteurella aerogenes
MSAGKIVQIIGAVIDVEFPQDAVPRVYDALKVESGLTLEVQQQLGGGVVRCIALGSSDGLKRGLKVENTGNPISVPVGTKTLGRIMNVLGEPIDEKGPIGAEDAWAIHRAAPSYEEQSNSTELLETGIKVIDLICPFAKGGKVGLFGGAGVGKTVNMMELIRNIAIEHSGYSVFAGVGERTREGNDFYHEMTESNVLDKVSLVYGQMNEPPGNRLRVPLTGLTMAEKFRDEGRDVLFFVDNIYRYTLAVTEVSALLGRMPSAVGYQPTLAEEMGVLQERITSTKTGSITSVQAVYVPADDLTDPSPATTFAHLDSTVVLSRQIASLGIYPAVGPIRFTSRQLDPLVVGQEHYDVARGVQGILQRYKELKDIIAILGMDELSEEDKLVVARARKIERFLSQPFFVAEVFTGSPGKYVSLKDTIRGFKGILDGEYDHIPEQAFYMV

SEQ ID NO: 93071 - protein, 358 aa, Clostridium difficile 630
MSKKLFIPGPIDVKEEVLQKMATPMIGHRGKDASMLQKSISEKMQKLFYTNNTILLSTSSGTGLMEGSIRSCTSKKAAVFSCGSFGDRWYKMAVANNVPADIFKVELGEATTPEMVDKVLSTGEYDLITVTHNETSTGIRNPIEEIGEVVKKYEDVIYCVDTVSSAGGIKVEVDKIGIDICITSVQKALGLPPGMSICTFSQKAIDRAKQVPFRGVYLDLLAMYEYLIKKNYQYPSTPSLSHMFALDFQLDNILDEGLDNRFNRHEDMANLVRNWAKKHFQIFTNENHLSNTLTVIENTQGISVSNLNSKLQERGFQIANGYGDLKEKTFRISHMGDYTVEDVQELLDNIDDILGFNK

SEQ ID NO: 93072 - protein, 146 aa, Zea mays
  misc_feature (56)..(56): Xaa can be any naturally occurring amino acid
  misc_feature (90)..(90): Xaa can be any naturally occurring amino acid
SARATPPYIFQLPLSVAAVDSTFIMIKPDGVQRGLIGEIIIRFEKKGFYLMALRLXNVPRSFAEKHYANLASKPFFQGLVDLLSSTGPLXEPVVMGSGTDAVYHILDPKIIGSTNPLASVPGNIRDNFAVDIGKHVIHGSDSIESA

SEQ ID NO: 93073 - protein, 439 aa, Actinobacillus succinogenes
VQIIGAVIDVEFPQNAVPKVYDALKVEEGGLTLEVQQQLGGGVVRCIALGTSDGLKRGLAVKNTGNPISVPVGTKTLGRIMNVLGEPIDQKGEIGAEETWAIHREAPSYEDQSNSTELLETGIKVIDLICPFAKGGKVGLFGGAGVGKTVNMMELIRNIAIEHSGFSVFAGVGERTREGNDFYHEMTESNVLDKVSLVYGQMNEPPGNRLRVALTGLTMAEKFRDEGRDVLFFVDNIYRYTLAGTEVSALLGRMPSAVGYQPTLAEEMGVLQERITSTKTGSITSVQAVYVPADDLTDPSPATTFAHLDSTVVLSRNIASLGIYPAVDPLDSTSRQLDPQVVGQEHYDVARGVQGILQRYKELKDIIAILSMDELSEDDKLVVARARKIERFLSQPFFVAEVFTGSPGKYVSLKDTIRGFKGILEGEYDHIPEQAFYMV

SEQ ID NO: 93074 - protein, 530 aa, Glycine max
MVSRFSPDRVNSKKQQLQKHQHTVSMGNCNSEASSQTQPHSDHHPQPRSNSNGITVLPPNSKPSVGRVLGRPMEDVRSTYTFGRELGRGQFGVTYLVTHKHTKQQFACKSIATPKLVHRDDLEDVRREVQIMHHLTGHRNIVELKGAYEDRHSVNLIMELCGGGELFDRIIAKGHYSERAAADLCRQIVTVVHDCHTMGVMHRDLKPENFLFLSKDENSPLKATDFGLSVFFKPGDVFKDLVGSAYYVAPEVLRRSYGPEADIWSAGVILFILLSGVPPFWSKKEQGIFDAILRGHIDFTSDPWPSISSSAKDLVKKMLRADPKQRLSAVEVLNHPWMREDGASDKPLDVAVLSRMKQFRAMNKLKKVALKVIAENLSEEEIIGLKEMFKSMDTDNSGTITLEELKAGLPKLGTKVSESEVRQLMEAADVDGNGTIDYIEFITATMHMNRMEREDHLYKAFEYFDKDRSGYITMEELESTLKKYNMGDEKTIKEIIVEVDTDNDGRINYDEFVAMMRKGKPDLVTNRRRK

SEQ ID NO: 93075 - protein, 198 aa, Burkholderia mallei ATCC 23344
MTLVATATLPTRYGTFTSYAFRVAGGDAEHLALVMGDVAEQPSVLTRLHSECLTGDVFGSYRCDCGEQLDLSLRYIAAEGRGVLLYLRGHEGRGIGLSNKIRAYALQEQGRDTVEANLDLGLPDDAREYDSAAAILRILKVTSVRLMSNNPKKFDTLARHGIPVCERVALAVPVREENERYIRTKQLKFGHYYFDENE

SEQ ID NO: 93076 - protein, 478 aa, Burkholderia mallei ATCC 23344
MPAAPAVPSRAARASAAARLERLPFSGYHKLIFVIIAIAFFFDSVDLGTMTFVLGSIKREFGLSTATAGLVASASFFGMVLGAAVAGLLADRFGRRPVFQWSMVLWGAASYLCSTAQSVDALIVYRVLLGIGMGMEFPVAQTLLSEFVPAAKRGRLIALMDGFWPLGFITAGVVSYFVLPLFGWRTVFALLELPAVFVLVVRRLVPESPRWLEHRGRLAEAGRVLAHVEAKVMKSARVASLPAPSRLAEPACAQGRGAFGEIWSAAYRRRTTMVWLLWFFALLGFYGLTSWLGALLQQAGFAVTQSVFYTVLISLGGIPGFLCAAWLVERWGRKPTCIASLVGGGAMAYVYGQSALFGGSVTLLVGTGLAMQFFLFGMWAVLYTYTPELYGTGARATGSGFASAIGRVGSLIGPYAVGIVLPVFGQGGVFTLGALSFVVAALAVGVLGIETQGLALEALASTHAADDDARDPAGAAAN

SEQ ID NO: 93077 - protein, 321 aa, Physcomitrella patens subsp. patens
MRSENRLKIFSGTANKALSQEIAYYMGLDLGKITIKRFADGEIYVQLQESVRGCDVFLVQPTGPPANENLMELLIMIDACRRASAKNVTAVIPYFGYARADRKTQGRESIAAKLMANLITEAGANRVLACDLHSGQSMGYFDISVDHVYGQPVILDYLASKMISSNDLVVVSPDVGGVARARAFAKKLSDAPLAIVDKRRQGHNVSEVMNLIGDVKGKVAVMLDDMIDTAGTIYNGAALLHAEGAREVYACCTHAVFSPPAIERLSGGLFHEVITTNTIPIAEGNYFPQLTVLSVANLLGETIWRVHEEGSVSSTLSFAAL

SEQ ID NO: 93078 - protein, 453 aa, Candida albicans SC5314
MLRRLFPIRQLYTTTRAMASKSTDPTSLHNPYFYQKPGQKDIWSLINETAAQAQQESGEPIVNLGQGFFSYNPPEFAINAVEEALTKPQFNQYAHARGNPNLLKQVAEHYSRSYGRAVGVDEVQITTGANEGMFAIFFGFLTPGDEVIVFEPFFDQYIPNVEMTGAKIKYVEIKYPKKFDNEVVTGQDWEIDWEGLNNAITDKTKIIVINTPHNPIGKVFTEKELYKIGKLAVEHNLILVSDEVYENLYYTDKFPRPAALPQLPELAERTLTVGSAGKSFAATGWRVGYIQGPANLIKFVTAAHTRICFSTPAPLQQAVSQGFEQAEKSNYFENTRKEYEHKYKIFTKVFDDLGLPYTVAEGGYFVLVNLSKVKIPADYEFPGTISDRGTLDFKLAYWLIKEIGVVGIPPTEFLTESNRKGNGLENCVRFAVCKDDSVLEDAVERLKKLKDYL

SEQ ID NO: 93079 - protein, 253 aa, Lactococcus lactis subsp. lactis Il1403
MSKIAAVTGAGQGIGFAIAKRLYNDGFKVAIIDYNEETAQKAAKELGENSFAIKADVSDREQVISALNAVVDKFGDLNVVVNNAGIAPTTQIETITPEQFHQVYNINVGGVLWGTQTSTALFRKLGHGGKIINATSQAGVVGNPNLMLYSSSKFAVRGMTQIAARDLAEEGITVNAYAPGIVKTPMMFDIAHQVGKNAGKDDEWGMQTFAKDIAMKRLSEPEDVANVVSFLAGPDSNYITGQTIIVDGGMQFH

SEQ ID NO: 93080 - protein, 540 aa, Lactococcus lactis subsp. lactis Il1403
MRAHEILNNPFLNKGTAFTMKERQELGLIGLLPPTVQTIEEQAEQTYEQYLTKPSDLEKRHFLMEIFNTNRTLFYYLFNKHIVEFNPVVYDPTIADTIENYSHLFVDPQYAAYLDINHPENITETLKNAAGDREIRLIVVTDAEGILGIGDWGTQGVDISVGKLMIYTAAAGIDPASVLPVVIDAGTNRKELLEDHLYLGNHQERIYGDQYYSFVDQFVETAESIFPKLYLHWEDFGRSNAATILNNYKTKIPTFNDDIQGTGIVVLGGIFGSLDITGEKLTDQVYLCYGGGSAGAGIAGRVHAEMVSEGLSEEEAYKHFFMIDQQGLLFDDMEDLTPAQKPFAKKRADYKDAGDMTDLLNVVKTVKPTILVGTSTNPGAFTKEVVEAMCANTERPVIFPISNPTKKMETTAEQVIEWSDGKAFVATGVPSGTISYKGVDYQIGQANNSLIYPGLGLGMLASEAKLLTDEMIGAAAHSLSGLVDPGKPGAPVLPPFEFVADVSIKVAEAVAKKAQEQGLTESKETDMAKAVRDLKWYPEY

SEQ ID NO: 93081 - protein, 443 aa, Salmonella enterica
IGVVGMAVMGRNLALNIESHGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFPEWNNGELSSYLIDITKDIFTKKDEDGNYLVDVILDEAANKGTGKWTSQSALDLGEPLSLITESVFARYISSLKAKRVAASKVLSGPKAQPASDKAEFIEKVRRALYLGKIVSYAQGFSQLPAASDEYHWDLNYGEIAKIFRAGCIIRAEFLQKITDAYAENAGIANLLLAPYFKKIADEYQQALRDVVAYAVQNGIPVPTFSAAVAYYDSYRAAVLPANLIQAQRDYF

SEQ ID NO: 93082 - protein, 498 aa, Physcomitrella patens subsp. patens
MADNREEQIPVFTSLSEIYGEGPLLEEAVRRYENLKQQFVQHYGRQPELFARAPGRVNLIGEHIDYEGYSVLPMAIRQDTVVAIGKREEEYSMLHIANVDSFEFKACKFPADPSQEVDRDNHLWANYCICGYKGVFEHLASKGELIGPTCGLNVLVHGTVPIGAGLSSSSALVCATVVALSSLFKLSFCKHEVAEFSCACERHIGTQSGGMDQAISVMAMPGVAKLIGFNPIRASDVLLPKSGSFVVANSLTESKKAVTASTNYNNRVVECRLAAMVLAVKLGMPSEEACTSVNTLSDVEGLCVKYASAHGSSSPVVAVEKLLHEAPYNTEEIEECLKEKLTTIMKKSPTTLAVLAAASLFKLYQRAKHVYTEAKRVHDFRGAAVQSDGEESVMKRLGDLMNESHASCSLLYECSCPELENLVGICRHNGAIGARLTGAGWGGCVVALVKEEEANSFISVLKDSYYRPLVQSGKIKEEDLDSYVFASKPSGGAAAFKL

SEQ ID NO: 93083 - protein, 471 aa, Gluconobacter oxydans 621H
MTTSPAPDHTPTHAGAISEEGYHKDLGRRHVQMIAIGGAIGTGLFLGAGSRLQVAGPSLAIIYAICGVFSFLILRALGELVMYRPTSGSFVTYAREFLGERAAYMAGWLSFLNWAMTGIVDITAVALYMHYWAVFLPVPQWAFALAALAIVGTMNMIGVRYFGEMEFWFSLIKVVALALFLIAGATILGTRMPVAGHTTGFHLITENGGIFPHGLFSALMLLQGVVFAYSGIELLGTAAGECEDAREILPRAINSVIWRIALFYVGSVILLVCLLPWTEYHAGTSPFVTFFQALGIPGIGTIMNIVVLTAALSSLNSGLYSTGRVLRALALGGSGPKALGKLNRSSVPYVGILTTLGVYLVGVMLNYLIPSRVFEIVLNFSALGIISTWGFILLCQLRLRAAINRGDIAPTGFNMPGAPYTTWATLGFLGFVLIMMAFDYPDGTITIGAIPLIGAILIGGWRLLDRGRRHG

SEQ ID NO: 93084 - protein, 393 aa, Sulfitobacter sp. EE-36
MYPERFSNLPAHAWPRLRALLDAHEGGGTPIHMTIGEPKHAFPAWVTDVIAENAAGFNSYPANDGTPRLRGAIAGWINRRYGVDVDADTQVMPLNGTREGLYNAVMATCPETKNGRKPAILMPNPFYQVYMIAAISGAADPVMVPATRETGHLPDFASLPEDVLNRTTAAYVCSPANPQGAVATHAYWADLIALAEKYDFKIFADECYSEIYRDTPPVGALQVAQEVGADPDRVVIFHSLSKRSNLPGLRSGFVASGANTMREIKQLRNYAGAPLPLPLQAASAAVWDDEAHVAENRALYIEKYEVADRILGNVPGYQSPEAGFFLWLPVEDDEAAALKLWRETGVRVLPGGYLAQSVDGENPGKHYIRVAMVAPKEETTRGIEAIRRCLYPE

SEQ ID NO: 93085 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYF

SEQ ID NO: 93086 - protein, 431 aa, Zea mays
MSKAGWYRSGIPGVRELPQSMEVSSRLQSLLRPFLLCRSRAAGMTLQTLALCSPPPPPRIPSSFLLRTRRLPPPFPHGGPSRLLFHSTFASVSPAPAPAPGRDHLNSKEQGPPPAPLPPPPPEELASEDESYYHEHLLEVAQENQSRVVPVKAFFLCTSIDLRSLQSQNSFNVIPPTSRATNYVVLRYYDVKGDPEGFKSGVIDESHCHYMVVFQYGSIVLFNVSDHEADGYLKIVEKHASGLLPEMRKDDYAVVEKPTLETWMQGGLDYIVLRDLSIDGIRTIGSVLGQSIALDYYIRQVDGMVAEFTDINRGMEKTGTFTMERKKLFQLVGKANSNLADVILKLGLFERSDIAWKNANYAQIWEYLRDEYELTQRFGNLDFKLKFVEHNIRFLQEILQNRKSDFLEWLIIILISVEILISVYNIIQEQM

SEQ ID NO: 93087 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENAGIANLLLAPYFKEIAYEYQQALRDVVAYAVQNGIPVPTFSAAVAYYDSYRAAVLPANLIQAQRDYF

SEQ ID NO: 93088 - protein, 344 aa, Streptococcus pyogenes M49 591
RAMIALDGTPNKGKLGANAILGVSIAVARAAADYLEVPLYTYLGGFNTKVLPTPMMNIINGGSHSDAPIAFQEFMIMPVGAPTFKEGLRWGAEVFHALKKILKERGLVTAVGDEGGFAPKFEGTEDGVETILKAIEAAGYEAGENGIMIGFDCASSEFYDKERKVYDYTKFEGEGAAVRTSAEQVDYLEELVNKYPIITIEDGMDENDWDGWKVLTERLGKRVQLVGDDFFVTNTEYLARGIKENAANSILIKVNQIGTLTETFEAIEMAKEAGYTAVVSHRSGETEDSTIADIAVATNAGQIKTGSLSRTDRIAKYNQLLRIEDQLGEVAQYKGIKSFYNLKK

SEQ ID NO: 93089 - protein, 303 aa, Brassica napus
  misc_feature (247)..(247): Xaa can be any naturally occurring amino acid
  misc_feature (268)..(268): Xaa can be any naturally occurring amino acid
MADLNEVIPTIDLKGVPDEKLNQQIREASERWGCFKVMNHGVSSSLLSEMKKTVTDLHERPHEVKIRNTDVILASGYKPRTDLNPLYESFGLFDVASPQAINTFCDKLEASAEQREIMMKYGKVMDGLAKDLTRMLAKSYELADPDICKEWPSQFRISKYHFNPETVGKNGLIIHTDPGFLTIVHGDDNVGGLEAMDHSSGTYYPINTSPNTLTVNLGDMAKIWSNGRLCNVKHRVQCKEAKMRITXSPFLLIPMDEVVKPPSEFVDXEHPRLYKPISDGELRKIRLSNNMHDGESFQFITLK

SEQ ID NO: 93090 - protein, 223 aa, Streptococcus pyogenes MGAS315
MDLLTNKKKIFETIRLSTEAANRTNDSVSVIAVTKYVDSTIAGQLIEAGIEHIAENRVDKFLEKYDALKCMPVKWHLIGTLQRRKVKEVINYVDYFHALDSVRLALEINKRADHPVKCFLQVNISKEESKHGFNISEIDEAIEEIGKMEKIQLVGLMTMAPANASKESIITIFRQANQLRKNLQLKKRKNMPFTELSMGMSNDYPIAIQEGSTFIRIGRAFFH

SEQ ID NO: 93091 - protein, 443 aa, Salmonella enterica
IGVVGMAVMGRNLALNIESRGYTVSILNRSREKTEEVIAENPGKKLVPYYTVKEFVESLETSRRILLMVKAGAGTDAAIDSFKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKKQPAGDKAEFIEKVRRALYLGKIVSYAQGFSQLRAASDEYHWDLNYGEIAKIFRAGCINRAQFLQKITDAYAENAGIANLLLAPYFKKIADEYQQALRDVVAYAVQNGIPVPTFSAAVAYYDSYRAAVLPANLIQAQRDYF

SEQ ID NO: 93092 - protein, 443 aa, Salmonella enterica
IGVVGMAVMGRNLALNIESRGYTVSVFNRSREKTEEVIAENPGKKLVPYYTVKEFVESLETPRRILLMVKAGAGTDATIDSLKPYLEKGGIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYFLLKGGLNLSNEELASTFTEWNNGELSSYLIDITKDIFTKKDEDGNYLVDVILDEAANKGTGKWTSQSALDLGEPLSLITESVFARYISSLKAKRVAASKVLFGPKAQPVGDKAEFIEKVRRALYLGKIVSYAQGFSQLRAASEEYHWDLNYGEIAKIFRTGCIIRAQFLQKITDAYAENAGIANLLLAPYFRKIADEYQQALRDVVAYAVQNGIPVPTFSAAVAYYDSYRAAVLPANLIQAQRDYF

SEQ ID NO: 93093 - protein, 444 aa, Haemophilus parasuis
MATGKIVQIIGAVIDVEFPQDAVPKVYDALKVETGLTLEVQQQLGGGVVRCIALGTSDGLKRGLKVENTNKAIEVPVGTKTLGRIMNVLGEPIDEAGPIGEEERWTIHRAAPSYEDQANSTELLETGIKVIDLIAPFAKGGKVGLFGGAGVGKTVNMMELIRNIAIEHSGYSVFAGVGERTREGNDFYHEMKDSNVLDKVSLVYGQMNEPPGNRLRVALTGLTMAEKFRDEGRDVLFFVDNIYRYTLAGTEVSALLGRMPSAVGYQPTLAEEMGVLQERITSTKTGSITSVPSGLRSADDLTDPSPATTFAHLDSTVVLSRNIASLGIYPAIDPLNSTSRQLDPLVVVQEHYDVARGVQKTLQRYKELKDIIAILGMDELSEDDKLVVARARKIERFLSQPFHVAEVFNSVPGKFVPLKETIRGFKGILAGEYDHIPEQAFYMA

SEQ ID NO: 93094 - protein, 471 aa, Mycoplasma hyopneumoniae 232
MEKQENVGHIVQIFGPVIDVQFPNEHMPAILSALEVKINDESIIFEVAQHLGEGIVRAIAMSMTYNLSKGLEVYDTGSQISVPVGKQVLSRMFNVLGQPIDGGKPLDSFIKNPIHANAPTYLEQKATSEILVTGIKVIDLLIPFIKGGKIGLFGGAGVGKTVLVQELINNIASKHGGLSVFAGVGERSREGNDLYFEMKKAGVLDKTALVFGQMNEPPGARMRVALSALTMAEYFRDYENQDVLLFIDNIFRFTQAGSEVSTLLGRIPSTVGYQPTLSTEMGQLQERITSTIRGSITSVQAVYVPADDITDPAPATTFSHLDAKTVLDRGIAALGIYPAVDPLASSSRALEPNIVGKKHYLVAKKVVQILQRFKELQDIIAILGVDELSESDKQVVARARRIRNFLSQPFFVAQKFSGIQGQFIKIQDTVNNFDELLSGKYDNIPEEAFLYVGTIDQALEKAKKMGWSEKN

SEQ ID NO: 93095 - protein, 139 aa, Frankia sp. CcI3
MTDPHDTTGPDKIVKTDEQWRAELDPERYAILRRAATEPPFTGAYTYSKENGTYRCGGCGAALFTSDTKYDSGSGWPSFTQPAVADALELVEDHSHGMIRTEVRCARCGGHLGHVFDDGPGPTGQRYCMNSLALDLDPH

SEQ ID NO: 93096 - protein, 444 aa, Pasteurella bettyae
  misc_feature (349)..(351): Xaa can be any naturally occurring amino acid
  misc_feature (394)..(394): Xaa can be any naturally occurring amino acid
MSAGKIVQIIGAVIDVEFPQDAVPKVYDALKVETGLTLEVQQQLGGGVVRCIAMGTSDGLKRGLSVSNTGKAISVPVGTKTLGRIMNVLGEPVDERGPIGAEEEWAIHRAAPSYEEQSNSTELLETGIKVIDLICPFAKGGKVGLFGGAGVGKTVNMMELIRNIATEHNGYSVFAGVGERTREGNDFYHEMTDSNVIDKVSLVYGQMNEPPGNRLRVALTGLTMAEKFRDEGRDVLFFVDNIYRYTLAGTEVSALLGRMPSAVGYQPTLAEEMGVLQERITSTKTGSITSVQAVYVPADDLTDPSPATTFAHLDSTVVLSRNIASLGIYPAVDPLDSTSRQLDPLVVGXXXLNVARGVQGILQRYKELKDIIAILGMDELSENDKLVVARARKXERFLSQPFFVAEVFNSTPGKYVPLKETIRGFKGILDGEYDHIPEQAFYMA

SEQ ID NO: 93097 - protein, 420 aa, Mannheimia succiniciproducens MBEL55E
MQITILVSIKEKLISKHNISKESPMFKNITPAPADPILGLGEAFKAETRENKINLGIGVYKDADGVTPIMTAVKKAEGQLFENEKDKNYLPIEGVAEYNAYAKELLFGKDSEIIASNRACTVQTLGGTGALRIAAEFVRRQTKAQNVWISKPTWPNHNAIFNAVGVTIREYRWYNPETKALDWDNLLADLNNANPGDVVLLHGCCHNPTGIDPTPEQWKALAEMSAKNGWLPLFDFAYQGLANGLEEDAVGLRTFAETHRELLVASSFSKNFGLYSERVGAFTLVADNADVAAVALTQIKSIIRTLYSNPSAHGARTVATVLANPELRKEWEDELTSMRDRIKQMRKQLVELLKEFGAQEDFSYIIDQKGMFSFSGLTAEQVDRLKEEFAIYAVRSGRINVAGITEANIRYLAESIVKVL

SEQ ID NO: 93098 - protein, 157 aa, Triticum aestivum
  misc_feature (144)..(144): Xaa can be any naturally occurring amino acid
MFKVIRSHPFASTIKCFKSGSVYNAQQKRALSIHEYLSVDLLSKYGIGVPRGSVATSGIEAEAVAKQIGSNDMVIKAQVLAGGRGKGTFDSGFKGGVRLIYSPAEAKTLAEQMIGHKLITKQTGAAGRLCNSVLICERKFVRRXEFYLAILMDRASQ

SEQ ID NO: 93099 - protein, 444 aa, Bisgaard Taxon 17
MSAGKIVQIIGAVIDVEFPQDAVPKVYDALKVESGLTLEVQQQLGGGVVRCIALGTSDGLKRGLKVENTGNPIQVPVGTKTLGRIMNVLGEPIDERGEIGAEENWSIHRAAPSYEEQSNSTELLETGIKVIDLICPFAKGGKVGLFGGAGVGKTVNMMELIRNIAIEHSGYSVFAGVGERTREGNDFYHEMTESNVLDKVSLVYGQMNEPPGNRLRVALTGLTMAEKFRDEGRDVLFFVDNIYRYTLAGTEVSALLGRMRSAVGYQPTLAEEMGVLQERITSTKTGSITSVQAVYVPADDLTDPSPATTFTHLDSTVVLSRQIASLGIYPAVDPLDSTSRQLDPLVVGQEHYDVARGVQGILQRYKELKDIIAILGMDELSEEDKLVVARARKIERFLSQPFFVAEVFTGSPGKYVSLKDTIRGFKGILEGEYDHIPEQAFYMV

SEQ ID NO: 93100 - protein, 426 aa, Bisgaard Taxon 5
  misc_feature (179)..(179): Xaa can be any naturally occurring amino acid
MATGKIVQIIGAVIDVEFPQDAVPKVYDALNVETGLVLEVQQQLGGGVVRCIAMGSSDGLKRGLTVTNTGKPISVPVGTKTLGRIMNVLGEPIDERGPIGAEENWSIHRAAPSYEDQSNSTELLETGIKVIDLICPFAKGGKVGLFGGAGVGKTVNMMELIRNIAIEHSGYSVFAGVGXRTREGNDFYHEMTESNVLDKVSLVYGQMNEPPGNRLRVALTGLTMAEKFRDEGRDVLFFVDNNYRYTLAGTEVSALLGRMPSAVGYQPTLAEEMGVLQERITSTKTGSITSVQAVYVPADDLTDPSPATTFAHLDSTVVLSRQIASLGIYPAVDPLDSTSRQLDPLVVGQEHYDVARGVQGILQRYKELKDIIAILGMDELSEDDKLVVARARKIERFLSQPFSLPKSLPVHRVNMSRLKDTIRGFK

SEQ ID NO: 93101 - protein, 394 aa, Clostridium difficile 630
MMSKDYAKLALEMHEINKGKVSVESKVEIKTKDDLSTAYTPGVAEPCLKIHENQDDVYRYTSKGNLVAVVSDGSAVLGLGNIGAEASIPVMEGKAILFKQFADVDAFPICLKTNDVDEIVKSVELMEPVFGGINLEDISSPRCFEIEERLKKSLSIPVFHDDQHGTAIIVAAAIINSIKLIENKKIEDLEIVINGAGAAGIAIAKILLNMNVKNIILCDRSGALEASIENLNYVQKEMLKVTNIRNEKGPLKDIIKGKDVFIGVSGPGAVTKEMVESMSEKPIILAMANPTPEIMPEEAKLGGAFIMGTGRSDFPNQVNNVLAFPGIFRGALDVKAKEINEEMKIAAAYAIANTISDEEICPEYILPDVFNKNVVKNVAKAVKEAAIKTKVNRI

SEQ ID NO: 93102 - protein, 154 aa, Burkholderia mallei ATCC 23344
MSLTVAQILRSKPDSGRTIHMVEKSDSVYNAIKLMAEKSIGALLVMDGANIAGIVTERDYARKVVLLDRSSKATRVEEIMTSKVRYVEPTQTSDECMALMTEHRMRHLPVLDDGKLVGLVSIGDLVKSVIADQQFTIDQLEHYIHGIPAAAHPQ

SEQ ID NO: 93103 - protein, 271 aa, Haloarcula marismortui ATCC 43049
MTTVTLGPEGTYSHRAAQAVTDDDISFSESVTAIVEAVANGEAERGVVPVENSIEGSVTESLDAFAEYDVAVVEEVITPIRHALLAQDDSFSLVASHAQALAQCRGWLDEHYPGVNVEAVASTARGVERARGDADIAAIGHPENATNGTELKVLAEDIQDRSSNATRFVVVASKSERSEAGGKTSFIVYPDVDYPGLLLELLEPFADRDINLTRVESRPSGERLGDYVFHIDISAGLYEQRTQEALADIEDIAGKGWVRRLGSYDSKTVVN

SEQ ID NO: 93104 - protein, 489 aa, Magnetospirillum magnetotacticum MS-1
MILKDSSLLKSRAFVNGAWTDADNGATFDVLNPATGEILASVPDMGAAEARRAIEAANAAWPAWKAKTGKERGAILRNWFNLIMAHQEDLAVLLTAEQGKPLAEARGEIAYGASFIEWFAEEAKRVYGDTIPGHAPDKRIVVVKEPIGVVAAITPWNFPNAMITRKCAPALAVGCPVVVKPAEDTPLSALALAELAVRAGIPAGIFNIVTARHGALVGGELSGNPLVRKLSFTGSTQVGKLLMSQCAATVKKVSLELGGNAPFIVFDDADLDAAVAGAMASKYRNAGQTCVCANRMLVQDGVYDEFARRLAKAVSQLKVGDGLASDANQGPLINAKAVEKVERMLADAVSKGATIVCGGKRHALGRTFFEPTIVTNVTSTMSMAREEIFGPVAPLFRFKTEAEAIAMANDTEFGLAAYFYAGNIARVWRVAEKLEYGMVGINDGIISTEVAPFGGVKESGIGREGSKYGIEDFLEIKYLCLGGIKEAAQ

SEQ ID NO: 93105 - protein, 444 aa, Bisgaard Taxon 7
MATGKIVQIIGAVIDVEFPQDAVPKVYDALNVETGLVLEVQQQLGGGVVRCIAMGTSDGLKRGLSVSNTNKPITVPVGTKTLGRIMNVLGEPIDEKGPIGAEENWSIHRAPPSYEEQSNSTELLETGIKVIDLVCPFAKGGKVGLFGGAGVGKTVNMMELIRNIAIEHSGYSVFAGVGERTREGNDFYHEMSDSNVLDKVSLVYGQMNEPPGNRLRVALTGLTMAEKFRDEGRDVLFFVDNIYRYTLAGTEVSALLGRMPSAVGYQPTLAEEMGVLQERITSTKTGSITSVQAVYVPADDLTDPSPATTFAHLDSTVVLSRQIASLGIYPAVDPLDSTSRQLDPLVVGEEHYNVARGVQGILQRYKELKDIIAILGMDELSEDDKLVVARARKIERFLSQPFFVAEVFNGTPGKYVPLKETIRGFKGILDGEYDHIPEQAFYMA

SEQ ID NO: 93106 - protein, 374 aa, Physcomitrella patens subsp. patens
IDAHTFTFRELAVATKNFRPECLLGEGGFGRVYKGRLENTGQARVAVKQLDRRGLQGNREFLVEVLMLSLLHHTNLVNLIGYCADGQQRLLVYEFMPLGCLEDHLHGLPQNKECLDWNTRMKIAVGAARGLEYLHDKAEPPVIYRDLKSSNILLGEGFHPKLSDFGLAKLGPVGDKTHVSTRVMGTYGYCAPEYAMTGQLTLKSDVYSFGVVLLELITGRKAIDESRGPGEHNLVAWARPMFKDKRKFQSMADPMLQGRYPIRGLNQALAVAAMCLQEQAATRPLIADVVTALSYLASQIYNPGGSQGSQALEEWERRSSVGRRDSPKHHAAPAARTGRDGGMQPHAPTRERERAVAEARVWGENWRDRQRGPT

SEQ ID NO: 93107 - protein, 472 aa, Haloarcula marismortui ATCC 43049
MVVGDVTTGTELLVIGGGPGGYVAAIRGAQLGLDTTLVERDAYGGTCLNHGCIPSKALISASDVAHDARQAESMGVFADPAVDMAGMTEWKDGVVTRLTRGVESLCKNAGVNLVEGTAEFVDDGTVRVAHGGEGQGSESLSFEHAIVATGSRPMAVPGFEFDGEHILSSKDALALESVPEKLLVVGAGYIGMELSTVFAKLGAEVTVVEMLDDVLPGYEDDIATVVRDRAEELGIDFNFGEAADNWEETDEGIRVQTVDEDEVVTEYNAEKCLVAVGREPVTDTLALDNIDLQTDENGVIPTDDQCRTAFESVFAVGDVAGEPMLAHKAMAEGEVAARAAAGEPAAFDHQAIPAAVFTDPEIATVGMTESEAEAAGFEPVIGQMPVRANGRALTVNEKEGFVRVVADADEEFLLGAQIVGPEASELIAELGLGIEMGARLEDIAGTIHTHPTLSEAVHEAAAAARGEAVHTR

SEQ ID NO: 93108 - protein, 1123 aa, Physcomitrella patens subsp. patens
MTVIAAPPEEDDDMLVPPQDFNDVIEPMEVVGQGEGVATVENQHVDDPQTGKFTWNIENFSKLSLRKHYSETFTVGGYKWRVLLFPKGNNVDHLSVYLDVADSAQLPYGWSRFAHFTLAVVNPYDPKLTVKKDTQHHFNVRESDWGFTSFMPLPDLYDPSRGFLMNDTLIVEADVNVRKVVDYWAYDSKKETGYVGLKNQGATCYMNSLLQTLYHLPYFRKAVYHMPTTENDVPSNSIPLALQSLFYKIQYSDTSIATKDLTKSFGWDTYDSFMQHDVQELNRVLCEKLEDKMKGTAVEGTIQQLFEGHHMNYIECINVDYKSTRKESFYDLQLDVKGCKDVYESFDKYVEVERLEGENKYHAEQFGLQDAKKGVLFIDFPPVLQLQLKRFEYDFMRDTMVKINDRYEFPLQLDLDRENGKYLSPDADRSVRNLYTLHSVLVHSGGVHGGHYYAFIRPTLSDQWFKFDDERVTKEEPKRALEEQYGGEEELPQTNPGFNNTPFKFTKYSNAYMLVYIREADKDKIVCNVDEKDIAEHLQVRLKKEQEEKERKRKEKAEAHLYTIIKASLHLIFLHLVGRDEDLQNQIGKDIHFDLVDHEKVRSFRIQKQTLFTQFKASKELGVPVECQRFWLWAKRQNHTYRPNRPLTEQEEAQTVGHLKEASNKAHNAELKLFLEVQRTPGAESVPMPPPIKTKEDVLLFFKLYDPLKEELRYVGRSYVKASGRPADILERLNEMAGFPPNEEIQLYEEIKFEPNVMCEHIEKKSTFKASQLEDGDIICYQRALTREQELASRYPDVPSFLEYVRNRQIVHFRRLDKPKDDEFCLELSKQHTYDDVVEKVAEEIKLEDASKIRLTSHNCYSQQPKPQPIKYRGVERLSDMLVHYNQTSDILYFETLDLPLPELQGLKTLKVAFHNAKTEEVSVHNIRLPKQSTVGDVVNELKGKVELSSPKAELRILEVFYHKIYKIFPLSEKIENINDQYWTLRAEEVPDEEKELGPQDRLIHVYHFTRDASQNYMVQNFGEPFFLVVRENETLTEVKQRIQKKLVISDEEFSKWKFAFLSLGRPEYLQDGDVVAARFQKRDTYGAWEHYLGLEHADCAPKRSHTTNQNRHNFEKPVKIYN

SEQ ID NO: 93109 - protein, 545 aa, Haloarcula marismortui ATCC 43049
MFEFNLPDLGEGVAEGEVLTWRVSPGDAVTEDQVLAEVETDKAAVDVPSPVDGVVQELHAEVGEMVQTGEVLITIAEEGDAETADAAASDTDEAESAGADTEEADSAASEAAAADEQSGASTSTADGRVFASPSVRRLAREKGVDIAAVDGSGPGGRVTEGDVEAATASADEATASDDSPTSVVSKASDDGDSPTAAVSQVDAGDTDDGTAVKSAVKSVSGDGQEAASRDQTLATPATRKAARELDVNIDAVPTDQTRDGQPYVDEAAVRTYAEAQQAAQAADAEAVSAEGGAAGTAAEAGGAGAETTAVETGDGERREPYRGVRRSIGEQMARSRREVPHATHHDQVVVSGLVEARERLAPLAEERDVTLTYTPFVVKCVAAALDKHPVLNTALDTENEEIVYRDAHNIGVAAATDHGLVVPVVNDVDGKGLVELAGEVNDLVGRARERDIERSEMQGGTFTVTNFGVIGGEYASPIINVPETAILGIGALKERPVAEDGEVVAKPTLPLSLAIDHRVIDGADAARFVNTLKEYLSDPTRLLLE

SEQ ID NO: 93110 - protein, 127 aa, Acinetobacter sp. ADP1
MEDKSKVIKIMVIDDSKTIRRTAETLLQKEGYTVVTATDGFEALSKIAQTNPDIIFVDIMMPRLDGYQTCALIKNSQNYQHIPVIMLSSKDGLFDQAKGRIVGSDEYLIKPFSKDELLTAIRNHVSV

SEQ ID NO: 93111 - protein, 194 aa, Xylella fastidiosa Dixon
MLLMLDNYDSFTYNLVQYLQTLGAEVMVIRNDAMTVEQIAALKPERIVISPGPCTPNEAGVSLKLIEQLGSSTPILGICLGHQSIGQAYGGDVVRATNIMHGKTSAIYHNGKGVFVGLPNGYDATRYHSLVVDKTTLPDVLEVTAWTENQDGTIEEIMGLRHREYFVEGVQFHPESILTEHGHGLLKNFLECPL

SEQ ID NO: 93112 - protein, 164 aa, Debaryomyces hansenii CBS767
MSQPKVIIISSDDEKFPVDVKIAEKSILIKKMIEDLNPDGLEEDFEIPTPNVRSTVLSKVLEWCTHHKNSVFPDDDDEDARKSAPVDEWDKNFLKVDQEMLYEIILAANYLNIRPLLDSGCKIVAEMIRGKSPEELRRTFNIVNDFSPEEEAAIKRENEWAEDR

SEQ ID NO: 93113 - protein, 501 aa, Ustilago maydis 521
MPAPVLTTNGSSSQFQVQSVPSHVRTICCIGAGYVGGPTCSVIAFKCPHIKVIIVDVNPARIAAWNSDDLPVFEPSLDAVVRECRGRNLFFSTDIDAAIQEADLIFVSVNTPTKTSGVGKGFAADLHYVEASTRRIASVATSSKIIVEKSTVPCRTAASMRTILESNSSYTADGTLISFQILSNPEFLAEGTAIRDLMAPDRVLIGSLDTQQGKAAAKALSEVYQNWVDPSKIYETGLWSSELSKLAANALLAQRISSINSLSAICEATGADVDEVAHACGLDGRIGPKFLKASVGFGGSCFQKDILNLVYLSESLGLNEVADYWHQVIKMNEYSKSRFAQKVVSTLFNTITMKKIAVLGFAFKKNTGDTRESAAITLCKYFRQERAQISIYDPKVTTNQIMLDLTEPGVVDDVEAVKQQVKIAGSMKEACEDAEAVVICTEWDEFRDATAQDWDEIYRSMKKPAFVFDGRGIVDAKVLRSVGFKVHAVGKGPLIVDPIWA

SEQ ID NO: 93114 - protein, 466 aa, Physcomitrella patens subsp. patens
VPTRFVWPHGGRRVYLCGDFTRWQDTLPLSPVEGSSRVFQVICSLAPGYHTYKFIVDGEWRHDEQQAHMAESNGQVNNWLLITKPQHPILPPAPDMGTPGVTMDVDHDMLHQPQVDRAVMAESGATVVSSAEAEASRKNIADFLNRHFAYDLLPESGKVVALDVALPVKQAFHALYEQGIPGAPLWDSSSQQFVGMLTASDFISILQRLGSHGASVFSEEELEMHTIEEWKKEKQALFPSASHSLVYVGPDDTLSHVANELMRLDVAQLPVLHYPPHSHIPELLHLACLSGILRCLCRHFRHVPSSVPLFSQPIGTLRIGNWVSGIAEPGSRPLQVLRRDESLSRALALLLEARVSALPVVDENGVFQDVYARGDITALARDSTYTRPQLNDLTVSQALQIGAAQDWTGPGPLSGNRYHMCIRSDSLRYVIERLALPGVRRLICIEAGSRQVEGIITLRDVFQFLL

SEQ ID NO: 93115 - protein, 223 aa, Xylella fastidiosa Dixon
MSNCLIAPSILSADFARLGAEVDAVLAAGADWIHFDVMDNHYVPNLTFGPMVCKALRSYGITAPIDVHLMVEPVDRIVPDFAQAGASMISFHIEASRHVHRTIQLIKSHGCMAGLVFNPATPVDMLDWVLPELDLVLLMSVNPGFGGQRFIPGTLDKLRLVRKKIDLLGRPVRLEVDGGVGIDNIGAIAEAGADTFVAGSAIFHARDYGDVIAQMRAVVAAVR

SEQ ID NO: 93116 - protein, 164 aa, Ashbya gossypii ATCC 10895
MYVPPRDYKDLHALTEDFESFYEDVFLEAARFGEVQELIVCENKTDHLNGNVYIRYSTIDAAKAARDALITRWYGERPLYCDLSHVTDFREAVCKSYEEGTCDRGEQCNFIHRRIIGYHIANGLMLSQWKSRHIMPQHRSDEARNTGHVAHSSAAVTAPLPPSA

SEQ ID NO: 93117 - protein, 362 aa, Sulfitobacter sp. EE-36
MVFGPDITEQLARARADLRLGVPIVLAGSRPVLVMAAETLTPARLTGLLAMGGEPVLVISARRAETLKARAYDGSFARVLLPRDATLRWVKSIADPADDLRSPLKGPLACARGGDATPHGLAIDLIKSARLLPAAVILDLEDAGQFAQQNGLTMINLSAAQPILAARSPLHPVVNARLPMEVSEAGRLHIFRPDDGGEEHYAIEIGRPDRSKPVLARLHSACFTGDIMGSLKCDCGPQLHAALTQMGKEGHGVLLYLNQEGRGIGLTNKMRAYSLQDQGFDTVEANHRLGFEDDERDFRLGSDILTSMGFSSVRLLTNNPRKVEMMEASGIKVAERVPLKVGENSHNHAYLATKAAKSGHLL

SEQ ID NO: 93118 - protein, 443 aa, Salmonella enterica
IGVVGMAVMGRNLALNIESRGYTVSVFNRSREKTEEVIAENPGKKLVPYYTVKEFVESLETPRRILLMVKAGAGTDATIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLRGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKAQLAGDKAEFIEKVRRALYLGKIVSYAQGFSQLRAASEEYHWDLNYGEIAKIFRAGCIIRAQFLQKITDAYAENAGIANLLLAPYFRKIADEYQQALRDVVAYAVQNGIPVPTFSAAVAYYDSYRAAVLPANLIQAQRDYF

SEQ ID NO: 93119 - protein, 217 aa, Sulfitobacter sp. EE-36
MSLQDITSRIAKAETDAGRTPGSVELIAVSKVQPDARVAAVLSEGHRCFGENRVQEAEGKWPAFRQEFDGVKLHLIGPLQSNKARSAFELFDVIHTLDRPKLAQTFARLAQEMGRCPDMFVQVNTGEEDQKAGVHPADADDFIKECLSLDLPVRGLMCIPPVDEEAALHFALLAKIAARNGLRDLSMGMSSDFEKAIALGATHVRVGSAIFGERTAG

SEQ ID NO: 93120 - protein, 443 aa, Salmonella enterica
IGVVGMAVMGSNLALNIESRGYTDSVFNRSREKTEEVITENPGKKLVPYYTVKEFVESLDTTRRILLMVKAGAGTDAAIDSLKPYLEKGDIIIDGGNIFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKANRVAASKVLFGPKAHPAGDKAEFIGKVRRALYLGKIVSYAQGFCQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYF

SEQ ID NO: 93121 - protein, 443 aa, Salmonella enterica
IGVVGMAVMGRNLALNIESRGYTVSVFNRSREKTEEVIAENPGKKLVPYYTVKEFVESLETPRRILLMVKAGVGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITESYAENAGIANLLLAPYFKKIADEYQQALRDVVAYAVQNGIPVPTFSAAVAYYDSYRAAVLPANLIQAQRDYF

SEQ ID NO: 93122 - protein, 299 aa, Methanosarcina barkeri str. Fusaro
MDRVISIVGHTALDYIVDVERIAGKNESSPVIDYEEYPGGGAANIAVAIAKLGGKSQLISPVGTDFVSSGYEKLLTEANVDLSRLYRIEDQKISKAFIFTDKEDNQTTYFYWGASSKFKKLEPEPVDFVHLATADSVYNAKLAQIAGFVSFDPGQDLVTYSKENLELILAHTDILFANRHEIRRVSEMTGKSFSELKAMIDIIVVTYDSKGSKIYTDKNEFLIPVISVQAADPTGAGDAYRAGFLLALTRGYPLPTCGKIGSTVASFAVQARGCQTDLPTWEEMKARYEANFGRLEKEC

SEQ ID NO: 93123 - protein, 290 aa, Prochlorococcus marinus str. MIT 9215
MRERKGIILAGGSGSRLFPITKGISKQLLPVFDKPMIYYPLTTLMEAGIRDVVVISNIDFLPLFENLLGDGSHFGININYLVQENPDGIAQAFLLAEKFIDGFPSALILGDNLFYGDKLHSQLLKSNSNSERSTIYTYRVKNPERYGVINFDSNFNIDNIEEKPQKPRSSYAITGLYFYDSKVVEKAKTLSPSSRGELEITDLNNLYIKDGLLDIENIGSGSAWFDTGTFESLHEASSYIRTMQNRQSLMIGCPEQVAWNNKWISDEDLYRLALPLTKSGYGNFLIELLN

SEQ ID NO: 93124 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKVQRVAASKVLSGPKAQPAGDKAEFIEKVRRALYLGKIVSHAQGFSQLRAASDEYHWELNYGESAKIFRAGCIIRAQFLQKITEAYVENAGIANLLLAPYFKKIAYEYQQALRDVVAYAVQNGIPVPTFSAAVAYYYSYRAAVLPANLFQAQRDYF

SEQ ID NO: 93125 - protein, 294 aa, Chlamydophila pneumoniae TW-183
MILMKRNDPCWCGSGRKWKQCHYPQPPKMSPEALKQHYASQYNILLKTPEQKAKIYNACQITARILDELCKASQKGVTTNELDELSQELHKKYDAIAAPFHYGSPPFPKTICTSLNEVICHGIPNDIPLKDGDIMNIDVSCIVDGYYGDCSRMVMIGEVPEIKKKICQAALECLNDSIAILKPGIPLCEIGEAIEARADTYGFSVVDQFVGHGVGIEFHENPYVPHYRNRSMIPLAPGMIFTIEPMINVGKKEGVVDPKNQWEARTCDNQPSAQWEHTIAITETGYEILTLLND

SEQ ID NO: 93126 - protein, 310 aa, Methanosarcina barkeri str. Fusaro
MTVKKALIPAAGLGTRFLPATKSMPKEMLPIIDTPVIHYVVEEAIASGIEDIIIITGRGKRAIEDYFDDSPELEMHLAKKHNTELLKLVRDVSSLVDIHYIRQKEPNGLGDAVLRAENHIGDEPFAVLLGDDIIVNDKPCTAQLIENFEKYGRSTLAVEEVPYEKLSSYGIIKGKPLCDSLYMLEDIVEKPSPENAPSNLGAIGRYVFTPEIFDCIKEAGTGVGNEIQLTDGIRVLNKSQIIYACRFKGKRFDTGDRLGYVKSVVDFALQNENLREDVFEYLRKILEAEDSLEQGETDIMKEPSVDKITT

SEQ ID NO: 93127 - protein, 306 aa, Mycobacterium smegmatis str. MC2 155
MSRALVIGEALIDIVEREGQVVGEHVGGSPLNVAVGLGRLGRDVDFLTHIADDPRGRRIVDYLKASGVQLVPGSTSAKKTPTAQVRLDAAGSATYEFDIDWQLAGTAEVAPPIVAHSGSIATVLEPGCRAAAALLDAYHLSATITFDPNVRPALISDGETARRRIERLVERADVVKISDEDLRWLDSRRSPEQIAKTWLSMGPSIVAVTAGGEGSFAVCGAGMVRVPARTVEVIDTVGAGDAFMTGLLDALWSLDLLGADRRRNLAHISTDALEHVLSTAALTSALTVAKAGADLPDRDALRAAQQ

SEQ ID NO: 93128 - protein, 444 aa, Oryza sativa
  misc_feature (409)..(409): Xaa can be any naturally occurring amino acid
MASISGAAAPPSSSAACRLRLRRQLLLRPSHLRLRAPHSIADLSRSSSSSSEQQPSSTPAAPLASRPGQNGSTRGAVEKDPIKLWERYVEWLYQHKELGLFVDVSRMGFTEEFLRRMEPRMQRAFAAMRELEKGAIANPDEGRMVGHYWLRDPGLAPNSFLRTKIETTLDRILAFSQDVVSGKIKPPSSPAGRFTQILSIGIGGSALGPQFVSEALAPDNPPLKIRFIDNTDPAGIDHQIAQLGPELASTLVIVISKSGGTPETRNGLLEVQKAFRDAGLDFSKQGVAVTQENSLLDNTARIEGWLARFPMFDWVGGRTSEMSAVGLLPAALQGIDIKEMLVGAALMDEETRNTVVKENPAALLALCWYWASEGIGNKDMVVLPYKDSLLLLSRYLQQLVMESLGKEFXTLDGHRVNQGLTVFGNKEADQEPNSHWKSVPLLRT

SEQ ID NO: 93129 - protein, 443 aa, Salmonella enterica
IGVVGMAVMGRNLALNIESRGYTVSVFNRSREKTEEVIPENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKVQRVAASKVLSGPKAQPAGDKAEFIEKVRRPLYLGKIVSYAQGFSQLRPASDEYHWELNYGEIAKIFRAGCIIRAQFLQKITDAYVENAGIANLLLAPYFKKIADEYQQALRDVVAYAVQNGIPVPTFSAAVAYYDSYRAAVLPANLIQAQRDYF

SEQ ID NO: 93130 - protein, 497 aa, Alkalilimnicola ehrlichei MLHE-1
MNWKRLKQEWFGNIRGDVLAGIIVALALIPEAIAFSIIAGVDPQVGLYASFCIAVVIAFTGARPGMISAATAAMALLMITLVADHGLEYLLAATLLTGVLQVIAGYLQVGRVMRFISNSVMTGFVNALAILIFMAQIPELVDVPWLVYPMVAGGLAIIYLLPYLTRAIPSPLVTIVVLTLLAWALGMNVPTVGDMGDLPDTLPVFLWPDVPLNLETLWIILPYSLALTVVGLLESMMTQSIVDDLTDSKTDRNRECRGQGISNLVAGSFGGMAGCAMIGQSIINVKSGGRGRLSSLVAGLVLIVLVVFLSPLLKMIPMAALVAVMIMVAIGTFSWGSIRDLRKNPMSTNIVMVSTVAVTVITHNLAIGVLTGVLLAGLFFANKVSQFMHVSSDVDEHPDDQTLQRTYRVVGQVFFASTEKFMNTFDFGEDLDKVTIDLTRAHFWDISSVAALDRVVINFRREGTEVEIVGMNEATATIVDRHAVHDKPDAIDRLMGH

SEQ ID NO: 93131 - protein, 444 aa, Actinobacillus delphinicola
MATGKIVQIIGAVIDVEFPQDAVPKVFDALKVETGLILEVEQQLGGGAVRCIAMGTSDGLKRGLSVENLGHPISVPVGTKTLGRIMNVLGQPIDQKGPIGAEEEWSIHRAAPSYEDQANSTELLETGIKVIDLICPFAKGGKVGLFGGAGVGKTVNMMELIRNIAIEHSGYSVFAGVGERTREGNDFYHEMTDSKVLDKVSLVYGQMNEPPGNRLRVALTGLTMAEKFRDEGRDVLFFVDNIYRYTLAGTEVSALLGRMPSAGGYQPTLAEEMGGLQERITSTKTGSITSVQAVYVPADDLTDPSPATTFAHLDSTVVLSRQIASLGILPAVDPLDSTSRQLDPLVVGQEHYDVARGVQGMLQRYKELKDIIAILGMDELSEEDKLVVARARKVERFLSQPFFVAEVFTGSPGKYVSLKDTIRGFKGILDGEYDHIPEQAFYMV

SEQ ID NO: 93132 - protein, 426 aa, Lonepinella koalarum
VQIIGAVIDVEFPQDAVPKVYDALKVESGLTLEVQQQLGGGVVRFIALGSSDGLKRGLKVENTGHPISVPVGVKTLGRIMNVLGEPIDEKGEIGAEENWAIHRQAPSYEDQSNSTELLETGIKVIDLICPFAKGGKVGLFGGAGVGKTVNMMELIRNIAIEHSGYSVFAGVGERTREGNDFYHEMTESNVLDKVSLVYGQMNEPPGNRLRVALTGLTMAEKFRDEGRDVLFFVDNIYRYTLAGTEVSALLGRMPSAVGYQPTLAEEMGVLQERITSTKTGSITSVQAVYVPADDLTDPSPATTFAHLDSTVVLSRNIASLGIYPAVDPLDSTSRQLDPLVVGEEHYNVARGVQGILQRYKELKDIIAILGMDELSEDDKLVVARARKIERFLSQPFFVAEVFHGAPGKYVSLKETIRGFKGILEGE

SEQ ID NO: 93133 - protein, 353 aa, Physcomitrella patens subsp. patens
MSKNRGFNAGSSMGNGGGEFEISQELLSVLPSDPYEQLEVARRITGMAVAARVSKLEGETVKLRQKLTEKEHLIYGLQERIGEAQSTLQETSARLSVALDVQNKLASEKNALVAQVKKLTRDVAKLETFKRTLMNSLQEDDESPNGEGGKRGVNPSLAIKRASQAESTVSRTPVSDDDYQSEKSSYDTDSSLTSEERGYQHASRPPTSYQNSAQNSARGTPRLSPRLTPSVSPKQQSARGSPQRSMSLTENSHRISLPSSKATSQSTTAPNSPPSSGSMPSRTPRVDGKDFFRQARNRLSYEQFSAFLANIKELNAHRQTREETLRKAQETFGPDNKDLYSAFEGLLSRHLPS

SEQ ID NO: 93134 - protein, 458 aa, Oceanobacter sp. RED65
MSSGKIVQIIGAVIDVEFPRDSVPKVYDALKVEGGKITLEVQQQLGDGMVRTIAMGSTEGLKRGLVAENTNQPIQVPVGKETLGRIMDVLGDPIDEKGPIGEQERASIHRKAPSYDEQAGGQELLETGVKVIDLVCPFAKGGKVGLFGGAGVGKTVNMMELIRNIAIEHSGYSVFAGVGERTREGNDFYHEMSESNVLDKVSLVYGQMNEPPGNRLRVALTGLTMAEKFRDEGRDVLLFVDNIYRYTLAGTEVSALLGRMPSAVGYQPTLAEEMGVLQERITSTKKGSITSVQAVYVPADDLTDPSPATTFAHLDATVVLSRDIASKGIYPAIDPLDSTSRQLDPLVIGQEHYDIARGVQTVLQRFKELKDIIAILGMDELSEEDKLTVARARKIERFLSQPFFVAEVFTGAPGKYVSLKETIRGFKGILEGEFDDLPEQAFYMVGTMDEAIEKAKNL

SEQ ID NO: 93135 - protein, 445 aa, Actinobacillus rossii
MSAGKIVQIIGAVIDVEFPQDAVPKIYDALKVEDAGLTLEVQQQLGGGVVRCIALGTSDGLKRGLKVNNTGNPISVPVGTKTLGRIMNVLGEPIDQKGEIGAEENWAIHRAAPSYEEQSNSTELLETGIKVIDLICPFAKGGKVGLFGGAGVGKTVNMMELIRNIAIEHSGFSVFAGVGERTREGNDFYHEMTDSNVLDKVSLVYGQMNEPPGNRLRVALTGLTMAEKFRDEGRDVLFFVDNIYRYTLAGTEVSALLGRMPSAVGYQPTLAEEMGVLQERITSTKTGSITSVQAVYVPADDLTDPSPATTFAHLDSTVVLSRNIASLGIYPAVDPLDSTSRQLDPQVVGQEHYDVARGVQGILQRYKELKDIIAILGMDELSEDDKLVVARARKIERFLSQPFFVAEVFTGSPGKYVSLKDTIRGFKGILDGEYDHIPEQAFYMV

SEQ ID NO: 93136 - protein, 426 aa, Vibrio sp. Ex25
MDLAFDRQHIWHPYTSTLTPLTCYPVASANGVHIKLEDGTELVDGMSSWWSTIHGYNHPHLNQAAHQQIDQVSHVMFGGITHQPAISLCKKLLSLAPSNLEHVFLADSGSVAVEVSLKMALQYWHAKGERRPKFLTLRHGYHGDTFAAMSVTDPDNSMHSLYKGFLPEHIFAESPTCGFWDEWKSEDLADFEHKIETHHQELAAVILEPIVQGAGGMRIYHPEFLKGVRRLCDKHGLLLIADEIATGFGRTGKLLACEHADIQPDILCVGKALTGGYMTLSATLASKHVADTVCGGDADCFMHGPTFMGNPLACAVATASLELIEQGDWKQQTQQIETLFSELLPKLEEYDLVKNTRWLGAIGVVETHRPVNMETIQALFVEHGVWIRPFGKLIYMMPPFISKPEDIEKLVNAIDAALQRKDCFAS

SEQ ID NO: 93137 - protein, 654 aa, Physcomitrella patens subsp. patens
QELLVIEDLLSAIVGIEGKYVFARRGWHKEGNSFSYQLDPTLDASLSDLAKRILPLCENYVVVSQFAEARSHFKHGLVNHAFAAALRAILQDYHAMTAQLEHQYRLGRLSLQGLWFFCQPMVAAMQVLSTAVQRAIVQHASGATMLNLLQKQQAIAMAGDNSARSLLQKLIHAASTPYFRILERWVYEGVIDDPYGEFLINENKSLQKESLSQDYYATYWQQRYSLRQEIPGFITSYAKTILTTGKYLNAMRECGHIVQVPSGENGPSSSGHAQQQVLERINVAHDFASAELLNLIKNKFDLIGRLRSIKHYFFVDQGDFLVHFMDTAKDELTRKPSAMSVEKLQSLLELALRTSVAASDPYHEDLTCSIEELSLMTQLHNIVRNGTVTSQHTGPTESANAPGLASGSTTGLETFTLEYKVKWPLSLVVSRKALTKYQLIFRHIFHCKHVERQLCATWQKHQSTVRTVNTLGTAISRSYVVCQRMLHFLQTFQHYMTFEVLEPNWHIMHGQLLNAKSIDEVMQHHDAFLEKCLRQCTLLWPQILKKVDKLKFICLKYATATQWLIPALFRQNENFQQSSSTNNKSKKGYKERRGRIEYPMHARQAAEDSNFKMTIGKIDEEFFKELKLLVVLLSNVSQSEPCLAHLAQGLQGVA

SEQ ID NO: 93138 - protein, 993 aa, Anabaena variabilis ATCC 29413
MVLQVQTSTYEAKTQEIARQLLGATQENRSFFASLRDQMRWDDKLLAWAMSNPGLRVQLFRFIDTLPALHSKAEIAAHLQEYLGDESVELPAALKGMLNFANPDSVPGQVAATTVSTAVETLAHKYISGENIKQVIKTVERLRKEKMAFTIDLLGEAVITETEAQSYLERYLELISQLTEASKNWGTVGAIDEADGEQLAKVQVSVKLTAFYSQFDPLDAKGSEEKVSDRIRILLRRAKELGAAIHFDMEQYAYKNLTLNILQKILLEDEFRQRTDIGITIQAYLRDSEQDARNAIAWLKQRGYPLTIRLVKGAYWDQETIKAAQKHWPQPVFNDKAATDANFEAITQLLLENNQYVYSAIGSHNVRSQALAIAIAETLQVPRRRFEMQVLYGMGDKLAKALVDRGYRVRVYCPYGDLLPGMAYLIRRLLENTANSSFLRQNLENRPVEELLAAPDINLAHAKAQRSKEEKGSFGATDTDFAVEEERKEAARAFAEVRGALGRSYLPLINGEYVQTAEVIDSVNPSNFGEVIGKVGLISVEQAEQAMQAAKAAFPGWRRTPVKERAAILRRAGDLLEERRAELSAWIVLEVGKPVKEADAEVSEAIDFCRYYADEMERLYQGINYDVAGETNRYIYQPRGIVVVISPWNFPLAIACGMTVAALVTGNCTLLKPAETSSVITAKLTEILLEAGIPKGVFQYVPGKGSQVGAYLVSHPDTHLIAFTGSQEVGCRIYAEAATLKPQQRHMKRVIAEMGGKNAIIVDESADLDQAVIGVVQSAFGYSGQKCSACSRVIVVEAIYDAFIHRLVEATKSLNIGEAELPSTQVGPVIDANARDRIREYIEKGKAESQVALELSAPNHGYFVGPVIFGEVPPHGTIAQQEIFGPVLAVIKAKDFAQALAIANDTDYALTGGLYSRTPSHIQQAQEEFEVGNLYINRNITGAIVARQPFGGFKLSGVGSKAGGPDYLLQFLEPRTITENIQRQGFAPIEGAE

SEQ ID NO: 93139 - protein, 158 aa, Ashbya gossypii ATCC 10895
MSRKLKKTNLFSKDVAPLMYAYGDSPQPLPETVQCVDELVTSYLTDICANAYRCAQTVHRTKIKVEDFKFVLRNDPVNLGRAEELIMMNKVIADARKQFDNSEGKSLKRVNKDEDLEDIPEEDGEDMGGMGPGSELAVEETSKRGRKPKKRKNAKGSV

SEQ ID NO: 93140 - protein, 102 aa, Acinetobacter genomosp. 13TU
RGATGEVIQDVVNIGVGGSDLGPQMVTHALCDFKVKTAKPLNVHFVSTMDGSQLSDLLHQLRPETTLFIISSKSFGTIDTLSNAQTVRQWLEKALGKHERVV

SEQ ID NO: 93141 - protein, 115 aa, Taxodium distichum var. imbricarium
  misc_feature (4)..(4): Xaa can be any naturally occurring amino acid
  misc_feature (8)..(8): Xaa can be any naturally occurring amino acid
AGPXQGWXTLNQSKPIGSLPLMNTGALMKQWKMGLKAKRSVKAAFKVKLVTPDGETEIECPDDQYILDVAEEAGIDLPYSCRSGSCSSCAGKVIAGNVEMEDQSFLDDEQIENGF

SEQ ID NO: 93142 - protein, 113 aa, Oryza sativa
  misc_feature (97)..(97): Xaa can be any naturally occurring amino acid
  misc_feature (102)..(102): Xaa can be any naturally occurring amino acid
  misc_feature (107)..(107): Xaa can be any naturally occurring amino acid
  misc_feature (111)..(111): Xaa can be any naturally occurring amino acid
MNPAAMAALGSKLATLGSAAREAARVAAMSGCAYNKAVVEGSRQLQPPPCEATRSAAKHGRAFHEELMERNKRYVIDPPTIQTCQELSKQLFLHPPXASIPXGRYEXSFWXKV

SEQ ID NO: 93143 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKVQRVAASKVLSGPKAHPVGDKAEFIEKVRRALYLGKIVSYAQGFSQLPAASDEYHWELNYGEIAKIFRAGCIIRAQFLQKITDAYVENAGIANLLLAPYFKKIADEYQQALRDVVAYAVQNGIPVPTFSAAVAYYDSYRAAVLPANLIQAQRDYF

SEQ ID NO: 93144 - protein, 422 aa, Physcomitrella patens subsp. patens
MATTQAILSATLAIAPASSCETSSRSPASTKTCLSVAGSSLHGSVAGLGAGKQIVSVQRKSVAVRAAVAAETAAPKQQAKSQYDITTLTTWLLKKEQAGVIDGELTIVLSSIALACKQIASLVQRAGISNMTGLQGAANIQGEDQKKLDVISNEVFSSCLRSSGRTGIIASEEEDTPVAVEESYSGNYIVVFDPLDGSSNIDAAVSTGSIWGIYKPNEECLTNLGEEPTIDEIAENCVVNVCQPGSNLLSAGYCMYSSSVILVLSVGDGVYGFTLDPLYGEFVLSHDNIQIPKSGKIYSMNEGNYALWDDNLKKYVDSLKDPGTSGKPYSARYIGSLVGDFHRTMLYGGIYGYPRDSKSKNGKLRLLYECAPMSYLAEQAGGKGSDGHQRILDIQPEQVHQRVPLYVGSVEEVEKLESFLSS

SEQ ID NO: 93145 - protein, 128 aa, Halobacterium salinarum
  misc_feature (1)..(1): Xaa can be any naturally occurring amino acid
XTVEYLNYETLDDQGWDMDDDDLFEKAADAGLDGEDYGTMEVAEGEYILEAAEAQGYDWPFSCRAGACANCASIVKEGEIDMDMQQILSDEEVEEKDVRLTCIGSPAADEVKIVYNAKHLDYLQNRVI

SEQ ID NO: 93146 - protein, 328 aa, Gluconobacter oxydans 621H
MPARRCSPAGVIVRVASSHVRVGTFQYFAAQGDIEGVRILADHVIGRLYPDLAEAENPYLALLEAVTARQADLVARWMLVGFIHGVMNTDNMSIAGETIDFGPCAFLDAYNPAKVFSFIDQNGRYAYGNQPDMALWNLGRLAEALLPLLDSDREKAIEQAKDALMRFDDVFNDTYLGGWRRKLGLAQEENGDARLTERLLTAMHRGDADFTLTFRRLGDVVRTGQTDSLVALFGPGSGIEDWIGDWQARLGREERPVEACYTDMQATNPRIIPRNHRIEEMIRSAVAGDYAPFHRLVEALSHPFDDAADRFEVPPAPHEKVMNTFCGT

SEQ ID NO: 93147 - protein, 426 aa, Gluconobacter oxydans 621H
MSRNALSAPHLTAADQPNLWLPYTQMQTAPFPVEAVSTSGSRITLADGRELVDGVAAWWTACHGYSHPHIHEALVRQAERMPHVMFGGMVHEPAIRLAARLAAMLPGDLERVFFTDSGSVAMEVAIKMAVQYHINRGTSGRTKILSFRGGYHGDTLGMMSICDPEEGMHSLFAGVLPEQALADLPVDGDSLARLEALLAERGDSIAAMVTEPLVQGAGGMLFHDPEVLRHLRELCDRHGILLILDEIFTGFGRTGTMFACEQAGIVPDIVALSKALTGGTMALAATVARRGVFEAFLSDSAGHALMHGPTFMANPLACAVANASLDLFETEPRLEQVATISAQLARELEPCRTLPGVKDVRVLGAIGVVELETLDDPDALRRAFVERGVWIRPFRNIVYLTPAFTIMPEELTRLTTAIVDVLREGA

SEQ ID NO: 93148 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFTFIGTGVSGGEEGALKGPSIMPGGQKDAYDLVAPILTKIAAVAEDGEPCVTYIGADGAGHYVKMVHNGIEYGDMQLIAEAYSLLKGGLNLSNEELANTFTEWNNGELSSYLIDITKDIFTKKDEEGNYLVDVILDEAANKGTGKWTSQSALDLGEPLSLITESVFARYISSLKAKRVAASKVLSGPKAHFGGDKADFIEKVRRALYLGKIVPYAQGFSQLPAASDEYHWDLNYGKIAKIFRAGCIIRAQFLQKITDAYAENAGIANLLLAPYFKKIADEYQQALRDVVAYAVQNGIPVPTFSAAVAYYDSYRAAVLPANLIQAQRDYF

SEQ ID NO: 93149 - protein, 443 aa, Salmonella enterica
IGVVGMAVMGRNLALNIESRGYTVSVFNRSREKTEEVIAENPGKKLVPYYTVKEFVESLETPRRILLMVKAGAGTDGAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEEGNYLVDVILDEAANKGTGKWTSQSALDLGEPLSLITESVFARYISSLKANRVAASKVLSGPKAQPAGDKAEFIEKVRRALYLGKIVSYAQGFSQLRAASDEYHWDLNYGEIAKIFRAGCIIRAQFLQKITDAYAENADIANLLLAPYFKKIADEYQQALRDVVAYAVQNGIPVPTFSAAVAYYDSYRAAVLPANLIQAQRDYF

SEQ ID NO: 93150 - protein, 264 aa, Sulfitobacter sp. EE-36
MPALDDLSLLIEAARRSGEIATSFTGKTAQRWDKPDDAGPVTEADLAVNAMLHQTLTAARPEYGWLSEESDDGTRRLGQRDLFIVDPIDGTRSFIEGSDTWSHSLAIARDGRITAAVVFLPMLDRLYAAAAGAGATLNGQSISVSDIATLPEATVLATKPVMEMQHWTKGDPGFKRAHRPSLAYRLGLVGQGRFDGMVTLRKSWEWDIAAGALIVTEAGGQCTDRTGQPLRFNNPDPRLNGVVAGGDAVHAALLSGLAQTQATP

SEQ ID NO: 93151 - protein, 439 aa, Glycine max
MKFTPSSKFLGFSNHFHSLLAPSFSPTPKFSSSFSATMSTLSTQNDTVTHKTQQPLQIAKRLEKFQTTIFTQMSLLAIKHGAINLGQGFPNFDGPEFVKEAAIQAIRDGKNQYARGYGVPDLNIAIAERFKKDTGLVVDPEKEITVTSGCTEAIAATMIGLINPGDEVIMFAPFYDSYEATLSMAGAKVKGITLRPPDFAVPLEELKSTISKNTRAILINTPHNPTGKMFTREELNCIASLCIENDVLVFTDEVYDKLAFDMEHISMASLPGMFERTVTLNSLGKTFSLTGWKIGWAIAPPHLSWGVRQAHAFLTFATAHPFQCAAAAALRAPDSYYVELKRDYMAKRAILIEGLKAVGFKVFPSSGTYFVVVDHTPFGLENDVAFCEYLVKEVGVVAIPTSVFYLNPEEGKNLVRFTFCKDEETIRSAVERMKAKLRK

SEQ ID NO: 93152 - protein, 443 aa, Salmonella enterica
IGVVGMAVMGRNLALNIESRRYTVSIFNRSREKTVEVIAENPGKKLVPYYTVKEFVESLETPRRILLMVKAGAGTDAAIDSLKPYLEKGDIIIDGGNTFSQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFTEKVRRALYLGKIVLYAQGFSQLTAASDEYHWDLNYGEIAKIFRAGCIIRAQFLQKITDAYAENAGIANLLLAPYFRKIADEYQQALRDVVAYAVQNGIPVPTFSAAVAYYDSYRAAVLPANLIQAQRDYF

SEQ ID NO: 93153 - protein, 506 aa, Alkalilimnicola ehrlichei MLHE-1
MIYANPGERDAKVQFKPRYGNFINGEWVEPASGQYFENITPVTGEVFCEVARSNADDVERALDAAHAAKDAWGKASVTERANVLLKIADRMEANLERLAVAETWDNGKPVRETLNADLPLAIDHFRYFAGAIRAQEGGISEIDHDTIAYHFHEPLGVVGQIIPWNFPLLMATWKIAPALACGNCIVLKPAEQTPASILVLMECIQDVLPPGVLNVVNGFGVEAGKPLATSNRIAKVAFTGETTTGRLIMQYAAENIIPVTLELGGKSPNIFMADVMDQDDDFLDKAIEGMTLACLNQGEVCTCPSRALIQEDIYDDFIAKVIDRFSMVKQGNPLDTETMIGAQASSEQMEKILSYMDIGRQEGAECLIGGDRAEIGGDFQNGYYVQPTLFRGHNKMRIFQEEIFGPVVSVTTFKDEAEALELANDTLYGLGAGLWSRSAHTTYRMGRAIQAGRVWTNCYHLYPAHAAFGGYKQSGIGRENHQMMLEHYQQTKNLLVSYSPKAMGFF

SEQ ID NO: 93154 - protein, 443 aa, Salmonella enterica
IGVVGMAVMGRNLALNIESRGYTVSIFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIKYGVMQLIAEAYSLLKGGLNLSNEELANTFTEWNNGELSSYLIDITKDIFTKKDEDGNYLVDVILDEAANKGTGKWTSQSALDLGEPLSLITESVFARYISSLKDQRVAASKVLFGPKAQMGGGKAEFFEKVRRALYLGKIVSYAQGFSQLPAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYF

SEQ ID NO: 93155 - protein, 444 aa, Pasteurella pneumotropica
  misc_feature (444)..(444): Xaa can be any naturally occurring amino acid
MSARKIVQIIGAVIDVEFPQDAVPKVYDALKVESGLTLEVQQQLGGGVVRCIALGTSDGLKRGLKVENTGNPIQVPVGTKTLGRIMNVLGEPIDERGEIGAEENWSIHRAAPSYEEQSNSTELLETGIKVIDLICPFAKGGKVGLFGGAGVGKTVNMMELIRNIAIEHSGYSVFAGVGERTREGNDFYHEMTESNVLDKVSLVYGQMNEPPGNRLRVALTGLTMAEKFRDEGRDVLFFVDNIYRYTLAGTEVSALLGRMPSAVGYQPTLAEEMGVLQERITSTKTGSITSVQAVYVPADDLTDPSPATTFAHLDSTVVLSRQIASLGIYPAVDPLDSTSRQLDPLVVGQEHYDVARGVQGILQRYKELKDIIAILGMDELSEEDKLVVARARKIERFLSQPFFVAEVFTGSPGKYVSLKDTIRGFKGILEGEYDHIPEQAFYMX

SEQ ID NO: 93156 - protein, 444 aa, Avibacterium gallinarum
  misc_feature (11)..(11): Xaa can be any naturally occurring amino acid
MATGKIVQIIXAVIDVEFPQDAVPKVYDALNVETGLVLEVQQQLGGGIVRCIAMGSSDGLKRGLSVSNTAKPISVPVGTKTLGRIMNVLGEPIDEQGPIGAEETWSIHRPAPSYEDQANSTELLETGIKVIDLICPFAKGGKVGLFGGAGVGKTVNMMELIRNIAIEHSGYSVFAGVGERTREGNDFYHEMTESNVLDKVSLVYGQMNEPPGNRLRVALTGLTMAEKFRDEGRDVLFFVDNIYRYTLAGTEVSALLGRMPSAVGYQPTLAEEMGALQERITSTKTGSITSVQAVYVPADDLTDPSPATTFAHLDSTVVLSRQIASLGIYPAVDPLDSTSRQLDPLVVGQEHYDVARGVQGTYKRYRELKDIIAILGMDELSEEDKLVVARATKIERFLSQPFFVAEVFTGSPGKYVHLKDTIRGFKGILEGEYDHIPEQAFYMV

SEQ ID NO: 93157 - protein, 484 aa, Chlamydomonas reinhardtii
MGDPRVSFSVANILGKGPNDPKLEDAYRVDKQIGKGAFGVVRAGAKRSTGDPVAVKSISKAKLVCKEDVKDVQAEVAIMNLVAGHPYVVTLRSTHEDKEFVHIAMELCAGGELFDSIVEAGNFTEKKAALYFRKMVEVVNHCHELGVMHRDLKPENFLLTSKGPEGELKLTDFGLGVFFKPGERFRDLVGSPYYVAPEVLRKNYSHEADMWSLGVILYILLSGLPPFWGDTEDQIFKMVLKGHIDFKTDPWPKISEAAKDCVKRLLDQDVTKRATAAQILKHEWLVKEGVALDIALDSVVLKRLKQFAQMNKLKKACLMVIGQHLTPDEIAGLKELFKSIDADGSGTITVEEMRKALAQWGHKINEVELQQLMAIADVDGDGLIDYNEFVAATMHLSKLEKEELLQQAFKQIDKDGSGTISVSELEQELKKFGIYDDAKELLATADTNGDGLIDYLEFCSMLRNNNEALKQSTRAIKRQYSKFF

SEQ ID NO: 93158 - protein, 488 aa, Legionella pneumophila str. Lens
MEIYEMYIDGKFTLAKSGATRDIIDPANGELIAKVPESAKEDAILAIKAARKAFDEGEWRISLALDRGKLLFKLADLIRANAKMLAELETRNCGKPLPEAEFDVTDAANCFEFYGGLATKIHGETMSVPANSFSYVVREPIGVCGQIIPWNFPLLMAAWKLAPALAAGNTVVLKPSELTPITALELFKLIDQCGFPAGVVNLITGPGIGVGEELASNAMVDKVAFTGGSATGRKIMQAATGNLKKISLELGGKNPNIVFADCDLEMAIDGALFGAFANQGEVCSAGSRLLVERSIHKKIVEGMLKKIPNIKLGHGLDAGVKMGPLVSSAHREKVESYVKLGMEEGAKLLCGGKRPTGSEFAKGHFFEPTIFDEVKSTMRIAREEIFGPVLVVIPFDTEEEAIRIANDTDYGLSGAVWTKNVTRAHRVTSQIRAGILWVNHYHPTYNEMPWGGYKQSGAGRELGLYGIESYLEVKQVNINLDETPIGWY

SEQ ID NO: 93159 - protein, 450 aa, Legionella pneumophila str. Lens
MKHQLVGTKLMKKIHIKTPIPGPKSQQLMELRRQHVARGPFHATPIFVKQAKGSFVEDVDGNVFLDFSSGFGVVNTGHCPDSVVNAIKLQAEKFIHTGFNIIPYESYIKVCEKLNDHTPGHFEKKSLLLNSGAEAVENAIKIARAYTGKQAVICFDHAFHGRTYMAMTLTSKNKPYKHGFGPFPSEIHRAPFPYEYRWKGVNCVEECFNEFTDLANFRVGVENIAAVIIEPVLGEGGFIQSPALFLQKLREFCTTNDIVFIADEIQSGFGRTGNLFAMNTLGVPPDLTISAKGLGGGVVLAGVTGKAEIMDAAMEGGLGGTFGGNPLSCAAALEVFHIFEEGSLLQNVTHLAKALQSRLSGFKEKYKVVGDVRGLGVMQAIELVKDKNTKEPNKEATVQLAQFCLEHGLIILTCGTYGNVIRLHMPLSTGVKDLEIGLSIIEEGLKKLSV

SEQ ID NO: 93160 - protein, 310 aa, Legionella pneumophila str. Lens
MSSKLLTIQLLEELVHAAELNQEGKTADYIPELANVNQELTAIAVQTLGEKTLAYSNNPLHPVTLQSTGKMIPLIGLLEEFGADQLFEWVKVEPSGDDFASITRLEQFGPKPSNPMLNAGAIALCSRIPGVGEQQFRWLEHWVQKLFNQRLSINPLVFASEKRTGNRNRALAYLLKSRNNLGADVHETLDLYFALCSYEAMLDQMLYLPTLLANSGKDSDTGEQILSMETCKITLAIMATCGLYDETGTHMVKTGMPAKSGVSGYTIAVVPGKAGIVVLSPRVNAKGNSIRGEIMLEGLSKAMNWHFALP

SEQ ID NO: 93161 - protein, 209 aa, Brassica napus
  misc_feature (32)..(32): Xaa can be any naturally occurring amino acid
RTSGEYLTHNGVSTFACSETVKFGSGYFNEKXEQYVEIPSDSGISFNVKPKMKALEIAEKARDAILSGKFDQVRVNLPNSDMVGHTGDIDATVVACEAADVAVKMILDAIEQVKGIYVVTADHGNAEDMVKRDKAGKPALDKEGKLQILTSHTLKPVPIAIGGPGLSEGVRFRKDLEIPGLANVAATVMNLHGFVAPADYEPTLIEVVE

SEQ ID NO: 93162 - protein, 366 aa, Physcomitrella patens subsp. patens
MGSTEENLDATHGFTRPEMMKKKPLVGSVDLYDRHVFLRYNQPSSWPAKVEAADYHPLPSKLVSTLRSKRNELPKKTRLTIADGQDEPERTNGDILVFPDMVKYKGISESDVESFVDEVLLKGDKWALGESEPLVGTHVFICAHGSRDKRCGVCGPPLRERFNQEIALRGLGEQVFVNYCSHIGGHKYAGNVIVFRPDGGSGGCSGHWYGYVTPDDVPEIMEKHIGLGEVVGRLWRGQMGLTEDEQKEVQQKRNPSSNLTQDGTKPEGKVDAASTSTGATAPIRKKPPPPLLPRIGSRDLHQMCGDEQEEEGPLKPYEEKKKPRFKWPTWVEDWESGDTIAVVTLATAVTAIYFAYHAYRVTSQQN

SEQ ID NO: 93163 - protein, 521 aa, Methanosarcina acetivorans C2A
MWNSLHMTQARRPLMLMILDGWGYREASEGNAILAAETPNLNSLLNEFPWCFLECSGEAVGLPEGQMGNSEVGHLNIGAGRVVYQDLTRINLSVRNGDFFENPVLLDAISNVKLNDSSLHLMGLVSYGGVHSYMTHLYALIKLARDKGLKKVYIHAFLDGRDVPPKAALADIRELDAFCKENGSARIATVQGRYYAMDRDKRWERSKLAYDALTLGVAPYTTSDAETAVSDAYARGETDEFVKPTVVTGSDGKPEAVVQDNDSIIFFNFRPDRARQLTWAFENDDFDGFPREKRPKVHYVCMAQYDETLDLPIAFPPEELENVLGEVLSKQGLVQLRIAETEKYAHVTFFLNGGQEKCYDGEDRCLIPSPKVATYDLKPEMSAYEVTDEVIRRIQSGKYDVIVLNFANMDMVGHTGIFEAAVQAVEAVDTCVGRIIEALKKAGGVALITADHGNAEQMENQHTGEPHTAHTSNPVRCIYAGKGEVKALENGKLSDLAPTLLDLLGVPKPEEMKGKSLILNE

SEQ ID NO: 93164 - protein, 449 aa, Burkholderia mallei ATCC 23344
MSYNDSRFWHPMLHPNDMKRREPIRIVRGDGCHVYDERGRQLVDGVAGLWNVNVGHNRAEVKEAIVRQLDELEYFQLFDGITHPRAEELSSKLIDMMEPEGMRRVLYSSGGSDSVETALKIARQYWKVRGQADRTKFISLKQGYHGTHFGGASVNGNTVFRRNYEPNLPGCFHVETPWLYRNPFTQDPEALGRICAELLEREILFQSPDTVAAFIAEPIQGAGGVIVPPANYWPLVREVCDRYGVLLIADEVVTGFGRSGSLFGSRGWGVKPDIMCLAKGISSGYVPLGATAVNARIEDAFASNADFGGAIMHGYTYSGHPVACAAALASLDIVLREDLPANAAKQGAHLIEALRPFVERFDALGEVRGKGLMVALDLVADKATRAPIDPMSGYANAVAEVARENGVLVRPVGTKIILSPPLVIQREQIDRIVAGLEAGFAATPFPGGR

SEQ ID NO: 93165 - protein, 536 aa, Rhizobium leguminosarum bv. viciae 3841
MRNATIVAPQPEAVEAGAEVLERGGNAIDAALACAFVQGVVDPQMAGIGGFGSMHVYMPKKGVHEILEFYARAPLKAAPDMWLDKIKHQSRDGFGYVLEGNISDIGYLAVCTPGSLKGYETALRDYGTFDWADLIKPAIRLARNGFMIRNHMHWYWAKDQSNDGFANTLDKLRFSETGRKVYFHDDGTLKNVGDLLVNKDMGETLERIARSGGSDIFYHGELAEQIAGDFKANGGLIDRQDLARYELSKVEPVWGDYRDHRIATSPPPGSGFPMLELLHIMEQFDVGSLQHGSADHVRILFEAMKRMTIDKDAHMGDPAYVDVPYEKLLSKEHAKAHARAIKAGEIASVSRLDSSQRDTTHISVIDKDGNAVAMTHTLGSPSGAITDGLGFMYNGTMSRFNPLPGKPGSIAPGKRRPSSAAPTIVFKGDEPSIVIGAPGGSYIAPAVAQCLMNMIDFDMSVLEAVSAPRIVGVSNTIDICNRIRHSVEDELRAQGYQVARSPQTYAFAAVHAIKIDGGISKGAADPQRDGMAISVG

SEQ ID NO: 93166 - protein, 482 aa, Neisseria meningitidis
GSADAEYDVVVLGGGPGGYSAAFAAADEGLKVAIVERYKTLGGVCLNVGCIPSKALLHNAAVIDEVRHLAANGIKYPEPELDIDMLRAYKDGVVSRLTGGLAGMAKSRKVDVIQGDGQFLDPHHLEVSLTAGDAYEQAAPTGEKKIVAFKNCIIAAGSRVTKLPFIPEDPRIIDSSGALALKEVPGKLLIIGGGIIGLEMGTVYSTLGSRLDVVEMMDGLMQGADRDLVKVWQKQNEYRFDNIMVNTKTVAVEPKEDGVYVTFEGANAPKEPQRYDAVLVAAGRAPNGKLISAEKAGVAVTDRGFIEVDKQMRTNVPHIYAIGDIVGQPMLAHKAVHEGHVAAENCAGHKAYFDARVIPGVAYTSPEVAWVGETELSAKASARKITKANFPWAASGRAIANGCDKPFTKLIFDAETGRIIGGGIVGPNGGDMIGEVCLAIEMGCDAADIGKTIHPHPTLGESIGMAAEVALGTCTDLPPQKK

SEQ ID NO: 93167 - protein, 500 aa, Burkholderia mallei ATCC 23344
MTQTDLVAVADTVRAFTEREFGVFIDGAMRAAHSPRRLDVFDPATGARLSRVPDADAHDVDAAVASAQRAFDARAWSGLRPAERERILLKLADVLEAHAEELAQLETLNQGKSILVSRGVEVGATIEYVRYMAGWATKITGQTLDVSIPFPPGARYTAYTRKEPVGVVAAIVPWNFPLMIAVWKLVPALAAGCTVVLKPSPETPLTALRLAELALEAGVPAGVFNVVTGARACGAALASHPAVRKISFTGSTATGKLVGAAAVQNMTRFSLELGGKNPIVMLEDVDVDAALGGVAAGAFFNQGQVCAAASRIYVHRSRFRRLAEGLAGVASAMRLGPGLDPAAQINPLVSAHHRDTVARHIDAARREGLTFFAGGTRADDLPGYFVRPAVIADAAHDSAIVRDEVFGPVVVVLPFDDPAEAVRLANASPYGLAASLWSNDLKAVMDLVPQIEAGTVWVNCHIPLDPSMPFGGYKQSGIGREFGQYAIEGFTETKSVCIAH

SEQ ID NO: 93168 - protein, 175 aa, Escherichia coli
SLLNVPAGKDLPEDIYVVIEIPANADPIKYEIDKESGALFVDRFMSTAMFYPCNYGYINHTLSLDGDPVDVLVPTPYPLQPGSVIRCRPVGVLKMTDEAGEDAKLVAVPHSKLSKEYDHIKDVNDLPELLKAQIAHFFEHYKDLEKGKWVKVEGWENAEAAKAEIVASFERAKNK

SEQ ID NO: 93169 - protein, 252 aa, Magnetospirillum magnetotacticum MS-1
MTDSHSHSDGTTHFGFKTVAEDEKVSLVRGVFDSVASKYDLMNDLMSAGVHRLWKSAFLDMLRPQPGQTLLDVGGGTGDIAFGWKKRGGGPVTVCDINREMLAVGRDRAVDRNLLDGLTWVCGNAEELPIPDRSVDRYTIAFCLRNVTHWDKAIAEAYRVLRPGGRFMCLEFSRVIVPGLREAYDAYSFNVLPKVGGMVTGNAEAYQYLVESIRKFPPQEEMAAMVEAAGFSRVEVRNLSAGIAAIHSGWRI

SEQ ID NO: 93170 - protein, 497 aa, Arabidopsis thaliana
ATLFWKPKEPRLHYDLPPSPPTLPIIGHLHLLLSVLVHRSLQTLSTKYGSILYLRVFSFPVALVSSASIAYEIFREHDVNISSRGFPPTDDSLFAGSFSFTSAPYGDYWKFMKKLLVTNLLGPQALERSRGFRADELDLFYENLLDKAMKKESVDICVEALKLSNNSICKMIMGRSCSEENGEAERVRALATQLDGLTKKILLANMLRAGFKKLVVSLFRKEMMDVSSRFDELLERILVEHEDKLDMHHQGTDLVDALLAACRDKNAEYKISRNHIKSFFADLLFASTDTFVQTTQWTVAEIINNPNVLERLRGEIDSVVGKARLIQETDLPNLPYLQAVVKEGLRLHPPGPLFARFSQEGCRIGGFYVPEKTTLMINAYAVMRDSDSWEDPDEFKPERFLASSRSEQEKERREQAIKYIAFGSGRRSCPGENLAYIFLGTAIGVMVQGFEWRIKEEKVNMEEANVGLSLTMAYPLKVTPVPRTLVPLTQNPLNRSS

SEQ ID NO: 93171 - protein, 450 aa, Methanosarcina acetivorans C2A
MEKEYDIIILGTGTAGRTLAGRAKSSGLKFAIIDSREYGGTCPLRGCDPKKVLAGASEATDWNNRLIGKGAGTEKPLEINWSSLIEFKRTFTRDYPRETEKMFADMGIDMYHGRANFENENTILVGKDKLKGKYIFLATGSKPRKLNIPGEEYLITSEEFMETEKFPEKIIFVGGGYVSFEFAHIALRAGAEVLILHRSEKPLRDFDSEMADLLVRASEAAGMRILTDRPVVAVEREGDRFLVRAEYKTETGSETQTFNADMVVNGAGRTPDIEDLRLENAGITAEKKGIIVDKHMQTSNPRVYAGGDCTAEGMQLTPVATLQGEIAAANIFDENRAEIDYTGIPSAVFTIPVLASVGITEAKVNDKHRVIFRDRSKWSTTRRAGLEFAASKIIVDETNDHIVGAHILGPNAEEAINIFATAMQLGLRASSIKKMAFTYPTTCSDIRYML

SEQ ID NO: 93172 - protein, 471 aa, Ashbya gossypii ATCC 10895
MDTSSVTMHTERACCHQAQRAVAAMLDKAPSWLIWTAVLYVGLPFMLYWAVPYLFYHNKTKSRRIAIYVLGDLGHSPRICYHARSFSAAGWEVELCGYLEEQPPKDLLDDPRVTIRALPGASNAGKSLGQTARKVVLQTCHIVRQLWELRGCDYILIQNPPSIPLLPIVAIFKVLTRTRLILDWHNFAYTVLQLRVGRFLHPLVLVSYAVEFLFSRMADYHITVTAAMKDYLVQSFLLPARRIAVMYDRPGEQFRPLPAGERGAALAEPFIRGYIPAGFDVQRGDTILVTSTSFTLDEDINVLFGALKIYESAAAKFDTTLPRILLFVTGKGPLKGKYMEEVRNYKWERCTIHFLWLSAEDYPRLLQLCDFGVSLHTSTSGLDLPMKVLDMFGSGLPAFVMDYPAIGELVQDRVNGLRFTTRRELEQCLIFAIKDEHTRKVLKENALLESKNRWHQRWASAMSELQVVRQS

SEQ ID NO: 93173 - protein, 418 aa, Bradyrhizobium sp. BTAi1
MGRLVLKFGGTSVANIDRIRNVARHVKREVDAGHEVAVVVSAMSGKTNELVAWCTEASPMHDAREYDAVVASGEQVTSGLLAIVLQSMGIQARSWQGWQIPIKTSDAHASARIVDIDGSELIQRFQERKEVAVIAGFQGINPATNRITTLGRGGSDTSAVAIAAAIKADRCDIYTDVDGVYTTDPRVVPKAKRLDKIAFEDMLELASQGAKVLQVRSVELGMVHNMPIFVRSSFDKPEDIDPHAKQPPGTLICSEEQIMENHVVTGIAFSKDEAQISVRQIEDKPGIAASIFGPLADANINVDMIVQNVSEDGKTTDLTFTVPATDYNRARETIAAAKDKIGYQRLDTATDVAKVSVIGSGMRSHAGVAAKGFAALAARNINIRAITTSEIKFSVLIDAVYTELAVRTLHTLYGLDQA

SEQ ID NO: 93174 - protein, 755 aa, Bradyrhizobium sp. BTAi1
MRSTSGGPRVLLRRLRETMAEQVSAQERLDKIVVLIAANMVAEVCSVYVLRVDNTLELYATEGLNRDAVHMTVLSAHEGLVGLVASEATPLNLSDAQNHPAFSYRPETGEEIYHSFLGVPILRAGNTLGVLVVQNRAKRTYVEEEVEALQTTAMVLAEMIASGELAALAQPGAEPAVRHSVHKTGAVLSDGIALGHVVLHEPRVVVNNYIAEDLPKEIKRLDAALVKLRADLDRMLERGDVADGGEHREVLEAYRMFANDQGWSHKLHEAVATGLTAEAAVERVQSDTRARMLRSTDPYLRERLHDLEDLGYRLLRQLVGQDHAPSREHLPDNAILIARAMGPAALLDYDRKRLRGLVLEEGTANSHVAIVARALGIPAVGEVPNAPGIADPGDAIIVDGTSGSIYVRPSAEIESAYAERVRFRARRQAQYSELRNKPCVTKDGQPVELMINAGLVIDLPHIEDTGSAGIGLFRTELQFMVSASLPRSSDQLALYRSVLDAAGTKPVTFRTLDIGGDKALPYMETVIEENPALGWRAIRLGLDRPGLLRGQIRALLRAGGGRSLRIMFPMISEVAEFDTAKAIVERELTYLRQHGHTLPERVDIGTMLEVPALLYQLDELLSRVDFISVGSNDLFQFLFAVDRGNAKVSERFDTLSTPILRALQQIVRKAKAAKRSVSLCGEMASKPIGALALIALGYRSLSLSATAHGPVKAMILELDAAKAEAKMAEWLAAPAGSLSMRQKLTEFAESEGLAL

SEQ ID NO: 93175 - protein, 188 aa, Prochlorococcus marinus str. MIT 9211
MADNSSLIALSKLQKILLMLVAFVLSAALLIMKISVASVQPLEQLARSSLLPEIALANGKPTIFEFYADWCEVCQKMSPSIVDLEKRMGDKLDIVLLNVDNQRWSPLIDKYNVNGIPQFIFFNQDGDLKGISIGLLSSEKIIKASEYLIDNKELTDIEEFNNMSPDRFKFTDLIDTSKSRPVNPRSHS

SEQ ID NO: 93176 - protein, 175 aa, Triticum aestivum
MAAVEGEKKMITLKSSDGQEFEVEEAVAMESQTIRHMIEDDCADNGIPLPNVDSKILSKIIEYCKKHVQASPKPADSGAAADANSSTSTAAPASAEDLKSFDAEFVKVDQATLFDLILAANYLNIKGLLDLTCQTVADMIKDKTPEEIRKIFNIKNDFTPEEEAEIRRENQWAFE

SEQ ID NO: 93177 - protein, 890 aa, Oryza sativa
MLASLSEAAADDGIGGQSGFVSLDCGREANYSDYKDPKTGIVYVSDEPYIDAGAGENHRISATATATAADSYLLQTLRSFPSGPRNCYALPTVAGTKYLVRLGFLYGNYDGENSSSSSASSLRFDLHLGAQRWATVDDVVVQTGGISRMYEVVFMGWARWAPACLVNVGGGTPFVSSVELRPIDDELYPSVKTSESLSLFKRSDMGADTTTLTRYPADEHDRIWKGTGNPGSTDISTQEKIQSENSFEVPLPVLQTAITTPGGNDTTLTVAWQDTRSSSEYMVFLHFADFQKIQPRQFNVTLNDIPIGSNGRSLMFSPSPLDSSSVYSSDGYRADDGNYNLVLRRTAASALPPMLNAMEIYTVITHDSPRTFHKDFDAIMDIKYEYGIKKNWMGDPCFPSEFIWDGIKCSTAGDDNTSRIISLDLSQSNLQGVVSINFTFLTALNYLNLSGNQLNGPVPDSLCKNIAGLYIFSYTSDGDICNNRTSSSRSTNRSTTILAISIVTPVLAVAILLAFLLWRAKGKHNGLTSFGISLISYNWFMQKPVSTFDPPRVPDPKKAPGSTTDHWSHLPINGSRQFTYEELKNFTLNFQRFIGQGGFGHVYYGCLEDGSEVAVKMRSESSLHGLDEFLAEVQSLTKVHHRNLVSLVGYCWEEHYLALVYEYMPSGSLCDHLRGKRDVGETLNWAKRVRIMLEAAQGLEYLHKGCNLPIIHGDVKTNNVLLGENLKAKLADFGLSKMYISDSQTHISVTAAGTVGYIDPEYYQTGRLTESSDVYSFGVVLLEVVTGELPILAGHGHIVQRVERKVTSGSIGLVADARLNDSYDISSMWKVVDTAMLCTTDVAIQRPTMSTVVLQLKECLALEEAREDRNRAGPTNDAVDVVSTFGPSAR

SEQ ID NO: 93178 - protein, 147 aa, Triticum aestivum
  misc_feature (9)..(9): Xaa can be any naturally occurring amino acid
  misc_feature (88)..(88): Xaa can be any naturally occurring amino acid
DERVAASKXFQGDYSSGETVDKAQLIEDVRKALYASKICSYAQGMNIIKKAYDRNGELANLLIDPEFAQEIMDRQAAWRRVVCLAINXGSAPLACRGLAYFDSYRRDRLPANLVQAQRDYFGAHTYERVDMPGSFHTEWYKIANSKI

SEQ ID NO: 93179 - protein, 865 aa, Arabidopsis thaliana
MERHCVLVATFLLMLHIVHAQDQIGFISVDCGLAPRESPYNEAKTGLTYTSDDGLVNVGKPGRIAKEFEPLADKPTLTLRYFPEGVRNCYNLNVTSDTNYLIKATFVYGNYDGLNVGPNFDLYFGPNLWTTVCLIKTGISIPFINVLELRPMKKNMYVTQGESLNYLFRVYISNSSTRIRFPDDVYDRKWYPYFDNSWTQVTTTLDVNTSLTYELPQSVMAKAATPIKANDTLNITWTVEPPTTKFYSYMHFAELQTLRANDAREFNVTMNGIYTYGPYSPKPLKTETIYDKIPEQCDGGACLLQVVKTLKSTLPPLLNAIEAFTVIDFPQMETNGDDVDAIKNVQDTYGISRISWQGDPCVPKLFLWDGLNCNNSDNSTSPIITSLDLSSSGLTGSITQAIQNLTNLQELDLSDNNLTGEIPDFLGDIKSLLVINLSGNNLSGSVPPSLLQKKGMKLNVEGNPHLLCTADSCVKKGEDGHKKKSVIVPVVASIASIAVLIGALVLFFILRKKKSPKVEGPPPSYMQASDGRSPRSSEPAIVTKNRRFTYSQVAIMTNNFQRILGKGGFGMVYHGFVNGTEQVAVKILSHSSSQGYKEFKAEVELLLRVHHKNLVGLVGYCDEGENMALIYEYMANGDLKEHMSGTRNRFTLNWGTRLKIVVESAQGLEYLHNGCKPPMVHRDVKTTNILLNEHFQAKLADFGLSRSFPIEGETHVSTVVAGTPGYLDPEYYKTNWLTEKSDVYSFGIVLLELITNRPVIDKSREKPHIAEWVGVMLTKGDINSIMDPNLNEDYDSGSVWKAVELAMSCLNPSSARRPTMSQVVIELNECIASENSRGGASRDMDSKSSIEVSLTFDTELSPTAR

SEQ ID NO: 93180 - protein, 464 aa, Legionella pneumophila str. Lens
MVLEFDTIILGGGKGGKTLAMDLAKSGQKIAMVENNQIGGTCINVACIPTKTLVQSAKVAHYCRKAKDYGLNTTLSPIDFKAIRARKDAVVNGMREANLKQFLDSGMDLMLGHGHFIGPKMIEVTLSSPRDNQKTLHITADKIIINTGALPYTPPIAGLDKVNYFTNDSLMNTDSVPQHLLIIGGGYIGLEFAQMFRRFGAEVTAIEASSEFLGREDKDIAEQVFQILSNEGIQFAVDTKINAIRQEKTEVIIEANRQGQSEIIRGTAVLVAVGRIANTAGLHLDRTGVELDERGFIKVNEFLETTAAGIWALGDVKGGAQFTHLSLDDYRLVKHNLQNPQKKLSSQNRLIPYTVFLDPELARIGLTEAQARSQGRPIKIATIPAAAIPRAKTQGETTGVLKAVIDAETDLILGVSIFCAEAGEILGVIQLAMELRVPYQKLRDMMFAHPTLVEGINLWFAQII

SEQ ID NO: 93181 - protein, 370 aa, Glycine max
MEEIEGVNCCSESESRSSSETRPPNPNPPSYRQCKLVRHASLQMKTKLSDVSAEPGHVTEDCQSDFFPTLRSGACADIGFRSNMEDVYVCADNFMVDYGLKNHIDGPSAFYGVFDGHGGKHAADFACHHLPKFIVDDEDFPRDIERIVASAFLQTDNAFAEACSLDAALASGTTALATLVIGRLLVVANAGDCRAVLCRRGKAIEMSRDHKPGCNKEKKRIEASGGYVYDGYLNGQLNVARALGDWHMEGMKSKDGGPLTAEPELMTTKLTTEDEFLIIGCDGIWDVFRSQNAVDFARRRLQEHNDPAMCSKDLVDEALKRKSGDNLAAVVVCFQQQPPPNLVAPRSRVQRSFSAEGLKELQSFLDSLGN

SEQ ID NO: 93182 - protein, 414 aa, Legionella pneumophila str. Lens
MSFKQLALIEPLNRAVSELGYTTPTSIQLKAIPLILNGHDLLGSAQTGTGKTASFVLPILQKAGQQTPASPNRVKVLILTPTRELAIQVHESIIQYGKYLTLRSAVIYGGVKSHNQIKQLDSGLEILVATPGRLLDLYQQRAVKFDEIDTLVLDEADRMLDMGFIHDIKKIIKLLPLKRQNLLFSATFTPEVRTLARNILNKAVEIDIAPRNTAVKTIKQTVYSVDRNHKLALLSHLLHKNNWGQTLVFSRTKHGANKLVKQLAESQIYSVAIHGNKSQAQRTKALADFKSGKVQTLIATDIAARGIDIEKLACVVNFDLPHVPEDYVHRIGRTGRAGASGLAVSLVSTEEIKLLLSIEKLINQKLERIKIKDFEFLHNFSDLVSAKIQKFAPPKAGYKGNISRKSRTAFNKSA

SEQ ID NO: 93183 - protein, 386 aa, Physcomitrella patens subsp. patens
MSLKSSTALKGDFLGAALKQTVAAPKAANVAFAVRAAGYDEELVKTANSIASKGKGILAMDESNATCGKRLESIGLENTEANRQAYRQLLVTTPGLGDYISGAILFEETLYQSTTDGRTMVDCLNANGIIPGIKVDKGLVPLTGSNNESWCQGLDGLASRTAAYYKQGARFAKWRTVVSIPNGPSELAVTEAAWGLARYASICQDNGLAPIVEPEILLDGDHGIDRTLEVASKVWSKVFYFLAENNVLFEGILLKPSMVTPGAECKERATPEQVAQYTLNMLKRRVPPAVPGIMFLSGGQSEVEATLNLNAMNQSPNPWHVSFSYARALQNSVLKTWKGQPENVEAAQRALLVRAKANSLAQLGKYSAEGEAEEAKQGMFVKGYTY

SEQ ID NO: 93184 - protein, 379 aa, Zea mays
MATAGKVIKCRAAVAWEAGKPLSIEEVEVAPPQAMEVRVKILYTALCHTDVYFWEAKGQTPVFPRILGHEAGGIVESVGEGVTELAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQAKKFGCTEFVNPKDHDKPVQEVLIELTNGGVDRSVECTGNVNAMISAFECVHDGWGVAVLVGVPHKDDQFKTHPMNFLSEKTLKGTFFGNYKPRTDLPNVVEMYMKKELELEKFITHSVPFSEINTAFDLMLKGESLRCIMRMED

SEQ ID NO: 93185 - protein, 723 aa, Vibrio sp. Ex25
MIYQAETLQVKEIQDGIAELSFCSPKSVNKLDLATLESLDKALDALIAHQGLKGLLLTSDKDAFIVGADITEFLGLFAKTDAELDQWLQFANSIFNKLEDLPVPTISVIKGHALGGGCECVLATDMRIGDKTTSIGLPETKLGIMPGFGGCVRLPRVIGADSAMEIITQGKACRADEALKIGLLDAVVETDALYESALQTLNSAINEKLDWQARRAQKTSPLTLSKLESMMSFTMAKGLVAQKAGPHYPAPMTAVITIEEGARFARNEALDIERKHFVKLAKSEEAKSLVGLFLNDQYIKGIAKKAAKSASKDTQRAAVLGAGIMGGGIAYQSALKGVPVLMKDIAQASLDLGMTEASKLLNKRLSRGRIDGFKMAGILASITPSLHYAGIENSDVIVEAVVENPKVKAAVLSEVESHVGDDTVITSNTSTIPINLLAKSLKRPENFCGMHFFNPVHRMPLVEIIRGEHTSDETINRVVAYAAKMGKSPIVVNDCPGFFVNRVLFPYFGGFSMLLRDGADFTKIDKVMERKFGWPMGPAYLLDVVGIDTAHHAQAVMAEGFPERMGKQGRDAIDALFEADKYGQKNGNGFYSYTIDKKGKPKKTFSEAILPVLADVCADKHDFDDETIIQRMMIPMINEVVLCLQEGIIATPQEADMALVYGLGFPPFRGGVFRYLDSVGIAEYVEMAKQHAELGAMYQVPQMLIDMAAKGESFYGAQQQGSI

SEQ ID NO: 93186 - protein, 203 aa, Physcomitrella patens subsp. patens
MTAQEAEGLATELEQQKLHSDDPIIEDAKDSDDEDDDEGDDDDVADGEEDGLTAGKSKQSRGEKKSRKAMQKLGMKPVPGVTRVTIKKSKNILFVISKPDVFKSPASDAHIIFGEAKIEDLSSQLQSQAAEQFKVPEVANVESKAEPASTAEAEEEGDVDETGVEPKDIELVMTQAGVSRAKAVHALKTTNGDIVSAIMDLTG

SEQ ID NO: 93187 - protein, 296 aa, Physcomitrella patens subsp. patens
MATAVAPKAHPTCINSGNPFHECSEYCYRRIAEGRTSNSAVAAADGNDAANVESEVSEQNTTVVVNEPEDSGIDPAAYAAMTPTQKKLFDLRLKLNQARKDNQLAIIAEKKREDAPEETRGVSKQKWFEEKKRKVGKQLEANGLDMSKAYMLDTQEDAEGKYKKWEKKPAPFGWDVFNQKSLYNGYKKRTKNIVVNPEEYAKAREADPDFYRDGASLQYGKQVEVPEENIDRMVKELDERGKARKEFSRRRKFHDERDIDSINDRNEHFNRKIERAFGKYTVEIKNNLERGTALPD

SEQ ID NO: 93188 - protein, 251 aa, Leptospira interrogans serovar Copenhageni str. Fiocruz L1-130
MSSMKNVIITGASSGIGKELARLYAQTGANVALTARRKDVLKKIVEELKSSGTKGKILFASLDVSDADQNFKVIPKLIKELGGLDLIVLNAGISTTSSFGGRSFEADRAVIETNLIGAMAGVEAVLPIFQKQKSGQIVAISSVASFRGLPGSASYSSSKAGLSVYMEALRGEVKRYGISVSVIHPGFIDTPINNRMKSRPFVISVERGAQKIFKRIENNVLSATVPWFPWVFLGYLMKRIPEFLWSKISLK

SEQ ID NO: 93189 - protein, 277 aa, Bacillus clausii KSM-K16
MIPTVTLKDGLQLPAIGFGTYALNGAAGVNAMVSAIDIGYRLLDSAFNYENEGAVGEAIRRSSVPRAQLRVTSKLPGRRQAYAQAIVTIQESLLRARLDYYDLYLIHWPNPKTDLYVEAWQALIDAQKWGLIRSIGVCNFLPEHLERLERETGVMPSINQIELHPYFSQESQRVWDNNHHIVTESWSPLGRASSVLQDKVIKQIAATHRKSVSQIILRWHVQLGAIPLPKSASPERQLENIAIFDFSLSTEEMEQINKLTKADGRIQNQDPAEYEEF

SEQ ID NO: 93190 - protein, 402 aa, Physcomitrella patens subsp. patens
MEYYPAPGRNHLFVPGPTNVPEPILRAMNRSNEDHRSPAFPKLSKSVIDDVKQIFRTTTATSFIFPTTGTGAWESALTNTLSPGDKIISFRLGQFSLLWIDQMQRYNFDVDVVDCEWGTGVDLDNLKQKLQSDWSHSVKAVCVVHNETSTGVTNDIGAIRRVMDEARHPALLLVDGVSSIGAIDFRMDDWKVDVALTGSQKALSLPTGLGIVCASPKALAAAKQSKSTRVFFDWGDYLKFYEAGTYWPYTPSSQMLYGLRASLDMILNEEGLDNVIARHCRLGEATRQAVKAWGLTLCTQDPKWKSDTVTAVVVPSWINSNDIVKIAYKKYNLSLGIGLNKVAGKVFRIGHLGNVNELQMLGALAGVELCLMEVGYPVTLGSGVAAAQAHLAKKTPLISSRI

SEQ ID NO: 93191 - protein, 434 aa, Xanthomonas oryzae pv. oryzae KACC10331
MFISTRGGAPAASLSQAIAAGLAPDGGLYVPQTLPPARTLIAGAGLADTATALLQPFFEGDALAAELSAICAEAFDFPAPLVALGTPGDYALELFHGPTAAFKDFGARFLAACLTRLRRAEDRPLTILVATSGDTGAAVAAAFHRQPGLRVVVLYPDGRVSPRQAHQLGCFGDNIQALRVAGSFDDCQAMVKQALNDAALQTQVPLSSANSISLGRLLPQMSYYAHAALQHHAAWGDVLNLVVPTGNLGNALAAIIARALGVPLGRIALASNANHVLPDYFAGDAYAPQPSVATLANAMDVGAPSNFERLRWLYNGDDAALREEFRALSVDDAAIRHTVQQRFARYGEVHCPHTATAVHVLEQLRAEGAEGGTGDWAVAATAHPAKFEGVVEPLIGRTVEVPPALAALLQRPAQAEALAADYAAFRQRLLADAT

SEQ ID NO: 93192 - protein, 307 aa, Bradyrhizobium sp. BTAi1
MTATALTDFTQRLDKTAEETEALLGELLGDAPLADEIARPQRLIESMRYSSLGGGKRLRPFLVVESAAVFGVPRKGALLAGAALECIHCYSLIHDDLPAMDNSDLRRGRPTLHKVYDDATAILAGDALLTIAFDIITRDEIHPDAGVRLALTRALARCAGVGGMAGGQILDLAGEGRFGDSGPVDVARVQQMKTGALLRFGCIAGALLGQASPAEYQALDDYGRALGEAFQIADDLLDVEGDAATLGKPAGADAELGKTTFVTQLGIEGAKQRVRDLLARGDAALSIFGSKGDVLRAAAHFVAERKS

SEQ ID NO: 93193 - protein, 132 aa, Helicobacter pylori
  misc_feature (11)..(11): Xaa can be any naturally occurring amino acid
  misc_feature (76)..(76): Xaa can be any naturally occurring amino acid
  misc_feature (110)..(110): Xaa can be any naturally occurring amino acid
SNIKYELDKEXGALMVDRVLYGAQNYPANYGFVPNTLGSDGDPVDALVLSDVAFQAGSVVKARLVGVLNMEDESGXDEKLLALPIDKVDPTHSYVKDIDDLSKHTLDKIXHFFETYKDLEPNKWVKVKGFEN

SEQ ID NO: 93194 - protein, 281 aa, Zea mays
MAPAPALTATSVLKRSHLPGVHSLACRRQPGADRVSVLSPAIPPPRVSWQQGSGVVAKRLLWASASGSFEKDNIGEDAVLPSQIAVENKVDFLKILKSANSIIPHIVLGSTILALVYPPSFTWFTTRYYAPALGFLMFAVGVNSSAKDFIEAIKRPDAIAAGYIGQFVIKPLFGFLFGTLAVAVLNLPAALGAGIMLVSCVSGAQLSNYATFLTDPHMAPLSIVMTSLSTATAVFVTPTLSYFLIGQKLPVDVKGMMSSIVQIVVAPIAAGLLLNRFLPRL

SEQ ID NO: 93195 - protein, 419 aa, Methanosarcina barkeri str. Fusaro
MKEVTVGSRSKLLEGVKQHLCTCAAGLKLTPDMEAFLEMPMRELYVSLPVHMDDGSIKVFKGFRVQYNEALGPTKGGVRFHPEDTMETTRALAALMTWKCALHKLPLGGAKGGVICNPKELSHREIERLSRAYIRGIYQIIGPDRDIPAPDIYTNPQVMAWMMDEYSKLAGRNVFGSITGKPTSLGGSAGRYDATARGGLYTIREAAERIGISLKASRVAVHGFGNVGYHAAYLANKLYGCKVVAVSDSKGAIFSPYGLDPEDVSGHKHSTGSVLDYPEAENLTNKELLELDVEILIPASLENIITEENAGNIKARILAEMANGPTTVEGEAILNSKGIHIIPDILCNGGGVIVSYFEMVQNQSSTQWEEEEVQNRLERKMKEAYFSVYDFASKNNVEMRQAAYTLAVGRVVEAMQLRG

SEQ ID NO: 93196 - protein, 164 aa, Desulfitobacterium hafniense Y51
MRHTLAVLVENRPGVLTHISGLISRRAFNIESIAAGYTEEPDTTRITVVVQADEMELEQVVNQLSKLVDVIKITNLTAADSIQRELAMIKVKASSETRSDIVDIVDIFRAKIVDVNRETMVIELTGEETKIDALCEVLKDYGIIEIVRTGKIALSRGPIPAKHG

SEQ ID NO: 93197 - protein, 496 aa, Glycine max
MEGNLINILYLLIFLISLKLLFFRKRLKNPAPSPPSLPIIGNLHQLKKQPLHRALYDLSQKYGPNNILSLRFGSQPVLVVSSASAAEECFTKNDIIFANRFRSSLTKYIGFNHTIITASSYGDHWRNLRRISSLEILSNHRLNSFLGVRKDETMKLLRKLAKGSDKDFRRVELRPMFSELTFNIIIKMVCGKRYYGEEYDGTNAEEAKRFREIMNEISQFGLGSNLADFVPLFRLFSSRKKLRKVGEKLDAFFQGLIDEHRNKKESSNTMIGHLLSSQESQPEYYTDQTIKGLIMALYVAGTETSAVALEWAMSNLLNSPEVLEKARVELDTQVGQDRLIEEADVTKLQYLQNIISETLRLHPPLSMLLPHLSSEDCTVGSYDVPRNTMLMVNAWAIHRDPKIWADPTSFKPERFENGPVDAHKLISFGLGRRACPGAGMAQRTLGLTLGSLIQCFEWKRIGEEKVDMTEGGGTIVPKAIPLDAQCKARPIISKIF

SEQ ID NO: 93198 - protein, 480 aa, Botryotinia fuckeliana
VVVAAGVAAFIVLSVVLNVLNQVLFANPNEPPMVFHWLPVIGSTITYGMDPYKFFFDCRAKYGDIFTFVLLGKKTTVYLGRKGNDFILNGKLKDLNAEEIYTVLTTPVFGKDVVYDCPNAKLMEQKKFMKIGLSTEAFRSYVPIIQMEVENFMKRSSAFKGPKGTADIGPAMAEITIYTASHTLQGKEVRDRFDTSFASLYHDLDMGFSPINFMLHWAPLPHNRARDHAQRTVAKTYMDIIQNRRAQATEAEFKSDIMWQLMRSSYKDGTPVPDKEIANMMIALLMAGQHSSSSSISWIMLRLASRPDIMEELYQEQIQVLGADLPALKYEDLSKLPLHQNVLKETLRLHTPIHSIMRKVTTPMPISGTKYVIPTSHTLMASPGCTSRDDEFFPEALEWDPHRWDLGSGRVVGNDQDEEFQDYGYGMISKGASSPYLPFGAGRHRCIGEQFATVQLVTIMATVVRLFKFKNIDGSKDVIG

SEQ ID NO: 93199 - protein, 296 aa, Enterobacter sakazakii
MVNLKAVIPVAGLGMHMLPATKAIPKEMLPIVDKPMIQYIVDEIVAAGIKEIVLVTHSSKNAVENHFDTSYELEALLEQRVKRQLLAEVQSICPPGVTIMNVRQAQPLGLGHSILCARPIIGDNPFVVVLPDVIIDAASADPLRYNLAAMIARFQENGRSQVLAKRMAGDLSEYSVITTQDPLDTEGKISRIVDFIEKPDQPQTLNSDLMAVGRYVLSADVWEELAKTEPGAWGRIQLTDAIARLNENQPVEAMLMTGESYDCGKKMGYMKAFVNYGLRNLKEGQKFRESIKKLLA

SEQ ID NO: 93200 - protein, 523 aa, Datisca glomerata
MPAVGGIVVGGSKKEYPGNLTPYVTITCIVAAMGGLIFGYDIGISGGVTSMDSFLKKFFPAVYRKKELDSTTNQYCQYDSQTLTMFTSSLYLAALLASIVASTITRKFGRRLSMLFGGILFCAGAIINGFAQAVWMLILGRMFLGFGIGFSNQSVPLYLSEMAPYKYRGALNIGFQLSITIGILVANVLNYFFAKIRGGWGWRLSLGGAMVPALIITVGSLLLPDTPNSLIERGNRDEARSKLQRVRGVDDVDEEFNDLVAASEESKQVEHPWTNLLRRKYRPHLAMAILIPFFQQLTGINVIMFYAPVLFNTIGFGSDASLMSAVITGCVNVAGTLVSIYGVDKWGRRFLFLEGGFQMLICQAVVAAAIGAKFGVNGNPGELPKWYAIVVVLFICIYVAGFSWSWGPLGWLVPSESFPLEIRSAAQSINVSVNMIFTFAIAQIFLTMLCHLKFGLFIFFAFFVVVMSIFVYFFLPETKGIPIEEMGRVWKSHWYWSRFVTDADYTIGSGVEMGKGAQELKNI

SEQ ID NO: 93201 - protein, 2551 aa, Alternaria solani
MDKPVAIIGIAFRGPGDARDPEAFYRMLVEGRNARTEIPKDRYNVDAFYHPDSERLGSIQQRHAHFLQQDFKVFDAPFFSITPKEAKAMDPTHRILLEATYEGFENAGLSLEKVSGTQTSCYIGTFTADFPNLQARDNEGPSIYHATGMSASLASNRLSWFYNLRGPSLTVDTACSSSLTAFHLACQSIRTGEAEMSVVGGANLMFGPDMSILLGAAKILSPEGKSKMWDANANGFARGEGFGVTILKPLDAALRDGDNIRAVVLATAANEDGHTPGISLPNSEAQQELIRRAYQIAGVDPAETAYVEAHGTGTQAGDPLEARAILKTIGSVEGRKSDLYVGSVKTNIGHLEGAAGVAGIIKAALTVERGMIPPNLWFEKLNPEIDLPDNVKIASKLTPWPHSGPRRASINSFGFGGANAHAILEDAASFLSRHGLSGRHTTAPLLPSLSSVRVSHPSDSPSSSASTVAEEATSGESSDNISDVSSEVLRDVYPIPKLFVLSSHDQEGVKRSAERLQEYLASKTSTTPSFLNDLAYTLSAKRTTLPWKSYAVSSSVSGLREKISSLPPVVRSSTSAIPRIAFVFTGQGAQWHAMGRGLSVYKTFAESLQRSEVMLKSFGCPWSLAEELSRSKAEYKLRETDYSQPACTAIQVALVDLLSGFDVRPVAVLGHSSGEIAAAYAAGFIDQEAAIKIAWLRGQVNKTVSKNGGMLAVSASADSIQSHLDGLKSGKAVVGCFNSTKACTVTGDTSAIDELQTMLKDAQVACTRLPMDVAYHSFHMEAAREKYEQALEGIAHGSTSTIPMFSSVTGTLVDPAQMKPSYWVDNLVSPVNFVAATRSLLSHPQESKSRKAFANLFVELGPHSALRSYLLDIISSENRAADTTYTTLLRRNFDGAATALEAMGHLWAHGCKVDLSKVNDVSSDSTNMLIDLPPYAWNHKPYWDESHLSRQHRLRKSPRTDLVGYRLLGTPEHTWRNFLRCNENPWIREHKVQGDILYPGAGMLVMAIEAAHQLAQETSADEIYGFELRDVSIDTALRVPDTEKGIEVMTQLHNRRTGTRAAPSSTLYEFTVSSWSEEMSSWSTHARGLVSITFKTFSPSMEREVALGNERYMSSLAEVRRVCQTPARSFLYDTVETIGMQYGPTFRNMTELYAGPNSSYGVINVPDTKAIMPKGFEFPHVVHPATLDSVLHLIFPSISGEDQALNEAVVPRSFDRIFVSASIPKNAGAELRGCSSAKKLSYTTWNSNITMSDATMTEPVVIMEGVVLASVGATEDASKQLETRASCFAQNWHVDADLLTPSQIKEIIYKRTLKSKDDDSVLDLLEFVCLVYIYRILDWFQTEEGKPHVPRDGFWKSYVEWMHDTVKQFPALPADVETEMEKARQRIVKSESGDITVQMVDRIGQNLSRIFTREVEALQCMTEGDLLYSFYRGAFGTSFNTNVAEYVGLIADKQPGLRILEIGAGTGGTTYHVLERLRNPDGTSKAAQYYFTDISPGFLAKAADRFNQDASIMQFGTLNIENAPTEQGFSPELFDLIVCANVLHATKSIQETLTHCKLLLKPGGRLVLSEVTIKRIFSGFIMGPLPGWWLGEADGRMGGPLLDADEWNVALKKAGFSGVDVDVRGDRETSKEPVSLLISTKPKTTAPSLPSCLVITTGTEASNMLADTIQRVFTSAGHDISIAQWNSVTKTQVEGKYCLCLAEWEDAILVNLTDDDWDRLREVVLSSEGALWITGGGALDTPFPMKSLMVGLGRAIRNEDAGVRLACLDLDPPTTIDFEEASRTTLKVAYAHIRGDGTEGEFAAHGDKVYVPRVERTLQVDGSLRKYEAKGDPEMVPFKSCGRPLKLTIKTPGLLDTFQWEEDETYHTPLPEDWIEIEVKAVGLNFKDVLVALGNLAENKLGVDASGIVTRVGSAVTNVQVGDRVMTASCDTFATYVRFPAKGAIGVPTGMSFEEAASMPLIFLTAYYALVTAGGIVAGEKVLIHAAAGGVGQAAIMIAQAKGAEIFATVGADTKKQLLIEQYGIPEDHIFSSRDTSFVKGVLRATDGQGVDLVLNSLAGEALRLSWTDCLAKFGRFLEIGKADLFANTGLDMKPLLDNKSYIGVNLLDFENNPTPRAVALWHDTAKMIHDGAIKPIAPLQVFTMAEVEKAFRHMQAGKHMGKVVVRVDDADVVRAVPRIPRVSIHPDATYMIAGLGGITREIARWLAEKGARYLVFLSRSAASGTDNQAFALQLRNTYDVTPLAYDCDVGNKAALQAVLDDLKAKGLPPINGCATGAMVLQDCLFDKMTADHVRTTVGPKVHGTWNLHELLPRDMDFFVMLSSLAGVMGHRGQGNYGCGNNFQDEFASFRRGQGLPAMTIDIGYLLSVGFVAEHDEYVDHVKAMGLKVMHTSDLHGLVATAIEGPSQHPGQVMCGLPFNEHDDAWYWMADARFAALRNVAAGSAANAGQAISLREELTRCGTVNEEAVQLITAAIAQRLASLMMIPEADIDAGRPLSAYGVDSLVAVEVRNWVAREMAVEVSVFDVMQNVPMTQLAQNLAEKSKLLLGQA

SEQ ID NO: 93202 - protein, 371 aa, Ehrlichia ruminantium str. Gardel
MENLLNSFNSNKHIIKKSIAELRTGIPVLLYNHKSNLLVFPSEMIDNQILHKIQKYSDNAYILITGNRLNFILQSPGNQLSRITLKESYSIDYISYLLTGKKPHSSFDHIDTNHITTSTNPLDITSISLIKLTKLLPSAIVTEIKHPDILQWCNKYNITPIKQEIIDNHNQEYELHEVCSSPLFLKNCCNANVNSSINIYRSDIGEPEHYALIIGEPDYSNPLVRIHSSCYTGDLLDSLSCDCRSQLHLSIKLMVENKGGIILYLAQDGRGIGLTNKIRTYQLQIKYNFDTVDANRFFGFEDDERAFIAAIKILEKLGISKLQLLTNNPNKAEEIKKYGINITKILPIFVDINQHNINYINTKAKRLGHVS

SEQ ID NO: 93203 - protein, 289 aa, Ashbya gossypii ATCC 10895
MDKLLHWSIANAQGDKEAAAKAGAPDPKLLQQLFGGGPDEPALMRDAMAVIMNPEATVDNKLVAFDNFEMLIENLDNANNIENMRLWAPLISILESEEEQLRECALSVVGTAVQNNEKSQSNFLKHDGAMKKIIELARKDSESEQVRTKAFYALSNIVRHNKDASALFVDNGGLEIMAPVLKHQNTGEKMKIRALALLTSVLTSLSADEKFSDRIREDKILEASLEHLAPSANPYLIDRVLNLLVLMKGSGAKFDTDELSKIRKSFASLYPVKDQLNEDDYNAVKEMLG

SEQ ID NO: 93204 - protein, 317 aa, Yarrowia lipolytica CLIB122
MAVILDKQKKQPPKQISTLGGFVAGAIAACGAVTVTNPIELVKTRMQLQGELAARGEAKKVYTSPLQALVKIYKSEGIKGLQSGLFSAYVYQIGLNGCRLGLYEPTRKVIANVCNIDLNKENPVGLNVASGAISGIMGAVAGSPFYLIKTRQQSYSPAFKVGAQTYYKSIGDGFRQIYGAEGFKGLYRGVDAAILRTGAGSSVQLPIYNWAKELLLKHHITDPGASTHLVASAMSGLGVAVVMNPWDVLMTRMYNQKGNMYKNPFDCLMKTVSIEGPFALYKGFGAHLLRIAPHTILTLMFMEQTMKWVKWFEGVPF

SEQ ID NO: 93205 - protein, 254 aa, Haloarcula marismortui ATCC 43049
MTTLLEDKVAVVTGGASGFGRAICRRYAEHGADVIVADRQQDPREGGKPTHELVEAETDRTAHFVECDVTDPDDLEVAVAAAEELGGIDIMVNNAGISEIADFYETTEEDYDRLMDVNTKGVFFGAQVATEAMRENGGGTVINMSSSGGIRGTGLLVNYCTSKGAVRLFTYALADRLSNYNIRVNAIHPGYSKTQMFEDERIDDTTKMMLKELIPSGRFGEPEEIADVATFLASDMASYVNGESVVVDGGLTNT

SEQ ID NO: 93206 - protein, 535 aa, Bradyrhizobium sp. BTAi1
MEAHFQIFLVLLAVLAGTALIARRANLAPAILMMLAGIALAFVPTMPAFALPPELVLLVVLPPLIYSSSVAMSWREFKRNLRPIVLLAVGCVLFTASAVAIATHYLLGLPWSIGFLLGAIVAPPDVVAPLAIARRLHLPRRVMVILEGEGLANDATALILYRFAVAAITTGTFSLPVAAGEFAAIVVGEIAFGIGVGWLMLRARHYARDPQVEITLSVLTPYLAFWIPEHVGGSGVIATVACGLYMSWNGPLWISSATRLQGVFFWDLMIYLIEGMLFLLTGFQMRLIYEKSKIFSLDEIVIATALVLAIVVIARFAWTFPATILPRLLSSSLRARDPLPPWQQTFIIGFTGVRGTVSLATALALPLTLSTGDAFPYRDQILFIAFGVIFFTLIGLGLTLPTVVQWLGVARTGRAEHAREHEQEIAARREALDSALRSLETMTNDRDLSDEVVRLLRARHEVRANQLPEGLKPDDNDASALGIELTRELITAERKFIHVMLRDGKITDETRRRIERDLDLEEASLANREYEHLPL

SEQ ID NO: 93207 - protein, 434 aa, Ashbya gossypii ATCC 10895
MPLLQQNPPIQPPYSRASQKLKSLLSSYGENTSTTTAAKEMNGIAPMNLIEKSVVHPPRTIYTKANFSIPGHYEVLQMLGKGSYGTVVSAIDNLNANYPIRIAIKKITNIFQREVLLKRAIRELKFMHYFKGHKNIVSLINLEIVNEKPYDGLYCYQELIDYDLARVIHSNVQFSEFHIKHFTYQILCGVKYIHSADVIHRDLKPGNILCSISGQLKICDFGLARGISPLFTNTKTSNHITNYVATRWYRAPELILSHKRYNKSIDMWAIGCILAEFYGRKPIFMGQDSMHQISEIVKVLGTPSRDTIIKYGSSRAYDIFCPPKPQYAKIPWAEIYPFAGPDALDLIERLLDWDPDRRLTVEEAIEHDFVKSVRDVNDEPCCPHGPFNFSYEAEFKSMSNLREVLYAEVKQFQEECATKDVVPSLPIPQQIYPI

SEQ ID NO: 93208 - protein, 132 aa, Helicobacter pylori
SNIKYELDKESGALMVDRVLYGAQNYPANYGFVPNTLGSDGDPVDALVLSDVAFQAGSVVKARLVGVLNMEDESGMDEKLIALPIDKIDPTHSYIKDIDDLSKHTLDKIKHFFETYKDLEPNKWVKVKGFEN

SEQ ID NO: 93209 - protein, 527 aa, Bradyrhizobium sp. BTAi1
MRDFSKPGRSDAIGERGMVCTSHPAASAAGLEMLRSGGNAMDAAIAAVAVQCVVEPHMTGIGGDCFALFSWNGASPIALNGSGRAPQAATAAWYVERGLTAIPDQSAHAVTIPGAIAAWCTLNKDYGAKSLAEVLAPAIGLAEQGMRVTARVAWDWARQVDKLSRDPDARAVFLSGGKPPAFGDLFRNPALGRTLRAVAQDGAAAFYRGSVAEALTRKLRAHDGLHSINDFASEHSDYVQPVSTAYRGHTVYECPPAGQGLAALMILRLIERFALGHARHSEADRIHYLAEATKAAYRARDAYFCDPAFGHTPAASFLSDDWTQRASDLIQPDRATAPEAWGEIEHKDTVYVSVVDRDMNAVSLINSLFAPFGSGLYEPTTGVLLHNRGLGFRTDPAHPSAIAPGKRPMHTIIPGMLYRDGLPMMPFGVMGGHYQATGHAHFVSQILDHGRSVQEAADAPRSFAFDGKLSLETTISADVKRDLEGRGHTVEWSDFPIGGAQAVWIDRERGILIGASDQRKDGMALGF

SEQ ID NO: 93210 - protein, 511 aa, Bruguiera gymnorhiza
MAMASFARRKAYLLTRNLSNNSCSDALSCSFCLSSFSRGFASAGSDDNDVVVIGGGPGGYVAAIKAAQLGLKTTCIEKRGALGGTCLNVGCIPSKALLHSSHMFHEAKHSFASHGVKFSSVEIDLPAMMAQKEKAVSTLTKGIEGLFKKNKVTYVKGYGKFVSPSEVSVDTLEGGNIVVKGKNIIIATGSDVKSLPGITIDEKKIVSSTGALALSEIPRKLVVIGAGYIGLEMGSVWGRLGSEVTVVEFAPDIVPSMDGEIRKQFQRTLEKQKMKFILKTKVVGVDTSGDGVKLTLEPASGGNQTTLEADVVLASAGRIPFTAGLGLDKIGVETDKVGRVLVNDRFQTNASGVYAIGDVIPGPMLAHKAEEDGVACVEFIAGTHGHVDYDKVPGVVYTHPEVASVGKTEEQVKSLGIDYRVGKFPFLANSRAKAIDDAEGIVKILAEKETDKVLGVHIMSPNAGELIHEAVLALTYDASSEDIARVCHAHPTMSEALKEAAMATYDKPIHI

SEQ ID NO: 93211 - protein, 445 aa, Bradyrhizobium sp. BTAi1
MPDAISIDVPPNDLEAFWMPMTANRRFKKTPMFFSAAEGMYYATPDGRRVLDAIAGLWCVNAGHCHPRIVEAIRAQAGKLDYASSFGVGHPLAFHFANRVVEIAPPGFRHLFLAGSGSEAVDSALKFALAYHRARGEGHRQRLIGRQRAYHGVGFGGLSVSGIGWQRAQFGALLPATSHLPHTHDLARNAFSRGQPAHGVEFADALEGLLFAVDPSTVAAVIVEPVAGAGGVLPPPQGYLQRLREICDRHGILLIFDEVVTGFGRLGAPFAAQALGVGPDLITCAKGMTSGTVPMGGVLISDRVHDGLSQGPEAVPELAHGYTYSGHPLACAAGLAALDVYRDEGLFERAARLAPIWEDALHGLRTLGPVRDIRNLGLLGAIEIDGGDGAPSERARACAEVCLERGVFIRALGDTLILSPPLVIDEGQIGQIVDAIGSGLRRLAA

SEQ ID NO: 93212 - protein, 264 aa, Triticum aestivum
MNPTILLLDEPTNHLDLEACVWLEEKLKNFERILVVISHSQDFLNGVCTNIIHMQNKTLKLYTGNYDQYVQTRSELEENQMKQYKWEQEQIANMKEYIARFGHGSAKLARQAQSKEKTLAKMERGGLAEKVVNDRILVFRFTDVGKLPPPVLQFADVTFGYTPDNLIYKNLDFGVDLDSRVALVGPNGAGKSTLLKLMTGDLSPLDGMVRRHNHLRIAQFHQHLTEKLDLDMPALQYMMREYPGNEEEKMKLDGNLACQKQVIQ

SEQ ID NO: 93213 - protein, 434 aa, Euglena gracilis
MLPRRLLVPLFQAARTRGYAEKILMPALSPTMEAGTIATWKKKVGDKLRPGDVLCSVETDKATLDFEWAGDEGIVAQLALEPGHEPVPVGTPIAVLADDESDLPAAKAMDLSQGTSKAAKSSPAAPAAAAPPSEAPAVKAPSSSPKSEGVKPEPYTSAKVRASPAAMAVFAKHIQGTGPNGRIVEADVEAFLKDAGSGKVAGAAATPAPSAAGTLPAQYEDTPASLMRKSIASRLTASKVEIPHFYLTVDVAVEKMKEMVAALNAGAKDKEYKITVNDFLVKACALACKKVPAANSQWHGDKIRRFHSVDISVAVATPTGLITPVVYNADLKGLKEISNDIRTLAALAREGKLTPEQYIGGTFTISNLGSYGVKHFTAIINPPQACILAVGAAQENGLMSVTLSCDHRVVDGAVGATWLQAFKGYVETPSSLLL

SEQ ID NO: 93214 - protein, 450 aa, Escherichia coli O157:H7 EDL933
  misc_feature (393)..(393): Xaa can be any naturally occurring amino acid
MTKHYDYIAIGGGSGGIASINRAAMYGQKCALIEAKELGGTCVNVGCVPKKVMWHAAQIREAIHMYGPDYGFDTTINKFNWETLIASRTAYIDRIHTSYENVLGKNNVDVIKGFARFVDAKTLEVNGETITADHILIATGGRPSHPDIPGVEYGIDSDGFFALPALPERVAVVGAGYIAVELAGVINGLGAKTHLFVRKHAPLRSFDPMISETLVEVMNAEGPQLHTNAIPKAVVKNADGSLTLELEDGRSETVDCLIWAIGREPANDNINLEAAGVKTNEKGYIVVDKYQNTNVEGIYAVGDNTGAVELTPVAVAAGRRLSERLFNNKPDEHLDYSNIPTVVFSHPPIGTVGLTEPQAREQYGDDQVKVYKSSFTAMYTAVTTHRQPCRMKXVCVGPEEKIVGIHGIGFGMDEMLQGFAVALKMGATKKDFDNTVAIHPTAAEEFVTMR

SEQ ID NO: 93215 - protein, 453 aa, Zea mays
MKERGGSSAAVDERYAQWKSLIPVLYDWFANHNLVWPSLSCRWGPQFEKATYKNRQRLYLSEQTDGSVPNTLVIANCEVVKPRVAAAEHISQFNEEARSPFVKKYKTIVHPGEVNRIRELPQNSKIIATHTDSPDVLIWDVEAQPNRHAVLGASESRPDLILTGHKENAEFALAMCPAEPYVLSGGKDKSVVLWSIQDHISALGDSSSSPGASGSKQSIKTANEKESPKVDPRGIFHGHDSTVEDVQFCPSSAQEFCSVGDDACLILWDARTGTAPAVKVEKAHSGDVHCVDWNPLDVNYILTGSADNSVRMWDRRNLGSGGAGSPIHKFEGHKAAVLCVQWSPDRASVFGSSAEDGFLNVWDHEKVGKKKNSNVPAGLFFQHAGHRDKIVDFHWNSSDPWTIVSVSDDGESTGGGGTLQIWRMSDLIYRPEDEVLAELENFKAHLASCAPKN

SEQ ID NO: 93216 - protein, 474 aa, Euglena gracilis
MFRQSFIQLAKHDLIVIGGGPGGYVAAIKAAQLGLNVACVEKRGTLGGTCLNVGCIPSKALLNASHHYHDAKHKFAGYGIDIPSVSMDIPKMQGTKAKSVTRLTGGIELLFKKNKVTYYKGFASLEGDKKVKVVGETTEVHEADKILIATGSEPIELPFLKFDEKVVCSSTGALDFQEVPAHLVVIGAGVIGLELGSVWSRLGSKVTVVEFMDRICPFMDADVGKEFHRILKKQGLQIKTSTKVVAGKVEGGQVILELESVDGAKKETLQANAVLVSVGRRPFTDGLGLDKVGVELNAKKFIVVDDHFKTNKDGIYAVGDVIHRGPMLAHKAEDEGICVAEMFAGKAGHINYDTIPNVIYTHPEVAWVGKTEEDLKKEGRKLKTSKFPFQANSRAVTNVDTEGFVKVVTDADTDRLLSMSIINSNAGEAIAEAVLAMEYSGSAEDIGRTCHAHPTLSEAIKEACMAAYDKPIHV

SEQ ID NO: 93217 - protein, 513 aa, Mycobacterium smegmatis str. MC2 155
MSSHRDEHLALVAELRSKLAAAALGGPERARERHVGRGKLLPRDRVDGLLDPGSPFLELAPLAAGGMYDDECPGAGMIAGIGRVSGRECVIVANDATVKGGTYYPITVKKHLRAQEIALQNKLPCIYLVDSGGAFLPRQDEVFPDRDHFGRIFYNQATMSAQGIAQIAAVLGSCTAGGAYVPAMSDEAVIVRNQGTIFLGGPPLVKAATGEVVTAEELGGGDLHSKTSGVTDHLAHDDRDALRIVRNIVATLGPAEPPPWQVLPAVDPIADQTELYDVVPVDARVPYDVHEVITRIVDGGEFGEFKAEYGTTLVTGFARIHGHPVGIIANNGVLFGESAVKGAHFIELCDKRKTPLLFLQNISGFMVGRDYEAGGIAKHGAKMVTAVACARVPKLTVVIGGSYGAGNYSMCGRAYSPRFLWMWPNARISVMGGEQAASVLATVRGEMTDAEAEEFKAPIREQYEHQGNPYYSTARLWDDGVIDPADTRTVVGLALSVVGQAPLEPVSYGVFRM

SEQ ID NO: 93218 - protein, 199 aa, Oryza sativa
MSCTSFPKIDKPAPDFKGQAVVNGAFKEIKLSDYRSKYVVLFFYPLDFTFVCPTEIIAFSDRADEFKRIGVELIACSADSHFSHLAWTNVPRKQGGLGQMNIPLLADKSGKISRDYGVYIEEEGITFRGLFIIDKNGTLRQITINDLPVGRSVDETLRLVQAFQFTDEHGEVCPANWKPGKETIKPAVEASKEYFSKAG

SEQ ID NO: 93219 - protein, 417 aa, Arabidopsis thaliana
  misc_feature (18)..(18): Xaa can be any naturally occurring amino acid
MLPDLHNDLVDEILCVCXRVPARNLKRLRCTCKRWNRLFKDDRRFAREHMHKAPKEYLPLMLTSEYRICPVSINLQGDVPSVVLKRELSLPDPDYSHQFDIGRVFHCDGLLVCNHVGKNPRYGSKIVVWNPLTGQTRWIEAGYRWKEYEVRFVLGYCYQQDENNSCSKKIYKILCFYPNGQDTEIYELNYSDRWTRTIPDGDLTPGWTLIYSEQTVSMNGNLYLFASEKSKPHLGVSLLRFDFSTEKSSLCVTLPYQRPRYEILSISAVRGGENLSLLLQLDFESKTEIWVTNKIDDTTTKGAAVSWTKVLAFDLSPDLQLFSEEVNFLLDEDKKVAVCCERWLEPQEHHRYQCRREYKITDKIYILGEDNKVDEVGSGEGEATDSLEGISQVILNYAPSLVQIEQAGGGKTKRGDD

SEQ ID NO: 93220 - protein, 395 aa, Ehrlichia ruminantium str. Gardel
MLESHDFTFANMKKIQDFSCRGKTILLRVDLNVPVDDNKVVLDDTRIVRLTTTVKYLLSNNAKIVMISHYGRPKSYDREFSLKFLVEYLNKIFATNVLFVDGVIGSYVEQAVQSVPLGSVLLLENLRFYVEEEKNDLNFAKQLALLADVYVNDAFSCMHRKHASIDAVARLLPSFIGFNFQEELKYLSYVVSSSDKPVGVIVGGAKISTKIHMLRNLTQKVNFLILGGAIANNFLLSQGLKIGNSLCEKLDEDPFVDVINFAKKYGCEIIVPEDYLVTKDLVSNEAVVKNNQELAPDDIILDIGPHTINIITSIIGKCRTVLWNGPMGMFEKEPFSHGTFSIARLLAEFTKAGKLKSIVGGGDSICAIKLSGLLSEDFTYISTGGGALLHFLSLA

SEQ ID NO: 93221 - protein, 286 aa, Medicago truncatula
AVATAALIYVKEIPLSPEKVTGNGVTDEDGNVTKSSNPCFGELSGAFRERKRPMWILLLVTCLNWIAWFPFLLFDTDWMEKEEYGGTVGEGHAYDKGVRAGALGLMLNSVVLGAASLGVDVLARGVGGVKRLWGIVNFLLAICLAMTVLVTKLAQHSRVYADASHTDPLPPSGGITAGALALFSVLGIPLAITYSIPFALASIFSSSSGAGQGLSLGVLNLAIVIPQMIVSVLSGPWDALFGGGNLPAFVVGAVAALASGILSVVLLPSPPPDLAKSVTATGGGFH

SEQ ID NO: 93222 - protein, 468 aa, Enterobacter sakazakii
MSKQQIGVVGMAVMGRNLALNIESRGYTVSVFNRSRDKTEEVIAENPGKKLVPYYTVQEFVESLETPRRILLMVKAGAGTDAAIDSLKPYLEKGDIIIDGGNTFFQDTIRRNRELSEEGFNFIGTGVSGGEEGALKGPSIMPGGQKEAYELVAPILKEIAAVAEGEPCVTYIGPDGAGHYVKMVHNGIEYGDMQLIAEAYSLLKHGLNLSNEDLAKTFAEWNEGELSSYLIDITKDIFTKKDEDGNYLVDVILDEAANKGTGKWTSQSSLDLGEPLSLITESVFARYISSLKEQRVAASKVLSGPQAKPFAGDKGEFIEKVRRALYLGKIVSYAQGFSQLRAASEEYNWDLNYGQIAKIFRAGCIIRAQFLQKITDAYAENPSIANLLLAPYFKKAADDYQQALRDVVAYAVQNGIPTPTFSAAIAYYDSYRSAVLPANLIQAQRDYFGAHTYKRTDKEGVFHTEWME

SEQ ID NO: 93223 - protein, 197 aa, Enterobacter sakazakii
MNVRQAQPLGLGHSILCARPIIGDNPFVVVLPDVIIDAASADPLRYNLAAMIARFQENGRSQVLAKRMAGDLSEYSVITTQDPLDTEGKISRIVDFIEKPDQPQTLNSDLMAVGRYVLSADVWEELAKTEPGAWGRIQLTDAIARLNENQPVEAMLMTGESYDCGKKMGYMKAFVNYGLRNLKEGQKFRESIKKLLA

SEQ ID NO: 93224 - protein, 329 aa, Fusobacterium nucleatum subsp. nucleatum ATCC 25586
MLDLENIIVIGVSHENLSLLERENFMRTRPKYIIERLYTEKKINAYINLSTCLRTEFYIELNSNIKAKEIKNLFSVDMIVKSRVEAIEYLFKVGCGFYSVIKGEDQILAQVKGAYAEALENEHSSKFLNIIFNKSIELGKKFRTKSMIAHNALSLEAISLKFIKSKFPNIEDKNIFILGIGELAQDILTLLTKEQLKNIYIANRTYHKAEQIKKEFDIVNIVDYREKYPKMIEADVIISATSAPHIVVEYDKFVAQMKENKDYLFIDLAVPRDVDERLANFKNIEIYNLDDIWEVYHLNSMNRDKLLEDYSYLIDEQMEKLIKTLNYYK

SEQ ID NO: 93225 - protein, 388 aa, Escherichia coli CFT073
MKITISGTGYVGLSNGLLIAQNHEVVALDILPSRVAMLNDRISPIVDKEIQQFLQSDKIHFNATLDKNEAYRDADYVIIATPTDYDPKTNYFNTSSVESVIKDVVEINPYAVMVIKSTVPVGFTAAMHKKYRTENIIFSPEFLREGKALYDNLHPSRIVIGERSERAERFAALLQEGAIKQNIPTLFTDSTEAEAIKLFANTYLAMRVAYFNELDSYAESLGLNTRQIIEGVCLDPRIGNHYNNPSFGYGGYCLPKDTKQLLANYQSVPNNLISAIVDANRTRKDFIADAILSRKPQVVGIYRLIMKSGSDNFRASSIQGIMKRIKAKGVEVIIYEPVMKEDSFFNSRLERDLATFKQQADIIISNRMAEELKDVADKVYTRDLFGSD

SEQ ID NO: 93226 - protein, 468 aa, Escherichia coli CFT073
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 93227 - protein, 517 aa, Aspergillus oryzae
MEAPSLAVPQSRSPSTSSVDEIETTAEEEDSEDYCKGGYHPVTVGETYNNGRYVVVRKLGWGHFSTVWLSRDTTTGKHVALKVVRSAAHYTETAIDEIKLLNRIVQAKPSHPGRKHVVSLLDSFEHKGPNGVHVCMVFEVLGENLLGLIKRWNHRGIPMPLVKQITKQVLLGLDYLHRECGIIHTDLKPENVLIEIGDVEQIVKTYVKEEQKKDHKEDNRNGRRRRRTLITGSQPLPSPLNTTFDFKHSSHHSQSSLSQMINEESETAPSEKASMKEILGIKEEDEKQKQREKTADLLEREVSGISLNKSSKEAKDELECDIISVKIADLGNACWVGHHFTNDIQTRQYRSPEVILGSKWGASTDVWSMACMVFELITGDYLFDPQSGTKYGKDDDHIAQIIELLGPFPKSLCLSGKWSQEIFNRKGELRNIHRLRHWALPDVLREKYHFSAEESMRISEFLLPMLEIPPERRANAGGMASHAWMKDTAGMDAVDLGISPGSRGEGIEGWASEVKRR

SEQ ID NO: 93228 - protein, 483 aa, Escherichia coli CFT073
MRNYMNNNKIITPIIMAGGSGSRLWPLSRILYPKQFLSLIGSHTMLQTTANRLDGLDCTNPYVICNEQYRFIVAEQLRKIDRLTSKNIILEPVGRNTAPAIALAALLMSKSDKSADDLMLVLAADHVIHDEEKFCNAVRSAIPYAADGKLVTFGIIPDKAETGYGYIHRGQYINQEDSDAFIVSSFVEKPNHETATKYLASGEYYWNSGMFLFSANRYIEELKQFRPDILSACEKAIASANFDLDFVRLDESSFSKCPEESIDYAVMEKTKDAIVIPMDAGWSDVGSWSSLWEINDKDSDGNVIVGDIFSHETKNSFIYAESGIVATVGVENLVVVQTKDAVLVSERNKVQDVKKIVEQIKNSGRSEHYVHREVYRPWGKYDSIDTGERYQVKRITVNPGEGLSLQMHHHRAEHWIIVSGTARVTIGSETKILSENESVYIPLGVIHCLENPGKIPLDLIEVRSGSYLEEDDVIRFQDRYGRS

SEQ ID NO: 93229 - protein, 425 aa, Zea mays
MDRLPESTRSMRKYASEAGGLRAARQGPHGRSLTARTAHSMSTTALRTKSKSAASLLRRVPFAPLRPVLANLQEVFLGTKLAVLFPAVPLAIAAQCAHFGQVWVFSLSLLGLIPLAERVSFLTEQIAIYTGPTVGGLLNATCGNATELIIALFALMEGQIEVVKCSLLGSVLSNLLLVLGTSLFCGGVVNLGSDQPYDRTQADVSTGLLILGVLCQSLPLMLRYAVGAGEHSVAAATTVLDLSRACSVVMLLAYVAYLFFQLKTHAQLFEPQEVDDGCEAEEDEQAVIGFASGLFWLAFNTVLIAILSEYVVGTIEPTSKSWGLSVSFISIILLPIVGNAAEHAGAIIFALKNKLVPLSVIVAWIAGIQMDLDFKLIETGSLFVSVIVTAFTLQDGSSHYLKGILLLLCYIVIGACFFVTRQPAS

SEQ ID NO: 93230 - protein, 144 aa, Picea sitchensis
MEQTFIMIKPDGVQRGLVGEIISRFEKKGFILKGLRMVGVERSFAEKHYEDLSSKPFFTGLVEYIISGPVVAMVWEGKGVVATGRKIIGATNPAASEPGTIRGDFAVEIGRNVIHGSDAVESAKKEIALWFPDGVVDWQSSLHS

SEQ ID NO: 93231 - protein, 335 aa, Escherichia coli CFT073
MNILVTGGAGYIGSHTAIELLNAGHEIIVLDNFSNASYKCIEKIKEITRRDFITITGDAGCRKTLSAIFEKHAIDIVIHFAGFKSVSESKSEPLKYYQNNVGVTITLLQVMEEYRIKKFIFSSSATVYGEPEIIPIPETAKIGGTTNPYGTSKYFVEKILEDVSSTGKLDIICLRYFNPVGAHSSGKIGEAPSGIPNNLVPYLLDVASGKRDKLFIYGNDYPTNDGTGVRDFIHVVDLAKGHLAAMNYLSINSGYNIFNLGTGKGYSVLELITTFEKLTNIKVNKSFIERRAGDVASCWADADKANSLLDWQAEQTLEQMLLDSWRWKKNYPDGF

SEQ ID NO: 93232 - protein, 335 aa, Fusobacterium nucleatum subsp. nucleatum ATCC 25586
MAVKVAINGFGRIGRLALRVMSKNKDFDVVAINDLTDAKTLAHLFKYDSAQGRFDGTIEVTDDGFVVNGDSIKVFAKANPEELPWKDLGVDVVLECTGFFTSKEKAEAHIKAGAKKVVISAPATGDLKTVVYNVNDNILDGSETVISGASCTTNCLAPMAKVLNDKFGIVEGLMTTIHAYTNDQNTLDAPHKKGDLRRARAAAENIVPNTTGAAKAIGLVIPELKGKLDGAAQRVPVITGSITELVTVLGKEVTVEEINAAMKAASNESFGYTEEPLVSSDIIGISFGSLFDATQTKVLTVDGKQLVKTVAWYDNEMSYTSQLIRTLKKFVEISK

SEQ ID NO: 93233 - protein, 362 aa, Anabaena variabilis ATCC 29413
MTQNYRITLLPGDGIGPEIMAVAVDVLKVVGQQFDIQFDFQEALIGGAAIDATGEPLPSATLDTCRQSDAVLLAAIGGYKWDSLPPHQRPEGGLLGLRAGLELFANLRPAQILPQLIDASTLKREVVEGVDIMVVRELTGGIYFGKPRGIFTTETGEKRGVNTMVYTESEIDRIGRIAFETARKRRGKLCSVDKANVLDVSQLWRDRITKLSQEYPDVELSHLYVDNAAMQLVRAPKQFDTIVTGNLFGDILSDAAAMLTGSIGMLPSASLGASGPGVFEPVHGSAPDIAGLDKANPLAQVLSAAMMLRYALNQPQAADKIEQAVLQVLEQGDRTGDIMSVGMNLLGCRAMGDSLIKALEKS

SEQ ID NO: 93234 - protein, 267 aa, Oryza sativa
  misc_feature (247)..(247): Xaa can be any naturally occurring amino acid
MANLFLKQAKQYAATRPAYPPELFDFIASKTARHDLAWDVGTGSGQAIPPLAKLYKDVVGTDTSAQQLSYAPRLPNVRYVHTPPDLPLDGIHAAVAPPGSVDLVTVAQAFHWLDLPRFYAQVRSVLRAPQPQQAAGVLAAWCYTEPCVDAAVDDAFWRLYNGSQPYWAPNRRLVDDRYSGVDFPFDLVDGEAHTGPFEFSTERRMDLDGYLAHITSWSAYQNGKGKGVELLDEATVCGFADAWGGDXVEVKTVRYPIFLRIGKVRPE

SEQ ID NO: 93235 - protein, 398 aa, Fusobacterium nucleatum subsp. nucleatum ATCC 25586
MKKIITDLDLNNKKVLMRVDFNVPMKDGKITDENRIVQALPTIKYVLEHNAKLILFSHLGKVKIEEDKATKSLKAVAEKLSELLGKNVTFIPETRGEKLESAINNLKSGEVLMFENTRFEDLDGKKESKNDSELGKYWASLGDVFVNDAFGTAHRAHASNVGIAENIGNGNSAVGFLVEKELKFIGEAVNNPKRPLIAILGGAKVSDKIGVIENLLTKADKILIGGAMMFTFLKAEGKNIGTSLVEDDKLDLAKDLLAKSNGKIVLPVDTVIASEFKNDIEFSTVDVDNIPNNKMGLDIGEKTVTLFDSYIKTAKTVVWNGPMGVFEMSNFAKGTIGVCESIANLTDAVTIIGGGDSAAAAISLGYADKFTHISTGGGASLEFLEGKVLPGVEAISNK

SEQ ID NO: 93236 - protein, 497 aa, Triticum aestivum
LLAAGLAVLAIGSYLAAFVVGRGAAGAQRYPPVAGTVFHQVYHLRRLHDYYTDLFREHATFRLLAPGRRQIYTSDTAVVEHILRTNFANYGKGASHYDKTSDLFGDGIFTADGDKWRQHRKIASYDFSTRALRDFSGGVFNRDAAKLAHIVSGNAAAKQPVDFQDLLMKATMDSIFTIAVGVDLDTLSGSDEGSRFAAALDDASEFTLLRFVNAFWKVSRFLNVGAEAALRRRIEVVDEFMYKRIRGRADEISDGGKVAKDDLLSRFIQATTGDAGEVDYKHLRDMILNIIMAGKDTTAGALAWFLYMMCKHPEVQEKISEEAAVAGQATSSIDDFSRSLNDEALNKMHYLHAALTETLRLYPSLPLDNKECFSDDVLPNGFSVGKGDIVFYAPYAMGRMERLWGDDAIVFRPERWLDERGVFLPESPFKFTAFQAGPRICLGKEFAYRQMKIFAAVLLRFFVLALHDKDASVNYRTMITLYIDQGLHLTATARVIV

SEQ ID NO: 93237 - protein, 325 aa, Corynebacterium efficiens YS-314
MMPRGGARRKALPVPDSPTAPVRLPRGRGTSMVTMSTLRAPLVPGEPTPIRKVPAHIERPEYVWKDEVLEAIGEPYVQTPEVIEAMRKTSRIAANALKVAGAAVAPGVTTDEIDRIAHEYMCDHGAYPSDLGYRGFTKSVCVSLNEIVCHGIPDTTVIQDGDIVNIDVTAYKHGVHGDCNATFLSGNVSEEHRLLVERTEEALMRSIRAAKPGREINIIGRVIESYAKRFGYNVVRDFTGHGIGPTFHNGLIVLHYDSTQYRDLLVPGMTLTIEPMINLGSLDYEIWDDGWTVQNKDRKFTAQFEHTIVITEDGNEILTLPDENI

SEQ ID NO: 93238 - protein, 497 aa, Candidatus Pelagibacter ubique HTCC1002
MNLLEHFVGGKLISGSSDRKSKVFNPATGEQESEVRLASKTDLDKAVGVAQKAFETWSLKPSLQRARVMFKFKELIEKNADELTKLIVSEHGKVYEDAKGSLTRGLEVVEFACGIPHLLKGEFSENVGTNVDSWSMRQPLGVVAGITPFNFPAMVPMWMFPIAIACGNTFILKPSEKDPSCPLRLAELLTEAGLPDGVFNVVNGDKEAVDAILTNKDVKAVSFVGSTPIAKYIYENSAKNEKRVQALGGAKNHLVVMPDCDLDGAVNGLMGAAYGSAGERCMAQSVAVAVGDIGDELVARLSKKAEALKVGPGMDKTSEMGPLVTKEHLEKVKSYVDLGVEEGAKLVVDGRNIKLQGYENGFFIGGCLFDHVKKDMRIYKEEIFGPVLSVIRVKTFEEATKLINDHEYGNGVSIYTRDGDAGRTFASKIQVGMVGINVPIPVPMAFHSFGGWKRSLFGDSAMHGAEGIKFYTKLKTVTSRWPSGIRSNAEFVMPTMK

SEQ ID NO: 93239 - protein, 440 aa, Serratia liquefaciens
MIMSKSNNKMGVVQLTILTAVNMMGSGIIMLPTKLAEVGTISIVSWLVTAVGSMALAYAFAKCGMFSRKSGGMGGYAEYAFGKSGNFMANYTYGVSLLIANIAIAISAVGYGTELFGANLSPLGICIATIGVLWLATVANFGGARITGRISGITVWGVIIPVVGISIIGWHWFSGSAYVAAWNPHQVPTFEAIGASISMTLWAFLGLESACANTDVVENPERNVPIAVLGGTLSAAVIYIVSTNVIAGIVPNMDLANSTAPFGLAFSHMFNPTVGKIIMALMIMSCVGSLLGWQFTIAQVFKSSADSGFFPKIFSKLSKADAPVKGMLTIVVIQSVLSLMTISPSLNKQFNVLVNLAVVTNIIPYILSMAALIIIQKVAKVPEKKARIANIIAGIGALYSFYALYSSGEEAMMWGAIATFLGWTLYGIVSPRFEMAGKKG

SEQ ID NO: 93240 - protein, 386 aa, Candidatus Pelagibacter ubique HTCC1002
MNIHEHQAKQILKKYGAVVPEGVFAFTVDELIEKAKSLKTEKFVLKAQIHAGGRGKAGGVKILNTIDELSVAAKELLGKTLVTHQTGPAGREVKRLYVEESSNIDKEFYLSCLVDRASSKIVFISSDQGGMDIEEVAEKTPEKIITTKIDITDEISDADCEKIIAIYALADDAKKQAIALIKSVYKMFLGTDANMVEVNPLILTKEKKIICLDAKVNFDSNALFRHPEIIELRDLNEEDPAEIDASKHDLAYIKLDGSIGCMVNGAGLAMATMDIIKLYGEEPANFLDVGGGASKEKVSAALKIILSDKNVKGILINIFGGIMRCDVLAQGVVDAAKEINISVPLVVRLAGTNFKEGKEILDNSGLKLISAENLDDAAKKIVKAIK

SEQ ID NO: 93241 - protein, 750 aa, Zea mays
MGSACQAGTDGPSRKDVLGIGNAALENGHHQAEADADEWREKEEDLANNGHSAPPPGMQQVDEHKEEQRQSIHWERFLPVKTLRVLLVENDDSTRQVVSALLRKCCYEVIPAENGLHAWRYLEDLQNNIDLVLTEVFMPCLSGIGLLSKITSHKICKDIPVIMMSTNDSMSMVFKCLSKGAVDFLVKPLRKNELKNLWQHVWRRCHSSSGSESGIQTQKCAKLNTGDEYENGSDSNHDDEENDDGDDDDFSVGLNARDGSDNGSGTQSSWTKRAVEIDSPQPISPDQLVDPPDSTCAQVIHPRSEICSNKWLPTANKRNVKKQKENKDESMGRYLGIGAPRNSSAEYQSSLNDVSVNPIEKGHENHMSKCKSKKETMAEDDCTNMPSATNAETADLISSIARNTEGQQAVQAVDAPDGPSKMANGNDKNHDSHIEVTPHELGLKRSRTNGATAEIHDERNILKRSDQSAFTRYHTSVASNQGGARYGESSSPQDNSSEAMKTDSTCKMKSNSDAAPIKQGSNGSSNNDVGSSTKNVAARPSGDRERVASPLAIKSTQHASAFHTIQNQTSPANLIGEDKADEGISNTVKMSHPTEVPQGCVQHHHHVHYYLHVMTQKQPSTDRGSSDVHCGSSNVFDPPVEGHAANYSVNGGVSVGHNGCNGQNGSSAVPNIARPNIESINGTMSQNIAGGGIVSGSGSGNDMYQNRFLQREAALNKFRLKRKDRNFGKKVACFQLHACCSYDLKSVIVI

SEQ ID NO: 93242 - protein, 232 aa, Munzothamnus blairii
GGRYSVCSAVGVLPLSLQYGFPVVEKFLKGARSIDQHFLSAPFEKNIPVLLGLLSVWNVSFLGYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVASHLVPHKTFTGNRPSLSLLLPSLDAYRIGQLLSMYEHRIAVEGFIWG

SEQ ID NO: 93243 - protein, 425 aa, Candidatus Pelagibacter ubique HTCC1002
MSEKILVPVLGESITEATVAKWLKKEGDTVVADEAIVELETDKVNLEVPSPIDGVLSEINSKDGETVEVGALLGMISQNGAQPSEKKIITKIEPKKTENNVVNLEIKKEAPKVLKEPEEEEPLVLTNEVKEEKTNSSNNNNEILSPAVRKIVVENKIDLKKVSGSGKEGRVLKGDLISMMGENPQPSERKIKYGQEERIKMSRLRQTIAKRLKQAQENAALLTTFNEVDMTGIMEMRKENQEDFQSRYGIKLGFMSFFVKACVAALKMYPSVNAEIDGDEIIYKNYYNMSFAVGTEKGLVVPVLRDTDQLSFADIEKNIKTISEKARDGKITIEDLQGGTFTISNGGVYGSMLSTPILNLPQSGVLGMHNIVERPMVVDGEIKIRPIMYLALSYDHRIIDGKESVSFLKMVKENLEDPRRLFLNI

SEQ ID NO: 93244 - protein, 232 aa, Rafinesquia californica
GGRYSVCSAVGVLPLSLQYGFPVVEKFLKGARSIDQNFLSAPFEKNIPVLLGLLSVWNVSFLEYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVASHLVPHKTFTGNRPSLSLLLPSLDAYRIGQLLAIYEHRIAVEGFIWG

SEQ ID NO: 93245 - protein, 466 aa, Candidatus Pelagibacter ubique HTCC1002
MSDKFQAVVIGGGPGGYVCAIRLAQLGLKTACIESRGSLGGTCLNVGCIPSKNLLNISENYHKAQNFSKLGIEVGEVKLNLQKMMQNKDKAITILTKGVEFLFKKNKVTYFKGTGSFKSANKISILDDQKKETIIETDKTVISTGSVPVALPGIEFDEKIIVSSTGALTLETVPKKMVVVGGGYIGLEMGSVWSRLGAEVHVVEFLEHITPGMDREISTEFMKILKKQGINFHMQTKVEGIKKNANGAIVSTSDKDGKKADFDCDVVLISVGRKPNTTNLNLEAIGVELDEKKRIKTDKTFQTNVENVYAIGDVIDGPMLAHKAEDEGIAVAENIAGQSGHVNYDIIPGVVYTTPEVASIGKTEEQLKEANTKYKIGKFSFMANSRAKAIDEAEGFVKILADEKTDRVLGAHIIGPHAGELIGEIGVAMEFGASAEDIARTCHAHPTFSEAVKEAALSVDKRAIHS

SEQ ID NO: 93246 - protein, 232 aa, Stephanomeria cichoriacea
GGRYSVCSAVGVLPLSLQYGFPVVEKFLKGARSIDQQFLSAPFEKNIPVLLGLLSVWNVSFLEYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVASHLVPHKTFTGNRPSLSLLLPSLDAYRIGQLLAIYEHRIAVEGFIWG

SEQ ID NO: 93247 - protein, 538 aa, Mycoplasma hyopneumoniae 232
MLEVRELSKIFADKTLFQNVNLKFTEGNTYGIIGANGAGKSTFLKILAGLIEPSSGSIHISQNQRISVLSQNHFEFDEFNVTDVVIMGNEKLYQIQQEKDQIYANPDATEADYNRAGELEEKFGLLGGWSAENDAQILLSALEIPKKYWNSKMSDLKSGYKVKVLLAKALFGNPDILIMDEPTNHLDFKAIKWLKEFLINYKNVVLIVSHDSDFLDQVCTHTVDIDYGEIKIFTGNYSFWKQSSELLKELQKNANAKKEEQIAKLEAFIAKFSANASKSAQATSRKKSLEKIQLEEIKPSSRKYPYIRFGVFPRPGKQVLNVENLSYKNPLTGNFLFQNISFNLLPGQKMVIFAEDDLVKTKLLEILTGKEMPTSGTISWGSTIKFDYLPANNDSFFNGDLDLLSWISQWPSLNLQPENKDNSTQRMRGFLGRMFFNGDQVFKKVSVTSGGEKVRLMFAKMMLSESNFLLFDQPLNHLDSESIDSFIEALKLYDSGVIFTTFNLALINEVANVILDIKEDSAIFFQGNLAEYEKKIGI

SEQ ID NO: 93248 - protein, 577 aa, Solibacter usitatus Ellin6076
MRQSVIPIFVPVTKPRPLECRSYQTKCRGVAVLNSPMLNKGTAFTSKERKELGLTGLLPPEISTLGTQVKLAYIQYDRLPDTLAKNTYLTTLHAHNEVLFYRLFSEHLREMIPVLDDATLSLAAQRNHHECGQSRGVYLSIDHIDAMEEAFANLGADAGDIDLILTTDGEQVRGVGDAGMSGIERSLGKLAVYTAAGGINPNRAISVVLDVGTDRQDLLDDPTYIGNRHPRIRGKRYDAFLESYVTTTTRLFPHAMLHWENFAPGNGRRLLEKYGGQVCTFNDDMQGTGAITLAAAISAVRICGTPLRNQRVVILGAGTAGVGIADQICDAMAREGLSRQEAVRQFWFVDRQGLLTSNMTGQLRDHQVTFARPDVESRGWKQLHGGGIGLAEVVRQVKPTMLIGASSSSGSFTEPIIRQMAAHTARPIIFVLSTPPVRAEANPADLIAWTAGRALIATGSLFAPVTYRGLTYVVAQLNNAMVYPGLSLGAVVARARRISEGMFEAAAGAVSSLVTVRHPGASLLPHIDDLSSVSMTVAAAVAEAAVSEGLSRAPIDDIVQQVRDAMWQPEYHEIQAS

SEQ ID NO: 93249 - protein, 564 aa, Lachancea kluyveri
MSEITLGLYLFERLNQVDVKTIFGLPGDFNLSLLDKIYEVPGMRWAGNANELNAAYAADGYARVKGMSCIITTFGVGELSALNGIAGSYAEHVGVLHVVGVPSVSSQAKQLLLHHTLGNGDFTVFHRMSANISETTAWVTDIATAPAEIDRCIRTTYVTQRPVYLGLPANLVDLMVPASLLDTPIDLSLKPNDPEAEAEVVNSVLELIKDAKNPIILADACASRHDVKPETKQLIDITQFPAFVTPLGKGSIDEQHPRFGGVYVGTLSNDDVKEAVESADLILSVGALLSDFNTGSFSYSYKTKNIVEFHSDYIKIRNATFPGVQMKFALQKLLSEIGAVVKDYKPVAVPPKPTPNPACDPSTPLKQEWVWNQVGRFLQEGDVVITETGTSAFGINQTHFPNNTYGISQVLWGSIGFTTGACLGAACAAEELDKNKRVILFIGDGSLQLTVQEISTMIRWGLRPYLFVLNNDGYTIERLIHGENAQYNEIQPWKNLDLLPTFGAKDYETYRVATTGEWDKLAQDEAFNKNSRIRMVEVMLPVMDAPSNLVKQAQLTASINAKQD

SEQ ID NO: 93250 - protein, 394 aa, Legionella pneumophila str. Lens
MHLKRTLSLTLLAFYGLGTILGAGIYALVGEVAKEAAQFTPLSFLIASIIAFFTAISYAELSSRLPLSAGSALYVRRAFQQRWLSGLIGWIVVLTGVISAATLSHGFVKYFQLFLPLPPSLIITILVVILAGVAVWGIRESATLILFMTLMEVGGLLMIIYYGRYSLASIDIQSFSFPHSFDGVLIGAFIAFYAFIGFEDMVNTAEETINPEKTLPKAIFLALISATILYVVVAWVIVSTIPSHTLVKTDMPLIEIIKLQGQSPLLFSIIALISITNGILVQIIMASRLIYGMANQQNAPQIFSFVYSKTQTPANSTLLVSLIILLFAYALPITTLAKLTSSIILCIFIIIHASLIKIKLTEKKSPEAISFPIVFPMISILLTLTFLGIQFFLK

SEQ ID NO: 93251 - protein, 2141 aa, Oceanobacter sp. RED65
MGDRHDYVALDWVKGEIEEVLKQAQYELEAYVEAPDDTARMKFCLTYLHQVRGTLQMVEFYGAAMLAEEMEAVAQALLSDQVADANEARQVLMQAILQLPNYLDHIKLGRRDLPVVLLPVLNDLRGARGEALLSETSLFQPSIETRQPLTDAQERQFSDKQFVDLLRKLRQMYQVALLGLLKGKDVDQNTQYLHKVAARLAKLFQKSQAQDLWHAAAAVLEGVASNGIALNSAVKELLKKLEPELKKVVTQGPSSLNARNDELLKNLLFYVAKCDINTPRIEQIKQDFNLKDALPTQDEVTAERKALKGPDKATMGSVATALIEEITTLKERLDLLVQDKEATSEQLALLIPAFKQITDTMGMLGLGTPRKVIQDQFDFISQFVAEGQTASNVQLMDVAGALLYVEASLTGLSDRFGGEPATAEAQQLGEAQHVVLRESKQIIEKVKELVVEYAKGGELSLLADAADQLMNLRGTLIMVPQVDAADIARYCSNILHKHVNQNERPSAALLEVLAESLSGVEYFLERVDDDAQQDSNGILLRAKEVILPYIPAQDLSPDEPVVAQDALEDDLEEVSLEVSSDDGLETDSQTRLQAADSAYEASEDSEAALETITLDDVSIQETEPEVIDFASIEQPEEWDVSAEDALTAALEEQPDNEFVTVEPEQVAVEQLAPVAMEDDDDDLIDDEIIEIFLEEAEEVLETIHEFWPAYKGDTSDEEALITTRRAFHTLKGSGRMVSASDIGETAWAIENMFNRLIDQTIQLSDELFTIVDYVIEQLPSLIEAFKHRHVCPLDVEAIQEYANKIAKGEVAGEWHGAAKKFEQDSQNLATTVESSAKLESHDGISETETNDQNMDQALLSVFSSEVTSHLKVVAEFIETAQSEDYQIDLNDDLQRALHTLKGSAHMAHIEPIAEVAAGLENFTKDLRAYHIEPSAEIIHFYIRGKELLDQGYQQLDSTPYAEIPGSQDLNADLIRFVDQVRTDVAEDSGQKNKGQVDPQVLSIFLSEGMDIINEAEDLMDDWKAHPDNSELLLTLIDEMQTLEKGAQMSELPPLVALCQALQIAYQRIKDEALAADSELAKTIIDAHEALLNMMDMVAASQAIVPAKQLIADLTGEVPVDSEEEYKQLVPDNSDLDDGPVTLDIPQVEVREEVIQQDIDPELLEIFLEEAEELLDSISEALNDWKQDPLNLIKVAELQRDLHTFKGGARMAEINAIGDLAHELEDLYEGLSLGRLTATPQLFELLQICHDRLADMVAALQDNQGMRPAPELITAIQLFIAGESLEVPSQANAIDETSTASDEDSLADPSASAVKPLQETQSVTVESLAIDADEEVIEIFLEEADELLEELDGLLQQWQQSPENLSTNEAVQRVLHTLKGGARIAGLVDIGDMAHHMETELQKRLTEKRPGDEALFNSLHEQYDFIAGRIEHVQEWFNAGASEPLMVQVENAVQSNENTDSDRAEVLSQPQTNVVPLRPQPDAEENTSKTTTAPIVPQAENNQVVAQSSPQQPVSRTEQEAQGKRQGPQEMIKVPASLLDGLVNLAGETSISRGRLETQVTDFSYTLDEMDATLDRLRDQLRRLDMETEAQVLFRREQQGPEYEDFDPLEMDRYSQLQQLSRSLVESASDLADLKSTLLDKTRDAETLLLQQSRVNTELQEGLMKTRMVPFSRLVPRLRRIVRQISTELGKQVELHVSNAEGEMDRSVLERLISPLEHMLRNAVDHGLESTEQRKAAGKSETGNIYLSLSRDGGDVVLRLADDGAGINVDAVRRKAIDRGLIDPSVKMPDQEIYQFILQAGFSTAEQVTQISGRGVGMDVVNSEIKQVGGTVVINSQQNQGTEFVIRLPFTVSVNRALMAKVGDALFAIPLNNIEGIVRVSANNLRELLKQDKPTYHYAGREYQLEYLGRLLRDENMTRLPEDNTPMPVVLVRGSSPAAIQVDTLMGSREIVVKTLGPQFNSVVGVSGGTILGDGSVVIILDLPNMMRHVNTLEYQQHMAIEHEQEAELEAVELARQSDVTSILVVDDSVTVRKVTTRLLERNGMEVRTAKDGVDAMATLQEYKPDLVLLDIEMPRMDGFEVASQMRHSQALKEIPIIMITSRTGEKHKERAMAIGVTDYMGKPFQEDRLLEAIAEYTGHRG

SEQ ID NO: 93252 - protein, 339 aa, Pseudomonas aeruginosa UCBPP-PA14
MSRVIRFHQFGPPEVLKCEELPTPAPAAGEVLVRVQAIGVSWKDVLWRQNLAPEQAALPSGLGFELAGEVLAVGAGVGDLPLGSRVASFPAHTPDHYPAYGDVVLMPRAALAVYPEVLTPVEASVYYTGLLVAYFGLVDLAGLKAGQTVLITEAARMYGPVSIQLAKALGARVIASTKSAEEREFLREQGADKVVVTDEQDLVLEVERFTEGKGVNVILDELGGPQMTLLGDVSATRGKLVLYGCNGGNESAFPACAAFKKHLQFYRHCLMDFTGHPEMGLERNDESVSKALAHIEQLTRDRLLKPVVDRVFEFDQVVEAHRYMETCPKRGRVVIHVAD

SEQ ID NO: 93253 - protein, 305 aa, Ehrlichia ruminantium str. Gardel
MDTGYKSINSFIDLDLHTYEELRKILDYGSLIKKHPDKYNKHLSNKNVALIFMQPSTRTRISFEVGVNQLGGNAIVLDWQNSQLTRGESIYDTAKVLSRYVNLVVIRILDHSSLLEFRKHSSVPIINSLTQYSHPCQVLADIMTYEEKMGSIEHATVSWIGDFNNMLVSWIHAATMLNFKLNVSTLEHSKDLELLLESAKKQGANIVYDRNPNNIIQDANVITTDSWVSMGDKNNIKSEFFNYQVNATLLKNARPDYMFLHCLPAHRGEEVTSEIIDGPNSYIFDEAENRLHIQKSIMLWCLNLL

SEQ ID NO: 93254 - protein, 184 aa, Triticum aestivum
  misc_feature (91)..(91): Xaa can be any naturally occurring amino acid
  misc_feature (110)..(110): Xaa can be any naturally occurring amino acid
  misc_feature (127)..(127): Xaa can be any naturally occurring amino acid
  misc_feature (135)..(135): Xaa can be any naturally occurring amino acid
  misc_feature (147)..(147): Xaa can be any naturally occurring amino acid
  misc_feature (163)..(163): Xaa can be any naturally occurring amino acid
MPPPQPTNGGKLTPNLAMDAEGTRLLNLTVLQRLDPAVEDILITAAHVTLYDFNIDLNQWSRKDVEGSLFVVKRNTQPRFQFIVMNRRTRXNCEVLVIDTLTPLCPMLNXIVRNVAISNGIGFTSSXDCDAVTNXSGKILKVYAKFXSKGQVPSTKSDLEDWXGGPTSACLNGPLEHRENPTHF

SEQ ID NO: 93255 - protein, 268 aa, Ashbya gossypii ATCC 10895
MLGRAVGRGGKVAALRWSSKMTSQDSSRKKELCAAYSVVDERVSRSMEECGRRRSEVLLLAVSKLKPASDVAILYEEMGLRHFGENYVQELVGKAAELPGDIQWHFIGALQSNKCKDLAKVVNLHAVETIDSLKKARKLEEARAKFQPDAPAILCSIEVNTSGEAQKAGVSDEAELCELVEFFLSEDAKHVRLRGLMTIGSWDASHAADGENPEFAALAKWKRVLDGKYGLNLELSMGMSADFAAAMRQGSSEVRIGTDIFGARPARK

SEQ ID NO: 93256 - protein, 511 aa, Oryza sativa Japonica Group
MAAMDLRVAAPASVAAAARCGTSLARPWPARAVGGGGGGGGRGRRLSVRTSVATTEAAAAAVGASEDAALEARDSKTVVAVILGGGAGTRLFPLTKRRAKPAVPIGGAYRLIDVPMSNCINSGINKVYILTQFNSASLNRHLSRAYNFSNGVAFGDGFVEVLAATQTPGSEGKRWFQGTADAVRQFDWLFDDAKAKDIDDVLILSGDHLYRMDYMDFVQSHRQRGADISICCLPIDDSRASDFGLMKIDDTGRVIAFSEKPKGDDLKAMQVDTTVLGLPQDEAKEKPYIASMGVYIFKKEILLNLLRWRFPTANDFGSEIIPASAKEINVKAYLFNDYWEDIGTIKSFFEANLSLAEQPPRFSFYDANKPMYTSRRNLPPSMINNSKITDSIISHGCFLDSCRIEHSVVGIRSRIGSNVHLKDTVMLGADFYETDLERGELLAEGKVPIGIGENTKIQNCIIDKNARIGKNVTISNSEGVQEADRTSEGFYIRSGITIVLKNSIIADGLVI

SEQ ID NO: 93257 - protein, 634 aa, Oryza sativa Indica Group
MAAAAISHLRRGAPRHARALLYLSTRRFSSSSAAGVAPLAAVAASARRLLSTSVDSGASSTGESYKPPLFDPFRAASLASSAPPLESPPIEELPDDATPPPEEEPGLPAPEKDPVATACQHELEGLKAWVETVRSRKESTEEKEAWSLLGRSVVSYCGTAVGTVAANDPSTANQMLNYDQVFIRDFVPSAIAFLLKGEGDIVKNFLLHTLQLQSWEKTVDCYSPGQGLMPASFKVRSIPLDGNSEAFEEVLDPDFGESAIGRVAPVDSVTDGSCMIDRRMGIHGHPLEIQSLFYSALRCAREMVSVNDGSNSLIRAINYRLSALSFHIREYYWVDMKKINEIYRYKTEEYSHDAINKFNIYPEQIPSWLADWIPEKGGYLIGNLQPAHMDFRFFSLGNLWAIISSLATQRQAEGILNLIEAKWEDIIANMPLKICYPALEYEEWRIITGSDPKNTPWSYHNGGSWPTLLWQFTLACIKMGRRDLAQRAIEVAEKRLSEDKWPEYYDTRTGRFIGKQSRLYQTWTIAGYLSSKMLLDCPELASILICEEDLELLEGCACSVNKSARTKCSRRAARSQEPGGSWNCEVSLAETNKIQARSLALQLDQLNTVVGEQKSIQQNLEDVKKKKLKYANIC

SEQ ID NO: 93258 - protein, 301 aa, Escherichia coli CFT073
MDEIMTNLKAVIPVAGLGMHMLPATKAIPKEMLPIVDKPMIQYIVDEIVAAGIKEILLVTHASKNAVENHFDTSYELESLLEQRVKRQLLAEVQSICPPGVTIMNVRQGEPLGLGHSILCARPAIGDNPFVVVLPDVVIDDASADPLRYTLAAMIARFNETGRSQVLAKRMPGDLSEYSVIQTKEPLDREGKVSRIVEFIEKPDQPQTLDSDIMAVGRYVLSADIWPELERTQPGAWGRIQLTDAIAELAKKQSVDAMLMTGDSYDCGKKMGYMQAFVKYGLRNLKEGAKFRKGIEKLLSE

SEQ ID NO: 93259 - protein, 368 aa, Oryza sativa Indica Group
MDEAWDDVVTQCPCQRTIAASVIHEGDLVVVIACDWIPEKGGYLIGNLQPAHMDFRFFSLGNLWAIISSLATQRQAEGILNLIEAKWEDIIANMPLKICYPALEYEEWRIITGSDPKNTPWSYHNGGSWPTLLWQFTLACIKMGRRDLAQRAIEVAEKRLSEDKWPEYYDTRTGRFIGKQSRLYQTWTIAGYLSSKMLLDCPELASILICEEDLELLEGCACSVNKSARTKCSRRAARSQLTESPEVMRARHAVQLLHPALFRSKQSWVKLSVVKTRLQSRSEIAPFFFTDAPSLTSLIAPCILCHLKEQEPGGSWNCEVSLAETNKIQARSLALQLDQLNTVVGEQKSIQQNLEDVKKKKLKYANIC

SEQ ID NO: 93260 - protein, 206 aa, Thiobacillus denitrificans ATCC 25259
MTAKPVLNRAHFFTSVAQFRDLPPSRAEVAFAGRSNAGKSSAINLLTRKNRLAFTSKTPGRTQLINFFELTADTYLVDLPGYGYAKVPPEVKAKWEGLLSRYLQEREALAGMVLIMDARHPLTPLDRQMLEWFAPTGKPVHILLSKADKLSNSEKALTLRKVKQELADRETVSVQLFSSLSRVGAEEAAVRIEGWLAPEAAVHAPG

SEQ ID NO: 93261 - protein, 301 aa, Ashbya gossypii ATCC 10895
MTEYTVPEVTCVARARIPTVQGTDVFLHLYHNSIDSKEHLAIVFGENIRSRSLFRYRKDDTQQARMVRGAYVGQLYPGRTEADADRRQGLELRFDETGQLVVERATTWTREPTLVRLHSECYTGETAWSARCDCGEQFDQAGKLMAAATEGEVVGGAGHGVIVYLRQEGRGIGLGEKLKAYNLQDLGADTVQANELLNHPADARDFSLGRAILLDLGIEDIRLLTNNPDKVQQVHCPPALRCIERVPMVPLSWTQPTQGVRSRELDGYLRAKVERMGHMLQRPLVLHTSAAAELPRANTHI

SEQ ID NO: 93262 - protein, 115 aa, Prochlorococcus marinus subsp. pastoris str. CCMP1986
MKSWSCIENCGACCHLDLNDRDNLSGVLSNKDIALINSMKSKDGWCKYLDRSSRKCMIYESRPHFCRVNEFSSAFKKYLINGDKFLIDCCTQHISSIYGSKSEQMKDFKSAISRK

SEQ ID NO: 93263 - protein, 442 aa, Acinetobacter sp. ADP1
MLYSIFIAHQESWMVDQFDLEHIWHPYTSMINPLPTFKVKRASGVMIELDDGRQLIDGMSSWWCAIHGYNHPALNQAVKDQLEQMSHIMFGGFTHDPAIELAKILLKITPPSLDKIFYADSGSVAVEVALKMAVQYWTAQGQHQKTNFITTRSGYHGDTWNAMSVCDPVTGMHQIFGASLPNRVFVSAPKSRFDGEWDSSEMDEVEQLIQQHTQLAAFIIEPIVQGAGGMRFYHPEYLRQLKQLCEKYQLLLIFDEIATGFGRTGKLFAWEHAQVEPDIMCIGKGLTGGYMTLSATLTSQHVAEVISRGEAGVFMHGPTFMGNPLACAVALKSTQLLVEQDWQSNIRRIENRLQPLYQLAALAHVADIRTLGAIGVVELKHNVDMKTLQQQFVELGIWIRPFGKLVYVMPPYIISNDELDELIQKMMNVVRQLSCEAQHGIA

SEQ ID NO: 93264 - protein, 695 aa, Magnaporthe grisea 70-15
MRSPTLLTAFTALVLAPASILATPVVSDPRLGAVASETSECSHIGTQILKAGGNAADSMIATVFCVGTIGMYHSGIGGGGFLLVRSPKGKYEFVDFRETAPAASSENMYKNKGTGSTRGGLASGIPGELRGLEYLHKHYGKLPWRDLLAPSIKLARDGFVVNADLVRYMDMEVDKPGDGGFFVSDPSWAVDFAPNGRRVRLGETMTRKRYAKTLQRIADEGPGVFYRGDMAQATIKALQATGGIMTLQDLAGYQIKLRRPAGINYRGYKLTATSAPSGGGVALAILNVLNGYKDFGHPSAVNQSTHRLNEAMRFAYAQRAKLGDPAFVNGTEKFQRDMLSGATGQLIRSKISDAKTQDTAYYNPEGLESLETPGTSHIAVADASGMAVSLTTTINTFFGSHVMVPETGVPMNNNMDDFSVPGMTNSFGYLPSPANFIRPGKRPLSSMSPLIAEVRDGKRLYFVLGAAGGSRIITSTVQNVIHVLDEGKTAPQALAMPRLHDQLTPAVTTFEWAYNNATVQYLKNLGHNVSWVAPGQSTAQAVRLLPNGTFEAAGEPRQLNSGGSLFHDTLGLLIYYRLLPIPRLLSPNRRWRRIHLRDGASIKLRHLLGLFESYPHSGVVRVRRRRRSLVAAEETVLLGATLPAPSQKAKDPQRDNGDYHKGADDRAGDDGCRWPVGSRTVLALALTVLGAVVRF

SEQ ID NO: 93265 - protein, 273 aa, Brassica napus
  misc_feature (86)..(86): Xaa can be any naturally occurring amino acid
  misc_feature (256)..(256): Xaa can be any naturally occurring amino acid
MFGGGSRRDEGSMPIQNTNLFAALDTRKKKKKSDKAGGKSKGSSSSHKEPEPQVFWAPTPLKAKAWADIDSDDEDDDYFVTTAPPXALWNASEASRSDVKETHVEESESEEDILDDGEVDDLEEEQETQVHPEAEPEVKKAPEVPAPPKEAERQLSKKERRQKELAELEALLADFGVAPTGQDNTQDNQEKKEVNGEGEKKENATGESKASKKKKKKDKQKEAKESQEEVKSNADAAGGESAEQEEQEASSSMDIXERLKKIASMNKKKSSKE

SEQ ID NO: 93266 - protein, 560 aa, Triticum aestivum
  misc_feature (349)..(349): Xaa can be any naturally occurring amino acid
  misc_feature (445)..(445): Xaa can be any naturally occurring amino acid
  misc_feature (547)..(547): Xaa can be any naturally occurring amino acid
MATTNWTLPDHPTLPKGKTVAVVVLDGWGEASPDQYNCIHVAQTPVTDSLKNGAPEKWRLVKAHGTAVGLPSDDDMGNSEVGHNALGAGRIFAQGAKLVDAALASGKIWEDEGFNYIKESFDKGTLHLIGLLSDGGVHSRLDQVQLIVKGASERGAKRIRLHILTDGRDVLDGSSVGFVETIEKDLAQLREQGVDARIASGGGRMYVTMDRYENDWSVVKRGWDAQVLGEAPYKFPNALEAVKTLRAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGXRTFACSETVKFGHVTFFWNGNRSGYFDETREEYVEIPSDSGITFNEQPKMKALEIAEKTRDAILSGKFDQVRINLPNGDMVGHTGDIEATVVACKXAADEAVKMVLDAVEQVGGIYLVTADHGNAEDMVKRNKAGEPMLDKSGSIQILTSHTLQPVPVAIGGPGLHPGVRFRSDIQTPGVCQNWLPPVMTSHGFQAPXAEYETTLIGVGDK

SEQ ID NO: 93267 - protein, 232 aa, Stephanomeria guadalupensis
GGRYSVCSAVGVLPLSLQYGFPVVEKFLKGARSIDLQFLSAPFEKNIPVLLGLLSVWNVSFLEYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVASHLVPHKTFTGNRPSLSLLLPSLDAYRIGQLLAIYEHRIAVEGFIWG

SEQ ID NO: 93268 - protein, 403 aa, Ralstonia solanacearum GMI1000
MHAMLSSKVSTLAPSPIQLMAARTREAREAGRDVVDLTLGEPDFATPEHICEAARRAIADGLTKYTPISGLARLREAVARKFRDENGIECTAAETLVGCGGKQVIYQAFVATIDPGDEVLIPAPYWSSYADIVTLCGGIVKPLPTTPESGYALQPQTLAAGISARTKWLVLNAPSNPSGTAYTAAQLEAFAEVLRRSGNPRLLILADDIYEHIVFDGLRFASFTAVAPDLRHRTLTVNGVSKAYAMTGWRVGYGCGPKPLIDAMANVQMQVNSHTASISQAAAIAALEGPQDELARRRAIFEQRRDSLLSRLGGIAGLRTPRPQGAFYLFPDAQAFIGRRTPEGCAIDDDQALAAYLLDSGVAVVPGSGFGMPGCLRLSYATSEARLELAATRLAGALRRLGD

SEQ ID NO: 93269 - protein, 232 aa, Stephanomeria lactucina
GGRYSVCSAVGVLPLSLQYGFPVVEKFLKGARSIDQHFLSAPFEKNIPVLLGLLSVWNVSFLEYPARAILPYTQALEKLAPHIQQVSMESNGKGVSIDGVRLPFEAGEIDFGEPGTNGQHSFYQLIHQGRVIPCDFIGIVKSQQPVYLIDEVVNNHDELMSNFFAQPDALAYGKTPEQLQSENVASHLVPHKTFTGNRPSLSLLLPSLDAYRIGQLLAIYEHRIAVEGFIWG

SEQ ID NO: 93270 - protein, 201 aa, Thermoanaerobacter tengcongensis MB4
MNPFDVMLKNYFDEKMLDKLSRVKILLIGCGGLGSNVAVMLIRSGIKNLTIVDFDEVDILNLNRQNYFLHQVGEKKVLALKDTLFKINPHANIAAKNIKIDESNLDELIPQHDIVVEAVDNEFTKTLIFKKAQKHNKKVVLASGVAGFGDCENIKIKRGKNFSIVGDFVTSINEKKPLAPKVMAVAAIQADEVLRMINELE

SEQ ID NO: 93271 - protein, 113 aa, Brassica napus
  misc_feature (38)..(38): Xaa can be any naturally occurring amino acid
  misc_feature (67)..(67): Xaa can be any naturally occurring amino acid
TAIHTNLFAALDTRRKKKKSGKAKASSFVKESEPQVFXINSDDEDDDYFTTTAPPPQPLRSASDAKXVHVEESESEEDVLDEGDDDEDDLEEEPETQVHPEAEPEVKRAPEFR

SEQ ID NO: 93272 - protein, 121 aa, Beta vulgaris subsp. vulgaris
MSTVFNGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGV

SEQ ID NO: 93273 - protein, 180 aa, Glycine max
RTLGIRLELEPNRLEEYQNTNVPQIYALGDVCDKGFELTPVAIAAGRKLSERLFGGNADAHLEYENIPSVVFAHPEVGSIGMTEPEAREAYGDDNIKIYQTNFTAMYFAMMEPEDKQPTAYKLVCAGKEEKVVGLHIMGVGSAEMLQGFGVAIRMGATKKDFDRCVAIHPVSAEELVTLK

SEQ ID NO: 93274 - protein, 452 aa, Desulfitobacterium hafniense Y51
MDGGITMGKISISDVVDQIGVSKYTYKTYFLVGLTLIFCGFSYMIVSYTMPQMSAEWGLTKVQTGSLASWSLLGLMVGGMIAGIISDSIGRKKGLAIFTIWFSLLTFPIYFVNSFEAFAILRILGGVGFGACIPIVITLMAENVPTKNRGFFISSIMSFYVLGWVVAGVVAIYVVPTFGWRVCYLIGVLPVLYAFVLMAALQESPHWLLGKGREKEAIEVLKRIEMVSKGKANDYAPGSLFLPPRPKKVGVGALFSREYSRATMALWIIYFMGSVVIYGINGWLPTLLVDKGYGLVKGYSFAVLQNVFGAIGGLCTGYVADIIGRRTNVIIGWIATAVAILLLGVASNQWMVVICGMLVGLAMNWGLSGTQPLLAEGYPTEFRSTGVASAQAFGRVGGFLGPIVAGYVQQLGVGFTGTFVFFAVPAVIASFVALFFVVETKGKSIERISANA

SEQ ID NO: 93275 - protein, 443 aa, Corynebacterium glutamicum ATCC 13032
MFGLFIATIVAIILKPMPMGAVTIIGMIAAVLTGLVPLTASSDDPGAVYGLIGFSNGTIWLIVMAFLISRGFIKTGLGRRIALFFVSKVGGKMLGVTYGLALADLVLAPAIPSATARGGGIMAPIMKSVALTYDSTPGPTRRRAGAFLALNVGQVNAITCAMFLTAMAGNPLIASLASQMDVNITWTNWAVGAIVPGLVALIVVPWVVYKIYPPELKDTPEVKKMASDELKQLGGFTYGEKVLAGTFVVLLLLWTGGDLVLGISATTTAFVGVIILLVAHVLTWEDIIQEKTAWDTMVWFAVLYMMATALSQYGFIAWISEVIASSLGGMNWVVALVVLVLIYFFSHYFFASATAHISAMYLAFLGAAIAIGAPPLMAALVLAYTSNLFSSLTQYSGGPSPTLFGLNYITVGEWWRTSAIAGAVSITIWLVIGGLWMNVIGLW

SEQ ID NO: 93276 - protein, 478 aa, Escherichia coli CFT073
MAQSKLYPVVMAGGSGSRLWPLSRVLYPKQFLCLKGDLTMLQTTICRLNGVECESPVVICNEQHRFIVAEQLRQLNKLTENIILEPAGRNTAPAIALAALAAKRHSPENDPLMLVLAADHVIADEDAFRAAVRNAMPYAEAGKLVTFGIVPDLPETGYGYIRRGEVSAGEQDTVAFEVAQFVEKPNLETAQAYVASGEYYWNSGMFLFRAGRYLEELKKYRPDILDACEKAMSAVDPDLDFIRVDEEAFLACPEESVDYAVMERTADAVVVPMDAGWSDVGSWSSLWEISAHTAEGNVCHGDVINHKTENSYVYAESGLVTTVGVKDLVVVQTKDAVLIADRNAVQDVKKVVEQIKADGRHEHRVHREVYRPWGKYDSIDAGDRYQVKRITVKPGEGLSVQMHHHRAEHWVVVAGTAKVTIDGDIKLLGENESIYIPLGATHCLENPGKIPLDLIEVRSGSYLEEDDVVRFADRYGRV

SEQ ID NO: 93277 - protein, 68 aa, Zea mays
MTTSRRLADRKTAKFQKNITRRGSVPETTVKKGNDYPVGPLVLGFFIFVVIGSSLFQIIRTATSGGVA

SEQ ID NO: 93278 - protein, 194 aa, Prochlorococcus marinus subsp. pastoris str. CCMP1986
MSLRVGQEAPDFTATAVYDQEFKDITLSSYKGKWVVLFFYPLDFTFVCPTEITAFSDEFNKFSDLNTEVLGVSVDSKHCHLAWIQTPRNEGGIGDINYPLVSDLKREICQAYNVLNDDGEADRGLFLINPEGIVMHTTVNKAPVGRNVDETLRILQGYQYVAANPDEVCPANWTPGEKTMLEDPKGSKEYFSAL

SEQ ID NO: 93279 - protein, 361 aa, Coccidioides immitis RS
MRTAEESRQRWDTLFDQHQCASLEELGQKLKSKLHGDPCEDGLRSICWKAFLVHKNVDRESWPTQLSDTRGAYTALKDHFLKYIDHPDDLPSAADPLAEDDNSPWQSLRQDEAIRTEIYQDVERCLQENYFFREPTTKRRMLDILFIFVKLNPDLGYRQGMHELLAPVLWAVWQDAIEKDSVSEDNLPSEDRELLLQALDSDYIEHDAFAIFCAIMQTAKLFYEHDEMKSNSDQQNVSSIIARSQRIHQILLGSIDPELMSHLQTIGILPQIYLTRWLRLFFGREFPFENTLSMWDLMFTDLRPELVELVCVSMLIRIRWQCKMHPLSILCTIESNNPPSIVMRLFVGPRFAVEIPFPGAS

SEQ ID NO: 93280 - protein, 357 aa, Leptospira interrogans serovar Copenhageni str. Fiocruz L1-130
MKKLLYTLNLSEQFLWEFPHFKNRWIRNKSQRFRFYSKGAFSQEFPQKDQKTFYLQKYDFMDCRNNLAPRLSKFRTSFLIINRWIEILFFWSFVLFCTFFSFPISAEIQWEKSVQIAFEKARSSGKPIFIDVYADWCSYCKTLKKEIYPKKEVQLELSKFVALSLDGDKFPNLKRKYGIKGYPSILFLDRNGSLIDKITGMPDSKMILKSLKNAYVRRNLENEYLENLTKDPQGIQTNFQAGVYYFEAKEYSKAIQFFQKAIDSNDSKNLEKKHDALFNLGISYLEIGNFKLAISTFNSYLSKYPNGDLVSVLFFRANAYEELNLKEEAKADYKKVLELTLDPDEKQDLQMRIDSLN

SEQ ID NO: 93281 - protein, 151 aa, Brassica napus
  misc_feature (38)..(38): Xaa can be any naturally occurring amino acid
FVIVDDAGKAVGPIVDGDAVVTFNFRADRMVMHAKALXYEDFDKFDRVRFPKIRYAGMLEYDGELKLPSRYLVSPPEIDRTSGEYLTHNGVSTFACSETVKFGHVTFFWNGNRSGYFNEKLEQYVEIPSDSGISFNVKPKMKALEIAEKAR

SEQ ID NO: 93282 - protein, 600 aa, Glycine max
MTSKQTYSVCFCWRRRFKLALAEAPSEIKTLFEEYSENEFMTPSHLKRFLVEVQRQEKATEEDAQAIIDSFRHFPRRGAGLNLETFFKYLFSDDNPPLLPSHGVHHDMTLPLSHYFIYTGHNSYLTGNQLSSDCSDVPIINALKRGVRVIELDIWPNASKDNIDVLHGRTLTTPVELIRCLRSIKDHAFVASEYPVVITLEDHLTPDLQAKVAEMVTETFGDLLFTPNSESVKEFPSPESLKKRIIISTKPPKEYLEAKEKEKGDDSQHEKEKGDDSQHGKALGEDEAWGKEVPSLKGGTIEDYKDYNVDEDLNDEEEFDESDKSHHNEAPEYRRLIAIHAGKPKGGLAECLKVDPDKVRRLSLSEQQLEKAAINHGQQIVRFTQRNILRVYPKGTRIDSSNYNPLIGWMHGAQMVAFNMQGYGRSLWLMHGMFRANGGCGYVKKPNFLLETGPDDEVFNPKAKLPVKTTLKVTVYMGEGWYYDFKHTHFDQYSPPDFYTRVGIAGVPNDTIMKRTKAIEDNWLPTWNEVFEFPLTVPELALLRIEVHEYDMSEKDDFGGQACLPIWELRSGIRAIPLHSQKGDKYNTVKLLMRFEFINN

SEQ ID NO: 93283 - protein, 466 aa, Escherichia coli O157:H7 EDL933
MDQKLLTDFRSELLDSRFGAKAISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKEGEDPGYTLYDLSERLRLRGWQVPAFTLGGEATDIVVMRIMCRRGFEMDFAELLLEDYKASLKYLSDHPKLQGIAQQNSFKHT

SEQ ID NO: 93284 - protein, 510 aa, Bradyrhizobium japonicum USDA 110
MKHILDALEDRRAGAKLGGGEKRIEAQHARGKLTARERIELLLDKGSFEEFDMFVEHRSTEFGMEKTKVPGDGVVTGWGTVNGRKTFVFAKDFTVFGGSLSETHALKITKLQDMAMKARAPIIGLYDAGGARIQEGVAALAGYSYVFRRNVLASGVIPQISVIMGPCAGGDVYSPAMTDFIFMVKNTSYMFVTGPDVVKTVTNEVVTAEELGGASVHATRSSIADGAFENDVETLLQMRRLIDFLPSNNTDGVPEWPSFDDIGRVDMSLDTLIPDNPNKPYDMKELILKVVDEGDFFEIAESFAKNIVTGFGRIAGRTVGFVANQPMVLAGVLDSDASRKAARFVRFCDAFNIPIVTFVDVPGFLPGTAQEYGGLIKHGAKLLFAYSQCTVPLVTIITRKAYGGAFDVMASKEIGADMNYAWPTAQIAVMGAKGAVEIIFRSDIGDPDKIAARTKEYEDRFLSPFIAAERGYIDDVIMPHSTRKRIARALAMLKDKKVEMPAKKHDNLPL

SEQ ID NO: 93285 - protein, 224 aa, Moritella sp. PE36
MKNFLIAPSILSANFASLGQEVDAVLAAGADVIHFDVMDNHYVPNLTIGPMICKALRDHGVTAPIDVHLMVRPVDHMINEFAKAGASMITFHAEASDHVDRSLQLIKEHGLKAGLVFNPATPLHHLDYVMDKLDMILLMSVNPGFGGQSFIPSTLQKLRDVRQLIDASGRDIILEIDGGVKVDNIREIAEAGADMFVAGSAIYGQEDYKKVIDEMRSELEKANV

SEQ ID NO: 93286 - protein, 232 aa, Stephanomeria tenuifolia
GGRYSVCSAVGVLPLSLQYGFPVVEKFLKGARSIDQHFLSAPFEKNIPVLLGLLSIWNVSFLEYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVASHLVPHKTFTGNRPSLSLLLPSLDAYRIGQLLAIYEHRIAVEGFIWG

SEQ ID NO: 93287 - protein, 232 aa, Stephanomeria tenuifolia
  misc_feature (54)..(59): Xaa can be any naturally occurring amino acid
GGRYSVCSAVGVLPLSLQYGFPVVEKFLKGARSIDQHFLSAPFEKNIPVLLGLXXXXXXSLLEYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVASHLVPHKTFTGNRPSLSLLLPSLDAYRIGQLLAIYEHRIAVEGFIWG

SEQ ID NO: 93288 - protein, 447 aa, Desulfitobacterium hafniense Y51
MNRTYISEVIDQLGVSKYTYTMYILVGIALLFDGFDYMIVAYTMPQMAAEWGLSKVQTGSLTSWSLIGLIIGGLTAGIISDRIGRKKTLSIFVAMYSLLTLPIYFVHSFEVFAMLRILSGIGLGACIPIAVTMMTESAPTHKRGFFTSSIMAFYISGWVVAGIVAITIVPVFGWRVCYLLGGIPALYSLVLWFKMKESPYWLLSKGREKEAIDVVKTIEIAARGKAGEWPLGRLITPPAPPKVGVSMIFSKNYRKATLANWTIYFMGSVLIYGISGWLPTLLVESGFGVVKGYSFAVLQNIFAIIGAMSIGFFADIIGRRLNVSLSWFFTAVFAILLGFATTQWQVILFIIIVGFLMNGALSSTQPLLTESYPTEFRSTGVAWAQAFGRLGGFSGPIAAGFIQQMGAGFTGLFIFFAIPSFIAAAVAFFFVVETKDKAIEKIVSANV

SEQ ID NO: 93289 - protein, 616 aa, Streptomyces kanamyceticus
MTSISELADVARQLRVDSIRAAAAAGSGHPTSSMSAADLMAVLIGGHFRYDFERPAHPGNDRFILSKGHASPLLYAAYKAAGALTDEELLTFRKEGSRLEGHPTPRALPWVEVATGSLGQGLPVGVGMALSGKRLDRIPYRVWVLCGDSELAEGSVWEAAEHAGYEHLDNLTAIVDVNRLGQRGPTRHEWRLAAYADRFAASGWHVVEIDGHDIDDIGRAYDEAASTAGQPTVILARTLKGKGVAAVEDREGLHGKPLRDPEAAIQELGGVRDVRVEVREPAAARAMHAVRSGHLELPRHEVGDAVATRTAYGQALAALGTARGDVVALDGEVGDSTRAEYFAKEHPDRFFECYIAEQQLVAAAVGLAARGWVPYASTFAAFLTRAHDFVRMAAISGAGINLVGSHAGVAIGQDGPSQMGLEDLAVFRAVHGSTVLYPCDAHQTGRLVAEMAGLEGVRYLRTSRGDTPVIYGPGEEFPVGGSKVLRASDADRLTVVAAGVTVHEALAAAETLDGAGIQVRVIDLYSVKPVDRTTLREAAERTGCLLTVEDHRPEGGIGDAVLDAFTDGRPVPRLVRLAVRRMPGSASPAEQLRAAGIDADSIAAAARLLVEQGVVR

SEQ ID NO: 93290 - protein, 151 aa, Stephanomeria tenuifolia
HIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVASHLVPHKTFTGNRPSLSLLLPSLDAYRIGQLLAIYEHRIAVEGFIWG

SEQ ID NO: 93291 - protein, 312 aa, Thermoanaerobacter tengcongensis MB4
MSGRENKIYEDITQLIGNTPMIRLNKVVPENSAEVIVKLESFNPGGSVKDRIALNMIKRAEEEGRLKPGGTIVEPTSGNTGIGLAMVSAVKGYKLILVMPDTMSIERRNLLLSYGAELVLTPGAEGMKGAIKKAQEILELNPDYIMLDQFKNPANPEIHELTTAKEILKDTNGIVDAFVAGVGTGGTISGVGKVLKQYNKDIKIFAVEPEESPVLSGGKPGPHKIQGIGAGFIPDTLNLDVIDEIIKVKERDAFEMSMKLAKQEGILCGISSGANVFAAVEVANRLGKGKRVVTVLPDTGERYLSMHKFFEY

SEQ ID NO: 93292 - protein, 129 aa, Chlamydomonas reinhardtii
MAGRGKGKTSGKKAVSRSAKAGLQFPVGRIARYLKKGKYAERIGAGAPVYLAAVLEYLTAEVLELAGNAARDNKKNRIVPRHIQLAIRNDEELGKLLGEVTIASGGVLPNIHAVLLPKKTKGGKGEETA

SEQ ID NO: 93293 - protein, 409 aa, Desulfitobacterium hafniense Y51
MRVLVQKFGGTSVSSAERRAQVAAKVSEAVREGYSPVVVVSAIGRSGDPYATDTFINLVNGITLESPKREMDLLMSCGEIISGVVLTSTLKSMGLEAILLTGGQAGIITNDCYGDARIIRVEPKGILDHLSEGRVVVVTGFQGVTEDGQVTTLGRGGSDTTASALGVALNAEAIDIYTDVEGIMTADPRIVEDARILDVVTYNEICHLAHQGAKVIHPRAVEIAMQRNIPIWIKCTFSDARGTLVTSIQPDMGAGTDITGDRTITGIAHTPNVTQIQVPTHDVADVLQVDKQIFKGMALADISVDFISVQPESVLYTVPDEIAEKAMKILDNLGFKPTAVPGCAKVSIVGAGIAGVPGVMANMVEALSDAGVRILQSADSHTTIWVLVNKEDMVPAVQALHKKFLLGAC

SEQ ID NO: 93294 - protein, 480 aa, Botryotinia fuckeliana
VVVAAGLAAFIVLSVVLNVLNQVLFANPNEPPMVFHWLPVIGSTITYGMDPYKFFFDCRAKYGDIFTFVLLGKKTTVYLGRKGNDFILNGKLKDLNAEEIYTVLTTPVFGKDVVYDCPNAKLMEQKKFMKIGLSTEAFRSYVPIIQMEVENFMKRSSAFKGPKGTADIGPAMAEITIYTASHTLQGKEVRDRFDTSFASLYHDLDMGFSPINFMLHWAPLPHNRARDHAQRTVAKTYMDIIQNRRAQATEAEFKSDIMWQLMRSSYKDGTPVPDKEIANMMIALLMAGQHSSSSSISWIMLRLASRPDIMEELYQEQIQVLGADLPALKYEDLSKLPLHQNVLKETLRLHTPIHSIMRKVTTPMPISGTKYVIPTSHTLMASPGCTSRDDEFFPEALEWDPHRWDLGSGRVVGNDQDEEFQDYGYGMISKGASSPYLPFGAGRHRCIGEQFATVQLVTIMATVVRLFKFKNIDGSKDVIG

SEQ ID NO: 93295 - protein, 472 aa, Clostridium acetobutylicum ATCC 824
MQKTKMIFTIGPSSDSEEKLKELMNAGMNAARLNFSHGTHEDHKEKIDIIKKLRKELNKNVAIVVDIKGPKIRTHNFENDKAEIKKGQTFTVMCGSEILGNSEKCSVSYDDLYKDVKKGGLLLVDDGLLEFEITDVQDKNIICKAKNNGIISNHKGVNVPGVSIGLPAVTEKDVLDLKFACKMQADLVAASFIRKAEDVSVVRKVLKENGGEDIRVISKIETQEGVDNIDKILELSDGIMVARGDMGVEIPIEDVPSIQKMIIRKCNDAGKIVITATQMLDSMIRNPRPTRAEASDVANAIYDGTDAIMLSGESASGLYPIEAAETMAKIAQKTESQIDYTKALNERKGEIITKISDAISLAACSTAAELKAAAIITATQSGITARMVSKFRPTCPIIAVTPHDDVARRLALNFGITPITSEKVVSTDELISVSIKRALNENLIKKGDLVVVVAGVPVGESGTTNMLKIQYT

SEQ ID NO: 93296 - protein, 406 aa, Ehrlichia ruminantium str. Gardel
MFVEVLMPALSPTMTSGIIRKWYKSEGEEVKSGDIIADIETDKAVMEFEYTDEDGIMGKIIVAEGTKNVLVNQLIALIVTDKLDLKEIDTYVSSSTASKTEKASVVLQGEEEIKNDVVTISEPKRIKISPLAKKIASDFAIDINSIQGTGPYGRIVKADVLDAASKKENNVEIIPTSNGENTFIEVSSMRKVIAERLVYSKQMIPHFYVSVDCKVDDLLKVRLEINAENFGTKITINDFIIKAVSMSIKKFPEINVSWDDNDKIIAFANIDISVAVSIDDGLITPIIRNADKKSLLEISNEVKMLASKAKTGKLKPEEFQGGGFTISNLGMFGIKEFNAIINPPQSCIMAVGCSDKRAIIVDDQICISNVMTVTLSVDHRVIDGVLAAKFLNCFKSYIEKPYLMLI

SEQ ID NO: 93297 - protein, 162 aa, Escherichia coli CFT073
MLEDLRANSWSLRPCCMVLAYRAAHFCSVWRKKNVLNNLWAAPLLVLYRIITECFFGYEIQAAATIGRRFTIHHGYAVVINKNVVAGDDFTIRHGVTIGNRGADNMACPHIGNGVELGANVIILGDITIGNNVTVGAGSVVLDSVPDNALVVGEKARVKVIK

SEQ ID NO: 93298 - protein, 541 aa, Medicago sativa
MAIEMTSIVSKLSMLSTSDHASVVSMNLFVALLCACIVLGHLLEENRWMNESITALLIGICTGVVILLFSGGKSSHILVFSEDLFFIYLLPPIIFNAGFQVKKKQFFVNFMTITSFGAIGTLISCVIITTGATFAFKRMDIGPLEIGDYLAIGAIFAATDSVCTLQVLNQDETPLLYSLVFGEGVVNDATSVVLFNAIQSFDLNQLNPSIALHFLGNFLYLFVASTLLGVVTGLLSAYVIKKLYIGRHSTDREVALMMLMAYLSYMLAELTYLSGILTVFFCGIVMSHYTWHNVTQSSRITTKHSFATLSFVAEIFIFLYVGMDALDIEKWKFVSDSPGTSIAASSVLLGLILLGRAAFVFPLSFLSNLTKKSQHQKISFRQQVIIWWAGLMRGAVSMALAYNQFTMSGHTQLRSNAIMITSTITVVLFSTVVFGLLTKPLIRLLLPHPKITSSMTTTESTTPKSFIVPLLGDSRDSEADLEGHEIHRPNSLRALLSTPTHTVHRLWRKFDDSFMRPVFGGRGFVPVEPGSPSERNGNQWG

SEQ ID NO: 93299 - protein, 565 aa, Gibberella zeae PH-1
MLRQFSAGLPKARASCSKVLGQASKFSMARRSMATVKVKGIEKDPTELDKVTTLPNGLRVASEALPGSFAGVGVYIEGGSRFENDSLRGVSHIMDRLAFKSTSKRSADDMLEQVEALGGNIQCASSRESMMYQAATFNNAVPQTIELLAETIRDPQITDLEVAEQIETARYEIREIWSKPELILPELVHTAAFKDNTLGNPLLCPEDRLGSIDKNTVMAYRDLFYRPERMVVAYAGIEHSEAVRLTEKFFGDMKKGARQITEATGSETSESELSDSEASASSASSSPQQSSGLLSRFFKNTPSAPQNLNNLPSQADIIRPSKYTGGFSWLPAQPPNLSGLPTFTHIHLAFEGLPVSSDDIYALATLQTLLGGGGSFSAGGPGKGMYSRLYTNVLNQHGWVESCMAFNHSYTDSGLFGISASCLPGRTAAMLDVMCQELRALTLTTGFSRLQETEVARAKNQLRSSLLMNLESRMVELEDLGRSIQVHGRKIPVKDMCRRIENLTVADLRRVATMIVGGQVKNPGGGSGAPTVVLQEAQAYGVSSHTMSWDQIQDRIDSWKLGSLS

SEQ ID NO: 93300 - protein, 232 aa, Physcomitrella patens subsp. patens
MPKRTTHTYSSEDAAPGGPESELFVYYCKHCGAHVLITDTQLQKMPKRKTDRAYVLDRNKHLSRLNVVEAGKHLLKRGEGKVEKQYRMKCNGCGLFVCYRCEEDLEAAPYLYVTDGALSSVAAETNPQDAPVPPCISQIDGGLVQVGIEVEDRAQRSQITRVNADDVRVTVAAPAARGEANNELLEYMGKVLGLRLTQMTLQRGWNNKSKLLVVEDLTVREVYEKLLAAVQP

SEQ ID NO: 93301 - protein, 235 aa, Triticum aestivum
  misc_feature (210)..(210): Xaa can be any naturally occurring amino acid
MTPSLQDAKITFLGGGNMAAAIIGGLLAKNTNKQNIYVSEPWDVNRNKMADLGVRTTADNKEAAADADVVILAVKPQVAKGVCEELSSAWAGRDSLPVVISIAAGITLASIAQWFKGDSGKAPHIVRVMPNTPALVGEGASGLYAAEDVTAAEKELTSALLGSVSKATEWVDKEELLDVVTGISGSGPAYFFAFVEHLISSGVSLGLSEXQATRLATQTCLGAGKMLVESSDEPS

SEQ ID NO: 93302 - protein, 132 aa, Helicobacter pylori
SNIKYELDKESGALMVDRVLYGAQNYPTNYGFVPNTLGSDGDPVDALVLSDVAFQAGSVVKARLVGVLNMEDESGVDEKLLALPIDKIDPTHSYVKDIDDLSKHTLDKIKHFFETYKDLEPNKWVKVKGFEN

SEQ ID NO: 93303 - protein, 239 aa, Brassica napus
  misc_feature (233)..(233): Xaa can be any naturally occurring amino acid
MMAETGGVIPTIDLEEVISDKTLNQKIREASERWGCFRVMNHGVSLSLMSEMKKTIMDLFERPHEVKVRNTDVLLGIGYRAPYDINPYYETFGLYDMASPQAVDTFCDQLDASADQREIMVKYAKSTDGLAKDLARRLAESYGLAETDFFKGWPSQLRINKYHFKPEAVGKLGFHLHTDSGFLTILQADENVGGLEAMDKASGKFFPISPMPNTLAIILGDMATIWSNGRWCXVKHRVH

SEQ ID NO: 93304 - protein, 724 aa, Oryza sativa
ACVLPPPKRSSCANYARVVNHILQGLTNLQLWLRIPLEKSEPMDEDHDGAKDNSDMVGYSLIRSTLPSMNSLGRWFGEPAFLTNARGYPCLSKRHQKLLTGFFNHSVQVIISGRSNHNVSQGGVLSGDENHTEDTAVRHALSPYLDYIAYIYQRMDPLPEQERFEINYRDFLQSPLQPLMDNLEAQTYETFEKDTVKYTQYQRAIAKALVDRVSDDDVSTTKTAAEETGRKLKVYAVEKNPNAVITLHSLIKLEGWESLVTIISSDMRCWEAPEKADILVSELLGSFGDNELSPECLDGAQRFLKPDGISIPSSYTSFIEPITASKLHNDIKAHKDIAHFETAYVVKLHRIARLAPTQSVFTFDHPNPSPNASNQRYTKLKFEIPQETGSCLVHGFAGYFDAVLYKDVHLGIEPNTATPNMFSWFPIFFPLRKPIYVPSKTPIEVHFWRCCGATKEKGEERERIEGIGEEDMTCEGIEEEDMTCEGIEGERECEQTADLSPLMEETATAAAAAEKASSYRYWVREATGDAAPLPVPRKLDATAAAAANGNGNPPPLGSVWNQAGTWEEKNLNSWANSRIKEMLGSLDSLEFPTGKASLDGVSKCIGDAFLVTVRNKKRVGYTYELSLKFKGEWLIKEEKMKVKGHLDIPEFSFGELEDLEVEVRFTDDKGLASDDKRQICKDLKSFLSPIREKLRAFEEELKDRSLKVPYFSQYPIACNCDCML

SEQ ID NO: 93305 - protein, 250 aa, Leptospira interrogans serovar Copenhageni str. Fiocruz L1-130
MDMSFRDHFSSHSSFYSEFRPGYPKDLFYYLKNLSPHGKTVWDCGTGTGQAAVPLGELFEKVIASDPSENQIVNAEPHQNVEYRVCKAENSTLGNHEVDLITVAQAFHWFDFNPFYKEVIRVGKKKGILAIWGYGLHSISSEIDGLVDKLYGEIVGPYWPSERKYVEEKYKTIPFPFEEIVPPHFSMKEEWNVDQLLGYLRTWSSVQKYIQKNESDPVLLVEEYIRNSWGPTQTKIVEWPLFFKIGRLPD

SEQ ID NO: 93306 - protein, 382 aa, Escherichia coli O157:H7 EDL933
MFKSDAARTRQRLSARKGRTLPPGRGKFPHSTTESFRNTFWLKKIMEHCFNMVDQQTTTAQTNANFLQIRFTTMSKKIAVIGECMIELSEKGADVKRGFGGDTLNTSVYIARQVDPAALTVHYVTALGTDSFSQQMLDAWHGENVDTSLTQRMENRLPGLYYIETDSTGERTFYYWRNEAAAKFWLESDQSAAICEELANFDYLYLSGISLAILSPTSREKLLSLLRECRANGGKVIFDNNYRPRLWASKEETQQVYQQMLECTDIAFLTLDDEBALWGQQPVEDVIARTHNAGVKEVVVKRGADSCLVSIAGEGLVDVPAVKLPKEKVIDTTAAGDSFSAGYLAVRLTGGSAENAAKRGHLTASTVIQYRGAIIPREAMPA

SEQ ID NO: 93307 - protein, 502 aa, Lepidium virginicum
MRINLNPANAGLDLDVSIGENKNLGRIAQIIGPVLDVAFPPGKMPNIYNALVVKGRDTLGQEINVTCEVQQLLGNNRVRAVAMSATEGLKRGMDVVDMGNPLSVPVGGATLGRIFNVLGEPVDNLGPVDNRTKAPIHKSAPAFIQLDTKLSIFETGIKVVDLLAPYRRGGKIGLFGGAGVGKTVLIMELINNIAKAHGGVSVFGGVGERTREGNDLYMEMKESGVINEQNLAESKVALVYGQMNEPPGARMRVGLTALTMAEYFRDVNEQDVLLFIDNIFRFVQAGSEVSALLGRMPSAVGYQPTLSTEMGTLQERITSTKKGSITSIQAVYVPADDLTDPAPATTFAHLDATTVLSRGLAAKGIYPAVDPLDSTSTMLQPRIVGEEHYETAQQVKQTLQRYKELQDIIAILGLDELSEEDRLTVARARKIERFLSQPFFVAEVFTGSPGKYVGLAETIRGFKLILSGEFDSLPEQAFYLVGNIDEATAKATNLEMESKLKK

SEQ ID NO: 93308 - protein, 188 aa, Prochlorococcus marinus str. MIT 9303
MTGSSPSSTLGQGQRLILLFTALGLAVVLFLLRGGLNAEAPLEQLARRSLDPDVALTNGRPTVIEFYADWCQACREMAPAMLTTERERETQLDVVLVNVDNPRWQDLVDRYDVNGIPQLNFFDNKGKLQGLSLGARTQEQLQQLTDALIQNQPLPKFAGVGAISNLNASQERTEKQNDLEAIGPMSHG

SEQ ID NO: 93309 - protein, 256 aa, Streptomyces hygroscopicus
MLPPAPGIDDVSDRAALVTGGSGPLGRAIAQQLSRSGYAVGVHAHRNEEAAAAVAEELRTAGAAAVALSADLTRPDSGRRVVGRVVEEFGRLDALVVNAGVHRDRLLLGVPEDEWDEQIAVNLSGAFRCLQAGVRAMTRHAGGRVVLVSSVAGLRGQPGQAAYAAGKSGLHGLAWTVAREYGRYGITCNCVAPGLVADTPAYHLLPARARDEVVSRTPLGRAGRAEEIASVVAFLCSSSASYVTGQVIAVDGGMTA

SEQ ID NO: 93310 - protein, 521 aa, Magnaporthe grisea 70-15
MPPPPNRFPTGPTTISPYQHQFPPHGQGHAGGHPPPLGNPAYINPNAQLNPFAANGALSLAAGLNAASGFGAHDASGLGSHAARLGFSQGATLQQHHQQQQQQHHPQQSHGVMVDHPTRNQTKGRIREVWKHNLHEEMAVLRDLIERYSYISMDTTFPGVVCRPMGSFRSKRDYHYQCLRANVDMLNVIQIGITLFNEDGENPPARPNSTDVAELLGAAGRRSAQQGPLPYTWQFNFQFSLKDDMYSQSQIESLLQAGIDFVALERDGINPKEFASLMISSGMVCDESISWISFHSAYDFGYLLKLLWCNMLPEDQDEFKQLLRLFFPNVYDVKYFMKHQMKPLNAIGFQGIDGAIVDALQKFDHKSTLETLAEVLKVKRTGPAHQAGSDSLLTGRAFFQMREKVFGGKLPEDILGQVWGLEDSEPGPSMSLASANAAAAANQGESGANGTQGHHLQHHQQQQQQNGPSTPNTVSASLVTTPGAVSHSHNTNGMGAAGMGPMTPGGGGGAFGHFAFSSHQR

SEQ ID NO: 93311 - protein, 250 aa, Mycoplasma hyopneumoniae 232
MAIIKNEFEISQLKIAGKILAEVKAKIYDFVRPGISLKELDAIAFEEIKSRNAKPAFLNYHGFPATICASVNEILIHGIPSEYVIKENDLVSIDLGLSYNGFFVDSAFTKSLGPDQENQKLINCAKEAFFAGFKAIKPGAKTGDIGFAINNVIKSYGFFTPYEFSGHGIGKKLHENPNIYNFGIPKKGIELVDNMVICIEPMILQTSPHIKILKDGWSVKAKDGRKTSHYEETILIKDGRGIILTEMAQN

SEQ ID NO: 93312 - protein, 145 aa, Oryza sativa
KGIWPIKPDDAHVVAHHDRLLRKASEHRHSENVRDIVSVSKTCQGARPSVRGLLPSLSAYEIGQLLAMYEHRIAVQGFVWGINSFDQWGVELGKSLASQVRESLHASRVEGKPVLGFNSSTTSLLTRYLAVEPSTPYNTTTLPKV

SEQ ID NO: 93313 - protein, 424 aa, Desulfitobacterium hafniense Y51
MYQKTVLPNGVRIITEEIDYVRSVAVGIWVGAGSRDEKEGYEGISHFIEHMFFKGTKNRTARDIAESLEAVGGQLNAFTTKEYTCYYAKVLDEDMDLAMDVLNDMFFESLFDENEIEKEKKVVIEEIKMYEDSPDELIHDLFSDHVWNDHPLGRPILGTEESVKGLSREKILTFMDHHYAPDNLVIAVAGKIKHDEVLKKLAPLYGEFKRGGRRILEETPKGQQVQEMILKDTEQMHLILGVPGLGQEDEDLYPMHILNNILGGGLSSRLFQEIREQRGMAYTVFSYHSTYVDTGLFAIYAGTTPSNSQEVVECVLAEILDIKKNGISQSELQRTKSQIKGGLYLGLESASSRMSRLGKTELTYNRVISPEEVVEKLERVTVEDTKRVINRLWKRDKISLLMLGPAGNEVDMDALFEKIGWDEE

SEQ ID NO: 93314 - protein, 249 aa, Thermoanaerobacter tengcongensis MB4
MYKVVLLRHGESIWNMENRFTGWTDVDLSPKGIEEAKQAGKILKEKGFTFDAAFTSVLKRAIRTLWIVLDELDLMWIPVYKSWRLNERHYGALQGLNKAETAKKYGEEQVKLWRRSAEVRPPALTKDDPRYPGNDPRYADLSEDEIPLTENLIDTINRVIPYWESTIAPTIKSGKRVIIAAHGNSLRGLVKYLDNLSNEEIMELNIPTGIPLVYELDENLKPIRHYYLADEEELKKKQQEVAEQGKARA

SEQ ID NO: 93315 - protein, 634 aa, Zea mays
ISPKVSHFGVNPKARWRVRSYKVLLQCNASLPLVGADVSEVDDPLRVAPLVVVPGDDLDHVVAHDHGEGGVDGGGDVGAPEVDGHERHVADLEDARELVGRGVAERLVHLLGEGLLGDLHDEVDDGDVRGGHPERDPVELALKVGEHQRDGLGGTGGRQETDERLFYKLLIDNVVELLPFVYTPTVGEACQKYGSIFGRPQGLYVSLKDKGKVLEVLRNWPHRNIQVICVTDGERILGLGDLGCQGMGIPVGKLALYTALGGVDPSVCLPITIDVGTNNEKLLNDEFYIGLRQKRATGEEYDELIEEFMSAVKQFYGEKVLIQFEDFANHNAFDLLEKYSKSHLVFNDDIQGTASVVLAGLLAALKMVGGTLAEQTYLFLGAGEAGTGIAELIALEISKQTNAPIEECRKKVWLVDSKGLIVDSRKGSLQPFKKPWAHEHEPLKTLYDAVQSIKPTVLIGTSGVGRTFTKEIIEAMSSFNERPIIFSLSNPTSHSECTAEQAYTWSQGRSIFASGSPFAPVEYEGKTFVPGQSNNAYIFPGLGLGLVISGAVRVHEDMLLAASKALADQATQDNFEKGSIFPPFTSIRKISAHIAAAVAAKAYELGLATRLPPPSDLVKYAENCMYTPVYRNYR

SEQ ID NO: 93316 - protein, 232 aa, Stephanomeria exigua subsp. coronaria
GGRYSVCSAVGVLPLSLQYGFPVVEKFLKGARSIDQQFLSAPFEKNIPVLLGLLSVWNVSFLEYPARAILPYTQALEKLAPHIQQVSMESNGKGVSIDGVRLPFEAGEIDFGEPGTKGQHSFYQLIHQGRVIPCDFIGIVKSQQPVYLKDEVVNNHDELMSNFFAQPDALAYGKTPEQLQSENVASHLIPHKTFTGNRPSLSLLLPSLDAYRIGQLLAIYEHRIAVEGFIWG

SEQ ID NO: 93317 - protein, 528 aa, Ehrlichia ruminantium str. Gardel
MSKVAIIDFGSQFTQLLARRIRDLNIYSEIFLPNVAFDLIKGVDAFILSGGPRSVPNSDGIPKIVHDILQFNEKTSIPVLGICYGLQILSNYFESDVVSNCNKEFGKTILNIIKNSKIIENIWESGDQAYVWMSHADSVYNIPRGFEVIAYSVLNNSIAMVANEQRRIYGMQFHPEVYHTPDGINLLANFLDIAGCQKDWTVTSFIDDQQDAIKKQIGNKKVIAALSGGVDSSVAAALTYKAIGDQLHCVFIDNGLLRYNEVEKVKQLFINELKIPVTIVDKSAVFLNRLKSITDPERKRKIIGETFIEIFEEEANKLEGVEFLMQGTIYPDVVESGGSGSIAKESVVIKSHHNVGGLPKTMKFKLVEPLKYLFKDEVRILGRNLGISTEILMRHPFPGPGLAVRIIGEITEEKVKMLQAADDIYINLIKKYELYDVMWQAFVVLLPVKTVGVMGDRRTYGHACVLRAVNSHDGMTAESFPFCMDEETQWKFFKCIQEASNAIINSVNGINRVAYDITSKPPATIEWE

SEQ ID NO: 93318 - protein, 168 aa, Clostridium acetobutylicum ATCC 824
MIYSYDDKKPNIHSSVFIAKSADIIGDVNIDKNSSVWFGAVIRGDSNYIRIGEGTNIQDNSVLHTNTYDNGIDIKNNVTIGHGVILHGCTINSNCIIGMGATILDDVEIGEYTIVGANSLITSGKKIPGGVLCMGSPAKVIRELTVDEKLEIDKNAEHYIEMGKKYFK

SEQ ID NO: 93319 - protein, 479 aa, Methanosarcina acetivorans C2A
MVAMKMQINGKAVEACGGEVFGIKNPATGELIEQVPRGTEEDVAVAVEAASSAFTGWASASPQQRGEVLYRAAEIVRQRKDELASLLTQEQGKPIVEARNEIEGFAHVLEYYCGLSGSQRGDFIPVPGNGYAFTVKKPLGVCAAIIPWNMPALIMGWKIAPVLISGNTLVLKPASNTPLTNLTLASIFVEAGLPAGVLNVVTGPGETVGESLVRSPEVRKISFTGEARTGKRVAELAACGMKRITLELGGSDPMLVCDDADLESAAAGALRGRFYNCGQTCTAVKRLYVFESVAEEFIKKLETGIKSLRLGNGMDKNISMGPLNNRTQWEYIKELAAEIEEKDAGRIITGGKVPEFKDSEKGYFFEPTLVSDVPGDSRLLKEEVFGPLLPVVTVKNLDEAIVGANSTCYGLGASIWTKNIDRARKGCEQLNAGIIWINQHLKVAPEVPFGGVKESGFGRENGPESLSEYLETKTIMLKI

SEQ ID NO: 93320 - protein, 366 aa, Nicotiana tomentosiformis
NQADDEENTQTADIERRIEQETKADKHIQKLLLLGAGDSGKSTIFKQIKLLFQTGFDEAELKNYIPVIHANVYQTIKVLHDGSKELAQSELEASKYLLSAENKDIGEKLSEIGGRLDYPHLTKDLVQDIEALWKDPAIQETILRGNELQVPDCAHYFMENLQRFSDINYVPSKEDVLFARIRTTGVVEIQFSPVGENKKSGEVYRLFDVGGQRNERRKWIHLFEGVTAVIFCAAISEYDQTLFEDERKNRMMESKELFEWVLKQPCFEKTSFMLFLNKFDIFEQKALKVPLNVCEWFKDYQSVSTGKQEIEHAYEFVKKKFEESYFQCTAPDRVDRVFKIYRTTALDQKLVKRTFKLVDETLRRRN

SEQ ID NO: 93321 - protein, 427 aa, Aspergillus oryzae
MDDTNGAIGASAPLLRGLDSEPLTSIPPIIVRYRHGRDGSIRFVSHTKHALCHSWVNVLLVFVPVGIAVKAVGLSAGLIFAMNAIAIIPLAGLLSHATECVASRLGDTIGALINVTFGNAVELIIFIIALVKDEIRVVQASLLGSILANLLLIMGMAFLLGGLRFQEQIYNSTVTQMSACLLSLSVMSLLLPTAFHASWSDNTAADKYTLKVSRGTSVVLLLVYVLYIVFQLKSHSYLYASIPQQIIDEESHPGVLADFMNHSSDSSSIVMLLLSTGLVAVCAEFLVDAIPEMIESSSVSEAFIGLIILPIVGNAAEHVTAVSVATKNKMDLSIGVSVGSSIQIAIFVTPLVVILGWCMDKDMSLYFTLFETISLFVTAFVVNFLVLDGRSNYLEGALLIAAYVIIGVAAFFYPPASQSSDVASAGY

SEQ ID NO: 93322 - protein, 402 aa, Rhizobium leguminosarum bv. viciae 3841
MSTFVPASRVSRIKVSPSTAAAARARELKAAGRDIVDLTVGEPDFDTPDNIKAAAHAAIDRGETKYTAVNGTPALRKAIIGDIKRRLGLSYADNEICVGGGAKQILFLALMASVENNAEVIIPAPYWVSYPDMVIANEGKPVIIECPQETGFKLTPEALERAITPKTLWLVLNAPSNPTGAAYDRSELEALGKVLLRHPHVFVLSDDIYDQVWFKDEPMTTLVAAVPELKERVLLTNGVSKSYAMTGWRIGYAAGPAVLIAAINKLQSQMSSCPSSVSQAAAAYALSSDQSFVTESVTVYRKRRDYACSRLNAVPGLSCLVPDGAFYLFPNCAGVIGKKTPEGKTIETDLDFVLYLLDGVGVAALQGAAYGVSPHFRLSIATSMEAITQACDRIERAVADLY

SEQ ID NO: 93323 - protein, 211 aa, Ehrlichia ruminantium str. Gardel
MGIIVSENPSFISSIEDIIEDAKAGKVFVLIDDEQRENEGDLVVLAEKVTTDAINLMVTHGSGIVCLSITEDLMYKLGLELIPRRNINNNSASFATSIDARYGITTGVSVHDRVRTILTAVSKNVTMDDLVTPGHIFPIVSKKGGVLERLGHTEASVDIARIAGLTPAAVVCELMNPDGTMSRLSDIIEFSQRYDIKVTTIAKLVEYINTH

SEQ ID NO: 93324 - protein, 205 aa, Oryza sativa Japonica Group
MQRAIQAIGSHGSLLKSAVLRHISAPKPSILPAVYSRSMSVSSAQIEESGFETATVADILKSKGKSADGSWLWCTTDDSVYDAVKSMTQHNVGALVVVKPGQDKSIAGIVTERDYLRKIIVQGRSSKSTKVGDIMTEENQLITVKPDTRVLQAMQLMTEKRIRHIPVIDGTGMVGMVSIGDIVRAVVSEHREELNRLNAYIQGGY

SEQ ID NO: 93325 - protein, 244 aa, Thiobacillus denitrificans ATCC 25259
MEKTTHFGYQEVAESEKAAKVAEVFHSVAAQYDIMNDLMSAGLHRLWKRFAVAQAGLRPGMKVLDVAGGTADLTRLFLKEVGASGTVLLTDINFSMLREGRDRMLNEGRTPPAVQCDGERLPFPDDYFDCVSVAFGLRNMTHKDQALAEMHRVLRPGGRLLVLEFSKVWKPLEAAYDLYSFKLLPLMGRLVANDAASYQYLAESIRMHPGQEELKAMMESAGFARVSYHNMTAGVVALHKGYKV

SEQ ID NO: 93326 - protein, 378 aa, Yarrowia lipolytica CLIB122
MSHSHPVRRILSPKDLEIFGASDTKKQVFGFVKVLNYYVVGKGNSYETLKHPIIGKLVAILDKVIDLVAKYPPEDATSSRFGKPEFRDFHQALEENAKDWISDLGELEDWQLVELCTYFAASFGDRTRIDFGSGHELNFICFLFCLRQLGLLDVPEYNPEVHDPTGEAKNAKCVEDETDSSAAVLTVFVQYLKTMRAVQASYWLEPAGSHGVWGLDDYHFLPFMFGSAQLACHKYLRPLSIHDMEMLDMWKHEYLYMGCIHFINSVKTTASLRWHSPMLDDISGVKTWAKVNQGMVKMYDAEVLSKLPILQHFMFGQLIKAPEGVSPPPDPNAEVQHIHNHWADCCGIKVPSAIAASEMSQKPGDLRKLRGSGVLPFD

SEQ ID NO: 93327 - protein, 128 aa, Zea mays
MSQETVNPKAYPLADSQLTITILDLVQQAANYKQLKKGANEATKTLNRGISEFVVMAADTEPLEILLHLPLLAEDKNVPYVFVPSKQALGRACGVTRPVIACSVTSNEGSQLKQPIQSLKDAIEKLLI

SEQ ID NO: 93328 - protein, 63 aa, Aureococcus anophagefferens
MRGILVDWLVEVHLKFKMLQPTIYLTVQIIDRYLSAKQIDRNQLQLLGVAALFIASKYEEIYP

SEQ ID NO: 93329 - protein, 255 aa, Coccidioides immitis RS
MPPKSKPKATNNPKSKSSSEPTKSHRQEPAPPNWPLLKPLIPSTDLALETILSDQIYVVRNLFTSTLCKNYVSFLSTLPLVTTPGRPKRGEAVRVNDRFQIDDPVFAERLWKETALSQVVSGQSADADSAEGKDLWGGEVLGLNPNIRVYRYSKGQFFGQHYDDSVSLHLPSLADRSLPGGETVFYPEPVLSSKKNGSKSKPLKDNNVDMDPIAVELEVGMALLHRHGDKCLLHEGREVKQGEKWVIRSDLVVRR

SEQ ID NO: 93330 - protein, 118 aa, Glycine max
VTAAFAFSGTELVGLAAAETKNPLKSLPGAVRQVFWRITLFYVLGLLFVGLLIDSTDPRLLGSGALIDVTASPFVLVGEYAGLKGFDSFMNVVILVSVVSIGVSGVYGGSRTLTALAE

SEQ ID NO: 93331 - protein, 63 aa, Alexandrium tamarense
MRGILADWLVEVAEEYKLCADTLYLSVNYIDRFLSIHPVQRSNLQLVGIACMWIASKYEEIYP

SEQ ID NO: 93332 - protein, 64 aa, Isochrysis galbana
MRGILADWLIEVHHKFKLHIETLYGSVDLIDRYLSKCAPITRSKLQLVGVAAMFIASKYEEIYP

SEQ ID NO: 93333 - protein, 232 aa, Stephanomeria exigua subsp. coronaria
GGRYSVCSAVGVLPLSLQYGFPVVEKFLKGARSIDQQFLSAPFEKNIPVLLGLLSVWNVSFLEYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVASHLVPHKTFTGNRPSLSLLLPALDAYRIGQLLAIYEHRIAVEGFIWG

SEQ ID NO: 93334 - protein, 167 aa, Triticum aestivum
MLRGAHGGQYGLVPNSARGEDDDDEGVEGEEKGSAPQQVVDISDEDDGGGDEEEGGDDDDDDDDDDDDEEDDDEVDEEEEPEEELGTEYLVQPLGRAEDEEHSSDFEPEENGDGAEDEEIEDDDAEDGEDSVKAQSSSKRKRSGAEDEDDDDGDDDGDDDEKPPSKR

SEQ ID NO: 93335 - protein, 387 aa, Streptomyces kanamyceticus
MNDHPTTPRHKRPSPSRRTFLTAAAAATAGAALVGAEAWAGSTPGPRGAARAGSFAVPAEDVRHTKTWMAWPDSSAIWGRQLGGVQADIALIARTVAKHEPVTLCANPASAAKARSLCGSSVEIITSVPVDDCWMRDSGPVFRTDGAGGLDAVGLHFNGWGGKQQHAKDARVAERIAALAGVRFTGAGLVGEGGAIEQDGAGTLMATRSSLLNGNRNPGMSEAHLTDAMCEAYGADQVIWFDGVRGQDITDDHVDATSRFLASGRALVQWPLDADDDAYAKDARAQFRVLSAATNAEGQPIAATKLQGPDYDKIRSRDPKFLASYANYYLCNDAVICAHFGDSTADAAAKAALARLYPGRTVEQIDIDRLGAGGGGIHCVTQQQPAP

SEQ ID NO: 93336 - protein, 63 aa, Prorocentrum minimum
MRGILTDWLVEVAEEYKLCADTLYLSVNYIDRFLSIHPVQRSNLQLVGIACMWIASKYEEIYP

SEQ ID NO: 93337 - protein, 393 aa, Thermoanaerobacter tengcongensis MB4
MITYEKKYLMDTYNRYPIMLVKGEGTRVWDSEGNAYLDFVAGIAVNSLGHCHPALVEAIKKQAETLIHCSNLYWNEKQIELARMISENSFGGKVFFANSGAEANEGAIKLARKYASLKYGGKRYKIITAKNSFHGRTFGALTATGQEKYHKGFGPLLAGFKYVPLNDIEALYEAVDDEVCAIMLEVIQGEGGIHEATPEYVKAVRKICDENDLLFILDEVQTGIGRTGKLFGYEHYGVVPDIMTLAKGLGGGFPIGAIVAKEDKAVFKPGDHASTFGGNPLACAAGIAVLNEVTKDGFLEGVDKKGKYFREGLETLQKKHKVVKEIRGKGLMVGCEVDLEDASEIVLKALEKGLLINSVSHNVLRFVPPLIVTEEEIDEALQILDDVLSEIRF

SEQ ID NO: 93338 - protein, 151 aa, Stephanomeria exigua subsp. deanei
  misc_feature (128)..(128): Xaa can be any naturally occurring amino acid
HIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVASHLVPHKTFTGNRPSLSLLLPSLXAYRIGQLLAIYEHRIAVEGFIWG

SEQ ID NO: 93339 - protein, 299 aa, Thermoanaerobacter tengcongensis MB4
MIRKEKFGDEILKAHILVEALPYIKKFSGKTVVIKYGGSAMLDCNLKKMVMQDVVLMKFVGLNPVIVHGGGPEISSFLKKLGIESKFVNGLRVTDEKTAEIVEMVLVGKINKEIVSMINELGGMAVGISGKDGKLLKAEKDLSNGDLGYVGKIVEVNIEVIEMLIDRGYIPVIAPVSFGDDGKTYNVNADTAAGKIAEALKAEKLILLTDVEGVLENVEDKTSLISRMDLEHAKKLMDSGRINGGMIPKLKCCIKAVENGVKRAHIIDGRLTHSLLLEIFTDEGIGTMIGKECFDDDNL

SEQ ID NO: 93340 - protein, 63 aa, Prorocentrum minimum
MRGILVDWLVEVAEEYKLCADTLYLSVNYIDRFLSIHPVQRSNLQLVGIACMWIASKYEEIYP

SEQ ID NO: 93341 - protein, 377 aa, Oryza sativa
MAVSQRIQQSSFAGSKAGLKKAAVRAAPVRAVGSSIRAEKKIKVAINGFGRIGRNFMRCLETRTDSLLDVVAINDSGGVKQASHLLKYDSTLGKFDAEVKVVDDGHISVNGKVIRVVSSRDPTKLPWGDLDIDLVIEGTGVFIDTPGASKHIQAGAKKVLITAPAKGSDIPTYVVGVNAHDYKHSDAIISNASCTTNCLAPFVKVLDEKFGIVKGTMTTTHSYTGDQRLLDASHRDLRRARAAALNIVPTTTGAAKAVALVLPKLKGKLNGIALRVPTPNVSVVDLVVQVEKKTFAEEVNNAFKEAANGALNGVLAVGDEPLVSVDFRCTDVSSTIDSSLTMVMGDDMVKVVAWYDNEWGYSQRVVDLAELTAQKWE

SEQ ID NO: 93342 - protein, 264 aa, Candidatus Pelagibacter ubique HTCC1002
MFFNLFIIILFILFILFILSVIRIYQMAHLILVRHGQSEWNLEKRFTGWVDVDLTGQGKLEACKAGENIKETKIDIDYFYSSFQLRAINTLKFIQDTLRDKREPVKAWQLNERHYGALTGLNKDEMKEKLGEDKIHAFRRSWDIKPNPLSRNNPYHPLNIEVYKSIPKENIPDTESLKDTYDRVMKFYIDEIQMKLKNDKNILISAHGNSIRALCKFLFKLDNQRITLLEIPTGNPLLINLDSKQNIKECTYLNQDRAKDLLVF

SEQ ID NO: 93343 - protein, 427 aa, Ralstonia solanacearum GMI1000 [sequence omitted]

SEQ ID NO: 93344 - protein, 320 aa, Streptomyces kanamyceticus
MAWPTRVDLWDGVLDQVQGEYAQVARAIAEFEPVTMVAPPGYGDAARARCGDGVDVLELPLDDSWFRDSAPLFVLDGDGHRAGVDFRFNAWGRKHHPYDSDDRISALLLDHLGVERLPSDMILEGGAITVDGEGTLITTEQCLLHPNRNPDLSRAEIEAELKSLLGVEKVIWLPYGGLLDTETDGHVDGVCAFAAPGKVVVSLPADPAHADHARMRANRAVLAASTDAKGRPLEIVDVPQTVFTEVTGGEVEVSYLNYYVANGGVVVPVAGLPADEDALAVIAAAYPGRKVVGVRAAAVAYGGGGVHCITQQIPAARPSA

SEQ ID NO: 93345 - protein, 337 aa, Oceanobacter sp. RED65
MTIKIGINGFGRMGRLTMRAAFDWDDIEIIQINDPAGDATTLAHLLTFDSVHGRWHHDATADDNTMLIADKRIPCTQNKTIEETDWSQCDIVIEASGKMKSKAVLQDYLAQGVKRVVVTAPVKEDGVLNVVMGVNDHLYDPQKHSIVTAASCTTNCLAPVVKVIHENLGIEHGSMTTIHDITNTQSILDQPHKDLRRARACGMSLIPTTTGSATAITHIFPELKGKLNGHAVRIPLANASLTDCVFEVKKHTTEEEVNQLLKAAADNELKNILGYEERPLVSIDYKTDPRSSIIDALSTMVVNGTQVKLYAWYDNEWGYANRTAELARKVGEIDSLG

SEQ ID NO: 93346 - protein, 444 aa, Rhizobium leguminosarum bv. viciae 3841
MDQISKTNAPVLENFWMPFTANRQFKATPRLLAAAEGMYYTDVDGHQVLDGTAGLWCCNAGHGRKKIAHAVERQLATLDYAPTFQMGHPIAFDFASKLAANAPGGPEAKLDRIFFTGSGSESVDTALKIAIAYQRAIGQGTRTRIIGREKGYHGVGFGGISVGGLVNNRRVFPQIPADHMRHTLDIERNAFSKGLPAHGVELADDLERLVQLHGAETIAAVIVEPMSGSAGVVLPAKGYLEKLRATADKHGILLIFDEVITGFGRLGTPFAADYFGVVPDLITTAKGITNGSIPMGAVFASRKVYDGLMVGPDNAIELFHGYTYSGHPVACAAGLATLEIYEEEGLLTRAADLAEYWQEALHSLKGLPHVVDIRNLGLVGAVELASRDGAPGTRAYDIFVDCFNKGLLIRVTGDIIALSPPLIIEKSQIDTIVSILGDALKRAA

SEQ ID NO: 93347 - protein, 257 aa, Streptomyces scabiei
MDNVSGMLPGRTVMITGASGGIGAAAARLFAAEGASVVLMARRKDRLEALAEEITAAGGRAASIPGDVRRPDDVARAVARAVEQFGSLDAAFNNAGWGSVGAVLHELDDSAYDMAMDVNVRGVWNCMREEIPVMLGQTDGGVVVNMSSVAGHSATGASAPYVAAKHAVLGLTRAAAAEYGDRGVRVNALMTGGTRTDLLEPYIANAPEVEAGMTRRAIQKRLADPHEIAQVAVWLCSDRASFVTGGAIPVDGGWSAV

SEQ ID NO: 93348 - protein, 489 aa, Prochlorococcus marinus str. MIT 9211
MSGSKSPATIKNICCIGAGYVGGPTMAVIADRCPSIQVKVVDINQSRINAWNSSDLTKLPVYEPGLDLVINRARHRNLHFSIEVEKAISEADMVFISVNTPTKTKGLGAGKASDLKWVEACARQVANFAKGHTIVVEKSTLPVRTAEVIKTILEAAQSSLDRDLNSPTFEVLSNPEFLAEGSAIHDLEEPDRVLIGGENSQAINSLAWIYQHWVPEEKILRTNVWSSELAKLTANAFLAQRISSINSIGALCEATGADVREVARAIGTDSRIGSKFLDAGPGFGGSCFKKDILNLVYLSRYFGLPEVADFWEGVVDLNTWHQHRISRLVVKKLFGTLSGKRVAMLGFAFKANTNDTRESSAINIAKDLLDEGAQLSIHDPKVDPKQIAVDLDLPESKSFVSKEFGSNEKLGEGIWCFAKDIADACSFADAVLILTEWHQYSQIDWVEISKKMRNPAWVFDARSIVDSEKVFDAGLQFWRVGDGSERISN

SEQ ID NO: 93349 - protein, 140 aa, Brassica napus
  misc_feature (135)..(135): Xaa can be any naturally occurring amino acid
MALAYDPLFITSDKSAMDVPSTPPPMMLTQDELKRIAAHKAVDFVESGMVLGLGTGSTAKHAVARIGELLRQGKLENIVGIPTSKKTQEQALSLGIPLSDLDAHPVIDLSIDGADEVDPHLNLVKGRGGSLLREXMIEGA

SEQ ID NO: 93350 - protein, 305 aa, Moritella sp. PE36
MLSNASLEELLAEVRPLIGKGNVANYIPALANVDPNQLGIAVCMANGDIFTAGDADTRFSIQSISKVFALTAALTRFSEDELWTRVGREPSGQAYNSLIQLEFEKGKPRNPFINAGALVVADMLQSRLSAPKQRMLELLRKLANSTDIYIDHNVADSEFEHMARNAAIAYLMKSHGNFNNSVETVLQSYFSYCAINMNCVELATAFSFLAKKGIPCHRNKSLVSERCTRRLNALLATCGLYDESGDFAFRVGMPAKSGVGGGIAAVIPGELTVCVWSPELNDSGNSLAGTALLELFSERFGHSIF

SEQ ID NO: 93351 - protein, 526 aa, Prochlorococcus marinus subsp. pastoris str. CCMP1986
MNNDFNSWDKYCNYLWFDKQVNIWLDISKINFTLDQISSLENKFKKVFSALKELEAGAISNIDEKRQVGHYWLRNPSVAPSNLIKDAINNEIRDISEFGEKILEGKITNNKNQKFTNVLWIGIGGSGLGPLLITEALQENSCGLNFSYIDNIDPFLISEKLDELSDKLATTLFVVVSKSGGTPEPKIAMNIIKKHVENKNLDWNSNAIAITMKDSQLYKKAQLENWLKIFNLPDWVGGRTSITSSVGLLPLALINRDVSEFIKGAAIMDDLTRIPNIKDNPAALLSSAWFFSGDGIGKRDMVVLPYRDRLQVFSKYLQQLVMESLGKKFNRKGEIVHQGISVFGNKGSTDQHAYVQQLRDGIDNFFCVFIELLDTPNSNFYFDSENPKEFLSGFLQGTRSALSNENRQSITITLDKLSCLTLGALIALFERAVSFYAELVDINAYDQPGVEAGKKAAAEIIDYQKQVTEIFNNGEELSIKEITSLLRNSSAEPIFFIIRQMCFGNDDYLINGDWSKPSTIRIKKIS

SEQ ID NO: 93352 - protein, 132 aa, Helicobacter pylori
SNIKYELDKESGALMVDRVLYGAQNYPANYGFVPNTLGSDGDPVDTLVLSDVAFQAGSVVKARLVGVLNMEDESGMDEKLLALPIDKIDPTHSYVKDIDDLSKHTLDKIKHFFETYKDLEPNKWVKVKGFEN

SEQ ID NO: 93353 - protein, 197 aa, Bradyrhizobium japonicum USDA 110
MAEREQRGGRDQRGGGRERKEREERDSEFVDKLVHINRVAKVVKGGKRFGFAALVVIGDQKGRAGFGHGKAREVPEAIRKATESAKRNLTRVSLREGRTLHHDIAGRHGAGRVYLRAAPAGTGIIAGGPMRAVFETLGVQDVVAKSIGSSNPYNMVRATFDALKHQDSPRSVAARRNIKVSTLQSRRIGGDAEAAAD

SEQ ID NO: 93354 - protein, 275 aa, Moritella sp. PE36
MITNKKIAFIGAGNMASSLITGMIADGYPAELIYAASPTRSRLDVLAEKFAINTTQDNHAAVAAADIIILAVKPQLMAEVCSHLAEQSSNYRGKLFVSVAAGVTVERLQSLLADNQPIVRTMPNTPALVQKGMTGLFPSPEVSDNDIKTIDQIMMAVGKTCWVDNEADLNTIIAATGSSPAYFFLFMEAMQESIIGMGFSKQQARELVQQAAAGSAELVIQNPHIDLATLRQNVTSKGGTTAEAIRTFEEQDLRGTVNTAMQAAVSRAEEMQKLF

SEQ ID NO: 93355 - protein, 476 aa, Oryza sativa Japonica Group
PRVRPWNFELFKMPRRTDNAASANSVEPEKSEECLEFDDDEEEEVEEEEIEYEEIEEEIEEEEVEEDEDVVEEVEEVDEEEDEEEEEESDETEGVSKTKGVHQKDVTEKGKHAELLALPPHGSEVYVGGISSDVSSEDLKRLCEPVGEVVEVRMMRGKDDSRGYAFVNFRTKGLALKAVKELNNAKLKGKRIRVSSSQAKNKLFIGNVPHSWTDDDFRKVVEEVGPGVLKADLMKVSSANRNRGYGFVEYYNHACAEYARQEMSSPTFKLDSNAPTVSWADPKNNDSASTSQVKSVYVKNLPKNVTQAQLKRLFEHHGEIEKVVLPPSRGGHDNRYGFVHFKDRSMAMRALQNTERYELDGQVLDCSLAKPPAADKKDDRVPLPSSNGAPLLPSYPPLGYGIMSVPGAYGAAPASTAQPMLYAPRAPPGAAMVPMMLPDGRLVYVVQQPGGQLPLASPPPQQAGHRSGSGGRHGGS

SEQ ID NO: 93356 - protein, 58 aa, Skeletonema costatum
MRGILADWLVEVHLKFKLVPETLYLVVNLIDRYLAKKEVTRSKLQLVGVTALFIATKY

SEQ ID NO: 93357 - protein, 231 aa, Moritella sp. PE36
MNSISTRLQQVLTQIENATSASCKKRSEINLLAVSKTKPVEQVMAVYALGQRKFGENYLQEAVEKITHLQQDGNYDDIEWHFIGPIQSNKTRPIAEHFDWVQSIDRLKVAQRLNDQRPADMPKLNVCIQINISAEDSKSGADVQQAHLLAEQVANLPNLVLRGIMAIPEKTADIDKLKSQFSQLESLYLSLQHQYNQIDTLSMGMTNDMELAIAQGSNMVRVGTAIFGARD

SEQ ID NO: 93358 - protein, 399 aa, Bacillus cereus G9241
MLENQINERSLLLHKELVGKIEITSKVEVNSADDLSLTYTPGVAESCKAIAADEETVYDYTARGNMVAVVSDGTAVLGLGNIGPKAAMPVMEGKSILFKKFANVDAFPLCLGTTDVDEIVTLVKNLEPTFAGINLEDIAAPRCFEIEKRLKEETSIPVFHDDQHGTAIVVLAAVINALKVVSKQMDHVKIVINGAGSAGIAIGKLLLKAGAKHITLVSLEGIVCEGEAWMNEAQIEVSKKTNREHVRGTLKEAIHQADIFIGVSAPNVLTKELVKTMNEKAIVFAMANPIPEIFPEDALEAGAAVVGTGRSDYANQVNNVLAFPGIFRGALDVRATDITEEMKLAAAYGIANIITDEERNANYVIPNPLDKRVVPSVAEAVAKAAIDSGVAQITKIPSY

SEQ ID NO: 93359 - protein, 98 aa, Bumilleriopsis filiformis
ATYSVTLVNEEKNINAVIKCPDDQFILDAAEEQGIELPYSCRAGACSTCAGKVLSGTIDQSEQSFLDDDQMGAGFLLTCVAYPTSDCKVQTHAEDDLY

SEQ ID NO: 93360 - protein, 175 aa, Ralstonia solanacearum GMI1000
MALYQLGDAVPTIDDDAYVAPEATVIGRVVLKARSSVWPGAVIRGDNEPIVVGEASNVQEGAVLHTDPGCPLDIGDRVTIGHQAMLHGCTIGEGSLIGIQAVVLNRAVIGRDCLVGAGAIVTEGKVFPDRSLILGAPAKAVRELTDDDIAKMRLNTETYAVRQAMYKQQLKRIDG

SEQ ID NO: 93361 - protein, 147 aa, Stephanomeria exigua subsp. macrocarpa
VSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVASHLVPHKTFTGNRPSLSLLLPSLDAYRIGQLLAIYEHRIAVEGFIWG

SEQ ID NO: 93362 - protein, 384 aa, Streptomyces kanamyceticus
MSHLLPSRRSALRAIAGIGAVVLGASACGPGDSVAGASTAGDEDAVTEGRRMGAEWESHARTFMSWPALESVWEDDLRYVREDIARIARSIAEYEYVVMMARPDQLKAAQKACGRDVEVIPLAVDDLWARDTVPVFVEDDGKVTGIDFNFNGWGNKQEHDNDGQVGRKLLAEYDIPRKKAPLVAEGGSFETDGEGTLLITESSIVNDNRNRGKSRDQIEDELKRTLGIKKVIWLAGVRGQDITDAHVDSLVRFTAPGVVLLDRAHPDTPADSWSRAADQAKSVLSEATDARGKPFEIIDLPQPDLYEITGEGDDFVSTYANFYVANDSVFIPKFGDRKADKRAKSILQEHFPKRDVVQINIDTIASGGGGIHCSTHDEPGKPVD

SEQ ID NO: 93363 - protein, 308 aa, Populus sieboldii x Populus grandidentata
CPNVNNIIRGVLVQALYTDPRIGASLTRLHFHDCFVNGCDGSILLDNTDTIESEKEAAPNNNSVRGFDVVDDMKAALENACPGIVSCADILAIAAEQSVCLAGGPSWTVPLGRRDSLIANRSGANSALPSPFASLDVLKSKFAAVGLDTSSDLVALSGAHTFGRAQCSSFNLRLYNFSGSGNPDPTLNTTYLAELQQLCPQAGNESVVTNLDPTTPDTFDGNYFSNLQTNEGLLRSDQELFSTTGADTIDIVNNFSSNQTAFFESFVVSMIRMGNISPLTGTDGEIRLNCRRVNDNSTGSNALLVSSI

SEQ ID NO: 93364 - protein, 440 aa, Chlamydophila pneumoniae AR39
MSKIVYKFGGTSLATAENICLVCDIICKDKPSFVVVSAIAGVTDLLVDFCSSSLREREEVLRKIEGKHEEIVKNLAIPFPVSTWTSRLLPYLQHLEISDLDFARILSLGEDISASLVRAVCSTRGWDLGFLEARSVILTDDSYRSASPNLDLMKAHWHQLELNQPSYIIQGFIGSNGLGETVLLGRGGSDYSATLIAELARATEVRIYTDVNGIYTMDPKVISDAQRIPELSFEEMQNLASFGAKVLYPPMLFPCMRAGIPIFVTSTFDPEKGGTWVYAVDKSVSYEPRIKALSLSQYQSFCSVDYTVLGCGGLEEILGILESHGIDPELMIAQNNVVGFVMDDDIISQEAQEHLVDVLSLSSVTRLHHSVALITMIGDNLSSPKVVSTITEKLRGFQGPVFCFCQSSMALSFVVASELAEGIIEELHNDYVKQKAIVAT

SEQ ID NO: 93365 - protein, 367 aa, Arabidopsis thaliana
MHLPEDLVLEILSKVPAVSLARFRSTCRRWNALVVDGSFAKKHYAYGPRQYPIVIMLIEFRVYLVSIDLHGINNNNGAPSAKLTGQFSLKDPLSNSSEEVDIRNAFHCDGLLLCCTKDRRLVVWNPCSGETKWIQPRNSYKESDLYALGYDNRSSSYKILRMHPVGNPFHIESEVYDFASHSWRSVGVTTDFHIQTNESYGMNVKGTTYWFALSKDWWSSDDRRFLLSFDFSRERFQCLPLPADVKNLHLTVVLSVTREEQQLCMFATLGAGNVYKLDVFVATKTEETTGELTWTKFRRFHSKICINVSADHEKKVLVPHHILLPYYNILHIVGEDIYIRQVNKDGDIGCPILLTYVPSLVQIQQGI

SEQ ID NO: 93366 - protein, 286 aa, Glycine max
MKLSAKPISSPGRTDKFPPPLMRFLRSNAASRSTRRSKSSPMFVRKKNTTAIETQTQEPSSPKVTCMGQVRVKQAATTSRDLAPPRCRCRCYCCWIRSPNNHPCRCKPLWPNWPSFFRRKPTTLKHHSEPERNFHDQESELPFHERVNVDKDSDFASNSSTPPRNALLLTRCRSAPYRSSSLASRFWSSPVKDQETEFPIPNTTEQQHTSEEPQTEPELGFLREKIASLTEPEKVEEVETETESASSRPTVLTRCKSEPARTGHRLLDPLVNNTSNLLNKRRLEFD

SEQ ID NO: 93367 - protein, 274 aa, Legionella pneumophila
TRVEDTRDLLDNIQYAPTNGRFKIYLIDEVHMLSQHSFNALLKTLEEPPSHVKFILATTDPQKLPVTVLSRCLQFNLKHLPAELINQQLQLILQEERLDFEIQALDILAQAARGSMRDALSLLDQAITSCETKLLASDVKILLGHTQQDYALLLLQALAKQEAPTMLVLSQQIIAEGGNFQYVLDEMLNYLHQITIYQCLGDNNPLISPKAEIKELVKQFSAEDTQLFYQIGIKGREEMHLAPTLAIGFNMTMLRMYTFKPASHVTTPPLAFEQ

SEQ ID NO: 93368 - protein, 170 aa, Glycine max
MGDWAQLAQSVIIGLIFSYLLAKLISIVVTFKEDNLSLTRHHDPEPELKNLKPEVDSRRIESSTGEADSLVAEQGSSRGDSVAGDTEDEDDDWEGVESTELDEAFSAATLFVTTAASDRLSQKVPSEVQQQLYGLYKIATEGPCTAPQPSALKITARAKWQAWQKLGAMP

SEQ ID NO: 93369 - protein, 349 aa, Zea mays
MDSHAAVSSSVGSGDGAAQPRRNSRKPKYSKFTQQELPACKPILTPKWVISVFVLVGVIFVPIGIVSLRASHQVVEIVDRYDDACIPANVTEKLAYIQNDSIPKTCTRNLTITKDMKQPIFVYYQLDNFYQNHRRYVKSRNDAQLRDKSKASDTTNCDPEAKTVDGKPIVPCGLIAWSLFNDTYTLIHNNKTLRVDKKDISWKSDRDHKFGSDVFPTNFQKGPLQGGKILNPKIPLSEQEDLIVWMRTAALPTFRKLYGRIHVDLKENDTITVQLENNYNTYSFSGKKKLVLSTATWIGGKNDFLGLAYLTVGGICFVLAFAFTLLYLIKPRKMGDNNYLSWNRPTLGR

SEQ ID NO: 93370 - protein, 494 aa, Saccharomyces cerevisiae
MSSEEDYFDELEYDLADEVNEEKEDIQTKKLTTVNCQTEKFNPFEILPESIELFRTLALISPDRLSLSETAQILPKIVDLKRILQQQEIDFIKLLPFFNEIIPLIKSNIKLMHNFLISLYSRRFPELSSLIPSPLQYSKVISILENENYSKNESDELFFHLENKAKLTREQILVLTMSMKTSFKNKEPLDIKTRTQILEANSILENLWKLQEDIGQYIASKISIIAPNVCFLVGPEIAAQLIAHAGGVLEFSRIPSCNIASIGKNKHLSHELHTLESGVRQEGYLFASDMIQKFPVSVHKQMLRMLCAKVSLAARVDAGQKNGDRNTVLAHKWKAELSKKARKLSEAPSISETKALPIPETNPKRKELGENLGSTRKNSDYRMSDNYKIGWNLAKQEQTVLDSYGEEVGLGMSNTSLQQAVGATSGSRRSAGNQAKLTKVMKHRISEANQQADEFLISLGHNTEQPNLSPEMVQMHKKQHTNPEEETNWFSGHG

SEQ ID NO: 93371 - protein, 184 aa, Corynebacterium diphtheriae NCTC 13129
MTGPLILPFNGKVPRVHETAFIAPNATLIGDVTIGPYASVFYGCVLRADINSIVVGARTNIQDNSVLHVDRDAACVLGDDVTVGHMALVHGSTVGDGTLVGMHAALLSRSVVGAGSLIAAGAVVLEGQVIPVKSLAAGVPAKVRRELSDEQSAGFIPHAGRYVEVAVQHGELGAPLSVEDVRFR

SEQ ID NO: 93372 - protein, 471 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGKQFALHEATLVLGMMLKHFDFEDHTNYELDIKETLTLKPEGFVVKAKSKKIPLGGIPSPSTEQSAKKVR

SEQ ID NO: 93373 - protein, 571 aa, Arabidopsis thaliana
MGLCFSSAAKSSGHNRSSRNPHPHPPLTVVKSRPPRSPCSFMAVTIQKDHRTQPRRNATAKKTPTRHTPPHGKVREKVISNNGRRHGETIPYGKRVDFGYAKDFDHRYTIGKLLGHGQFGYTYVATDKKTGDRVAVKKIDKAKMTIPIAVEDVKREVKILQALTGHENVVRFYNAFEDKNSVYIVMELCEGGELLDRILARKDSRYSERDAAVVVRQMLKVAAECHLRGLVHRDMKPENFLFKSTEEDSPLKATDFGLSDFIKPGKKFHDIVGSAYYVAPEVLKRRSGPESDVWSIGVISYILLCGRRPFWDKTEDGIFKEVLKNKPDFRRKPWPTISNSAKDFVKKLLVKDPRARLTAAQALSHPWVREGGDASEIPIDISVLNNMRQFVKFSRLKQFALRALATTLDEEELADLRDQFDAIDVDKNGVISLEEMRQALAKDHPWKLKDARVAEILQAIDSNTDGFVDFGEFVAAALHVNQLEEHDSEKWQQRSRAAFEKFDIDGDGFITAEELRMHTGLKGSIEPLLEEADIDNDGKISLQEFRRLLRTASIKSRNVRSPPGYLISRKV

SEQ ID NO: 93374 - protein, 270 aa, Methanosarcina acetivorans C2A
MENQKIGFIGAGKMGSALMQGTIKAGIVTPENIGASDVYEPFLKDLQAKLGIRVSTDNAVIVRESDILILAVKPQTLSSVLSNLKNEITSEKLVISIAAGVPLSTYEDALLEGTRVVRVMPNIAATVSEAASGIAPGKNATPEDLKAALEIFSAVGTAVQVPESLMDAVTGLSGSGPAFIFPVIEAMADGAVLEGMDRKSALTLAAQTVLGAAKMALETGMHPGELKDMVTSPAGTTIQGIHSLEEAGIRAAFMNAVIRASERSKELGKK

SEQ ID NO: 93375 - protein, 577 aa, Prochlorococcus marinus subsp. pastoris str. CCMP1986
MKETSPKSNNGTIVDNNENFNIEFDPISDALAAIRNGECIIVVDDERRENEGDLICAAQFATPQQINFMATEGRGLICLAMQGEKLDALDLPLMVDRNTDENQTAFTISIDAGPENNVTTGISAEDRAKTIQVAINPSTKPEDLRRPGHIFPLRAKKGGVLKRAGHTEAAVDIAAMSGLYPAGVICEIQNPDGSMSRLPQLKQYAKEWGMKLISIADLISYRFQNERFVYRKSDAILPSIFGNFKAYGYINELDGSEHIALVKQKSNKLSEPVLVRMHSECLTGDAFGSLRCDCRPQLEAALARIEKEEEGVVVYLRQEGRGIGLINKLKAYSLQDGGLDTVEANEKLGFPADLRNYGVGAQILTDLGIKKLKLLTNNPRKIAGLGGYGIEVTERVPLVICPGEHNSEYLNVKRQKLGHMLEEEKLNSIDIDPYIAIFLDGDYKSIDLVPIKNKIIEFCEKNKINIMLESSPRLLAFWNRPKLVWKILHDKNREDFTINDNEINKIEIFIKFLSEYNKSSKVGIIVSKNIQQALHPKNSIKLKNTKFSIKNEELHSSTRKFNLDKETFSIIFDKKLS

SEQ ID NO: 93376 - protein, 260 aa, Oryza sativa Indica Group
MTQTKIVDFFRIQKGAEDAEAEKCGLFQDVKKRRKRSLVMHKKRRRILPYVPTEDKVQRLKQMASLATAMTSSKMKFSNELTYIPGMAGRSCNQATLEEGGMQILPKEDKETIELCRTMQKRGECPPLLVVFDSREGFTVQADADIKDMTFIAEYTGDVDFLENRANDDGDSIMTLLLTEDPSKRLVICPDKRGNISRFINGINNHTLDGKKKKNIKCVRYDIDGESHVLLVACRDIACGEKLYYDYNGYEHEYPTHHFV

SEQ ID NO: 93377 - protein, 518 aa, Zea mays
MAAITPPTQSEPSPQTGRPASSAAAAAKRGGGGAGAAGGPLMGKYELGRLLGHGTFAKVYHARHVDTGDNVAIKVLDKEKAVKSGLVPHIKREIAVLRRVRHPNIVHLFEVMATKTKIYFVMELVRGGELFSRVSKGRLREDTARRYFQQLVSAVGFCHARGVFHRDLKPENLLVDEQGNLKVSDFGLSAVAEQFRPDGLLHTFCGTPAYVAPEVLGRRGYDGAKADVWSCGVILFVLMAGYLPFHDKNIMAMYKKIYKGEFRCARWFSKDLTSLLMRILHTNPNTRITLPEIMESRWFKKGFKPVKFYIEDDQLHNVIDDEDGLLDMGPAGPVPPPLPPPPPPLPPPKVDGDESGSDSDSSISSCPASMLSDESQRPRGSLPRPASLNAFDIISFSRGFNLSGLFEEKGDEVRFISAEPMSDIITKLEDIAKLKSFKLRRKDWRICLEGTREGVKGPLTIGAEIFELTPPLVMVEVKKKAGDNEEYENFCDKELKPGMQHLVHHMVRAPSMLLTDAK

SEQ ID NO: 93378 - protein, 181 aa, Moritella sp. PE36
MNQETLGFIKNSIKSIPDYPKEGIIFRDVTSLVENGPAFSATIDLLAERFKDAGFTKIAGTEARGFIFGAPLAKALGLGFILVRKPNKLPRKTIEQSYQLEYGTDILQIHVDAVDAGDKVLIVDDLLATGGTVAATVSLIRQLGGIVEEAAFVISLPDLGGEAVLNNLNVNITKLVDFDGE

SEQ ID NO: 93379 - protein, 373 aa, Bacillus anthracis str. A2012
MAKGECISMKRQLILEDGTVLIGTGFGGEIEKSGEVVFTTGMTGYQETLSDPSYCGQIVTFTYPLIGNYGINRDDFESIHPSVNGLIVNEICDHPSNFRNEISLNDYLKERNIPGLAGIDTRKLTRKIRQYGTLRGRLCNMDADVEYIVSQLKATVFTDHVKRVSTKDPYPSPGRGHRVVLVDFGMKHGILRELNKRDCDVIVVPYNTTAEEILRLSPDGIMLSNGPGDPKDVPEAIEMLKDIIGKVPLFGICLGHQLFALASGANTSKLKFGHRGLNHPVKNIATGKVAITSQNHGYAVEEESVENTELEITHVALNDGTVEGLRHKKFPAFTVQYHPEASAGPEDANDLFEDFLTMIENFKKEGEELCQNA

SEQ ID NO: 93380 - protein, 337 aa, Oryza sativa Indica Group
MGSAASAAAPPPPPTAQPHMAAPPYGAGLAGILPPKPDGEEEGKKKEVEKVDYLNLPCPVPFEEIQREALMSLKPELFEGLRFDFTKGLNQKFSLSHSVFMGSLEVPSQSTETIKVPTSHYEFGANFIDPKLILVGRVMTDGRLNARVKCDLTDDLTLKINAQLTHEPHYSQGMFNFDYKGTDYRAQFQIGNNAFYGANYIQSVTPNLSMGTEIFWLGHQRKSGIGFASRYNSDKMVGTLQVASTGIVALSYVQKVSEKVSLASDFMYNHMSRDVTSSFGYDYMLRQCRLRGKIDSNGVVAAYLEERLNMGVNFLLSAEIDHSKKNYKFGFGMTVGE

SEQ ID NO: 93381 - protein, 306 aa, Bacillus anthracis str. A2012
MTMSHLLTMSELSEVEISEILKDAEDFANGKESKTTEQTFVANLFFENSTRTRFSFEVAEKRLGLDVLNFSADASSVQKGETLYDTIRTLESIGTKAVVIRHEQDRYFDELKDQVNIPILNAGDGCGNHPTQCLLDLLTIKQEFGRFEGLKIAIVGDVRHSRVARSNAEALTKLGATIYFASPEEWKDEDNTFGTYKPLDELVPEVDVMMLLRVQHERHDHYETDIMKEYHEKHGLTVEREKRMKEGSIIMHPAPVNRDVEIASELVECERSRIFKQMENGVYVRMAVLKRALPNVLGGMKHELFV

SEQ ID NO: 93382 - protein, 461 aa, Zea mays
MVSETNQSKNVCVIGAGPSGLVAARELKREGHKVVVLEQNHDIGGQWLYNPNVQEEDPLGRDPWLKVHSSIYESLRLMSPREVMGFTDFPFLVKKGRDPRRFPSHRELLLYLKDFCEWFELRDMIKFNTKVHYVGPLNYGVPSEDLKWVVRSKDKNSEEEVEQVFDAVVVATGHYSNPRLPCIQGMAIWKRKQMHSHIYRSPEPFRGEIVVVVGNSFSGQEISMELVKVVKELHLSSKSLDIYEGLSKVISKHENFHLRPQIETLREDGTVIFNDGSSIIADTILYCTGYTYSFPFLDTKGMVVVDDNRVGPLYEHTFPPALAPSLSLVGIPRRILGLPFFESQGKWVAQLLSGKKALPSYEEMMKSIKEFYHSKEEAGIPKHYTHEIEGFDYCDKYAENVGLPKLQEWRKDLCVSAVVNLFINLETYRDSWNDDIDEKLQEALRSPYFTQLGVEPEDPSL

SEQ ID NO: 93383 - protein, 274 aa, Legionella pneumophila
TRVEDTRDLLDNIQYAPTNGRFKIYLIDEVHMLSQHSFNALLKTLEEPPSHVKFILATTDPQKLPVTVLSRCLQFNLKHLPAELINQQLQLILQEERLDFEIQALDILAQAARGSMRDALSLLDQAITSCETKLLASDVKILLGHTQQDYALLLLQALAKQEAPTMLVLSQQIIAEGGNFQYVLDEMLNYLHQITIYQCLGDNNPLISPKAEIKELAKQFSAEDTQLFYQIGIKGREEMHLAPTLAIGFNMTMLRMYTFKPASHVTTPPLAFEQ

SEQ ID NO: 93384 - protein, 580 aa, Oryza sativa Japonica Group
MGGGGTLVDGFRRLFHRRTASGSNQSSNAGEEAASSDLEVADDPDLVALRSIRIRVPKRKMPLPVESHKKNTVEMEFFTEYGEASQYQIQEVIGKGSYGVVAAAVDTRTGERVAIKKINDVFEHVSDATRILREIKLLRLLRHPDIVEIKHIMLPPSRREFQDIYVVFELMESDLHQVIRANDDLTPEHYQFFLYQLLRALKYIHAANVFHRDLKPKNILANSDCKLKICDFGLARASFNDAPSAIFWTDYVATRWYRAPELCGSFFSKYTPAIDIWSIGCIFAELLTGRPLFPGKNVVHQLDIITDLLGTPSSETLSRIRNEKARRYLSTMRKKHAVPFSQKFRNTDPLALRLLERLLAFDPKDRSSAEEALADPYFASLANVEREPSRHPISKLEFEFERRKLTKDDVRELIYREILEYHPQMLQEYMKGGEQISFLYPSGVDRFKRQFAHLEENYSKGERGSPLQRKHASLPRERVGVSKDGYNQQNTNDQERSADSVARTTVSPPMSQDAQQHGSAGQNGVTSTDLSSRSYLKSASISASKCVAVKDNKEPEDDYISEEMEGSVDGLSEQVSRMHS

SEQ ID NO: 93385 - protein, 274 aa, Legionella pneumophila
TRVEDTRDLLDNIQYAPTNGRFKIYLIDEVHMLSQHSFNALLKTLEEPPSHVKFILATTDPQKLPVTVLSRCLQFNLKHLPAELINQQLQLILQEECLDFEIQALDILAQAARGSMRDALSLLDQAITSCETKLLASDVKMLLGHTQQDYALLLLQALAKQEAPTMLVLSQQIIAEGGNFQYVLDEMLNYLHQITIYQCLGDNNPLISPKAEIKELAKQFSAEDTQLFYQIGIKGREEMHLAPTLAIGFNMTMLRMYTFKPASHVTTPPLAFEQ

SEQ ID NO: 93386 - protein, 350 aa, Mycobacterium sp. KMS
MIPAALRCVPAGQVDVTAPVTIDGLSYIAPDDPAMPMYRVIANNRQPVALRDLMIQPVRSGYIGDGHQPDPALVPPTGAQAVPDVDVDQVYLPVRDGVARCQLYRPRAAPADEQLPVIVYYHGGGFTVGVSEDCDFLARKLAFTNSALVVSANYRSAPEFMFPTPLDDAFDVYRWVTVNAELVGGDATRVAVAGDSAGSNFAAALALRARDEHARVPDAVVMLGAMPDFHFERWDSFRAQAPRGIVYDMAFAGFIRGAYVGPTPWDHPWVSPIEGDLTGYPLTVITAGTHDPIVDSARAFGERIRAAGGQTVEYFPAGMPHGYYFFPGVHAEEDVAYEIVAEVLAKPFRR

SEQ ID NO: 93387 - protein, 177 aa, Zea mays
DIMVRDFEGDAGSLVINGTAYYLRQLHWHSPTEHTVDGRRYDMELHLVHESAENKAAVIAVLYEIGGHDDALLRQLEPAIRRVADVRDREMRVGVVDPRRARGRASVYYRYVGSLTAPPCTEGVIWTIVKRVRSVSKHQLELLREAVHDDMENNARPLQEANDRDVSMFRPKPNKHY

SEQ ID NO: 93388 - protein, 590 aa, Coprinopsis cinerea okayama7#130
MVEPALAPASNARSNASTFPPLPSVSSDEDDEPPSSRPYQSGHPQVTNDSAGENGISAAAVTDLEAEDARFPPVKKRDTLYISNSNETRVARGSDDGGALVRADTFTTLDAEKQEGRSVSEEGPRGRWASIKNRFRLSKTSRVRALFTPAHDIGPRPTYLQSLKATARYTPLNILLLAIPVSWALHWTHQSPTMVFVFSCLAIIPLAALLGLGTEQIALHTSQSVGGLLNATLGNVVEMIIAGIALKQCELELVQSSLLGGLLSNLLLVLGCAFIVGGFKFQQQEFQPMVAQLNSSLLILSVISLIIPVAFHLYLEDKLAPGTEVDVLLKLSRGSAILLFLIYFAYLFFQFYSHNHLFLDTHQSKPARRRTTSSSSSESNDMPTFSRSSTKSETLRNGPTSTLASVSSLSLEDQQDGHHEVLKLNIPFSLVLLGAVTALAYITAEHLVDSLEGLVRDHPSISKEWITLIIIPVISNAAEHATAVVVARKGKFDLAMSVAVGSCIQIALLVIPLLVLVAWGMDKPLMLLFDPLETILLFFSVLAVKFIIEDGKSHWMSGLALISVYILIALSFWFYPDPVRLIQGQPLICK

SEQ ID NO: 93389 - protein, 495 aa, Roseovarius nubinhibens ISM
MTDWQARVAKLYDGGFRPMVIGGKWCAAQSGEVMEARNPADGGLLATVPKGGAEDIDAAVAAARAAFEGPWAKFTPFERQALLLRIAERFEAEWETLCLSDTLDMGMPIQRTLANSRRVLGMLRYYAGQAVAIHGETIPNSFPGEIYSSTVREPVGVVGAIIPWNAPIAGSIWKIGPALATGCTVVLKPSEEASLTVLLIAKLMQEAGLPDGVLNIVTGHGSDAGAALAAHPGVDKIVFTGSTATGQAIARAATGNLKRVALELGGKSPVIVCRDADIDKAVPVAAMSVFANSGQICIAGSRLFVAREIHDEFVRRVAEYAAGLRLGHGIHEETEIGPIISARQAERIGGYLEAGRREGAEVMTGGAAPEGAAFENGHFYKPTVFAGVTDEMTIAREEIFGPVISALPFDTLDEVVERANATPYGLAAGVFSTHLGTAHQLAHRIKAGSVWVNMYHAIDPAVPFGGVKMSGYGREGGREHVEEYLDTKAIWINAE

SEQ ID NO: 93390 - protein, 495 aa, Burkholderia xenovorans LB400
MTTHHASATPDLPLDMIIFGGTGDLSFRKLLPALYMAHLHCNLPPDTRILTIGRKPWSREEYINEFMEQKAKPFIEKKAFDAAAWDKFLALFEYVRMDVDSVEDYQRLKEASREGVRRVFYLATSPDLFTNICDNLAAAGLVDGNSRVVLEKPLGHDLASAQEINTAVGKHFSEAQIYRIDHYLGKETVQNLMVLRFGNPIFGPLWQAPYIKSVQITVAETVGVGSRAGFYDKTGALRDMVQNHLLQLLCIVAMEPPVSLDPDAVRDEKLKVLRSLRPMTPEDIARDTVRGQYTAGAVDGEAVKGYLEEDNVPAGSRAETFVALRAHINNWRWAHVPFFLRTGKRMQKKVSEIVIEFSELPFSIIPNGNSGRNYGNRLVIQLQPEESIQLQVLAKEPGSGMHMLPVNLNLDLQQAFTERRAEAYERLLIDVIRGRLTHFMRRDELEAAWAWAEPILAGWSKSGEKPRGYTAGTFGPAASTALMARENAVWAEESQ

SEQ ID NO: 93391 - protein, 392 aa, Ganoderma sp. BS-1
WHGFFQKGTNWADGVAFVNQCPISSGNSFLYDFQVPGQAGTYWYHSHLSTQYCDGLRGPFVVYDPEDPLLSMYDVDDDSTVITLTDWYHTAAKLGPAFPLGADATLINGLGRSPATSTAELAVINVTQGKRYRFRLISMSCDPNYTFSVDGHDMTVIEADGIETQPVTVNAIQIFAAQRYSFVLTADQDVDNYWVRANPNFGNVGFTDGINSAILRYDGADPVEPTTSQQTTQNLLNEVDLHPYVAIPTVPGSPTPGGVDLAINFAFNFNGSRFFINGDTFVPPTVPVLLQILSGAQTAQELLPSGSVYELPMNSSIELTFPATASAPGTPHPFHLHGHEFAVIRSAGSTEYNYDNLRVRDVVSTGVAGDNVTIRFQTNNPGPWILHCHIDF

SEQ ID NO: 93392 - protein, 434 aa, Oryza sativa Indica Group
MFRLRSSARLLRELREASRSSGRRREWLSGGAVASAARTTSLLHPLPGLDVPQCLPDQLGVQPTRVTTLPNGVRVASEDLPGPSACVGVFVDSGSVYETAETAGVSHLLERLSFKDTAHRSHLQIVQDVEATGGNIGASASREQTVYSYETLKAYLPQAIEVLIDCVRNPLFLQDEVERQENFTADRLVVAASGVDHQYLLDVAEPLLSDWHKGSPVERPESKYIGGDFRHRADSEMTHVALAFEVPGGWLEERDATIMTVVQTLMGGGGSFSSGGPGKGMHSRLYLRVLTKYHTVESFSVFSNAFDRSGLFGIYLTTPSDFVAKAVDIATKELIAIATPGQVTDIELARAKNSTISAVLMNLESRVIVAEDIGRQILTYGCRKPVDHFLQCMDEMTLDDITAFAKKMLSSPPTMASWGDVDKVPPYEFVCKRF

SEQ ID NO: 93393 - protein, 172 aa, Synechococcus elongatus PCC 6301
MATITLPTWVTLTRLFAVPILLVGMEQPGLLPTWVPLVVFLLAAATDWLDGWLARRLNQVSDLGKVLDPLVDKLLVLAPLLVLVAQQVVPTWAVFLILARELTIAGWRVNQPKISGANLWGKLKTVVQIAAIALLLPPLSPRFLPLGLGCFWIAVALTLISGWTYLRPSKTT

SEQ ID NO: 93394 - protein, 181 aa, Arabidopsis thaliana; identical to SEQ ID NO: 1237

SEQ ID NO: 93395 - protein, 637 aa, Prochlorococcus marinus subsp. pastoris str. CCMP1986
MLLSELSHPNQLHGLTVSQLEEIACQIRERHLEVVSTSGGHLGPGLGVVELTLALYQTLDLDFDKVVWDVGHQAYPHKLITGRFNEFDSLRQQKGIAGYLKRSESHFDHFGAGHASTSISAALGMAIARDRKGEDHKCVAVIGDGALTGGMALEAINHAGHLPNTPLVVVLNDNDMSISPPVGALSTYLNRVRLSPPLQFLSDSVQESVKNIPLIGKDIPEELKNIKGSVRRLAVPKVGAVFEELGFTYMGPIDGHDISNLINTFNAAHRLKKPVMVHVVTTKGKGYPYAEADQVGYHAQSSFDLTTGKSIPSSKPKPVSYSKIFGQTLLKICEQDSKVIGITAAMATGTGLDLLQKNIPEQYIDVGIAEQHAVTLAAGMSCDGLKPVVAIYSTFLQRAFDQLIHDVGIQNLPVSFVLDRAGIVGADGPTHQGQYDISYMRAIPNFVLMAPKDEAELQRMLITSINYKGPTALRIPRGSGLGVAVMDEGWEPLKIGEGEILEEGDDVLIIAYGSMVQSATETANLLKNRGISACIINARFVRPLDQDLIIPLVRKLKKVVTMEEGTLVGGFGSAIVEMLNDNDINIPVLRIGIPDVLVDHASPDQSKEKLGLTPDQMAEKIINKFNLAKLNSKITVE

SEQ ID NO: 93396 - protein, 55 aa, Zea mays
MALRRVYSEIRGKKVTELPGYIKSTFSMETVKTSVKRGLDNYNEKYIQTSSGNQD

SEQ ID NO: 93397 - protein, 513 aa, Prochlorococcus marinus subsp. pastoris str. CCMP1986
MEDYLKKILQAKVYEVAKETPLEKANNLSKALKNNIYLKREDLQDVFSFKIRGAFNKMRQLPQSQLANGVITSSAGNHAQGVALSALKLNCSATILMPITTPLVKVNAVRNLKAKVILFGDNYDETYKEALRLSEENNLCFIHPFDDPEVIAGQGTIAIEIEKQVKEPPEAIYVAVGGGGLIAGISLYIKNIWPQVKIIGVEPEDADAMTKSLNNSKLIELASVGQFADGVAVKKVGEKTFEIGRKYIDKMITVNTDEICAAIKDVFEDTRSILEPAGALSIAGMKKDIFESKYANKNMIAIACGANMNFERLRFIAERSALGEYKEAMFAVEIPEKAGSLINFCSLLNNRNLTEFSYRMSNSVNAQIFVGIEVNGVIDKDELLQEFRKSNYPFIDISNDELSKNHLRHMVGGRLPQKFTVLEKSKYIELLYRFEFPERPGALINFLKNMKSNWTISIFHYRNHGSDVGKIVIGVLIDRAEINYWNKFVEFLGYKYWDETNNQTYKLFLGASD

SEQ ID NO: 93398 - protein, 494 aa, Moritella sp. PE36
MTTQTQHSLHTGGKWQPENSLYIGGEWQSGVSTIANINPSDISKNLGNFAQASTAQVQQAISAAKHAQPTWEKTPLEQKQAVLQGIGDELIARCDELGSLLSSEEGKPFLEGRGEIYRAGQFFQYFAAEVLRQIGDSAASVRPGVTVEVTREAVGVVAIISPWNFPTATAAWKIAPALAFGNSVIWKPANLTPASAVALTEIIHRQGLPAGTFNLVLGSGSVVGDALINSTEVNGVSFTGSVDTGRKIAAATAPNFVRCQLEMGSKNALIIADDADINIAVEATIAGSFSGAGQKCTASSRLVVMDGIHDAYVEALIKRMSELKVGHALEDGVFMGPVVDGKQLEANFDWIDTARQSGGELAFGGERLSLEHEGFYMSPTLFVNTKNDWSVNQEEVFAPMACVIRVADLDEAIATTNDTRFGLTSGIITQSLRTSTLFKQQAQTGCVMVNLPTAGTDYHVPFGGRKESSFGPREQGQYAKEFYTVVKTAYQRAY

SEQ ID NO: 93399 - protein, 369 aa, Zea mays
WVPRGRPGSIKNSGQQERKKTTTRERERDREERDCQRGEAAGQSSISARGLRAERQGAMAASVALSSGHRMPAVGLGVWRMEKADIRGLIHTALRVGYRHLDCAADYQNEAEVGDALAEAFQTGLVKREDLFITTKLWNSDHGHVLEACKDSLKKLQLDYLDLYLIHFPVATRHTGVGTTSSALGDDGVLDIDTTISLETTWHAMEELVSMGLVRSIGISNYDIFLTRDCLAYAKIKPAVNQIETHPYFQRDSLVKFCQKHGICVTAHTPLGGSTANAEWFGTVSCLDDPVIKSLADKYGKTPAQLVLRWGLQRDTVVIPKTSKVERLQENFDVFGFDISGEDMERMKAIDRKYRTNQPAKFWGIDLYA

SEQ ID NO: 93400 - protein, 596 aa, Prochlorococcus marinus subsp. pastoris str. CCMP1986
MSNIDLKRRTKIVATIGPATQSEEIITDLIKAGVTTFRLNFSHGDHKDHQERIQTIRKVSEKLDLDIGILQDLQGPKIRLGRFKDGPVKVKKGDKFSLTSNEVECTKSIANVTYNKLAQEVTSGKRILLDDGKIEMIVEKVDIGNNLLECKVTVGGVLSNNKGVNFPDVQLSVKALTDKDIEDLEFGLTAGVDWIALSFVRNPSDINEIKNLINKNGHSIPVVAKIEKFEAIDQIDSILPLCDGVMVARGDLGVEMPAEEVPLLQKELIRKANTLGIPIITATQMLDSMASNPRPTRAEVSDVANAILDGTDAVMLSNETAVGDYPVEAVETMATIARRIERDYPLKAIESHLPSTIPNAISAAVSNIARQLDAGAIIPLTKSGSTARNVSKFRPPTPILATTTERCVARRLQLVWGVTPLLVKNDDRTAKTFSIAMQIAQELGILKQGDLVVQTAGTLTGISGSTDLIKVGLVRKVVTRGISVGEIGVTGKARNIKTNLDLSLISPGEILFVPKNILMDLPFTKIITGIVTDENIDECYKVFKKNNIKISTICNLSAIDNLVSNGDLITLQLNEGVVYMGQIEDDEDALDKYKYV

SEQ ID NO: 93401 - protein, 274 aa, Rhodospirillum rubrum ATCC 11170
MHRVSANGIAIPALGFGTWQIEGDDARVAVAEALALGYRHIDTARAYGNEAQVGAGIAQSGVPRGDIFLTTKIWTSEFKPEALTAALADSLAKLGTDYVDLTLLHWPNPEVPLADSLGALAALQQEGLTLAIGVSNFPVALVEEAVAVCGRPLAVNQVEYHPFLDQSKVIEACRRHGMAVEAYSPLARGKVMEDATLRRIAEIYGRTPGQVALRWLIQQDGVIALPKAVRPEHAKANLGALDFALSQSEMAEISALARPDGRLINPSWAPAWDD

SEQ ID NO: 93402 - protein, 408 aa, Herminiimonas arsenicoxydans
MNSHRITLEDRYCAHNYQPLPVVLSKGKGIWLWDENGKRYMDMMSAYSAVSFGHSHPDLVAALTHQAGRLAVTSRAFYTDQLGPFLQLLCEMTGMPQALPMNSGTEAVETALKAARKWGYKVKGIPDQQAEIIVCHGNFAGRTTTIVGFSSEAQYRDGFGPFDGGFVTIPFGDAAALEAAITPRTTAFLVEPIQGEGGIIVPPDGYLAQCREICTRHNVLLICDEVQTGLGRTGRLLACDHEGIKPDGLILGKALGGGLLPVSAFLARRDVMGVFTPGDHGSTFGGNPLAAAVGHAALSLLHDGELIAAARQRGQHLLDGLHAIRHPAIRSVRGKGLLIGLELDPAIILARSFCERLMENGLLSKETHYTVVRLAPPLVISAAEIDAALRIIEHVFATLTTPHMEGCT

SEQ ID NO: 93403 - protein, 132 aa, Helicobacter pylori
SNIKYELDKESGALMVDRVLYGAQNYPANYGFVPNTLGSDGDPVDALVLSDMAFQAGSVVKARLVGVLNMEDESGMDEKLLALPIDKVDPTHSYVKDIDDLSKHTLDKIKHFFETYKDLEPNKWVKVKGFEN

SEQ ID NO: 93404 - protein, 232 aa, Stephanomeria virgata subsp. virgata
GGRYSVCSAVGVLPLSLQYGFPVVEKFLKGARSIDQQFLSAPFEKNIPVLLGLLSVWNVSFLEYPARAILPYTQALEKLAPHIQQVSMESNGKGVSIDGIRLPFEAGEIDFGEPGTNGQHSFYQLIHQGRVIPCDFIGIVKSQQPVYLKDEVVNNHDELMSNFFAQPDALAYGKTPEQLQSENVASHLVPHKTFTGNRPSLSLLLPSLDAYRIGQLLAIYEHRIAVEGFIWG

SEQ ID NO: 93405 - protein, 500 aa, Ralstonia eutropha JMP134
MLRSRHLLSGSFFNGRTTMLKLQDPSLLRQQCYIDGRWTDGERRIDVTNPATGELVAQVPQFGVAETRHAIEAANRALPAWRARLAKERSALLRKWFELILANQDDLARIMTAEQGKPFAEAKGEIAYAASFIEWFAEEGKRVYGETIPAPVSSQRIVVTKEPIGVCAAITPWNFPAAMITRKAGPALAAGCTMVVKPASQTPLTALALAVLAERAGIPAGVLSVVTGSAGAIGGELSSNPLVRKLTFTGSTEVGRVLMAQTASTIKKVSMELGGNAPFIVFDDADLDAAVEGAIISKYRNAGQTCVCANRIYVQDKVYDAFAQKLVAAVAQLKVGNGMEDGVRIGPLIDEKAVAKVEEHIADALGKGARVLEGGHRHGLGHTFFQPTVLADVAPNMLVAREETFGPLAPLFRFKTEDDVVAMANDTEFGLASYFYARDLGRVWRVSERLEYGMVGVNTGLISNEVAPFGGVKQSGVGREGSHYGIEDYLVIKYTCMAGI

SEQ ID NO: 93406 - protein, 283 aa, Ralstonia solanacearum GMI1000
MRRIQHRTQGNAMNDTFTMPAFGLGTFRLTGEAAIDSVRTALELGYRAIDTAQIYANEAEVGQAIAASGVPRRDLFLTTKIWVDNLAADRLIPSLKASLARLRTEQVDLALIHWPSPGGAVPMAEYLGALDEARREGLTRALGVSNFTVALLREAIETVGAAQIATNQIELHPYLQNRKVAAFAQSQGIHVTSYMTLGVGRVLADPVLADIARAHGATPAQVVLAWAMQLGCSVIPSSTRRANLQSNLAARDLRLTGDDMARIGALDRGERIADPAGIAPDWD

SEQ ID NO: 93407 - protein, 141 aa, Triticum aestivum
  misc_feature (100)..(100): Xaa can be any naturally occurring amino acid
  misc_feature (108)..(108): Xaa can be any naturally occurring amino acid
  misc_feature (116)..(116): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFNKVGFISRXEHNASPGXYYDGRYWXTMWKLPISGATTHTMITSGGGKKDT

SEQ ID NO: 93408 - protein, 310 aa, Zea mays
GDSPSRRTRSNAAPVTAPAFLWAPKNYGFSSDDAKEVVHYQTISPKSLAKSVLEEGGWSNFMCSREDTQNNVDVAIVFIGSKLQSSDISKDKQVDPALADTLKLSFTRSEFSMAFPYVSTTVDERLEDSLLSSFAENCNNGFGRNRVTYTDTCTGQDLKKYHNMDAINDLVVSGVASRRVNHPSGQTDVIVFCSGGFENPGTAKSEGELLSQLVDLLDLSGAKYTVLYASQPSGLLESPSGLPLGRHLAEKKTNGTKAVQGEKCDGECLVKSSLLEGTFVGIVLLIILISGLMCMMGIDTPSRFEAPQES

SEQ ID NO: 93409 - protein, 357 aa, Streptomyces kanamyceticus
MANGGTGAADAGGVTGAGDGADPRQLVQLVFGSMAAQTLRAAARMRVVELIGDKERTAAEVAAEAGARPEGMIRLLRALAGIGVVAERTPGVFAVTPTGALLDSRRPGNVASLVLMMSDPTMLRGWEHLDEVVRTGEPAFDTVFGTDFFGHLREHPEESARFNEAMSQSTGAAAATLPRAFDFTRFATVADVGGGDGTLLSAVLKEHTGLTGIIYDTAEGLAQAPATLERHGLTERCSSVAGDFFQSAPKGADLYLLKSILHDWPDERAVTILSHCRAVLPPEGRVLILEHVLPEAVDPAAPGFAYLSDLNMLVNLGGRERTRADFDELCGRAGLSIVSVTPMGAPNPLSMIEVAAA

SEQ ID NO: 93410 - protein, 270 aa, Ralstonia solanacearum GMI1000
MHPMLNIAVKAARKAGTVINRATLQGDSRQIERKQHNDFVTDVDRAAEATIIEIIKTAYPDHAILAEESGRSWADGETASENVWVIDPLDGTTNFIHGFPQFAVSIALMQRNVVTQAVVYDPTRDELFTASKGAGAFLNNRRIRVTRRDKLADCLIGTGFPYRDMEGLDDYVKLFATMTENCAGLRRPGAAALDLAYVASGRLDGFFEQGLNAWDMAAGSLLITEAGGLVGNYCGEAGYLDQGEILAGNPKAFVQMIKLTTPFSRSQAVV

SEQ ID NO: 93411 - protein, 498 aa, Lobularia maritima
MRINPTTSDPQVSIREKKNLGRIAQIIGPVLDVAFPPGKMPNIYNALVVKGRDTLGQEINVTCEVQQLLGNNRVRAIAMSATEGLKRGMDVIDMGNPLSVPVGGATLGRIFNVLGEPVDNLGPVDTGTTSPIHKSAPAFIQLDTKLSIFETGIKVVDLLAPYRRGGKIGLFGGAGVGKTVLIMELINNIAKAHGGVSVFGGVGERTREGNDLYMEMKESKVINEENLAESKVALVYGQMNEPPGARMRVGLTALTMAEYFRDVNKQDVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPRIVGEEHYETAQQVKQTLQRYKELQDIIAILGLDELSEEDRLTVARARKIERFLSQPFFVAEVFTGSPGKYVGLAETIRGFKLILSGEFDSLPEQAFYLVGNIDEATAKATNLEMESKLKK

SEQ ID NO: 93412 - protein, 469 aa, Salmonella typhimurium LT2
MVDQVKVAADEQAPAEQSLRRNLTNRHIQLIAIGGAIGTGLFMGSGKTISLAGPSIIFVYMIIGFMLFFVMRAMGELLLSNLEYKSFSDFASDLLGPWAGYFTGWTYWFCWVVTGMADVVAITAYAQFWFPGLSDWVASLAVVILLLSLNLATVKMFGEMEFWFAMVKIVAIVALIVVGLVMIAMHFKSPTGVEASFAHLWNDGGWFPKGISGFFAGFQIAVFAFVGIELVGTTAAETKDPEKSLPRAINSIPIRIIMFYVFALIVIMSVTPWSSVVPDKSPFVELFVLVGLPAAASVINFVVLTSAASSANSGVFSTSRMLFGLAQEGVAPKAFAKLSKRAVPAKGLTFSCICLLGGVVMLMVNPSVIGAFTMITTVSAILFMFVWTIILCSYLVYRKKRPHLHEKSIYKMPLGKLMCWVCMAFFAFVLVLLTLEDDTRQALIVTPLWFIALGLGWLLIGKKRMAGMR

SEQ ID NO: 93413 - protein, 465 aa, Clostridium acetobutylicum ATCC 824
MPNDLLKEYKNAWDKYDDKQLKEVFALGDRFKNFISNCKTERECVTELIKTAEKSGYRNIEDILAKGETLKEGDKVYANNRGKGLIMFLIGKEPLYTGFKILGAHIDSPRLDLKQNPLYEDTDLAMLETHYYGGIKKYQWVTLPLAIHGVIVKKDGTIVNVCVGEDDNDPVFGVSDILVHLASEQLEKKASKVIEGEDLNILIGSIPLKDGEEKQKVKHNIMKILNEKYDISEEDFVSAELEIVPAGKARDYGFDRSMVMGYGQDDRICAYTSFEAMLEMKNAKKTCITILVDKEEVGSIGATGMQSKFFENTVADIMSLCGDYDELKLRKALYNSEMLSSDVSAAFDPNYPNVMEKRNSAYLGKGIVFNKYTGSRGKSGCNDANPEYIAELRRILSKESVNWQTAELGKVDQGGGGTIAYILAEYGMQVIDCGVALLNMHAPWEISSKADIYETKNGYSAFLNN

SEQ ID NO: 93414 - protein, 537 aa, Vitis pseudoreticulata
MAARRISSLLSRSLSVSSAFSLSLGKNFNRGKSIHRFSTAAAAVEELITPTVQINYTQLLINGQFVDAASGKTFPTFDPRTGEVIANVAEGDAEDINRAVSAARKAFDEGPWPRMSPYERSRILLRFADLAEKHNDELAALETWNNGKPYEQAAKAELPLFVRLFRYYAGWADKIHGLTVQADGPHHVQILHEPIGVAGQIIPWNFPLMMFAWKVGPALACGNTIVLKTAEQTPLTALFAAKLFHEAGLPPGVLNIVSGYGPTAGAALASHMDVDKIAFTGSTDTGKIVQELAAKSNLKPVTLELGGKSPFIVCEDADIDQAVELAHFALFFNQGQCCCAGSRTFVHESVYDEFIEKAKARALSRTVGDPFKKGIEQGPQIDPEQFAKVLRYIKSGVESNATLECGGGRIGSKGYFVQPTVFSNVQDDMLIAKDEIFGPVQSILKYKDLDEVIRRANSTRYGLAAGVFTKNINTANTLTRALRVGTVWVNCFDVFDAAIPFGGYKMSGVGREKGIYNLNNYLQVKAVITPLRNPAWL

SEQ ID NO: 93415 - protein, 336 aa, Roseovarius nubinhibens ISM
MAQRKVLITGTAGFIGFHLAQLLLDEGFVVQGYDGMTDYYDVTLKERRHAILNQNKAFSACEGMLEDQARFDAVADEFAPDVIVHLAAQAGVRYSLENPRAYIESNVVGTFNVMEAARRHKVDHLLMASTSSVYGANEEMPFAETHKADTPLTIYAASKKANEAMGHSYAHLYDLPTTMFRFFTVYGPWGRPDMAPYKFTKGILDGSTIDIYNNGDMWRDFTYVTDLVRGIRGLIDAVPGGEETRVAGDSLSPAAPYRVVNIGNSDKVRLMDFIEAIEAAAGRKAVRNYMPMQTGDVYATYADAELLKALTGYRPQTDIRDGMARFVAWYREYYGV

SEQ ID NO: 93416 - protein, 297 aa, Myxococcus xanthus DK 1622
MATFQLNSFLAAQQARVEALLNERVARLGPSGTPPQLAEAMRYSLLAGGKRLRPVLCLAFADLVARGSAVSAVAGDAACALEYVHTYSLVHDDLPAMDNDDYRRGRLTNHKVYGEAMAILAGDALLTEAFTLVASGPESMRAALCRELAVASGAAGMVGGQVLDTAEDRPSALDYLIRMHRMKTGALIRAACRMGVLASGGDADALARADTYGDAVGLAFQIADDVLDVTATAAELGKPAGADAAAGRFTFPAVVGLEASRTLADQKVAEAIAAVRPLEGEDGPLAALARYTVERKS

SEQ ID NO: 93417 - protein, 383 aa, Arabidopsis thaliana
MGLLCSRSRHHTEDTDENTQAAEIERRIEQEAKAEKHIRKLLLLGAGESGKSTIFKQIKLLFQTGFDEGELKSYVPVIHANVYQTIKLLHDGTKEFAQNETDSAKYMLSSESIAIGEKLSEIGGRLDYPRLTKDIAEGIETLWKDPAIQETCARGNELQVPDCTKYLMENLKRLSDINYIPTKEDVLYARVRTTGVVEIQFSPVGENKKSGEVYRLFDVGGQRNERRKWIHLFEGVTAVIFCAAISEYDQTLFEDEQKNRMMETKELFDWVLKQPCFEKTSFMLFLNKFDIFEKKVLDVPLNVCEWFRDYQPVSSGKQEIEHAYEFVKKKFEELYYQNTAPDRVDRVFKIYRTTALDQKLVKKTFKLVDETLRRRNLLEAGLL

SEQ ID NO: 93418 - protein, 515 aa, Vitis vinifera
  misc_feature (402)..(402): Xaa can be any naturally occurring amino acid
MVSMGFFCNPMSLVFAISALTLVFLMKILVGKSTEKKRRYHPIGGTVFNQLFNFNRLHHYMTDLAGKHRTYRLLSPFRNEIYTADPANVEYILKTNFENYGKGSYNYNILRDLLGDGIFTVDDEKWRQQRKVSSYEFSTKVLRDFSSVVFRKNGAKLAIVVSEAASSNQTMDIQDLFMKATLDSIFKVAFGVELDSMCGSNEEGTKFGSAFDDASAMTLYRYVDIFWTIKKSLNIGSEATLKRSIKVVDDFVYKLIHSKTELMKNSQNDSSMKKDDILSRFLQLKDIEIDPKYLRDIILNFIIAGKDTTATALSWFIYMLCKHPTIQEKVAQEVREAINLKEATNYAEFAASVTEEALENMQHLHAAITETLRLYPAVPVDAKICFSDDTLPDGFSVRKGDXVSYQPYAMGRMRFVWGDDAEEFRPERWLNEKGLFCPESPFKFTAFQAGPRICLGKEFAYRQMKIFSAILSGCFVFKLSDNKKAVNYRTMINLHIDGGLHVRAFHRPDTKILEA

SEQ ID NO: 93419 - protein, 546 aa, Streptococcus agalactiae 2603V/R
MNKFKVNISGMTCTGCEKHVESALEKIGAKNIESSYRRGEAVFELPDDIEVESAIKAIDEANYQAGEIEEVSSLENVALINEDNYDLLIIGSGAAAFSSAIKAIEYGAKVGMIERGTVGGTCVNIGCVPSKTLLRAGEINHLSKDNPFIGLQTSAGEVDLASLITQKDKLVSELRNQKYMDLIDEYNFDLIKGEAKFVDASTVEVNGTKLSAKRFLIATGASPSLPQISGLEKMDYLTSTTLLELKKIPKRLTVIGSGYIGMELGQLFHHLGSEITLMQRSERLLKEYDPEISESVEKALIEQGINLVKGATFERVEQSGEIKRVYVTVNGSREVIESDQLLVATGRKPNTDSLNLSAAGVETGKNNEILINDFGQTSNEKIYAAGDVTLGPQFVYVAAYEGGIITDNAIGGLNKKIDLSVVPAVTFTNPTVATVGLTEEQAKEKGYDVKTSVLPLDAVPRAIVNRETTGVFKLVADAETLKVLGVHIVSENAGDVIYAASLAVKFGLTIEDLTETLAPYLTMAEGLKLVALTFDKDISKLSCCAG

SEQ ID NO: 93420 - protein, 189 aa, Halobacterium sp. NRC-1
MRRADCRNTMPVDATVHTSEGEFDIELYDERAPRTVENFLNLARHEPAADADPAPDTVTWEDPESGEIRGDSLYAGVSFHRIIEGFMIQGGDPTGTGRGGPGYEFADEFHDDLTHDGPGVLSMANSGPDTNGSQFFITLDAQPHLDGRHAVFGAVTDGMDVVETIGDVETDANDAPASEITIDRVEIHE

SEQ ID NO: 93421 - protein, 419 aa, Oryza sativa Indica Group
MALLRAHHLLLMRPRAAFSSRPPPLSSSPCRRALPTTAVASRLLCSHHASSPPDDAPTSASPSIVADLLDYLNESWTQFHATAEAKRQLLDAGFTLLSENDDWDLQPGGRYFFTRNMSCLIAFAVGEKYKLGNGFNIIAAHTDSPCLKLKPRSASFKSGHQMVNVQTYGGGLWHTWFDRDLTLAGRVILKDADGSFKHELVKVLSDEIGCKSDEIIGMELNVCDTQPSCLGGGNNEFIYSGRLDNLASCYCALRSLMDSSKMPEELSNEKAIRMIALFDNEENYLDVSADMAHALHPNYPDKHEEHHRPELQKGLVIKHNANQRYATSAVTAFLFKEIARHHNLPVQEFVVRNDMGCGSTIGPILASGVGIRTVDCGIPQLSMHSVREMCGKEDVDTTYRHFKAFFEMFSDIDRKLNVD

SEQ ID NO: 93422 - protein, 398 aa, Arabidopsis thaliana
MASTSLLKASPVLDKSEWVKGQSVLFRQPSSASVVLRNRATSLTVRAASSYADELVKTAKTIASPGRGILAMDESNATCGKRLDSIGLENTEANRQAFRTLLVSAPGLGQYVSGAILFEETLYQSTTEGKKMVDVLVEQNIVPGIKVDKGLVPLVGSNNESWCQGLDGLSSRTAAYYQQGARFAKWRTVVSIPNGPSALAVKEAAWGLARYAAISQDSGLVPIVEPEILLDGEHDIDRTYDVAEKVWAEVFFYLAQNNVMFEGILLKPSMVTPGAESKDRATPEQVAAYTLKLLRNRVPPAVPGIMFLSGGQSEVEATLNLNAMNQAPNPWHVSFSYARALQNTCLKTWGGRPENVNAAQTTLLARAKANSLAQLGKYTGEGESEEAKEGMFVKGYTY

SEQ ID NO: 93423 - protein, 411 aa, Synechococcus elongatus PCC 6301
MSESLESLARLAHWRHELRTPINAILGYSQLLLEDWAGTAIATDLERIESAGQELLRLVNEILDPHSSDRGLSLDTYQARLRYALRTPVNTVCGYVELLLEEDSPELAESRVDLERISAAGERLLEQLEAMAAWDQPASQASAVALSEMEVEVAESVLRYRQAAVSASAVTGGRLLVAEDNEINRDVLERRLRRLGHDVVCVASGQEALNQLAQQPFDLLFLDLMMPGLTGFEVLQQLKADPTLAELPVLMISALDDLESVIRCLRLGATDYLTKPFEPTLLQTRLETCLQHKRLRDRELDYLRNVAIVTDAAVAVEAGDYDRDRLQTVAERSDALGQLARMFRQMTRSVEQRETQLKQTIRRLELQIDTATVKSQVKEITESDYFRDLESRARQIRRDRSYRSSPPDRHA

SEQ ID NO: 93424 - protein, 392 aa, Oryza sativa Indica Group
MSPISSWIRAAREINLSKPPVLFVVFGQQTELYSLVIEQRIGGCSWFLEENHLPCQLSTSRRKKTTRQYRGSMEEEPSATCRYFCHMCSLIVRPEMGIEEVKCPHCHSGFVEEMVGGDDDDGRRSGNAAAGGRGAASEENADDEATPAPPPWAPMLIDLLGVSSRRHGLDDGSSDLAAFARRQYRNIAFLQLLSALQDDDEAGGDTPGDSGRERLVLVTPADGNDAAATSGFTLGDLFLGPGLDLLLDYLADTDPNRQGTPPARKEAVAALPTVRVHDAAGATCPVCLDEFEAGGEAREMPCKHRFHDGCILPWLEAHSSCPVCRYQLPTDDEPTAGNVVVAAEGGDELIGNARGGGGDGDGDGGSSGRRRWLSWPFGGLFSHRSSGSSSSS

SEQ ID NO: 93425 - protein, 222 aa, Physcomitrella patens subsp. patens
MGTQSLIYSFVARGSTVLAEYTAFSGNFSTIAVQCLQKLPPNNNKFTYTCDRHTFNYLVEEGYTYLVVADEEFGRQIPFAFLERVKEDFKRRYAGGKADSAIANSLDKEFGPKLKDHMQYCVDHPDEMNKISKIKSQVAEVKGIMMDNIEKVLDRGEKIELLVDKTENLRFQADNFQRQGKQLRRKMWFQNMKVKLIVLAIIIVIIIIIWLSICRGFTCSNR

SEQ ID NO: 93426 - protein, 562 aa, Vibrio vulnificus CMCP6
MNNDKRPLYIPFAGPALLSTPLLNKGSAFSAEERISFNLEGLLPETTETIQEQVERAYMQYKAFESDMDKHIYLRNIQDTNETLFYRLVQNHITEMMPIIYTPTVGAACENFSNIYRRGRGLFVSYANRDRIDDILNNASNHNVKVIVVTDGERILGLGDQGIGGMGIPIGKLSLYTACGGISPAYTLPIVLDVGTNNPQRLADPMYMGWRHPRITGADYDAFVEEFIQAVQRRWPDALIQFEDFAQKNAMPLLERYKNRICCFNDDIQGTAAVTVGSLMAACQAAGSKLSEQRITFLGAGSAGCGIAEAIIAQMVSEGISDKKARSQVFMVDRWGLLQEGMPNLLDFQQRLVQKHSVTAKWETEANGFSLLDVVKNAKPTVLIGVSGAPGLFTQEVIQEMHKHCPRPIVFPLSNPTSRVEAVPADIIRWTNGDALVATGSPFDPVIHEGKTYPIVQCNNSYIFPGIGLGVLAVNAKRVTDEMLMESSRALATCSPLAINGKGALLPPLEEIHTVSKRIAYAVAKKAIEQGVALEIADDALQVAIEQHFWQPVYRRYKRTAF

SEQ ID NO: 93427 - protein, 495 aa, Oryza sativa Indica Group
MAAAVRPTVKGSCSSGGHAGAGRGAGWAPRRRDRRRGGPRRGRSTRASSRRGRRRPRSGYQSRMSRAEQVGPEIRTGFLKDGKPIQLKQGKEITITIDYSIKGDENLISMSYHKLAIDLKPGSTILCADGTITLTVLSCDCEQGLVRCRCENSAMLGERKNVNLSGVIVDLPTLTEKDKVDILQWGVPNKIDMIALSFVRKGSDLMLVRSVLGEHAKSILLMSMVENQEGVANVDEIIANSDAFMVARGDLGMEIPIEKIFYAQKVMIHKCNIHGKPVVTATQMLESMIKSPCPTRAEATDVANAVLDGTDCVMFSGETAAGAYPELAVQTMANICLRAESYLDYPFIFKKLSSEAPVPLSPLESLASSAVQTANISKASLILVLTRGGTTARLIAKYRPAMPVLFVVVPELKADDSFNWTCSDEAPARQSLIVRGLIPMLSTATPKAFDIESTDEAILSGIDYAKKLGLCNSGDSVVVLHRIGGYSIVKIVTVN

SEQ ID NO: 93428 - protein, 394 aa, Prochlorococcus marinus subsp. pastoris str. CCMP1986
MTETKLISTLNKENLPHLDKTYVPSRLLLGPGPSNANPEVLKALALNPIGHLDEAYIELMSEVQKLLRYTWQCNNRITLPMSGTGSAAMEASIANFIEPGEKILIAKKGYFGDRLVDMASRYNADVSVIEKEWGEAFTFEEIKYEIETKKPVIFAIVHAETSTGVLQPLEGIGDLCRKNNCLFLVDAVTSLGALELFIDDWKIDLAYSCSQKGLSCPPGLSPFTMNKRAEDKLSARTSKVPNWYLDLSLLNRYWGSDRVYHHTAPVNMNFAIREGLRLIANEGLENIWRRHNSNAIKLWKGLESLGMDLHVSSEFRLPTLTTVKIPPAVDGDAYRNHLLKNFGIEIGNGLGALSGKVWRIGLMGFNSNEENVDRLLNLFDTELKKFSIFDSSSF

SEQ ID NO: 93429 - protein, 403 aa, Arabidopsis thaliana
MASLGLSFPPAAKTPTYLASSSSTFFSNSSLSVRTSQFRSRNSVFACVKCDMPESLNVGNGNPSIPIINERTLPKFLESARMEKSVNRTNTRLKLFSGTANPALAQEIAWYMGLDLGKVNIKRFADGEIYVQLQESVRGCDVYLVQPTCTPTNENLMELLIMVDACRRASAKKVTAVIPYFGYARADRKTQGRKSIAAKLVANLITEAGADRVLACDLHSGQSMGYFDIPVDHVYCQPVILDYLASKSIPSEDLVVVSPDVGGVARARAFAKKLSDAPLAIVDKRRSGHNVAEVMNLIGDVRGKVAIMVDDMIDTAGTIVKGAALLHQEGAREVYACCTHAVFSPPAIERLSGGLLQEVIVTNTLPVAEKNYFPQLTILSVANLLGETIWRVHDDSSVSSIFL

SEQ ID NO: 93430 - protein, 473 aa, Prochlorococcus marinus subsp. pastoris str. CCMP1986
MAKSPQDVLSQIKDEGIELIDLKFTDIHGKWQHLTLTSDMIEEESFTEGLAFDGSSIRGWKAINASDMSMVPDSSTAWIDPFYKHKTLSMICSIQEPRSGEPYNRCPRSLAQKALKYLDSTGIADTAFFGPEPEFFLFDDVRYDSKEGSCFYSVDTIEAPWNTGRTEEGGNLGYKIQYKEGYFPVAPNDTAQDIRSEMLLQMAELGIPTEKHHHEVAGAGQHELGIKFDSLISSADSVMTYKYVVRNVAKKYGKTATFMPKPVFNDNGTGMHVHQSLWESGQPLFYGEGSYANLSQTARWYIGGILKHAPSFLAFTNPTTNSYKRLIPGFEAPVNLVYSEGNRSAAVRIPLTGPNPKAKRLEFRSGDALANPYLAFSVMMLAGIDGIKNQIDPGDGVDVDLFELPAEELSKIDTVPSSLNDSLNALKADKDYLLAGGVFTEDFIDNFIDMKYEEVQQLRQRPHPHEFFMYYDA

SEQ ID NO: 93431 - protein, 426 aa, Lactobacillus plantarum WCFS1
MQQPLAYRMRPKTLKDVVGQQQLVGPGKIIARMVKAKRLSSMILYGPPGTGKTSIASAIAGSTKYAFRMLNAATDSKKQLQIVAEEAKMSGTVILLLDEIHRLDKTKQDFLLPHLESGRIILIGATTENPYISINPAIRSRTQIFQVFPLTDDDIQHAVERALADEKNGLGSYHVDLAPAAMHHLCTATNGDLRSALNGLELAVLSSSPADDGTIAISQQTIEECLQKKALSADKDGDAHYDVISAFQKSIRGSDVNAALHYLARLVEAGDLKSIMRRLMVIAYEDIGLANPAACAHTVAAVQAADQLGFPEARIPLADAVIELALSPKSNSGISAIDAALTTVRDGHFGDIPADIKDAHYQGAAKLGHGVGYDFPHDHPGDWVAQQYLPDAIKSAKYYEPKTNGRYETALAQQYEKLLKANERNR

SEQ ID NO: 93432 - protein, 403 aa, Moritella sp. PE36
MDEHVVILIIALIVLFYGFISKKLAQFDISGPMVFTVLGLICSPFGFGITAVEVDAEFVTVLVEIALVLVLFSDAALLDLKLLRRSWQIPARLLFIGLPLTIIAGTAVAVWLFPEQPITYMILLALLLTPTDAALGKAVVTDPKVPKIIRSIINVESGLNDGIVFPIVLTVVALITSGLTKANDYSWIWYVAEQIVFGMLVGGMVGYLGAKLLNKAIEHNWIQESYQNLIPIALAILGFYLAEALLGNGFIAAFFAGLYIGNTSKQARIHIEEFAESEGELFILISFFLFGLAFVPLTLHDISVNVVIYALLSLTVLRMLPVMVSLMGTDLDFASRVFIAWFGPRGIASILYVLIVVHNVGDIGGFDIVYAVVTLTILMSIFAHGFSAQPFSNLYSKKHRNEA

SEQ ID NO: 93433 - protein, 256 aa, Gibberella zeae PH-1
MPGVGFGTFANEGAKGETYKAVIAALKTGYRHLDCAWFYLNEGEVGQAVRDFLAEDNGVKREDLFICTKVWNHLHEPEEVKWSFENSLKNFGLDYIDLFLVHWPIAAEKGDDYQPKIGPDGKYVIKKDLTENPEPTWRAMEEIYASGKARAIGVSNWTIDGLKQLMAFAKVKPAVNQIEIHPFLPNEDLVKFCLENDILPAAYSPLGSQNQVPTTGETVRSNKTLNEVADRSGNTLAQVLIAWGLRRGYAPVRRGL

SEQ ID NO: 93434 - protein, 389 aa, Xanthomonas campestris pv. vesicatoria str. 85-10
MNFHEYQSKQLLAEYGIPVPAGKVAATPDEAVEVANSLGNGPWMVKAQIHAGGRGKAGGVKFCKTTDDVKAAAAKMLGTKMSTYQTAGVELPINLVLVTTAGEIVKELYLSILVDRGTKTITYIASSEGGVEIEQVAAETPELIHALNVDFVEGVQGYHGRDFGFKLGLNAKQAGQFASIMVNLYRLFNEKDLALVEINPLAILDDGNLYALDGKFDSDDNAAFRQKQLVAMRDKTQEDETEVTASELDINYVTMDGNIGCMVNGAGLAMATMDVIKLNGGEPANFLDVGGGANKQRVIEAFKLILSSDKVEGIFVNIFGGIVRCDMIAEGIIAAVKEVGVKVPVVVRLEGTNVEEGKQLLRDSGMAIIPADNINDGAKKVVEAVKNAA

SEQ ID NO: 93435 - protein, 499 aa, Rhodospirillum rubrum ATCC 11170
MTQAAPPIDWTARARALRLPNHALIDGAPASAGDGATFDCVSPIDGRVLTRVAACGAADVDRAVAAGRAAFEDRRWCGLSPAARKKILLAFAERIEAHRDELALLETLDMGKPIADSLAVDVPATARCLRWYAEALDKVYGEVAPTGDDVLATITREPLGVVGVVVPWNFPMIMAAWKIAPALAAGNSVVLKPAEQSPLTAIRLGELALEAGLPAGVLNVVPGLGPVTGRAIGLHPDIDGAFFTGSTAVGKLFLSYSSQSNMKRLGLECGGKSAHIVLASCKNTTAAAQAAASAIFFNQGEMCTAGSRLIVERAIADEVIEKVVAEAAFWRPGPPLDPATRMGALVDAEQTERVLGYIALGQDEGARLATGGSRAMAESGGCYVEPTIFTGVAPTMRIAREEIFGPVLSVITVESADEAVRVANDSDYGLAAAVWSDDVTTLHRVAKRLRAGMVYANCYDADDITVPFGGFKQSGIGRDKSLHAIDKYTELKTTWLRLG

SEQ ID NO: 93436 - protein, 232 aa, Stephanomeria virgata subsp. virgata
GGRYSVCSAVGVLPLSLQYGFPVVEKFLKGARSIDQQFLSAPFEKNIPVLLGLLSVWNVSFLEYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVASHLVPHKTFTGNRPSLSVLLPSLDAYRIGQLLAIYEHRIAVEGFIWG

SEQ ID NO: 93437 - protein, 890 aa, Arabidopsis thaliana
MKSLHWFLHLLIIAFTVLRSVEAQNQAGFISLDCGLVPKETTYTEKSTNITYKSDVDYIDSGLVGKINDAYKTQFQQQVWAVRSFPVGQRNCYNVNLTANNKYLIRGTFVYGNYDGLNQFPSFDLHIGPNKWSSVKILGVTNTSMHEIIHVVPQDSLEVCLVKTGPTTPFISSLEVRPLNNESYLTQSGSLMLFARVYFPSSSSSFIRYDEDIHDRVWNSFTDDETVWISTDLPIDTSNSYDMPQSVMKTAAVPKNASEPWLLWWTLDENTAQSYVYMHFAEVQNLTANETREFNITYNGGLRWFSYLRPPNLSISTIFNPRAVSSSNGIFNFTFAMTGNSTLPPLLNALEIYTVVDILQLETNKDEVSAMMNIKETYGLSKKISWQGDPCAPQLYRWEGLNCSYPDSEGSRIISLNLNGSELTGSITSDISKLTLLTVLDLSNNDLSGDIPTFFAEMKSLKLINLSGNPNLNLTAIPDSLQQRVNSKSLTLILGENLTLTPKKESKKVPMVAIAASVAGVFALLVILAIFFVIKRKNVKAHKSPGPPPLVTPGIVKSETRSSNPSIITRERKITYPEVLKMTNNFERVLGKGGFGTVYHGNLDGAEVAVKMLSHSSAQGYKEFKAEVELLLRVHHRHLVGLVGYCDDGDNLALIYEYMANGDLRENMSGKRGGNVLTWENRMQIAVEAAQGLEYLHNGCRPPMVHRDVKTTNILLNERCGAKLADFGLSRSFPIDGECHVSTVVAGTPGYLDPEYYRTNWLSEKSDVYSFGVVLLEIVTNQPVIDKTRERPHINDWVGFMLTKGDIKSIVDPKLMGDYDTNGAWKIVELALACVNPSSNRRPTMAHVVMELNDCVALENARRQGSEEMYSMGSVDYSLSSTSDFAPGAR

SEQ ID NO: 93438 - protein, 268 aa, Ralstonia solanacearum GMI1000
MPYTAPKRIALIDIPFFHRPMFTRIREDIRAIMERDPAARSRWEVLTCYPGLHAIIVHRAAHACWGAGFRWLGRWLSHLGRFLTGIEIHPGAQVGRRVFIDHGMGVVIGETAEIGDDCTIYQGVTLGGTSLYKGAKRHPTLGKGVVVSAGAKVLGGFVIGDGARVGSNAVVLKPVPAGATAVGIPARILERDVPGAVQPALKQEFSAYGITPDADDPVSLALKRLIDHSALQQERIESILSALDRLGAHLENSPNDPFDASELKRMLK

SEQ ID NO: 93439 - protein, 401 aa, Magnaporthe grisea 70-15
MSASLLFGLSILAASVTPVLSSCAYGTHLMPRAEGGEVKVGKFGYAGAIAPANWVALDPVANAACNTGTRQSPISMTTGNFQIVQASEVQLDIPDFPATEFENLGTTVEVIAKGGKMSVAGVNYDLQQFHFHLPSEHLDNGTSMAMEMHMVWQSAAKEIAVIGMYIDIEGNPAAAPAAAAPAPAQPARRHARHLEAREGAAAPAAAEPAAAVPAMQQMGETARIAAAPVKSNLLATIMPEVSKIATPGTKTETPPLVMSELVQQIKSGSFQSYSGSLTTPPCSEGVRWLVSTQKLAISAQNFFAMRNVIGFNARFAQNSPGQPNLMSLATAAAGASAPAAPAAPAAEGAKQKQQLTEAEKAAKKAQKAAKKAGKANNATAPAAPPAVPAAVAGAILGSTSV

SEQ ID NO: 93440 - protein, 263 aa, Corynebacterium glutamicum ATCC 13032
MWKDEVQEAIGEPFVQAPEVIEKMRETSRIAANSLKIAGEAVKPGVTTDELDRIVHEYTCDMGAYPSDLGYRGFTKSSCISLNEIVCHGIPDSTVIEEGDIVNIDVTAFKHGVHGDCNATFLAGDVSEEHRLLVERTEEAMMRSIRAAKPGREINVIGRVIESYAKRFGYNVVRDFTGHGIGPTFHNGLVVLHYDNTQYRDLLVPGMTLTIEPMINLGSLDYEIWEDDWTVQNVDRKFSAQFEHTIVITEDGNEILTLPDDSV

SEQ ID NO: 93441 - protein, 403 aa, Glycine max
LFDFSFISFAGQNPFRRKTHRNLCGSQLRFRLHRAPLTRSIYICMYMGKTRWLIILVTCLCLLSFSDGRELKVRHKKQHYQYNHTVATILVEYASAVYLSDLTELFTWTCSRCNGLTKGFEMIELVVDVEHCLQAFVGVADDPHAIIIAFRGTNEHSLQNWIEDLYWKQHDINYPGMDDAMVHRGFYTAYHNTTIRPAILDAVERAKKFYGDIEIIATGHSMGGAMASFCGLDLTVNQNEKNVQVMTFGQPRIGNAAFASLYTKLVPNTIRVTNDHDIVPHLPPYYYYLPQKTYRHFPREVWLYNIGLGSLVYSVEKICDESGEDPNCSRSVTGNSIADHLVYYGVDMGSDEPSSCRIVMDSYVQNTNIKDSRGNLILSRDPATPLIKLSGEGDNQENPINVD

SEQ ID NO: 93442 - protein, 888 aa, Arabidopsis thaliana
MRFLSFLIFVFAVLGLVQAQDQSGFISLDCGLVPTEITYVEKSTNITYRSDATYIDSGVPGKINEVYRTQFQQQIWALRSFPEGQRNCYNFSLTAKRKYLIRGTFIYGNYDGLNQLPSFDLYIGPNKWTSVSIPGVRNGSVSEMIHVLRQDHLQICLVKTGETTPFISSLELRPLNNNTYVTKSGSLIVVARLYFSPTPPFLRYDEDVHDRIWIPFLDNKNSLLSTELSVDTSNFYNVPQTVAKTAAVPLNATQPLKINWSLDDITSQSYIYMHFAEIENLEANETREFNITYNGGENWFSYFRPPKFRITTVYNPAAVSSLDGNFNFTFSMTGNSTHPPLINGLEIYQVLELPQLDTYQDEVSAMMNIKTIYGLSKRSSWQGDPCAPELYRWEVLTFGLSIRNLSGSNLSGTITSDISKLTHLRELDLSNNDLSGDIPFVFSDMKNLTLINLSGNKNLNRSVPETLQKRIDNKSLTLIRDETGKNSTNVVAIAASVASVFAVLVILAIVFVVIRKKQRTNEGPRSFTTGTVKSDARSSSSSIITKERKFTYSEVLKMTKNFERVLGKGGFGTVYHGNLDDTQVAVKMLSHSSAQGYKEFKAEVELLLRVHHRHLVGLVGYCDDGDNLALIYEYMEKGDLRENMSGKHFNLVESISLDSLKHSKPGTGKHSVNVLSWETRMQIAVEAAQGLEYLHNGCRPPMVHRDVKPTNILLNERSQAKLADFGLSRSFPVDGESHVMTVVAGTPGYLDPEYYRTNWLSEKSDVYSFGVVLLEIVTNQPVMNKNRERPHINEWVMFMLTNGDIKSIVDPKLNEDYDTNGVWKVVELALACVNPSSSRRPTMPHVVMELNECLALEIERKQGSQATYIKESVEFSPSSASDFSPLAR

SEQ ID NO: 93443 - protein, 246 aa, Salmonella typhimurium LT2
MLEQVCQLARNAGDAIMQVYDGAKPMEYARKQDDSPVTAADIAAHTVILEGLRTLTPDIPVLSEEDPPAWEVRQHWQRYWLVDPLDGTKEFIKRNGEFTVNIALIEQGKPVLGVVYAPVLKVMYYAAEGKAWKEECGVRKQIQVRDARPPLVVISRSHTDDELTEYLQQLGEHQTTSIGSSLKFCLVAEGQAQLYPRFGPTSVWDTAAGHAIAVAAGAHVHDWQGKTLDYTPRESFLNPGFRVTIY

SEQ ID NO: 93444 - protein, 87 aa, Zea mays
MNSSSIRVHFAIRVHFVLILVKPWQRKLLLTVLVPMKQAYYLPETEYVHWARSHPEFSTSQVVGLVNLVATMKGWRRKTRLETVEKN

SEQ ID NO: 93445 - protein, 375 aa, Roseovarius nubinhibens ISM
MLRAISKQTMDHRGPDFAEVGLTAIAGMKTIFKTKQRVFIYPSSGTGAWEAALVNTLAEGDKVVMYETGHFATQWKKMASKLGIDAEFIEGDWRSGADADRIEARLRQDTGHEIKAVCVVHNETSTGSVSPIAEVRRAIDAAGHPALLMVDTISGLASIDFQFDTWGVDVAVSGSQKGLMLPPGLSFNAVSDKAFELSKTGGMRRSYWDWQDMDAINGSGYFPYTPGTNMLYGLNEAIAMLHEEGLDNVFARHQRHGAATRSAVRHWGLEVLCRQQGQESGVLTAVLMPEGHSADAFRATTLQHYDISLGNGLSKVADRVFRIGHLGDFNDLTLAGTLTGVELGLRKSGVPHTEGGVAAAMAVLETTQFDTVAAE

SEQ ID NO: 93446 - protein, 436 aa, Saccharomyces cerevisiae
AVSKVYARSVYDSRGNPTVEVELTTEKGVFRSIVPSGASTGVHEALEMRDGDKSKWMGKGVLHAVKNVNDVIAPAFVKANIDVKDQKAVDDFLISLDGTANKSKLGANAILGVSLAASRAAAAEKNVPLYKHLADLSKSKTSPYVLPVPFLNVLNGGSHAGGALALQEFMIAPTGAKTFAEALRIGSEVYHNLKSLTKKRYGASAGNVGDEGGVAPNIQTAEEALDLIVDAIKAAGHDGKVKIGLDCASSEFFKDGKYDLDFKNPNSDKSKWLTGPQLADLYHSLMKRYPIVSIEDPFAEDDWEAWSHFFKTAGIQIVADDLTVTNPKRIATAIEKKAADALLLKVNQIGTLSESIKAAQDSFAAGWGVMVSHRSGETEDTFIADLVVGLRTGQIKTGAPARSERLAKLNQLLRIEEELGDNAVFAGENFHHGDKL

SEQ ID NO: 93447 - protein, 414 aa, Vibrio vulnificus CMCP6
MNWSPNQVRAQFPALAQYHNQRPVTFFDGPGGSQVPQSVLDAMVGYLGHFNSNLGGHYFSSHKTVEVMKQARQSAQALLNAPSQDNIVFGANMTSLTFQLSRAISRDWQAGDEVIVTALDHYSNVSSWEQAAEDKGVTVHQVRVNPEDCTLDMEHFKQLLNARTKLVAVTFASNTTGTIVDIASVVKLARSVGALVYVDAVHYLPHHLVDVQALGCDFLACSAYKFFGPHVGIAYVASPWLETLRPYKVEPATNIGPGRFETGTQSFEGLAGVSAAIEYLAQFGEEGASLRQRLEQSYARYAQHEQTLSQHFLQRLSALDGVTLYGINDASSDKRTPTFAITVKGYSPEFMAKTLGEHNICVWNGHFYALGLIRQLGLEFSGGVIRIGCMHYNTVEEVDLLFNVLESIVDQPSA

SEQ ID NO: 93448 - protein, 612 aa, Arabidopsis thaliana
MAGGIVSPASLLDLIADIVEIPLNTGMFKKDCADLTRRVCLLTHLLEEIRDSTPIDSAASSSSENDCWSDLVVGLQAAKRLLSTARFQARDSSDGAAKRISFQFQCVTWKLEKALSNLPYDLYDISDEVGEQVELARSQLRRAMQRYGSLNSNKFSSALSEPMERDGFSNVIKIKAEEKLESVSETLHFGEEEEKQSSPPLRRSSSISLAYYLSKDADTDRLDKMVNKNTDESKKSDKLTIPVDFLCPVSLELMKDPVIVATGQTYERAYIQRWIDCGNLTCPKTQQKLENFTLTPNYVLRSLISRWCAEHNIEQPAGYINGRTKNSGDMSVIRALVQRLSSRSTEDRRNAVSEIRSLSKRSTDNRILIAEAGAIPVLVNLLTSEDVATQENAITCVLNLSIYENNKELIMFAGAVTSIVQVLRAGTMEARENAAATLFSLSLADENKIIIGGSGAIPALVDLLENGTPRGKKDAATALFNLCIYHGNKGRAVRAGIVTALVKMLSDSTRHRMVDEALTILSVLANNQDAKSAIVKANTLPALIGILQTDQTRNRENAAAILLSLCKRDTEKLITIGRLGAVVPLMDLSKNGTERGKRKAISLLELLRKACQ

SEQ ID NO: 93449 - protein, 273 aa, Bacillus licheniformis ATCC 14580
MKRIGFIGAGSMAEAMIKGLVKSGAMEPEAIFVTNQSNTARLRELSETYGVCGEADTAKVAARSDTLVLAMKPKDAAGGIAALRPYLRKEQLLISVLAGIPIHTIQHYAGLELPVVRAMPNTSAAIQKSATAFAASPLVTKEQMQEAADLFATVGSVTIVEESALDAVTAVAGSGPAFVYRFVEALQASAAELGLPEKTAKQLIIDMMAGAAQMLETGRDPSVMRKEITSAGGTTEAGLRMLDDHQFEQTVISCVKEAANRSAELRDMFAAKI

SEQ ID NO: 93450 - protein, 450 aa, Physcomitrella patens subsp. patens
MPPSTMQDSYTSTPRKMKIDRSNYFGRVASRWHTTASARLLACSAVLLILTLFVMYRISSISGGIVEGGIIGRSVAAFKPTHEWELKVRQSCVPKRLEEDVMVVLVTGAAGFVGTHVSLSLKKRGDGVVGLDNFNDYYETSLKRARLDLLEKHGVFVVEGDINDETLLMSLFEVGQITHVMHLAAQAGVRYAVQNPRSYVHSNIAGLVNLFEVCKAANPQPAIVWASSSSVYGLNNKVPFSESDRTDQPASLYAATKKAGEGIAHTYNHIYGLSITGLRFFTVYGPWGRPDMAYFSFTQDILRGKAINIYTGSGGKDLARDFTYIDDIVKGCMRALDTAEKSTGSGGKKTGPAQLRVFNLGNTSPVTVPILVDILEKHLKQKAIRNIVKMPRNGDVPFTHANTSSAQSQLNYHPTTNLDTGLRKFVKWYLSYYGVGTDHRLWLGDREQIV

SEQ ID NO: 93451 - protein, 666 aa, Physcomitrella patens subsp. patens
ESIMDERFKIRDLDSGKQFLMKKFNRDGSLNMLREMDTGKDLTFAEFERTLGLVSPVTQELKMRQLALDGQVSIRNSEPKTDEKAPSTTKRRGWLRKLKDASSVVGSISGDASPKGDSSFSGLKRKEFTKCDSMPGLPIDDVDDSFWRSPQKVKVRSRQKSSRDLSDLHLSQEISAHQGAIWTMKFSPDGCYLASAGQDRIIHVWEVIDHPQRESSVKGDNDGSIKAGQDRIMSKIDKEGSIKSGRGTLRKLKSSNQSKGPVPKLFWLSEKPICSFKGHTEDILDLSWSRSQFLLSSSMDNTVRLWHISYDECLRIFPHNDFVTCAQFNPLDDRYFLSGSLDDKVRIWSIPDHHVVDWSDLQEMVTAVCYTPDGKKAIVGSYKGTCRFYNAIGNKLQLQAHVDVREESKKARGKKITGLHCMPKDPNKVLVTSNDSRVRVYDGLDLVAKYKGLRNVKSQISSSFSPNGDFIISASEDSRVLVWSSANRDISNKSSLYRKDKQLSCEEFTSRHVSVAIAWPDSSVRSACDPPGRSERFGSVQQVESGSLGNHGHQLDASPVDISAKVSVQSLSLEENPSYLQRRPSFFPERGSTTWPEEKLDSLRMSRPSMMQSASIVSNMSDLNGGEVTPPSDLVNVSAAWGLVIVTAGLGGEITTFQNYGFPVRL

SEQ ID NO: 93452 - protein, 620 aa, Kluyveromyces lactis NRRL Y-1140
MKTCYYDLLDVKSDATDTDLKRAYRKKALLYHPDKNRNNIEEATEVFAQIRAAYEVLSDAQERAWYDAHKDQILNDSIDDAYDSDGSNVVDSSVTGVTTEELLKFFDGGMYSRIDDSPAGLYQIGGKIFAKLAGDEVRNGRKLGMAAFKDVVDDTVDADIVSIGYVNSMEKYKESNLLLPTFGYSGTSYQEVKVFYKKWGNFSTVKSFSWKDEYMYSRNYDRRTKREINKRNEKLRTQARSEYNKTVKRFVTFIKKFDKRMKEGARKQEEEKKLRLQNALKSQISKDKDVEMSKKQADFALQDWQTIDHNRLQEIDEYYLSKDQKKAPTDGEHHINNDLEDVLIYECFICNKNFKSEKQLENHTNTKLHRKLLRQLQWEMKQESIALGLDNISDVDEFKSASETYSDNETSGSIHLSSPDEFEEIEESDTFSFSDIDAELKKIDEDLDALNSTESNINNFMLETSEDDKQISDVEYIIDDEVDENISQKVETNNATQVSKNENQNKDTEPKDDLAMLLESLKKDNADTSWEPKKKNNGKKNKSRKKQTNSTTQIDSNTTSGNNAENKISADIDSFICSTCGVKFDTRNKMFKHLDSTNHAAPLSTNKKGSKKRNIRNNSK

SEQ ID NO: 93453 - protein, 492 aa, Bacillus licheniformis ATCC 14580
MKKDQMEPKAVIVIFGATGDLAKRKLYPSIHRLYENGQIGNEFAVVGVGRRPWTNEDFRSTVQQSVSKFPLNEKDVDEFTSHFYYHPFDVTNSGSYRELNELIEKLESTYDIPNNRMFYLAMAPEFFGTIAKFLKSEGVTSTTGWSRLVIEKPFGHDLPSAKALNQEIREAFTEDQIYRIDHYLGKQMVQNIEVIRFANAIFEPLWTNRYISNIQITSSEDLGVEDRARYYEKSGALRDMVQNHILQMVALLAMEPPIKLNTEEIRSEKVKVLRALRPIQKDDVDQFFVRGQYDAGVVDEKHVPAYRDEQNVAKDSNTETFVAGKLLIDNFRWAGVPFYIRTGKRMQKKSTQIVVQFKDIPMNLYYGNGNTMHPNLLVIHIQPDEGITLHLNARKLGGGTFAQPIKLDYCHNCGDGINTPEAYEKLILDCLHGDATNFAHWDEVALSWSFVDAISQNWEENKTLSPNYKAGSMGPKASDDLLAKDGFHWWPL

SEQ ID NO: 93454 - protein, 151 aa, Glycine max
MKMGGGCKCLVSLVLALVLMRSLAEAQSGTSTTCAQELIPCVNFLNGTTTPPSSCCDPLKQTVENQLDCLCNIFFSPGLLQSFNVSVDQALALSRRCGVTNGITSCSNGSAPAPGSGPPPVTPGGDKGGAGRVTFTGLSFLLLFWVSMLFN

SEQ ID NO: 93455 - protein, 464 aa, Triticum aestivum
  misc_feature (196)..(196): Xaa can be any naturally occurring amino acid
  misc_feature (210)..(210): Xaa can be any naturally occurring amino acid
  misc_feature (275)..(275): Xaa can be any naturally occurring amino acid
  misc_feature (381)..(381): Xaa can be any naturally occurring amino acid
  misc_feature (388)..(388): Xaa can be any naturally occurring amino acid
  misc_feature (398)..(398): Xaa can be any naturally occurring amino acid
  misc_feature (415)..(415): Xaa can be any naturally occurring amino acid
  misc_feature (421)..(421): Xaa can be any naturally occurring amino acid
  misc_feature (424)..(424): Xaa can be any naturally occurring amino acid
  misc_feature (431)..(431): Xaa can be any naturally occurring amino acid
HSITSLYKKAGWYRSGIPGISSTHASDDGGGEALDLVYERLEAMDASTAEKRAAEILFGLGFDKQMQAKPTRDFSGGWRMRIALARALFMNPTILLLDEPTNHLDLEACVWLEEKLKNFERILVVISHSQDFLNGVCTNIIHMQNKTLKLYTGNYDQYVQTRSELEENQMKQYKWEQEQIANMKEYIARFGHGSAXKLARQAQSKEKTLXKMERGGLAEKVVNDRILVFRFTDVGKLPPPVLQFADVTFGYTPDNLIYKNLDFGVDLDSRVALVXGPNGAGKSTLLKLMTGDLSPLDGMVRRHNHLRIAQFHQHLTEKLDLLDLDMPALQYMMREYPGNEEEKMRAAIGKFGLSGKAQVMPMKNLSDGQKARVIFAWLAFXQPQMLLXDEPTNHPDIXTNDSLAEALKEWDGGLXLVNHDXKLXNQVAKNXGPLKQRYKLEIGLSKLKKGGPKSLPPRPWIQFR

SEQ ID NO: 93456 - protein, 160 aa, Ustilago maydis 521
MVVKTIESYEEFQTLINGDKPVVIDFWATWCGPCKVIGPIFEKISDTPAGEKLGFYKVDVDAQDKIAAEVGIKAMPTFVFFKGGQVVKQVVGANPQALQERQSCSDQGRVPGLDAFFSSFALEYCHQSRKLENVLKIWSTPVKEVVCQSGHRRYATVRMP

SEQ ID NO: 93457 - protein, 273 aa, Oryza sativa Indica Group
MGTLGRAIYTVGKWIRGTGQAMDRLGSTIQGGLRVEEQLSRHRTIMNIFEKEPRIHKDVFVAPSAAVIGDVEIGHGSSIWYGSILRGDVNSIHIGAGTNIQDNSLVHVSKANISGKVLPTIIGNRVTIGHSAVLHACIVEDEAFVGMGATLLDGVVVEKHSMVGAGSLVKQNTRIPSGEVWVGNPAKFLRKLTEEEMTFIAQSATNYINLAQVHAAENAKTFDEIELEKMLRKKFAHKDEEYDSMLGVIREIPPELILPDNILPNKAQKAVAH

SEQ ID NO: 93458 - protein, 416 aa, Ralstonia solanacearum GMI1000
MALIVHKYGGTSMGSVERIKNVAKRVAKWHRAGHQIVVVPSAMSGETNRLLGMAKEISAQPDPRELDMIASTGEQVSVGLLAIALHAEGIDAISYTGWQVPVQTDSAYTKARIQSIDDERVRADLEAGRVVVITGFQGIDGEGHITTLGRGGSDTSAVAVAAALEAEECLIYTDVDGVYTTDPRVVDDARRLDKITFEEMLEMASLGSKVLQIRSVEFAGKYRVKTRVLSSLTDPLMPLEVEMHSGTLITFEEDSNMEAAAISGIAFARDEAKITVIGVPDKPGIAYQILGPVADANIDVDMIIQNQSVDGKTDFTFTVPRGDYQRALGILNDSVKGHIGAANVSGDPKVSKVSVVGVGMRSHVGIASKMFRTLSEEGINIQMISTSEIKISVLIDEKYMELAVRALHKAFELDQA

SEQ ID NO: 93459 - protein, 333 aa, Oryza sativa
MGGGTGRGAMGGVPAGACGLWFSMEESSREGRWWPPARADGDGGRKKMRGGDSDKLIFERLQREFEAARTAQTEEIPIDDEQWNDGLLATIREKVHMEADRKAMANQANVPADPQFQSRTTYRVKNKVIYCLDGARIGIQYETYFAGEPCEIYHCVLESKSFLEKMTVIEHTLPFFLPIREVESEFLSSNAIKFIDHLEEILQSYVDRREQVRLIKELYGNQIGELFHSLSYNLIEFVMEDFECKVTVSIRYSDLLFTLPSQARVLAWPLRSSRGISVTERRASRSASAQLVPFRLPYAEDALKTLSLPEAFAEIVLSLPRALKRILSSQESD

SEQ ID NO: 93460 - protein, 759 aa, Malus x domestica
MGLLSEGLTQVVIPLAAVVGPGFALLQWFLVSKVKVSGGHGERNGFKDKLIGDEEEGVSSVEVTIKCAEIQHAISIGATSFLFTQYRYLSIFVGVFSTIIFLFLGSVKGFSTKSEACTYNTGNMCKPALANAFFSTIAFLLGAFTSVLSGFLGMKIATYANARTTLEARRGVGKAFIAAFRSGAVMGFLLAANGLLVLYITINLFKLYYGDDWEGLYESITGYGLGGSSMALFGRVGGGIYTKAADVGADLVGKVERNIPEDDPRNPAVTADNVGDNVGDIAGMGSDLFGSYAESSCAALFVASISSFGIGHDYTAMSYPLIISSMGIVVCLITTLFATNPFEIRKVSEIEPALKRQLVISTVLMTVGIAVVTFVALPSEFTLFSFGTNKAVKNWYLFFCVAIGLWAGLVIGYTTEYYTSNAYSPVQDVADSCRTGAATNVIFGLALGYKSVIIPVFAIAFAIYVSFSLAAMHGIAAAALGMLSTISTGLAIDAYGPISDNAGGIAEMAGMSHEIRERTDALDAAGNTTAAIGKGFAIGSAALVSLALFGAYVSRAGIETVDVLTPKVFIGLLVGAMLPYWFSALTMKSVGSAALKMVEEVRRQFNTIPGLMEGTAKPDYATCVKISTDASLKEMIPPGALVMLTPLIAGTSFGAETLAGILAGSLVSGVQIAISAFNTGGAWDNAKKYIEAGASEHAKSLGPKGSEPHKAAVIGDTIGDPLKDTSGPSLNILIKLMAVESVVFAPFFAAHGGLLFKWL

SEQ ID NO: 93461 - protein, 288 aa, Heliobacillus mobilis
MTDVKSKLAGSVQGPVGYLGPEGTFSDEAAQAFFLPETPRRPYSTIPMVYEGLNRWEIDAAVLPIENSIEGAVNQTLDALIENPGLFIVGEIILPVCHHFLVPPDVDWTEVTEVYSHPQPLAQCRHFLENRLPNAQATATNSTAEGAKKALQVSTAESPKGAIASEFVAKTYGLEIAVRDVQSRPNNKTRFVVVGRQLTEPTGNDKTSIVCALPSDRPGGLYEILREFAEREINLSRIESRPTKYELGQYLFFIDCAGHQRDRKVSEALNAIGRFTILTRVLGSYVRG

SEQ ID NO: 93462 - protein, 582 aa, Herminiimonas arsenicoxydans
MTSFTLHGIPVSRGIAIGRAHILAPAALDVQHYLIADDQVEAEVARLQDAITLVHAELQNIWNELPADAPAELGAFIDVHALILSDPMISEMPLDIIRSRYYNAEWALVTQIEELSAQFEEIEDTYLRERKSDIQQVGERVLKALTGSANILPKGEGAEGGASMIVVAHDISPADMLQFRNRAFSGFITDVGGQNSHTAIVARSLDIPATVGVSNASRLIDQGDWLIIDGDAGVVVVAPNSVVLDQYREKQARQMRERKKLGKLKKMPSVTLDGTPITLLANIEFPDDCAHAMDAGAHGIGLFRSEFLFMGRTGHANQLPSEDEQFESYKKAVIAMKGRPVTIRTLDIGADKPMDFAEQTALNPALGLRAIRFCLSEPQMFLTQLRAILRASAFGPIKLLVPMLAHAFEIDQTLLMIEQAKAQLREQKIKFDAELPVGAMIEIPAAALSLPMFIKRLDFLSLGTNDLIQYALAIDRVDHEVAHLYNPLHPAVLYLISTTIAMAAKAGIPISVCGEMAGDVQMTRLLLGMGLREFSMHPSQLLAVKNEILNSDLNALTPLTRKIVRSFEQEEIIEAVERLRVM

SEQ ID NO: 93463 - protein, 157 aa, Heliobacillus mobilis
MMIKIAPSILSADFSNLGSQVADVEAGGAEYLHIDVMDGHFVPNITIGPLVVASLRPRSQMVFDTHLMIEEPDRYIPDFIKAGSDLVTVHQEACTHLHRTVSLIREKGAKAGVALNPATSWQSLEYVLPMVDLVLVMSVNPWFWRSKVYQRRLAEDH

SEQ ID NO: 93464 - protein, 66 aa, Datura stramonium
VYILDQAEEEGHDLPYSCRAGSCSSCAGKVTAGTVDQSDGNYLDDDQMADGFVLTCVAYPQSDVTI

SEQ ID NO: 93465 - protein, 397 aa, Roseovarius nubinhibens ISM
MSLQNPTFIPGPTNLPEVLRKACDMPTIDHRSPLFGDILRPARAGVQQVLKSRDAEILIFPSTGTGGWETALTNTLAPGDTVLAARNGMFSQRWVDMCQRHGLTVEIVETPWGEGIPADRFEEILSADKAHKIKAVLATHNETATGVRSDISAVRRAMDAAAHPALLFVDGVSSIGSMDFRFDDWGVDIAVSGSQKGFMLPAGLAILGLSPKAMAAAETATLPRAFFDIRDMKRAYDNAAYPYTPLVGLLNGLNLSTKMLLDEGLDNVFARHRRIADGVRAAVAAWGLPLCAATPDLYSDTVSAVRTPEGVDATEIVRRAAADYGVAFGVGLGQLSGKAFRIGHLGSLTDVMMLSGLATLEMCMADLGLDIRPGSGVAAAQDVYRKSQTPQAREAAE

SEQ ID NO: 93466 - protein, 773 aa, Arabidopsis thaliana
MTITSNISVQNDNLVVQGKTILTKIPDNIILTPVTGNGFVSGSFIGATFEQSKSLHVFPIGVLEGLRFMCCFRFKLWWMTQRMGSCGKDIPLETQFMLLESKDEVEGNGDDAPTVYTVFLPLLEGQFRAVLQGNEKNEIEICFESGDKAVETSQGTHLVYVHAGTNPFEVIRQSVKAVERHMQTFHHREKKKLPSFLDWFGWCTWDAFYTDVTAEGVDEGLKSLSEGGTPPKFLIIDDGWQQIENKEKDENCVVREGAQFATRLVGIKENAKFQKSDQKDTQVSGLKSVVDNAKQRHNVKQVYAWHALAGYWGGVKPAASGMEHYDSALAYPVQSPGVLGNQPDIVMDSLAVHGLGLVNPKKVFNFYNELHSYLASCGIDGVKVDVQNIIETLGAGLGGRVSLTRSYQQALEASIARNFTDNGCISCMCHNTDGLYSAKQTAIVRASDDFYPRDPASHTIHIASVAYNSLFLGEFMQPDWDMFHSLHPTAEYHAAARAVGGCAIYVSDKPGNHNFDLLRKLVLPDGSVLRAKLPGRPTRDCLFADPARDGISLLKIWNMNKFTGIVGVFNCQGAGWCKETKKNQIHDTSPGTLTGSIRADDADLISQVAGEDWSGDSIVYAYRSGEVVRLPKGASIPLTLKVLEYELFHISPLKEITENISFAPIGLVDMFNSSGAIESIDINHVTDKNPEFFDGEISSASPALSDNRSPTALVSVSVRGCGRFGAYSSQRPLKCAVESTETDFTYDAEVGLVTLNLPVTREEMFRWHVEILV

SEQ ID NO: 93467 - protein, 293 aa, Burkholderia xenovorans LB400
MLKVTKAVFPVAGLGTRFLPATKASPKEMLPIVDKPLIQYAVEEAMAAGITEMIFVTGRSKRAIEDHFDKSYEVEAELEARGKDKLLQLVRSIKPSHVDCFYVRQPEALGLGHAVLCAEKLVGDSPFAVILADDLLYGSPPVMTQMIEVFDHYHSSVIGVEEIPAQDTKSYGIVDGKEWEQSIIKMSGIVEKPEPSAAPSNLGVVGRYVLKPRIFKHLRTIKPGAGGELQLTDAIESLLADEQVLAYKYRGTRFDCGSKIGYLKATVEFAVRHPEVGVEFREYLEEYLSLLPM

SEQ ID NO: 93468 - protein, 332 aa, Salmonella typhimurium LT2
MKTLGEFIVEKQHEFSQATGELTALLSAIKLGAKIIHRDINKAGLVDILGASGAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLVYTTGCGVHAFTYDPSLGVFCLCQERMRFPEKGKTYSINEGNYIKFPNGVKKYIKFCQEEDSSTSRPYTSRYIGSLVADFHRNLLKGGIYLYPSTASHPQGKLRLLYECNPMAFLAEQAGGKASDGKERILDIIPESLHQRRSFFVGNRHMVDDVERFIREYPDA

SEQ ID NO: 93469 - protein, 66 aa, Datura metel
VYILDRAEEEGHDLPYSCRAGSCSSCAGKVTAGTVDQSDGNYLDDDQMAEGFVLTCVAYPQSDVTI

SEQ ID NO: 93470 - protein, 111 aa, Saccharomyces cerevisiae
MHHHHHHMVTQLKSASEYDSALASGDKLVVVDFFATWCGPCKMIAPMIEKFAEQYSDAAFYKLDVDEVSDVAQKAEVSSMPTLIFYKGGKEVTRVVGANPAAIKQAIASNV

SEQ ID NO: 93471 - protein, 321 aa, Triticum aestivum
  misc_feature (159)..(159): Xaa can be any naturally occurring amino acid
  misc_feature (167)..(167): Xaa can be any naturally occurring amino acid
MCYRSGIPGISSTHASERHSLQALDLPHRSSLPTTPHPHPTMADRGGERGGDRGGERGGFGRGFGRGGRGDRGGRRGGRRGPRQEEEKWVPVTKLGRLVKEGRFTKMEELYLHSLPIKEHQIVEQLCPGLKDEVMKITPVQKQTRAGQRTRFKAFVVVXGDSNGHVXGLGVKCAKEVATAIRGAIILAKLSIVPVRRGYWGNKIGLPHTVPCKVTGKCGSVTVRMVPAPRGSGIVAARVPKKVLQFAGIDDVFTSSRGSTKTLGNFVKATFDCLMKTYGFLTPDFWRETTFTKAPYQEFTDILVKPTKALMLDAPAEKIEA

SEQ ID NO: 93472 - protein, 507 aa, Burkholderia xenovorans LB400
MVTTSTDETVAHAGDNKAVSTEQGVPAAVRLVPVVLAGGAGSRLWPMSREQYPKQLIDVLGSESLLQATVQRMKGFNAQGRLVSTPIVVCGNEHRFVTSEQLRERGVEARIVVEPARRDTAPALTLAATTACADGEDAIVLVMPADHAIVDVAAFQAAIALAAQHAERGAIVALGVPPTRADTGFGYIKLGDEISGEAHRIERFVEKPAAEIAAQYVASGEYWWNSGIFVLRASVWLATLKRLQPAMYDACLQAQAQGYSDASFFRPGADAFSSSPADSIDYAVMEHLGSQQGIAEGVVVPLSAGWSDLGSWDAVWDALEKDADGNACRGRVVFEGATSSFAHSEKRLIACVGVTNVVVVETDDAVLVADRSRVQEVKIVVSRMRALQAPEAEVHRKVRRPWGYYDSVDHGERFQVKRIVVNPGGRLSLQRHHHRAEHWIVVSGTALVTRGDEEFLLSENQSTFIPLGVTHRLENPGKLPLELIEVQSGSYLGEDDIVRFDDTYGRA

SEQ ID NO: 93473 - protein, 501 aa, Salmonella typhimurium LT2
METVGNFIHGKTTLSSSGETLPVTNPATGKVIRQVTQSTREEMLAAIQSAHEAFPAWSKMTPLRRARILFEFKVLLEKHRDELAALIVSEHGKVWSDALGELTRGIEVVEFACGIPHLSKGEYSFNVGSGVDSFSLMQPLGVVAGITPFNFPAMVPMWMFPVALACGNTFVLKPPALVPSASLRMAQLLQEASLPDGVFNVVHCGNEAASLLTSDPRVQAVSFVGSSAVAEHIYTTASAHGKRVQAFGAAKNHAIVMPDADLDATVNAIMGGAFGSAGERCMALPVVVAVGDETADRLIERLKPLIAALRIGPGELRGKDENEMGPVVSRAHQQKVLGYIDKGVSEGATLVMDGRNYSVAGYPEGFYVGGTLFDNVTPEMTIWREEIFGPVLGIVRVPDYATAISTVNSHEFGNGSVIFTTNGHYAREFAQSVEAGMVGINIPVPVPMAFHSFGGWKRSVFGALNVHGPDGVRFYTRMKTVTSRWPNGQQIVSEFSMPTLG

SEQ ID NO: 93474 - protein, 392 aa, Clostridium perfringens str. 13
MILENMILDNVKNMPPSGIRKYFDLINEMEDVISLGVGEPDFVTPWNVREAGIYSLEQGHTHYSSNAGFIELREEISKYLNRRFSLRYNPKDEILVTVGGSEGIDLALRALVGPGDEVIIPEPSFVAYKGCTAFTGATAKTIDLRACDDFKLTPELLEEAITEKTKVVIIPFPNNPTGAIMNKEELQKIVDVLKDKDVIIISDEIYAELSYDEDHVSIASFQEVKEKTIVINGFSKAYAMTGWRLGYVCAHKVLIDAMKKIHQYAIMCSPTTAQYAAIEALKNGDESVFEMAREYNRRRRVLVDGFRSMGLDCFEPLGALYVFPCIKSTGMSSDEFCEKLLLEEKVLAVPGNAFGECGEGFIRACYAASMEDIMEAIKRIRRFVERNNMQGK

SEQ ID NO: 93475 - protein, 592 aa, Arabidopsis thaliana
MNSVQLPTAQSSLRSHIHRPSKPVVGFTHFSSRSRIAVAVLSRDETSMTPPPPKLPLPRLKVSPNSLQYPAGYLGAVPERTNEAENGSIAEAMEYLTNILSTKVYDIAIESPLQLAKKLSKRLGVRMYLKREDLQPVFSFKLRGAYNMMVKLPADQLAKGVICSSAGNHAQGVALSASKLGCTAVIVMPVTTPEIKWQAVENLGARVVLFGDSYDQAQAHAKIRAEEEGLTFIPPFDHPDVIAGQGTVGMEITRQAKGPLHAIFVPVGGGGLIAGIAAYVKRVSPEVKIIGVEPADANAMALSLHHGERVILDQVGGFADGVAVKEVGEETFRISRNLMDGVVLVTRDAICASIKDMFEEKRNILEPAGALALAGAEAYCKYYGLKDVNVVAITSGANMNFDKLRIVTELANVGRQQEAVLATLMPEKPGSFKQFCELVGPMNISEFKYRCSSEKEAVVLYSVGVHTAGELKALQKRMESSQLKTVNLTTSDLVKDHLRYLMGGRSTVGDEVLCRFTFPERPGALMNFLDSFSPRWNITLFHYRGQGETGANVLVGIQVPEQEMEEFKNRAKALGYDYFLVSDDDYFKLLMH

SEQ ID NO: 93476 - protein, 450 aa, Desulfitobacterium hafniense DCB-2
MTMTGSDQSAPTYFDDMKLTSSHKRMLWLAAICYMFDQMDVGTFAYAAPVLVKTWGLTMEQIAQVNSYGFVGMFLGAIFGGWIADKIGRKKTIILCVAIFSLGSLGNALAFNFHTLAITRFFTGLGVIGMLVVAMVYIAEMMPSEHRGRYQALTMACGTIAIPVGAAFARWVVPLSTESWRYIFVLGGTSILLLPFCFIVFKESPRWLVSKGRITEAEKVIREITGREVDLSSEVPEKIKKSSSLSTLKLILSKEYLKRTIILVIITDGVVLGAQMLGGFYPAILQEYAGFQLTLVLSIMALSWWGIPFGDLSASLVSDKGGRKGPLALFSIINGMTFVVCGFFPTPAVIIAAVFLSRVFGGGSVSILYTYLAESYPTHIRSTAVGLIMGQVRILSAVIVLIVPPILATYGWLGVHLVNAGIIIVTAIVALIFGQKTSKRTLEEINKAPG

SEQ ID NO: 93477 - protein, 501 aa, Oryza sativa Japonica Group
MVVSVAATDSDTAQPVQYSTFFASRYVRDPLPRFRMPEQSIPREAAYQIINDELMLDGNPRLNLASFVTTWMEPECDKLIMDSVNKNYVDMDEYPVTTELQNRCVNMIAHLFNAPIKEDETAIGVGTVGSSEAIMLAGLAFKRKWQNKRKEQGKPCDKPNIVTGANVQVCWEKFARYFEVELKEVKLSEGYYVMDPVKAVEMVDENTICVAAILGSTLTGEFEDVKLLNNLLTEKNKETGWDVPIHVDAASGGFIAPFLYPELEWDFRLPLVKSINVSGHKYGLVYPGVGWVIWRSKEDLPEELIFHINYLGTDQPTFTLNFSKGSSQIIAQYYQLIRLGFEGYKNIMQNCMENTAILREGIEATGRFEILSKEAGVPLVAFSLKDSGRYTVFDISEHLRRFGWIVPAYTMPANAEHVAVLRVVIREDFSRSLAERLVSDIVKILHELDAHSAQVLKISSAIAKQQSGDDGVVTKKSVLETEREIFAYWRDQVKKKQTGIC

SEQ ID NO: 93478 - protein, 467 aa, Lactobacillus plantarum WCFS1
MSTGKVVQVIGPVVDVEFSLNDKLPDINNALIIQKDNDDTLTVEVSLELGDGVVRTVAMDGTDGLRRGMTVEDTGSSITVPVGKETLGRVFNVLGETIDGGPEFGPDAERNPIHRDAPKYDELTTSTEVLETGIKVIDLLAPYVRGGKIGLFGGAGVGKTVLIQELIHNIAQEHNGISVFTGVGERTREGNDLYFEMKASGVLKNTAMVYGQMNEPPGARMRVALTGLTIAEYFRDVQGQDVLLFIDNIFRFTQAGSEVSALLGRIPSAVGYQPTLATEMGQLQERITSTKKGSVTSIQAVYVPADDYTDPAPATTFAHLDATTNLERSLTEQGIYPAVDPLASSSIALDPSIVGEEHYQVATEVQRVLQRYRELQDIISILGMDELSDEEKTTVARARRIQFFLSQNFFVAENFTGQPGSYVPINDTIKGFKEILEGKYDDLPEDAFRQVGKIDDVVEKAKSMVTD

SEQ ID NO: 93479 - protein, 315 aa, Arabidopsis thaliana
MDNNGVKPAVSAMEAFEKLEKVGEGTYGKVYRAREKATGMIVALKKTRLHEDEEGVPPTTLREISILRMLARDPHIVRLMDVKQGINKEGKTVLYLVFEYVDTDLKKFIRSFRQAGQNIPQNTVKCLMYQLCKGMAFCHGHGVLHRDLKPHNLLMDRKTMTLKIADLGLARAFTLPMKKYTHEILTLWYRAPEVLLGATHYSTGVDMWSVGCIFAELVTKQAIFAGDSELQQLLRIFRLLGTPNEEVWPGVSKLKDWHEYPQWKPLSLSTAVPNLDEAGLDLLSKMLEYEPAKRISAKKAMEHPYFDDLPDKSSL

SEQ ID NO: 93480 - protein, 483 aa, Aspergillus nidulans FGSC A4
MPLKRVAVIGTGPSGAIAVDALVQEGAFDVIRVFERQEKAGGNWVSRKTERAEPLDIDNLSARTADKPVEIPANLPCYTPPLKAHRYTDSHIYPNLHTNVDASVMEYSGPGEKIPTVRSEWSIGLHGEDTPFRHHEVICGYVESLLNRNGYQDLVEYNTTVERAVKNEEKDEWILTLRKAGGEEEGKERMDYWWTERFDALVVASGHYHVPYVPSIPGLKEFAEKYPGSVEHAKQYRGPGKYKGKVVTIGASVSAADTAVSLIGTAQTPIYAVTRGKYNIYFGDHAFKHPSISLRPAITHIDDTNESRTVHFEDGTSVSGVDHLIFGTGFTWTLPFLPQIPIRNNRVPDLYLHVFHQSDPTLVFIGAVGAGLTFKVFEWQAVAAARVLAGRAKLPPLQVQKKWEEDRIAVKGDGAGFLMVYPEFGEYFEQLRAIASEPDGTKGRRLPVFEQKWADDFAAGHERRIRMWKRANEAAAKALKVPA

SEQ ID NO: 93481 - protein, 404 aa, Vibrio cholerae O1 biovar eltor str. N16961
MLPEFQRVVTFMFTHLPAPVLDPILSLSVAFRNDPRPQKVDLGIGVYKNSLGETPIMRAVALAQDKVVASQKTKSYVGLAGCEEFNQSMMQLVLGSTLDTERTIAIQTPGASGALRMLGDLMRVAQPDTTVWITDPSYVNHKPVMEAAGLKVRYYRYFSRETKMVDTEQMLADLAQAGTKDVVLLHGCCHNPTGADIDFSAWQAITELAQKNGFIPFVDIAYQGFGDGLEQDAQGLRYMAERMEEMLITTSCSKNFGLYRERTGAAIVIGKNQQEVTNARGKMLTLARSTYTMPPDHGAALVKTVLRDEQLTAIWKQELSEMQQRLLTLRKNLCNELRNQHNTRQFDFIESHRGMFTVLGFSAEQMGRLREEFAIYGVADGRINIAGLTEKDIPYVANAIIHVS

SEQ ID NO: 93482 - protein, 66 aa, Brugmansia arborea
VYILDQAEEEGHELPYSCRAGSCSSCAGKVTAGTVDQSDGNFLDDDQMADGFVLTCVAYPQSDVTI

SEQ ID NO: 93483 - protein, 292 aa, Triticum aestivum
  misc_feature (91)..(91): Xaa can be any naturally occurring amino acid
  misc_feature (211)..(211): Xaa can be any naturally occurring amino acid
MAKDEVMETGGGGDFAAKDYTDPPPAPLIDAAELASWSLYRAVIAEFIATLLFLYITVATVIGYKHQTDPAVNAAADAACGGVGVLGIAWXAFGGMIFVLVYCTAGISGGHINPAVTFGLFLARKVSLVRALLYMIAQCLGAMCGVGLVKAFQSAYFVRYGGGANTLAAGYSKGTGLAAEIIGTFVLVYTVFSATDPKRSARDSHVPVLAXPLPIGFAVFMVHLATIPITGTGINPARSLGAAVIYNKDKAWDDQWIFWVGPMIGAAIAAFYHQYILRAGAIKALGSFRSNA

SEQ ID NO: 93484 - protein, 568 aa, Arabidopsis thaliana
  misc_feature (364)..(364): Xaa can be any naturally occurring amino acid
MGSSGDVNWKLADHPKLPKGKTIGLIVLDGWGESDPDQYNCIHKAPTLPRGPKVGAIFPLKDGKPDTWRLIKAHGTAVGLPSEDDMGNSEVGHNALGAGRIYAQGAKLVDLALASGKIYEDEGFKYISQSFEKGTVHLIGLLSDGGVHSRLDQVQLLLKGFAERGAKRIRVHILTDGRDVLDGSSVGFVETLEADLAALRAKGVDAQVASGGGRMYVTMDRYENDWSVVKRGWDAQVLGEAPHKFKSALEAVKTLRAEPGANDQYLPSFVIVDDNGKAVGPIVDGDAVVTFNFRADRMVMHAKALEYKDFDKFDRVRVPDIRYAGMLQYDGELKLPSRYLVSPPLIDRTSGEYLAHNGVRTFAXCSETVKFGHVTFFWNGNRSGYFNEKLEEYVEIPSDSGISFNVQPKMKALEIAEKARDAILSGKFDQVRVNLPNGDMVGHTGDIEATVVACEAADRAVRTILDAIEQVGGIYVVTADHGNAEDMVKRDKSGKPALDKEGNLQILTSHTLKPVPIAIGGPGLSAGVRFRQDIETPGLANVAATVMNLHGFVAPSDYETSLIEVVEK

SEQ ID NO: 93485 - protein, 163 aa, Bordetella parapertussis 12822
MKHVISVLMENEPGALSRVVGLFSARGYNIETLTVAPTEDATLSRLTVVTVGSDEVIEQITKHLNRLVDVVKVVDLTEGAHIERELMLIKVRAVGKEREEMKRMVDIFRGRIIDVTDKSYTIELTGVQEKIQAFIEALDRSAILETVRTGVSGIGRGERILKI

SEQ ID NO: 93486 - protein, 513 aa, Physcomitrella patens subsp. patens
MRGSALRKARLAKLLAQRQTQQQFRTSAWHQAVPRTESAQASSSGGVLSWFLGERSTTPVPALYEPLQGVHLPPALPEDIKPSDTKVTTLANGLRIASENVPGPTATVAIHIDSGSKNETPFCTGASHLLERMAFKSTVNRSHFRLIREVEAIGANLMSTSAQEQMCYSADAIKTFLPEMVEILVDSVRNPLFNEWEVQEQLAKLKAETAGIMSHPHSAIMEALHSAGFVGGLGQPLTAPESSLRRLNGGVLHDFVKENYTAPRIVLAASGVEHEDLLSLAEPLLADLPSVNEPIPVETQYVGGDWRQSVDSSLTHVAIAFEVPGGWRNEKDSCAVTVLQSLLGGGASFSAGGPGKGMFSRLYTRVLNRREQVHSCTAFNSIYRDTGLVGIHATSSGDYIPYLVDIMCQEINQVATPGEVTEAELHRAKNSAISSTLMNLESRVVITEDIGSQILTYGQRKPVAKFIQRIQAVTLEDIAEVSRKIISSPLTMASWGDVVQVPRYDAVAERFEM

SEQ ID NO: 93487 - protein, 246 aa, Candida glabrata CBS 138
MSRVEIYSPEGLRLDGRRWNELRRFESAINTHPHAADGSSYLEQGNNKVITLVKGPKEPTLKSQMDIQKAILKVTVNITKFSKFERSKSSHKNERRVLEMQTALVRTFEKNVMLHVYPRTLIDIEIHVLQQDGGIMGTLLNGISLALIDAGIAMYDYVSGISVGLYDTTPLLDINSLEENAMSAVTLGVVGKSEKLSLLQIEDKIPLDRIENVLAIGIAGAHRIRDLMEQEIRAHAEKRVANASKQ

SEQ ID NO: 93488 - protein, 201 aa, Brassica napus
  misc_feature (40)..(40): Xaa can be any naturally occurring amino acid
AIFLNNNQFEGEIPGNLGNSPASVINLANNKFSGEIPTSXGLTGSRVREVLLLNNQLTGCIPESVGMFSEIEVFDVSHNSLMGHVPDTISCLSEIEILNLAHNRFSGEVPDLVCSLRSLINLTVSFNFFSGISSECSRVSFGFDFAGNCIPGRNSQRPEPDCSGYSGGAMSCYRTPLQPLACAAISIGLKEKFSRYTSSNP

SEQ ID NO: 93489 - protein, 509 aa, Bacillus licheniformis ATCC 14580
MNMFERVDDLNNSRQKASLGGGQERIDRQKQKGKLTARERIDLLLDEGTFTELNAFARSRQSGGPLGDGVVTGFGKIDGRPVYLFSQDFTVTGGALGEMHAKKIAAVMDLALKNKAPFIGLNDSGGARIQEGVLSLDGYGHIFYRNVLCSGIIPQISVILGPCAGGAVYSPALTDFVFMSEKTGQMFITGPKVIKTATGEAVSSGELGGAYIHNSISGNAHFSGDSDEAVLHEVRKLLSYILQNHEEKPPAKARKAKDHEIRPALMTILPEDGQRPYDVKQIIAEIADGGTFFEVQCHFAKNAVIGFARIAGETAAVVANQPKYLAGSLSMDAADKIARFIRFCDSFQIPILTLVDCPGFLPGIREEHGGVIRHGAKILYAYAEATVSKVTVILRKAYGGAYVALNSKALGADAVFAWPNAEIAVMGASEAADVLFAKEIERSDDPRAAREEKIRKCMQASSPFTAARYGMVDDIIDPKETRKKLIQTFDMLKSKKEIRLDKKHGNIPL

SEQ ID NO: 93490 - protein, 454 aa, Desulfitobacterium hafniense DCB-2
MKNFSISEVMDSFGVNKFTWSIFFFLGLAMVFDGYDYMIVSYTMPQISAEWGLSAVEKGSLSSWSLFGLIIGGAISGIVSDKIGRKRTLVYSIAIYSLLNIPIFFAPSFGFYALFRVLAGLGLGACIPVVTTIFSESTPTNRRALFITFGMAWMIVGWVLAGLVATYLVPRVGWRWCYLVGGFPFIYSIFLHFKMKESVYWLANKGRNEDAVKRLQEIEKVATGKVTNWDPNALVVPPKSKVVGPKALFSKTYRMTTAGVWITYFCGCFTVYGINAWLPSLMLEKGLQLSSAYGLSIAQNAAAVIANCSTGFVAEVIGRRKNLIGSYGLGIVAILIMAFVGSSFWAILAANIFLGFAINYSITAVQPLMAEGYPTDIRNTGVSWCQAFGRLGGALAPIVAGMIIGLNLGYSSAFLFYVVPLLFGLLAAFLLIRNETKGKSIDQIQEENVLKAGS

SEQ ID NO: 93491 - protein, 88 aa, Arthroderma benhamiae
ARAGVLIDCYATWCGPCKAISPVVDRLSEEHSADVDFYKVDVDECSDIAAELGVRAMPTFFFFKNGEKLQSVAGAAEGPIVAALTQFK

SEQ ID NO: 93492 - protein, 198 aa, Ralstonia eutropha JMP134
MNDTEIALIDSARLPTRFGEFTAHAFKGVDSGIEHLALSVGDITGEDVLIRMHSECLTGDVFGSCRCDCGPQLELAMEKIAAEGRGILLYLRGHEGRGIGLAEKIRAYALQDTGLDTVDANLALGQAIDARNYAFAADLLHQWGVKSVRLMSNNPLKAAALEKAGIVVKEQLRHIVPSNAENEKYLATKRSRMGHLLD

SEQ ID NO: 93493 - protein, 330 aa, Desulfovibrio desulfuricans G20
MKIAVAGGGSWGSALAHLLAANACDVTLLVRDAVQARRINADHVNPDYLPDVVLHSSVRATVDDAEALDGAGLLLMAVPCQHFRKVLQRLRPLLPPEPVVVCANKGIEVENLCTVSEVVAQELEGTGHTFAMLSGPSFAVEVMRDMPTAVVLGCRDAATGRRLRHIFSYGLFRTYSSTDVRGVELGGAVKNVIAIAAGLADGLGFGHNARAALITRGLAEMSRLGVAMGARASTFMGLSGMGDLVLTCTGDLSRNRQVGLKLAQGMTLEEVTRSMRMVAEGVKTTEAVHTLAARLQVDLPITSAMYDVLHSGKNPRDAVRELMSRELKEE

SEQ ID NO: 93494 - protein, 134 aa, Coccidioides immitis RS
MFRSALIRSLRTVSIPRAVRNSSTVRQLPRASAIVRQSQFAPCIPYQAIRSYSAPAGLNQSEVEGRIIDLLKNFDKITPTSHFTNDLGLDSLDTVEVVMAIEEEFSIEIPDKEADAIHSIDQAVQYILSQPDAH

SEQ ID NO: 93495 - protein, 290 aa, Clostridium perfringens SM101
MNINSLKEEVDQSLKAYFDKDREYNKVLYDSMAYSVNVGGKRIRPILMLLSYYIYKSDYKKILTPAIAIEMIHTYSLIHDDLPCMDNDDLRRGKPTNHKVFGEAIAVLAGDALLNEAMKILVDYSLEEGISALKATKIIADAAGSDGMIGGQIVDIINEDKEEISLKELDYMHLKKTGELIKASIMSGAILAEASERDIKKLEDFGYKLGLAFQIKDDILDVVGNAKDLGKNVHKDQESNKNNYITIFGLEECKKKCVNITEECIDILSSIEGNIEPLKVLTMKLLERKF

SEQ ID NO: 93496 - protein, 838 aa, Coprinopsis cinerea okayama7#130
MAYTPSDFDGNQDEYAPPEHHVIEPDMRGMEEALGFSVSAFARSRSRAATPTEAGPSTVKQQPFSPAIAADKKGKQRAERQMDVAGAFTQNAEAQRSKKEKKKVKKKRQSVVPVVKLSGFGSKDDPFTLDDSDDDAGKASATAPVGGVSWAESNLNPPSTVTATATAPLPPLPVRPPAPPPTLVATSSTTATTGTARANATAILSDPHVAGGTKAPALEPAVSTSTAIGSSVKDASKGSKLKELLEQERSRVAASTPVPIPRPASQAPVTPSIASVPLAPTSNPTVSPDKSFTETRGGESRGSSEEQESRDTSAKSTPSSAVVLPSSATKAVPVLGTSMTTAVGVHSREEGMEDEDDDLPTLPLTGPEEVGTSDENAAMEVDDLLVPSRQSSAEIEDITVALGSQDIANGEPSRQPSSDEDEGSPSTPEDQDNSEFDVANDEDDDDELALVPGQPPPPLESKTARIEKFKAAAVTTPARTGASGFQQLTFHDYRLHLQNTPFEVYYARDLPHSLQDGINNTKDMHLLAGMRDLFKAFIQEHTVQDEPDAPPIDIINNIDDEPAPPWEFHYSNQMWHSDNVPPPDVKNLEGCDCVGRCTKSCACLRRQKKLLDPEGPPGQVNDFMYDKKGRLRHPEFQEPIVECNALCGCDQDCVNRVVQNGRKVQVSIQKTKHKGWGVFAGPKKIPKGTFLGVYSGELLTDEEGDERGKVYNKFGRTYLFNLDFWFLKANLTPEEAEEWDNKYVVDAFNVGNFTRFLNHSCDPNCKIHPCFINEANKEKPLLTVFTDRDIDPYEEICFNYTGMDADEAKARVSEMAKTDKIYEPCMCGAKNCCGVMFE

SEQ ID NO: 93497 - protein, 653 aa, Roseovarius nubinhibens ISM
MAVTLTHLDDIAIATVDNPPVNAVNHAVREGLLAALAETEANPAIRATILLCAGRSFIAGADIREFGQPPKPPHLPDVIDRMEGATKPWLAAIHGTALGGGLEIALGCHYRIAAPSARLGLPEVTLGLIPGAGGTVRLPRLIAAEEALEMISGGKPVTAPKALDIGLIDALAEGDLQEAALDFLRARLDAPLPTPLRHRQPHAPRDAADWDKRRQRLHARARGQAAPLAALEAIETALKEPADLALARERDSFLRLKSHPESAALRHVFFAERAAGQMPRLKDVTPGPLTQIGVIGGGTMGAGIATACLLADLPVTLIERDAAACEAGRARVTDSLDGARARRLIDADRHATLLSQLATDTDYAALTGADLVIEAVFEDMDLKHAVFAALDAHTRPDCILASNTSYLDINDIARATAQPDRVIGLHFFSPAHVMKLLELIVTDRASDRALATGFALGKRLRKLTVPAGVCDGFIGNRILSSYRRDTDAILQDGATPSQIDQAMRDFGFPMGIFEMQDLAGLDISWAMRKRRAATRDPSERYVDIADTLCEAGRFGRKTGRGWYLYEDGKTPIPDPEVEEIARQSAAAAGITRRSFSDDEIISRILATMQREGEEILNENIAERASDIDVVMINGYGFPRWRGGPMYMAGHRNS

SEQ ID NO: 93498 - protein, 494 aa, Arabidopsis thaliana
MQSDNGKLFIGGISWDTNEERLKEYFSSFGEVIEAVILKDRTTGRARGFGFVVFADPAVAEIVITEKHNIDGRLVEAKKAVPRDDQNMVNRSNSSSIQGSPSGPGRTRKIFVGGLPSSVTESDFKTYFEQFGTTTDVVVMYDHNTQRPRGFGFITYDSEEAVEKVLLKTFHELNGKMVEVKRAVPKELSPGPSRSPLGAGYSYGVNRVNNLLNGYAQGFNPAAVGGYGLRMDGRFSPVGAGRSGFANYSSGYGMNVNFDQGLPTGFTGGTNYNGNVDYGRGMSPYYIGNTNRFGPAVGYEGGNGGGNSSFFSSVTRNLWGNNGGLNYNNNNTNSNSNTYMGGSSSGNNTLSGPFGNSGVNWGAPGGGNNAVSNENVKFGYGGNGESGFGLGTGGYAARNPGANKAAPSSSFSSASATNNTGYDTAGLAEFYGNGAVYSDPTWRSPTPETEGPAPFSYGIGGGVPSSDVSARSSSPGYVGSYSVNKRQPNRGIAT

SEQ ID NO: 93499 - protein, 788 aa, Aspergillus nidulans FGSC A4
MLRSLLSITGLQRDDYIFPTVDPKQDGPDCKKDCADCTLNFPDKVKVETSLPLYGRIKQFHTHVLVATGRSDWKQHVEQERGSLMEAFDGGLTCAVADQGTLQRMMVSASNLKPPEDDGEGTARGNGTTILLLPSFTFVDGVDPSDVREVVSHFIDTPLSQHSKTNTSPNVRLKSRPCEYDYVVLLCSHKRRDARCGITAPLIKRELERHLRPRGLYRDADDERPGGVGIFFVSHVGGHKFSANVLVYRKKEQQMIWLARVRPEHCEGIVNYTLLQGKVVHPDFQLRGGFDRLKGLTSCWLSSSQESNAGGQRYRVCLAALARSNAIEKDPAVTAYALGPGLVYETLGHSSFSFNQQLTPSPESSKSATGASGISSHVSSLAAEPSPDNETSRLKLRIQYLESQIASATPFARDVQPECSIEATSSHLSGTFHLHYKRHPEHAEPIARGFSLKTRLLGQSHWVVSIAYLARDLFKSIEPCMQELSDAWIGLLKAQPASSWPLLASELPLRDICDTLSNHYLQRTESFYRILHIPSFCREYEKFWEPGAVRNPAFMVQLKLGSAQEAIYMGLHRNPSHLLQRSIFAAEMHRSLPCGGAPLISLDDFDTSPPKNFDDEQLETGDPSPKPQAEMTQVSVAIVLRRTLPQRLAVVKLLNDLYTLGSYKQTLRLDAELRAAYRELCQTVMVAMELRAQLQEDAGLNPVPLRSDLLSVLNDVKSRCLRVIEAGETNIKGNLLWRRMAGAYDQDRDLGAEVVSNIPMDIIDNWDFMASDLAASALLDATNPMSWI

SEQ ID NO: 93500 - protein, 485 aa, Vitis vinifera
  misc_feature (205)..(205): Xaa can be any naturally occurring amino acid
  misc_feature (372)..(372): Xaa can be any naturally occurring amino acid
MSYSYSSEKQNPYLPLKKSPSSWSNLWFKSPNKALNHVVFTMHLKSLTKHQLQPHKALIFDRTLLLSDELLLRVFQKLPESQRKPNSLVCKRWLSLQGRLVQSVKLLEWDFLESGRLVSRFPNLTRVDLVHACIVWPRSCGVLLNHRVVSVPVDSEVSQNGFLENGKVLASNVVDRGLRFLASGYPNLRKLAVVGASELGLLSVXEECSTLQELELHKCSDATLRAISGFGNLQILKLIGNAEGLYKSLVSDVGLTILAQGCTRLVKLELSGCEGSYDGIKAIGQCCQMLEELTLSDHRLDGGWLSALSYCENLKTLRFQSCRRIDVCPGLDEYLGSCPTLERLHLHKCQLRDKLSMRALYMISGAVRDFVXQDCWGLDNDILGLATTCRRVKLLSLEGCSLLTTEGLESAVLSWKDLQKLRVVSCKNIKDSEVSPALSTLFSILKELQWRPDTRSLLSSSLVESGMGKRGSKFFQEDMRPEVPA

SEQ ID NO: 93501 - protein, 426 aa, Bordetella parapertussis 12822
MPGLRQDFARRRCRISRRPGFCQNCRNIAATAKPRAMELLTILLIAAVLCVPLAQRLGLGAIPGYLLAGGVIGPSGLGLVTDVPDIMRVSEWGVVMMLFVIGLELAPKRLWAMRREVFGAGLRHLAGMGWQAAILCGLSLALSSTAVALRLLEERGLVRTPLGRSALGVLLLQDMAAIPMLVAAGLLGSDGDSAPSFEAALVAVVVVLACYRLRLLDWAARSQLHELFTAATLLVVLGTAQLFDYAGLSAGLGGFLVGMLLAESRHRNELEHTIEPFKGLLLGLFFLAVGMSVNVEEALDYWPYVLAGVVALLSLKALVLYGIARLMGLPHYHRLLYALVLAQGGEFSFVIFNEAWDNHLMSLEQRDLLAIVVAISMGAVPIVIRLLERLPGRYGGIGDMAVTLVGFAGSPPPQSAADNEERSGPG

SEQ ID NO: 93502 - protein, 153 aa, Triticum aestivum
  misc_feature (7)..(7): Xaa can be any naturally occurring amino acid
  misc_feature (28)..(28): Xaa can be any naturally occurring amino acid
  misc_feature (39)..(39): Xaa can be any naturally occurring amino acid
  misc_feature (51)..(51): Xaa can be any naturally occurring amino acid
  misc_feature (71)..(71): Xaa can be any naturally occurring amino acid
  misc_feature (74)..(74): Xaa can be any naturally occurring amino acid
  misc_feature (83)..(83): Xaa can be any naturally occurring amino acid
  misc_feature (86)..(86): Xaa can be any naturally occurring amino acid
  misc_feature (93)..(93): Xaa can be any naturally occurring amino acid
  misc_feature (97)..(97): Xaa can be any naturally occurring amino acid
  misc_feature (104)..(104): Xaa can be any naturally occurring amino acid
  misc_feature (110)..(110): Xaa can be any naturally occurring amino acid
  misc_feature (120)..(120): Xaa can be any naturally occurring amino acid
  misc_feature (127)..(127): Xaa can be any naturally occurring amino acid
  misc_feature (136)..(136): Xaa can be any naturally occurring amino acid
MAPTVMXSSATSVAPFQGLKSTAGLPVXSRRSNGASLGXASSNGGRIRCMXVWPIEGIKKFETLSYLPPLXTEXLLKQVDYLXRSXKWVPCLXFNKXGFIFREXNASPGXYDGRYWDKCXNWLCFGXNRPPPKVNXTKVGGRVKRSYPERLCS

SEQ ID NO: 93503 - protein, 332 aa, Candida glabrata CBS 138
MVRIAINGFGRIGRLVLRVALSRSNIEVVAVNDPFITTDYAAYMFKYDSTHGRYAGEVTHDDKHIIIDGKKIAVHQERDPANLPWGSENIDIAIDSTGVFKELDTAQKHIDAGAKKVVITAPSSTAPMFVVGVNEDKYTSDLKIVSNASCTTNCLAPLAKVIDEAFGIEEGLMTTVHSLTATQKTVDGPSHKDWRGGRTASGNIIPSSTGAAKAVGKVLPQLQGKLTGMAFRVPTVDVSVVDLTVKLQKETTYDEIKKVIKQASEGKLKGVLGYTEDAVVSSDFLGDSRSSIFDASAGIQLSPKFVKLVSWYDNEYGYSTRVVDLVEHVAKN

SEQ ID NO: 93504 - protein, 118 aa, Physcomitrella patens subsp. patens
MSLEELVELKFRLHDGTDIGPNRYAPTTTVANMKESILNQWPKEKQNGPKSINDLKLINAGKILENTKTLADSRVLLGEIPGCVITMHVVVRPPSNDKASEKQQSETPNSENCCCTIL

SEQ ID NO: 93505 - protein, 1020 aa, Candida albicans SC5314
MLAIDNSPSNPNTHHSHSSYPSQMEDFSTEVISLANSEMTIESRYQAAAAAATTPSTPPQLQEQLQLQEQPPLTKISSQSKASTPSVSTSALKKASSLFKLNTNSQSRNKKHTNKQQQQQQSQPSPTSPKTLTNITSRQSTPTPTPTPSNSTSRPNLRSLLRIGSFSNNQPHIHSNNPHVKNPSITALEGEIEVKIDEEDIEEEDNIEEEDDEIAYLSDSESDLNYDPKAEESHEDYRTGGYHPVSKGEIYYSKKLPNREYIILRKLGWGHFSTVWLAKSRYNGNLSLEKEEEDDEEEEEVEESLLDSVDINEYYVAIKFVKSNKNYMEAARDEIKIMNVLNDPINNNHHIPKENISFFKNDNKLHPGYNHVMQLKDDFEISGPNGIHICMVFEILGENVLNLIYRYKRLYRNINSEIKRKESAEENICLQQQSQMKFSKWDTKNWKKSTKSMLSLGLHNKKDTHKHDSTSNNNNNDTNNNFTINHNNNTNTNGQASINTTAISTASSSSLNSNPHEDSFIESSGSGSNSVSGSGSGSGSGQDNESTTTVDSWEDDLDKKIKSLNSQSLIKLIETSKTVGGIPLYIVKQIVKQMLLAIDYMHHCGIIHTDLKPENILIDIKDINKLIRTIEDEKLSKFRANNNNNLSRSRKASLLSNCSRTRRRRSSSKQLNQHYQSQQQQQQQKSNCCSSSCHIRTLSTTSNSSQSSYFYKKSKNSIVGKYESPIRCSKPLSSSISSDSIFKDVNFNGNDSNNHSNSKPRKKSISKAISPRNFSFFDYNKKDQEMIDDNIEEEEQQQRECEGNIRGGISIKIADLGNATFVDEHFTNQIQTRQYRSPEIILKYKHWGSSTDLWSIGCIIFELITGDFLFDPHDGKCFDKDEDHLAQIVELLGDFPNDEYLLDCKLTGKFFKLNPNPDLKGNSQIMFKNIDQLKIWKLKDVLIEKYKFNKNDYEVDLICDLILKCLKYDLNERYDANSLLKHPWFDSDNNSTISPGLEDRLKNLPNCHDDLPGYTCECKI

SEQ ID NO: 93506 - protein, 359 aa, Saccharothrix mutabilis subsp. capreolus
MLDEVVGHLRREAEIGGYVAARERADDLEAGYGVFASLMGAHPDEVAFTDSATRSWLAAFDAVPLGPGDRVLVTEVEYGGNAIPILHRAREVGFEVVTIPSDAVGQVDVEALRELVDERVKLVSLVHAPTNGGLVNPVREVASAAHEVGALVLLDACQSLGQLPVRADELGVDIISATGRKWLRGPRGTGVLVVCRSAADRLRPRLVDLHSGEWVGPEEVKLREDARVYELWETSVADRLGLIAAARYALDLGIDAIAAEVRSRAERLRAGLREVPGVEVRDIGARLSGIVTFTVEGRDPVAVRDELARHDVVVTTSHLTSTRIDMTRRGVEGLVRMSPHYFVSPEQVDRAVEVVAALG

SEQ ID NO: 93507 - protein, 426 aa, Bacillus licheniformis ATCC 14580
MAVEQMTMPQLGESVTEGTISKWLVSVGDHVNKYDPIAEVMTDKVNAEVPSSFTGTIAELVGKEGETLQVGDVICKVETNEEAKPEAEAVSKPDQEEAEPAKPEAKDTSQKKRYSPAVLRLAGEHNIDLEQVEGTGAGGRITRKDIQRIIASGAVPQTDAAPEKQPGANAAGAIEPDQKPAQAAPQAAPPQSAAGDVEIPVTGIRNAIATNMVRSKHEIPHAWTMMEVDVTGLVSYRNKIKNEFKKKEGFSLTFFAFFVKAVAQALKEFPQMNSMWAGDKIIQKKDINISIAVATEDALYVPVIKHADEKTIKGIAREISELAHKVRSGKLTSGDMSGGTFTVNNTGSFGSVQSMGIINHPQAAILQVESIVKRPVVMEHGMIAVRDMVNLCLSLDHRVLDGLICGRFLARVKEILEQIDDHTSIY

SEQ ID NO: 93508 - protein, 473 aa, Bacillus licheniformis ATCC 14580
MATEYDLVILGGGTGGYVAAIRASQLGLKTAVVEKQKLGGTCLHKGCIPSKALLRSAEVYRTAKKADEFGVVIPEVGLRFSQVQSRKQKIIDQLHNGVKHLMKKGKIDVYEGIGRILGPSIFSPMPGTVSVEMANGDENEMLIPKNVIIATGSRPRSLPGLELDGENVLSSDEALELEQLPASMLIVGGGVIGIEWASMLNDFGVDVTVIEYADRILPTEDADISREMQAQLAKKGITMITGAKVLPDTLEKGDAVSIQAEKDGEKQSYSAEKMLVSVGRQANIEGIGLENTDIQVENGFIVTNSMYQTKESHIYAIGDVIGGLQLAHVASHEGITAVEHIAGENPHAIDYSLVSKCIYSSPEAASVGLTEGEAKAQGKSVKVGKFPFQAIGKALVYGETDGFVKIVADRETDDILGVHMIGPHVTDMISEAGLAKVLDATPWEVGQTIHPHPTLSEAIGEAALAVDGKAIHF

SEQ ID NO: 93509 - protein, 461 aa, Desulfitobacterium hafniense DCB-2
MKKKWLGLGLGILILFTGYFWPETAGLTQPGKMSIAILMAGIVLWVTEVMPLAITALLLMVCMPYFEIFNWSTTWSKFISSVIFFIIATFAISVALIKTSLATRIAGVLIKWSQGNSKRLVLGFMAGTALLSAVCNNVPACSLFMSLALSILITDNAIPGKSNLGKCLMIGIPFGAMIGGTMTPAGTSINIMAMGLLEEATGITISFLDWMLMGIPFAIIIVPVCWLSLIMIFKPEDISQKSIDILQNRVVTTEKLNKEEKKIIIIIAVMLAAWIASTWIPWLDATGIAVMGLIAFFFPGIEVLSWDEFIKGVSWEVVLMIGGVNAVAAGIMSTGAAAWIVDSVMGGASGWSYPMLAGVTATVMAVLHGICPVGPAICGMATVPISGLAELINASPAVLTIIVAFGAGITFLLPLDCVPLITYGKGYYKMVDMVKAGIIPTIAVILVSAFILPPLGALIGL

SEQ ID NO: 93510 - protein, 98 aa, Oryza sativa
  misc_feature (47)..(47): Xaa can be any naturally occurring amino acid
  misc_feature (64)..(64): Xaa can be any naturally occurring amino acid
LGTVRGLVVCVLNVALSLGTWAVTGLGVWGFGGGAVWDQDGNEEANXVFGRLPTRYVRDKVLAXASGEPTVPHARVVGQFSSAESRKVHQVRDPRSHG

SEQ ID NO: 93511 - protein, 240 aa, Desulfovibrio desulfuricans G20
MKHTDSQEHACNVSGMFGRIAGCYDFLNHFLSVGMDYWWRYELVRQIIPGPTGRVLDLAAGTYDVSLEIRRQYPHMRVAALDYCLPMLTTGKKKLRGLKGAGVYPAQGDGRHLPLADNSVDCATIAFGIRNIIPREEAFREILRVLVPGGRLCVLEFGSGKNKVWKGLYNFYLQHALPRIGKIFSGDDSAYRYLADTIIAFPDARELAQEMRDAGFARVLHRPLTSGIVQLHVAQKANRK

SEQ ID NO: 93512 - protein, 437 aa, Desulfovibrio desulfuricans G20
MIRFEELTDANAAVAVVGLGYVGLPLAVALSEHFRVIGFDISQRRVDALIKGEDATGEVENSRLAACKAEFTADPARIGQADIVIVAVPTPIDGNRRPDLFPVESASRTVGRTMKKGCVVVYESTVYPGLTEEICVPILEKESGMKFGTDFTVGYSPERINPGDKVHTLETIVKVVSGSDEATADLLQRMYGTVVTAGTFRASSIRVAEAAKVIENTQRDLNIALMNELALLFDRMDIDTLEVLEAAGTKWNFLPFRPGLVGGHCIGVDPYYLTFKAEALGHHPQVILAGRRINDGMGKFVAETCVKKMIRKGNVVAGSRVGVLGLTFKENVPDLRNTRVVDVIDELRDYGVHVLVHDPQADPAEAHEEYGLTLTGLDTLRELDAVILAVPHAEYDALQAQDIRGWFRDPQKALLLDIKGAKSPAAFTDAGFDYWRL

SEQ ID NO: 93513 - protein, 529 aa, Synechococcus sp. RS9917
MIKLLLFVSFKVPQSLSLIPNRQAIPKECLAGLVVALGIIPEAIAFSIVAGVDPQVGLFGSICILIVVALLGGRPAMVSACTAGVALLMGGLMQSHGLPYLLAATILAGVFQILWGYLRLAQQMRFVPRAVTVGFVNAIGVLIFLAQLPQLGIGRDGGETIPSLAATGESISWPWVWGLVALGLLIIYGLPRLTKLVPSTLVAILLISGLAEWLQLPIPRVGDLGQLPNSLPVFQIPAVFGSWDSWGIILPTALAISFVGLLQSFLTANVVEDMLDQQADYEAEARAQGFANITAGLFGGMAGAGMIGQSVINLNSGGRHRLSTLTAGVGLLILVISLSSWLARIPMAALVSVMIMVSISTVSWDSFLKVKVVPKSDTSVMLLTLVLALMTRNLAIAVVVGVALAGILFSRKVAKVISVTTTELTNDHLYVTVQGQLFFVSTVYFLAGFKKHVHPARVTIDMAQAHVWDQTGMRALDQVIRKLQQGGSKVELINLNQESLDLFDRISETPAFVIGARCDLPESVNTTGS

SEQ ID NO: 93514 - protein, 429 aa, Salmonella enterica subsp. enterica serovar Typhi
MKALNREVIDYFKEHVNPGFLEYRKSVTAGGDYGAVEWQAGSLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRRPFMPLLPGFRHVPFGNIDAMSMAFSEGKKTGDEIAAVILEPIQGEGGVILPPQGYLTEVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDTLLDGFRQLAREYPNLVHEARGKGMLMAIEFVDNETGYRFASEMFRQRVLVAGTLNNAKTIRIEPPLTLTIELCEQVLKSARNALAAMQVSVEEV

SEQ ID NO: 93515 - protein, 507 aa, Ralstonia eutropha JMP134
MSALPQTANAVPSVPLLINGEWVESSATEFRDVVNPATQEVLARVPLATASEVAAAVDSAHRAFATWRHTPIGARLRIMLRYQALIREHSKRIAAILTAEQGKTLADAEGDIFRGLEVVEHACSIGTLQQGGFAENVAATVDTYTLQQPIGVCAGITPFNFPAMIPLWMFPMAIVCGNTFVLKPSEQDPLSTMELVKLAVEAGVPPGVLNVVHGAKDVVDALCTHPDIKAVSFVGSTAVGTHVYNLAGAHGKRVQSMMGAKNHAVVLPDAHKEQTLNALVGAGFGAAGQRCMATSVVVLVGAAREWVPELVAKAKTLKVGAGAEAGTDVGPVVSVAAKERILGLIASGEKEGAKLVLDGRNVEVPGYAQGNFIGPTVFTDVTTDMSVYTNEIFGPVLVVLGVETLDEAIALVNRNPFGNGTGVFTQSGAAARKFQSEIDVGQVGINIPIPVPVPYFSFTGSRGSKLGDLGPYGKQVVQFYTQTKTVTARWFDDATVNDGVNTTISLK

SEQ ID NO: 93516 - protein, 397 aa, Clostridium perfringens SM101
MNFNKKTIEDVQVKGKKVLVRCDFNVPLKDGVITDENRLNGAMPTIKYLVDNGAQVILCSHMGKPKGEAKPEFSLAPVAKRLSEMLGKEVVFAADDNVVGENAKKAVAEMKDGDVVLLQNTRYRKEETKNGEELSKELASLAEMFVNDAFGTAHRAHCSTVGVTEYLKPAVCGYLIQKELKFLGDAVETPERPFVAILGGAKVSDKINVINNLLEKVDTLIIGGGMAYTFLKAQGYTVGSSLVEEDKVEYAKEMLAKAEEKGVKLLLPVDHRVAKEFKDVEAVVTEDQNIAEGFMGLDIGPKTEAIYAEAIKDAKTVIWNGPMGVFEFENFNKGTIAVAKAMAEADATTIIGGGDSAAAVNILGFGDKMSHISTGGGASLEFLEGKVLPGIAALNDK

SEQ ID NO: 93517 - protein, 371 aa, Zea mays
MAGSAVAVVLLSAVALLCLYHLLFLSLSVPDPAAAAAVPRRAGGHHGSNVPSGSGTANVVLRFGLSGQPLRLHDPASAAGLPDIDTFRGKLERLLPPDDHDPGWSRRFDAELGPVHRYFGPDAPLDVRQRIAYLFAILDRSPRGVGVGVGVGELEAWLRWQAAARLDAVTRREMAPHDTDRDGAVTLREFFAGWWMHKFASADRDGDGSLNAVEFNDFLHPEDSSQESVMLWLLKDKLSEMDHDGDGRLSQEEFVAQSHIIISGARHADDGGHAHDLERAEAAKKFTELDADKDNYLTVEEARCVLQSLVTGEFSYATSHAKFLMKADVNHDGKLSLEEMLDDYISFYSTVYMDDHYASEGEVDSDSRDEL

SEQ ID NO: 93518 - protein, 502 aa, Cryptococcus neoformans var. neoformans JEC21
MKASIPPPPKDAVNFCDFVTHAPTPFHAVAHLTTRLFTSGFVPISERSPTSSLEPGGKYYYTRNQSSLVAFTLPAKPLPETAISFAVGHLDSPCLKVRPVSKKTKSNYLQVGVELYGGGIWHSWFDRDLSLAGRVIVANREAHHSEDPKFVSKLVKIDRPILRIPTLAIHLDRTANDNFKFNKETEFQPILGLVEDALNATDAGLGMKRSHSGSLHQPLAKKDSHETEKSDDLFNVANMEDKHHPKLLAVLADELGCDIADIQDFELSLFDTQPSTIGGLSNEFVYSPRIDNLMTSFCTIEALCEAVKTSNAEDESNIRCVILFDNEEVGSVSHHGAESNLLPAFVERIVQLKDYKDVGYYAMLANSFLISADMGHAMHPNYESRYEPNLAPKINGGIVIKTNANQRYTSNAQTTFLLRRVAKKAGVPVQEFEIRNDSTCGSTVGPHLSTHVRTVDIGLAQLSMHSIRETAGSHDVRHYINFFKIFFQGFGEIDRELRIDWH

SEQ ID NO: 93519 - protein, 485 aa, Roseovarius nubinhibens ISM
MTDTTRQTHTVEKIGGTSMSRLRELRDTLLIGTRKPADLYNRVFVVSAFGGITNLLLEHKKSGEPGVYASFANDDTAHRWHDQLDRVADAMKEAHAAILDHKADLLEADRFVDERIHGARGCLIDLQRLCAYGHFRLDQHMGQTRELLSGLGEAHSAFTTTLLLQRAGVNARFVDLSGWRDEGNVSLDERIRDAFAGIDPASEMPIVTGYAQCAEGLMGEYDRGYSEVTFSRLAALTQAREAIIHKEFHLSSCDPNLVGPDAVRKLGRTNHDVADQLSNLGMEAIHPKAAKTLRQAGVPLRVTNAFEPDDPGTLIDDLPADSAAVEIVTGLDIVSLEVFEQDMVGVKGYDAAILDVLARHNVRIVSKVSNANTITHYLDGSLKTLRRVEKDLATLYPAAEITTRRLSLVAAVGRDLSGLSVLTRGLQAIAAAGLEAIGATQGPRNVDVQFILDRADMEPAIRALHGALIEKPQAQSVRQELSHAA

SEQ ID NO: 93520 - protein, 458 aa, Streptococcus agalactiae 2603V/R
MENHRYEDEGKFQRKMTSRHLFMLSLGGVIGTGLFLSSGYTIAQAGPLGAVLSYLIGAVVVYLVMLSLGELAVAMPVTGSFHTYATKFISPGTGFTVAWLYWICWTVALGTEFLGAAMLMQRWFPNVPAWAFASFFALVIFGLNALSVRFFAEAESFFSSIKVIAIIIFIILGLGAMFGLVSFEGQHKAILFTHLTANGAFPNGIVAVVSVMLAVNYAFSGTELIGIAAGETDNPKEAVPRAIKTTIGRLVVFFVLTIVVLASLLPMKEAGVSTAPFVDVFDKMGIPFTADIMNFVILTAILSAGNSGLYASSRMLWSLANEGMLSKSVVKINKHGVPMRALLLSMAGAVLSLFSSIYAADTVYLALVSIAGFAVVVVWLAIPVAQINFRKEFLKENQLEDLSYKTPFTPVLPYITIILLLISIVGIAWDSSQRAGLYFGVPFIIFCYIYHKLRYKKW

SEQ ID NO: 93521 - protein, 520 aa, Myxococcus xanthus DK 1622
MDQTPEKDPLRARLEKMEKQAELGGGADRIAKQHESGKLTARERIDLLLDPGSFCELDKFVTHRSSEFGMGDKKIPGDGVVTGYGTVEGRKVFVFAQDFTVFGGSLSGAYAQKICKIMDLATRVGAPVIGLNDSGGARIQEGVESLAGYADIFVRNTLASGVVPQISLIMGPCAGGAVYSPAITDFIMMVKDTSYMFITGPDVIKTVTHEEVSKEALGGAVTHNQKSGVAHFAAENEQAAIVMTRELLSFLPSNNQEEAPVQPCEDDAFRAEESLKTIVPSNPNKPYDIKEVIKAIVDDKHFFEVQEHFAKNIVIGFARMNGRSVGVVANQPAVLAGVLDIDASIKAARFVRFCDCFNIPLVTLVDVPGFLPGTDQEWGGIITHGAKLLYAYAEATVPKVTVITRKAYGGAYDVMASKHIRADMNFAWPTAEIAVMGPEGAVNIIFRNELAKAPDAAAERARLTADYRDKFATPFKAAELGYIDEIIRPEETRAKLIRSLELLKDKRQENLPRKHGNIPL

SEQ ID NO: 93522 - protein, 374 aa, Zea mays
MVFDGSAPASRLAASTTASGIKMIGSFITGMLTLVLGYAYPAYDCYKTVELNRPEVEQLRFWCQYWILLAFLTVLERVGESFVSWLPMYSEAKLAFIVYLWYPKTRGTAYVYESFFKPYIAKHETEIDRNLLELRTRAGDMAVLYFQRVTNYAQTRSYEILQYIASQSPTQRQMLLSFSLASLNIYAIKLPKIFKILATNLLRVSAVDDVIHSFHLHEISLAVILLHGHPELPHVVMLIGVFAISSFLQAHQQQQRPPPPRTRQVNPAPPPIPAPSAPPMPPQPAQAQVPPTPPRPLVPVVPPGAVPPAPPPTAPEATATNGLQDTETMQVDPPRASLSGPPLPPEETLIEEAIRLTRGRLRRRLAGGSGPPQN

SEQ ID NO: 93523 - protein, 669 aa, Oryza sativa Japonica Group
MAQIPNLDNAPLNLAALREQSQKDLLNILKSIRGKKCVVIDPKLAGTLSLILQTSLLKEYGAELRLLSAEPLQTECAKILYLVRSELKFMKLIASQIKNDEPKGLQREFFLYFVPRRTVACEKILEEEKVHQKLTLGEYPLYLVPLDEDVICFELDHSLQECLIEGDTSSVWHVAKAIHKLEFAFGVIPNVRAKGVASTKAAELLNSMQQEDPVNMDDMGTPEINTVILLDREVDLVTPMCSQLTYEGLLDEMLQINNGSVEVDATIMGAQQDGFSFSHLWEVFCLPLLGRLTSLAFQVVGSDKLYKEIRDLNFEVVVQVLRQKATSIQQDYAEVKSTNTQSVSELKDFVKRLHSLPEIARHVHLAQHLQSFTGKPSFHARLDIEQTILEVQNFEICFEYIEEMIHKQEPIENVLRLLVLLSLTNAGLPKKNFDYLRREILHSYGFEHMPLLYNLEKAGLFKRQESRSNWIGITRALQLIVDVNDTANPSDISYIFSGYAPLSIRLVQHAVRSGWRSIEELLKLLPGPHLDLKRGSSAINSSLDVHQGLGLQQSIDRLFALSGDEGFMRDLIQTYESKPETGVGHRSLVLVVFIGGVTFAEIAALRFLSSQEGMGYDFLVATTKVVNGNTILRPIITNSKELDLYQKSLKGVLDHDLTINRRFRWKRRA

SEQ ID NO: 93524 - protein, 198 aa, Streptococcus agalactiae 2603V/R
MAEEFLNTHNASILLSAANKSHYPQDDLPEVALAGRSNVGKSSFINTLLGRKNLARTSSKPGKTQLLNFYNIDDKLRFVDVPGYGYAKVSKTERAKWGKMIEEYLVTRDNLRVVVSLVDFRHDPSADDIQMYEFLKYYEIPVIIVATKADKIPRGKWNKHESSIKKKLNFDKKDHFIVFSSVDRTGLDESWDTILSEL

SEQ ID NO: 93525 - protein, 320 aa, Physcomitrella patens subsp. patens
MASSAMLASQAPTGASGVAVVSVPRSSVSGSSSSTTQLSVKSFGASSTLLCGGEVVQKQAGFGSVPKKSNAMTFAPRAQSQATQALTQDELKKIAAEKAVEYVKSGMVLGLGTGSTAAFAVAKIGELLKEGKLTDIVGVPTSKRTAEQAASLGIPLSVLDDHPKIDLAIDGADEVDPDLNLVKGRGGALLREKMVEKASAKFVVIVDETKLVKGLGGSGLAMPVEVVQFCWKYNAERLKNLPEVAGCEVELRMDGDKPYVTDNSNYIIDLYFQEPIKDANAAAHAISALEGVVDHGLFLNMASAVIIAGSDGVTVQTKDT

SEQ ID NO: 93526 - protein, 536 aa, Phanerochaete chrysosporium
MGLTQAQRLVLGQLARLVAPALAVCVLLAAARRTQLVRAPVWADALIALIAIPLFHVGRAHWRVDVLQLVDEAYRRGFLSDYFYEKFGELGHTYNFYVLWDMDYCTEDAAVIKAVLATDFNNWVKGERFDSYMHSVLGTGVFNADGELWKFHRSMTRPFFARERITDFETFNRHAEEAILKMKERLREGFAVDFADLISRFTLDAATEFLFGACTTSPRRSARRRTQSRIARASRTDTPMRTVDRYLTPIIERALAMSRAAKQAPQGEKEEVADGETLLDHLARYTTDPTILHDEILNIMIAGRDTTGGTLTFVIYFLTQHPDVLQRLRQEILDVVGPSNLPTYDDIKQMKYLRAVLNETQRLYPPVPWNMRYAVEDSIVPNSEPEGKPWFIPAGASVSYSVHCMHRRKDYWGPDAEEFDPDRFLDERLHKYLTPNPFIFLPFNAGPRICLGQQFAYNEMSFFLVKLLQTFEDISFERDAFEPNALPPAEWAKFPGRKGKEKFWPRAHLTLYSEVRMTAGGMWVKMREAQAMGQVA

SEQ ID NO: 93527 - protein, 196 aa, Zea mays
  misc_feature (69)..(69): Xaa can be any naturally occurring amino acid
  misc_feature (90)..(90): Xaa can be any naturally occurring amino acid
MAAYLSSRNAVEVVRLEQKAASLGKLVEEEEEAQVTLDVLSKPKHPGFLLRHLFPSKAGDIPAWLDPVXLPSGKSSYSGFCGKPLQFVLXIYALTKDNVAAFHRTLFMFMCPSMACLLRDQHEQWKHKYGNPCRSVKIFRCQLPRNNAFYSAQPPKHDGSNKPLCLGALVCHWCGTWKGDKICSNCKKARLMALDC

SEQ ID NO: 93528 - protein, 218 aa, Oryza sativa Japonica Group
MGSTRLLVLLAAASLLLATAVPAARAQEETDHEEEFTYISGDEKGPEHWGKLKPEWAQCGAGEMQSPIDLSHERVKLVRDLGYLDDSYRAAEASIVNRGHDIMVRFDGDAGSVVINGTAYYLRQLHWHSPTEHSVDGRRYDMELHMVHESAEKKAAVIGLLYEVGRPDRFLQKMEPYLKMIADKEDRAALHAGGGLDDCQEGSHRVEVSARPSQGSCA

SEQ ID NO: 93529 - protein, 314 aa, Coccidioides posadasii
MASRHTTFRLNTGEDIPAIGFGTWQDENAQEDAVLTALSAGYRHIDTAAVYGTEKAIGRALARSRLSRDELFITSKLWNNKHRPEDVEQAIDQSLKNLEIDYLDLYLMHWPAAFAPGDDMFPKDSQGNSKTVDIDYVDTYKAMEKLVKSGKTKAIGISNFSKGEMERLLESCSIVPAVMQMELHPWLQQNDFVEWLKSKGIHVTQYSSLGNQNEVYSGRERYGRLIEDPALAAIGTKYGKTGAQVALAWGITKGHSVLVKSKTPHRIQQNFESDFELKQEDMKAIENIDKKLRFNDSSADFGYNFFVGLEGKEK

SEQ ID NO: 93530 - protein, 310 aa, Physcomitrella patens subsp. patens
MHQVTGAHRPIDIEKSVHDMKLYAFAGLGVFDVADTYGPAEDIYGRFYDEYWGRRPVLGFTKFDPGYGEVHTRLVVEAIIDRSRNRMRVATLDMVQFHWWDYSDERYCVSVKWLHTLQQEGKIKELGLTNFDTEHMAKIVEDCGIRAVSNQVTYSVIDTRPEKKMIAWCLQHDVKLLAYGTLMGGLLSEKYLGQPEPLRTDPINTPSISKYKYIINAWGGWALFQELLLVLSMIAKKHRISISNVAVRYIADKPAVAAVIVGARLGASQHIASNQAIYSFPGLDEGDIDLIHSIVKKGSELHGDPGDEFR

SEQ ID NO: 93531 - protein, 353 aa, Saccharomyces cerevisiae
MFEGFGPNKKRKISKLAAEQSLAQQPWVEKYRPKNLDEVTAQDHAVTVLKKTLKSANLPHMLFYGPPGTGKTSTILALTKELYGPDLMKSRILELNASDERGISIVREKVKNFARLTVSKPSKHDLENYPCPPYKIIILDEADSMTADAQSALRRTMETYSGVTRFCLICNYVTRIIDPLASQCSKFRFKALDASNAIDRLRFISEQENVKCDDGVLERILDISAGDLRRGITLLQSASKGAQYLGDGKNITSTQVEELAGVVPHDILIEIVEKVKSGDFDEIKKYVNTFMKSGWSAASVVNQLHEYYITNDNFDTNFKNQISWLLFTTDSRLNNGTNEHIQLLNLLVKISQL

SEQ ID NO: 93532 - protein, 69 aa, Physcomitrella patens subsp. patens
GLKAAFVACLATAIPTLTAVRMVPWVKANVNYTGQALIISGATIATYFVVAEQTILECSRKQNATNLEK

SEQ ID NO: 93533 - protein, 429 aa, Herminiimonas arsenicoxydans
MQLLAVGLNHTTAPVSLREKVAFPADQLGQAVASARVWYGRSDSKTYSDEAAILSTCNRTELYAASHQPGGVNEAIDLTAHFLADYHKLPYSELRPYLYALPQDNAVRHAFRVASGLDSMVLGEPQILGQMKDAVRQAEAAGGLGTYLHQMFQRTFAVAKEVRSNTEIGAHSVSMAAASVRLSQRIFDTISEQNVLFIGAGEMIELCATHFAAQNPKSLTIANRTLERGETLAHRFNGRAIRLADLPDQLASYDIVISSTASSLPIIGLGMVERAIKARRHKPMFMVDLAVPRDIETEIGRLDDVFLYTVDDLGTFVQTGLENRQAAVTQAEAIIETRVQSFMHWIDARAVVPVIQDLHESSEMMRMIELERARKLLAKGEDIDAVLEALSKGLTAKFLHGPQQALNNAQGDERTRLAALLPQLFRTKR

SEQ ID NO: 93534 - protein, 418 aa, Ralstonia eutropha JMP134
MTASSGKRRFARIDRLPPYVFNITAELKMAARRRGEDIIDMSMGNPDGATPPHIVAKLVEAAQRPDTHGYSASKGIPRLRRAISHWYRERYDVEIDPDTEAIVTIGSKEGLAHLMLATLDRGDSVLVPDPSYPIHIYGAVIAGADIRSVPLVPGVDFFAELERTIRGSYPKPKMIVLGFPSNPTAQCVELDFFERVIALARKHDIFVVHDLAYADIVFDGWKAPSIMQVPGAKDIAVEFFTLSKSYNMAGWRIGFMVGNPDLVAALTRIKSYHDYGTFTPVQIAAIAALEGDQECVKEIAAHYQSRRDVLAKGLIESGWLVDIPKASMYIWARIPEPYRALGSLEFAKQLLAKAKVSVSPGIGFGDYGDEYVRFALIENEARIRQAVRGIKAMFRADGLVKVPASEHADGHGKEKGKG

SEQ ID NO: 93535 - protein, 339 aa, Glycine max
MDHSADAQRTDLMTITRFVLNEQSKHPESRGDFSILLSHIVLGCKFVCSAVNKAGLAKLIGLAGETNVQGEEQKKLDVLSNDVFIKALISSGRTCILVSEEDEEATFVEPSKRGKYCVVFDPLDGSSNIDCGVSIGTIFGIYLIKEDHEPTVEDVLQPGKNMLAAGYCMYGSSCTLVLSTGSGVNGFTLDPSLGEFILTHPDIKIPKKGKIYSVNEGNAKNWDGPTTMYVENCKYPKDGSSPKSLRYIGSMVADVHRTLLYGGIFLYPADKKSPNGKLRVLYEVFPMSFLMEQAGGQAFTGNQRALDLVPKKLHERSPIFLGSYEDVEEIKALYSADEK

SEQ ID NO: 93536 - protein, 532 aa, Nocardia farcinica IFM 10152
MTILRSTLDSAAPEYTAAAEAMTTKLTEIEAEFAKAVAGGGPEKLARHRKRGKLTARERIELLIDEDSPFLELCPLAAWGSEFHVGASVIAGIGIVEGVECMIVAPDPTVRGGTSNPWTLRKNLRMNDIAMENRLPVIGLVESGGADLPTQKEVFVPGGRMFRDLTKLSAMGIPTIALVFGNSTAGGAYIPGMSDYTVMIKERSKVFLGGPPLVKMATGEESDDESLGGAEMHARTSGLADYLAADEQDAIRIGRSIVKRLNWRKQGPAPRGPVLEPRYDPEELLGIVPADLKIPFDPREVIARVVDDSDFDEFKPLYGSSLVTGWAQLHGYPVGILANARGVLFSEEAQKAAQFIQLANQSDTPLLFLHNTTGYMVGKEFEQKGIIKHGAMMINAVSNSKVPHISLLMGASYGAGHYGMCGRAYDPRFVFAWPSAKSAVMGGAQLAGVISIVGRAAAEARGKPFDEEADAGMRAMIEAQIEAESLPMFMSGRLYDDGVIDPRDTRTVLGMALSAIHNAPIKGAEGFGVFRM

SEQ ID NO: 93537 - protein, 239 aa, Oryza sativa
  misc_feature (24)..(24): Xaa can be any naturally occurring amino acid
GSNNESWCQGLDGLASREGAYYQXGRTVVSIPNGPSELAVKEAAWGLARYAAISQDNGLVPIVEPEILRDGEHGIDRTFEVAQKVWAETFFYMAENNVMFEGILLKPSMVTPGAECKDRATPEQVSDYTLKLLHRRIPPAVPGIMFLSGGQSEVEATQNLNAMNQGPNPWHVSFSYARALQNTCLKTWGGQPENVKAAQDALLLRAKANSLAQLGTVHPRDGEAAEAHRRACSSQNYVY

SEQ ID NO: 93538 - protein, 501 aa, Rickettsia rickettsii
MLPPKIFFEKVKEIIWPIERKELKLFIPMALMMLCILFNFGALRSIKDSLVVPSMGAEIISFLKLWLVLPSCVIFTVLYVKLSNNLNFEYIFYIIVGSFLLFFLLFAYIIYPNQDIYHPNDEMINKLIASYPHFKWFIKIGSQWSYALMYIFAELWSAVVINLMFWQFANHIFDTSKAKRFYPVLGMVGNIGLIIAGSVLVFFSSGQDVIDSELLPDAFNLSVGNAIMLKPIMSIIVTAGIIAMLLFRIINRFILTDSINVLDAKKVTAKMKTKLSVIESIKLVMHSKYIGRIALLIICYGLLINIVEGPWKAKIKELHPNTIEYVNFMGRFNIWMGISCVTFMIIGSNILRRLGWFISALLTPIMLSITGLMFFIFIIFIEEIGECFGDFNLLYAAIIVGAIQNILSKSSKYSLFDSTKEMAYIPLSLELRTKGKAAVEVIGTKFGKSLGAFIQSLIFIIIPTATFDSIIIYLLVTFIVMMSLWIWNVIKLNKEYIKLCQ

SEQ ID NO: 93539 - protein, 501 aa, Rickettsia typhi
MLPPKIFFEKFKEIIWPIERKELKLFIPMALMMLCILFNFGALRSIKDSLVVPSMGAEIISFLKLWLVLPSCVIFTVLYVKLSNKLNFEYIFYSIVGTFLLFFLLFAYIIYPNQDIYHPNDAMINNLIASYPNLKWFIKIGSKWSYALMYIFSELWSAVVINLMFWQFANHIFDTAKAKRFYPVLGMIGNIGLIIAGSVLVFFSSGQYIIDSELLTDSFNSSSCNSIILQPIISIIVTAGIIAMFLFRIINRFILTNAINVLDVKKAAARTKTKLALIESIKLIIHSKYIGRIALLIICYGLLINIVEGPWKAKIKELHPNTIDYVNFMGMFNIWMGISCVTFMIIGSNILRRLGWLISALLTPIMLSITGFIFFIFIIFIEEIGTCFGDFNLLYVAIIVGAIQNILSKSSKYSLFDSTKEMAYIPLSLELRTKGKAAVEVIGTKFGKSLGAFIQSLIFIIIPTATFDSIIIYLLVIFIVMMNLWIWNIIKLNKEYIKLCQ

SEQ ID NO: 93540 - protein, 275 aa, Oryza sativa Japonica Group
MGVYLSTPKTEKLSEDGENDKLKFGLSSMQGWRATMEDAHSALLDIDNDTSFFGVFDGHGGRVVAKFCAKYLHREVLRSEAYSAGDLGNAAHKAFFRMDEMMRGQRGWRELQALGDKINQISGMIEGLIWSPRGSDSNDQHDDWAFEEGPHSDFAGPTCGSTACVAIVRNSQLVVANAGDSRCVISRNGQAYNLSRDHKPELEAERERILKAGGYIQMGRVNGTINLSRAIGDIEFKQNKFLSPDKQMLTANPDINTVELCDDDDFLVLACDGIW

SEQ ID NO: 93541 - protein, 512 aa, Rickettsia montanensis
MTINASNIENSSSKINSYFSKLTDYIWPIKRHEVSKFLFITLLMFCILFIQNLIRALKDSIVTTMIGAETISFLKFWGVMPSAFLMTAIYVKLVNKMKAENIFYLIISIFLTFFALFAYVIFPNHEMLHLSPVTVQNLTASLPNLKWFILLLSKWSFSLFYIIAELWPNVVFALLFWQFGNNITTVEESKRFYPLFGLLSQTGIYLAGQFLENLSNINDYVTNKFALQSSFHTLSIQIILTIVLILGIIAIKTFWLLNHKVLGKEHMALLRFKAKKKSMTIAESFQMLLSSRHIRLIATLLICYGIAINLVEGPWKAAATKIYKTPTEYAAFIGSYLSYTGVFTILFVVLGSNIVRRLGWFTAAVITPLIVFITGILFFAVNNFERFAGLIIANFILTDPALIAITIGAIQNVLSKSSKYTLFDSTKEMAYVPLDPEIKIKGKAAARVIGTKLGKSGSAFLQSLVFIILPSTSYQSISICLMIIFIITCLTWLWATKALNKEYKNSIKFSQK

SEQ ID NO: 93542 - protein, 515 aa, Oryza sativa Japonica Group
MELGLEPQEAPMVDTPLMVDVMNYAYRLGVRYLEKAVFNLDYGQLKLVFHALKERKQVVYYWFGLKFYDIVAGRRLLHLSRYYSVDESVELFPTLAKNSHDRSLRGTVVYYDGQMNDSRLNVGLACTAAVVGAAILNYAEVVSLIKDESGERIIGARIRDTLSGKEFDAFAKVVVNAAGPFCDSVRKMANNDVVPMISPSSGVHIVLPDYYSPDGMGLIVPKTKDGRVVFMLPWLGRTVAGTTDSSTAITMLPEPHEDEIQFILDAICDYLNVQVRRSDVLSAWSGIRPLAMDPSAKNTESISRDHVVFEDYPGLITITGGKWTTYRSMAEDAVNAAIRSGNLKPANGCVTDHLHILGGYGWDPASFTVLAQNYKRMKRTYGGKIIPGAMDSAVSKHLSHAYGTLATQVASIAQNEGLGKRLAHGYPFLEAEVAYCARHEYCESAVDFIARRCRLAFLDTDAAGRALPRIIEILALERKWDKARQKLELQKGKDFLETFKSSKNAQFRDGKHNGQ

SEQ ID NO: 93543 - protein, 169 aa, Oryza sativa Japonica Group
MTTMVGSCGHPLVVGLDVEWRPAAPVPGPVAVLQLCVDRRCLVFQILHADYVPDALSRFLADPRFTFVGVGVRDDAARLRVGYGLEVPRAVDLRALAADTLGRPDLRRAGLRALVREVMGVQMDKPHHVRVSAWDKRNLSEDQFKYACADAFASREVGRRLYTCNCDGA

SEQ ID NO: 93544 - protein, 512 aa, Rickettsia rickettsii
MTINASNIENSSSKINSYFSKLTDYIWPIKRHEVSKFLFITLLMFCILFIQNLIRALKDSIVTTMIGAEIISFLKFWGVMPSAFLITAIYVKLVNKMKAENIFYLIISIFLTFFALFAYVIFPNHEMLHFSPATVQNLTASLPNLKWFILLLSKWSFSLFYIIAELWPNVVFALLFWQFVNNITTVEESKRFYPLFGLLSQTGIYLAGQFLENLSNINDYVTNKFALQSSFHTLSIQIILTIVLILGIIAIKTFWLLNHKVLDKEHMALLRFKAKKKSMTIAESFQMLLSSRHIRLIATLLICYGIAINLVEGPWKAAATKIYKTPTEYAAFIGSYLSYTGVFTILFVVLGSNIVRRLGWFTAAVITPLIVFITGILFFAVNNFERFAGLIIVNFILTDPALIAITIGAIQNVLSKSSKYTLFDSTKEMAYVPLDPEIKIKGKAAADVIGTKLGKSGSAFLQSLVFIILPSASYQSISICLMIIFIITCLTWLWATKALNKEYKNSIKFSQK

SEQ ID NO: 93545 - protein, 296 aa, Bacillus licheniformis ATCC 14580
MTGKLEGFLKSRKTVIEERLPMYIKDLQAPSILKESMLYSLEAGGKRLRPILVLALLHAYGKDEEAGIPVGCAVEMIHTYSLIHDDLPCMDDDDLRRGKPTNHKIYGEATAILAGDALLTESFKMITSNMPSDVSAEKRIRLVNELISAAGAEGMVGGQILDMEAESKSVSLDELQRIHEGKTAKLLSFSVIAGAILADASEKEIEKLREFSHHIGIGFQIRDDILDLEGSEDKIGKRIGSDASNGKSTYPSLLSLEGASQKLDEHIEKAKQLISELPLEKELMYEFCDMIAARDH

SEQ ID NO: 93546 - protein, 284 aa, Streptococcus agalactiae 2603V/R
MTTFTAKFIDQEWEVPVESGRYHMIVGEFCPYAQRPQIARQLLGLDKHISISFVDDVPSDIGLIFSQPEQVTGAKSLRDIYHLTDPTYQGPYTIPILIDKTDNRIVCKESADLLRLFTTDFSDLHQEDAPVLFSQETASLIDNDIKDINKNFQSLMYKLAFLDKQADYDTYSKEFFTFLDQKEHLLGQRPFLLGDNLSEVDIHFFTPLVRWDIAGRDLLLLNQKALEDYPNIFSWAKTLYNDFNLKTLTNPQSIKNNYYLGKFGRAVRHHTIVPTGPNMAKWEK

SEQ ID NO: 93547 - protein, 155 aa, Zea mays
NIVAIAAGLVDGLDMGNNTKAAIMRIGLREMRAFSKLLFPSVRDNTFFESCGVADLITTCLGGRNRRVAEAFARNGGKRSFDELEAEMLRGQKLQGVSTAREVYEVLTYRGWQELFPLLSTVHEICIGQLPPTSIVEYSEHTPNLSIIGGHTPFY

SEQ ID NO: 93548 - protein, 129 aa, Triticum monococcum subsp. aegilopoides
QGRNEFVIRLQPSEAMYMKLTVKKPGLEMATEQSELDLSYGMRYQDVKIPEAYERLILDTIRGDQQHFVRRDELKAAWQIFTPLLHDIDAGKLKAVSYKPGSRGPKEADELSEKVGYMQTHGYIWIPPT

SEQ ID NO: 93549 - protein, 510 aa, Zea mays
MATAMGAMAATCMASIPAAATFPGDLGVGRRRAVVPGWRAGGRRLRATPPARRPFLFSPKGVSDSRSSQTCLDPDASTSVLGIILGGGAGTRLYPLTKKRAKPAVPLGANYRLIDIPVSNCLNSNVSKIYVLTQFNSASLNRHLSRAYGNNIAGYKNEGFVEVLAAQQSPENPNWFQGTADAVRQYMWLFEEHNIMEFLILAGDHLYRMDYQKFIQAHRETDADITVAALPMDEQRATAFGLMKIDDEGRIVEFAEKPKGEKLRSMMVDTTILGLDPERAKELPYIASMGIYVFSKDVMLRLLRENFPAANDFGSEVIPGATEIGLRVQAYLYDGYWEDIGTIEAFYNANLGITKKPVPDFSFYDRSAPIYTQPRYLPPSKVLDADVTDSVIGEGCVIKHCTINHSVVGLRSCISEGAVIEDSLLMGADYYETENDKNVLSETGGIPIGIGKNSHIRKAIIDKNARIGENVKIINFDNVQEAVRETEGYFIKSGIVTVIKDALIPSGTII

SEQ ID NO: 93550 - protein, 415 aa, Desulfovibrio desulfuricans G20
MSESCGCSAGGNCSSGGCHENKSPEDLRLESSVSRIRNKVVVMSGKGGVGKSTIAANIAVSLALAGQKVGLLDVDVHGPSIPRLLGLDKAEIRMEERSLLPVPWNANLSVMSVGFMIPDPQQAVIWRGPVKMGFIKQMLSEVAWGDLDFLVVDCPPGTGDEPLSVLQLLGTDARAVIVTTPQAVAVDDVRRSIGFCRELGNPIAGVVENMSGFACPQCDHVEPLFGQGGGEALAKETNVPFLGAVPATSLMSRCGDKGLVFVQAQPENPVAEAIGRIVKPLLAHAGTLHEREGAVPAPQAEGTVKVALPLANGSLCQHFGHCEQFAIVTADTTAKTVLGTENITPPPHEPGVLPRFLAEQGVNVVLAGGMGARAQSLFTGQGINVVTGISGGSPHEVVSAWMQGSLTAGANTCDH

SEQ ID NO: 93551 - protein, 525 aa, Rhodospirillum rubrum ATCC 11170
MTDRTSVSATDRILIIDFGSQVTQLIARRVRESGVYSEIQPFNTVTAASIAAFAPKGVILSGGPASVTAADTPRAPIELFTMGLPVLGICYGQQTMVAQLGGRVEAPDHREFGRAFVEVTAGCALFDGVWTPGERDQVWMSHGDRVDAIPEGFSVVAVSEGAPYAAIADEARHFYGVQFHPEVVHTPKGAALLRNFTHGICGCGGDWTMAAFKDQAIARVREQVGSGRVICGLSGGVDSSVVAALIHEAIGEQLVCVLVDHGMMRQGETEQVVRVFRDRFNITLVHRDASELFLGKLDGVVDPEAKRKIIGATFIDVFDEEARKVGGADFLAQGTLYPDVIESVSFTGGPSVTIKSHHNVGGLPERMKMALVEPLRELFKDEVRDLGRELGLPDEMVGRHPFPGPGLAIRIPGQPLTREKLDILRRADAIYLEEIRNAGLYDVIWQAFAVLLPVRTVGVMGDARSYDFALALRAVTSTDGMTADYYPFDHTFLGRVANRIINEVKGVNRVVYDITSKPPGTIEWE

SEQ ID NO: 93552 - protein, 512 aa, Oryza sativa
MGCFLSKPAGAGPLPPNDAAALPADNPADPEAAAANGGADSAAADGGGDDKDAAKRAVPVFREFGLAELRAATKGFSADLIVSESGEKAPNVVYRGRLDGGRLIAVKRFSRLSWPDPQQFLAEAAGVGKVRHKRLVNLIGCCADGDERLLVAEYMPNDNLSKHLFHWDKQTWAWEMRLRVAYYIAQALDHCNAENRKIYHDLNAYRVLFDEEGDPRLSSFGLMKNSRDGNSYSTNLAYTPPEFLRTGRVIAESVIYSYGTVLLDLLSGKHIPPSHALDLIRGKNILLLMDSSLEGQYANEDASKLVDLASKCLQFEARDRPNIKYLLSSVGPLQKQKEVASHVLMGITKATAVLPTILSPLGKACSGMDLTAVHDILLKTGYKDEEGAENELSFQEWTQQVQEMLNTKKFGDIAFRDKDFKTAIDYYSKLVGMMSVPSATVFARRSFSYLMNGQSELALRDAMQAQVCMPEWPTAFYLQALALSKLGMETDAQDMLNDGATFEAKKQNSWRG

SEQ ID NO: 93553 - protein, 79 aa, Cucumis melo
TGAPVYLAAVMEYLAAEVLELAGNAARDNKKNRIIPRHVLLAIRNDEELGKLLAGVTIASGGVLPNINPVLLPKKTDKG

SEQ ID NO: 93554 - protein, 617 aa, Mannheimia succiniciproducens MBEL55E
MQNYPLLSLINSPEDLRLLNKDQLPQVCNELREYLLESVSRTSGHLASGLGTVELTVALHYIFKTPFDQLIWDVGHQAYPHKILTGRRERMTTIRQKDGIHPFPWREESEFDVLSVGHSSTSISAGLGIAIAAEKENAGRKIICVIGDGAITAGMAFEAMNHAGALHTDMLVILNDNEMSISENVGGLNNHLARIFSGSIYSSLRDSSKKILDTMPPIKNFMKKTEEHMKGVISPISTLFEELGFNYIGPIDGHNIEELIATLSNMKTLKGPQFLHIRTKKGKGYTPAEQDPIGFHGVPKFDYHTGQLPKSTATPTYSQIFGEWLCETAEQDEKLIGITPAMREGSGMVEFSNRFPDQYFDVAIAEQHAVTLAAGLAIGGYKPVVAIYSTFLQRAYDQVIHDVAIQNLPVLFAIDRAGIVGADGPTHQGAFDLSFLRCIPNLIIMAPSNENECRLMLHTGYCCGKPAAVRYPRGNAIGVELEPLRKLEIGKSNLVRQGQDIAILNFGTLLPNALDVAEKLNATVVDMRFVKPLDHERINELAKTHRTLVTLEENTIQGGAGSAVSEVVNIQQHHVNILHLGLPDEFVAQGTQQEVLKELKLDATGIEEQIKNFLRIA

SEQ ID NO: 93555 - protein, 300 aa, Mannheimia succiniciproducens MBEL55E
MMRLMYQFSNDLQQAQQRINRFLEAQFDEINTRPSPLADAMKYGLLLGGKRIRPFLVYATGRMLGADTAQLDYAAAAIEAIHAYSLIHDDLPAMDNDSLRRGQPTCHIAFDHATAILAGDALQAFAFEILTKSTALSAEQKLRLIQVLSHNSGVFGMCLGQSLDLISEHKQISLSELEQIHRNKTGALLSAALKMGFICSSHFADNALEAKLDRYAAAIGLAFQVQDDILDIEGDLAAIGKNVGSDLESDKSTYPKLLGLAGAKQKARELYVAAVGELEHLPFDTTALRALAEFIINRKN

SEQ ID NO: 93556 - protein, 335 aa, Haemophilus influenzae R2846
MITSQTPITVLGAGSYGTALAITFSRNGSPTHLWGHNPVHIAQMQTERQNYRFLPDVIFPEDLHLESNLAQAMEYSQDILIVVPSHAFGEILIKIKPHLKAHHRLIWATKGLERNTGRLLQTVVEEQLGTQYPLAVLSGPTFAKELAQGLPSAITLAANNEQFAREFQSRIHCSKGFRVYINSDMTGVQLGGAIKNVIAIGAGISDGMGFGANARTALITRGIAEITRLGISLGANTNTFMGMSGLGDLVLTCTDNQSRNRRFGLMLGKGLDAQMAMENIGQVVEGFYNTKEAYLLAQRQGVEMPITEQIYQMLFCGKSAQDVAISLLGRACKGE

SEQ ID NO: 93557 - protein, 267 aa, Haemophilus influenzae R2846
MTLDVWQHIRQEAKELAENEPMLASFFHSTILKHQNLGGALSYLLANKLANPIMPAISLREIIEEAYQSNPSIIDCAACDIQAVRHRDPAVELWSTPLLYLKGFHAIQSYRITHYLWNQNRKSLALYLQNQISVAFDVDIHPAAKIGHGIMFDHATGIVVGETSVIENDVSILQGVTLGGTGKESGDRHPKVREGVMIGAGAKILGNIEVGKYAKIGANSVVLNPVPEYATAAGVPARIVSQDKAAKPAFDMNQYFIGIDDDMNLNI

SEQ ID NO: 93558 - protein, 387 aa, Clostridium perfringens SM101
MAKRDYYEVLGLQKGASDDEIKRAFRKMAMKYHPDRNPGDKEAEENFKEVNEAYDVLKDPDKKAKYDQFGHAAFDGSGGFGGGGFGGFDAGGFDFSEMGGFGDIFESFFGGGFGGGSSRRRNAPQRGADLEYRLNITFEEAVFGCEKEISITRTENCETCNGTGAKAGTSPKTCPKCNGSGQIRVQRQTPLGSFVSTTTCDQCGGTGKVIEDPCPDCKGKGTVRKNRKITVKIPAGVDTGNIIPLRGQGEQGANNGPAGDLYIRVNVAPSKIFRREGSDIYYDYKISMAKAALGAEITVPTVDGNVKYKVPAGTQPGTKFRLKGKGVPYVNGGGRGNQYVHMVVEVPKHLNKEQEEALKAFMKASGESVDDIDEKDEGFFSKFKKKK

SEQ ID NO: 93559 - protein, 171 aa, Oryza sativa Japonica Group
MDTMRGALERARMLVGMEVDEESAPEEQSFFDDVTRNCALTTTQRLYGFAICLAAGLTCTFLSMLVFFNPVKFGVTFTLGNLMALGSTAFLIGPKRQFDMMLDSVRIYATAVYIASIIIALFCALFVHSKLLTLLAIILEFGALVWYSLSYIPFARSVVSKVMTSCFDTEF

SEQ ID NO: 93560 - protein, 489 aa, Roseovarius nubinhibens ISM
MQSFEMLINGAWVAAGDGASFDTVSPADGKVWAKIPEATEEDVDRAVRAAHAACYEGPWSRMTPTERGHCLRRLAELLKDNAERLGEIETRDTGKMFKETRWQANYIAEFFHFYAGCADKIHGDTLPIDKPDMFVFTHREPLGVIAAIVPWNSQLFLTAVKIGPALAAGNTVVLKASEHASAAMLEFGKLIAEAGIPDGVVNIVTGHGEPCGRALTSHPLVARISFTGGPGAARHVLMNSTKNFAEVSLELGGKSPFIVFEDADIESAVNGSVAGIFGASGQSCVAGSRLIVHEDVADAFLARMVEIARAVKIGDPMAEETEMGPLCTLGQLETIEREVARAVEEGGRVLCGGKRAEAGEMYFEPTIIDCPSPDLHIVDTELFGPVLSVLRFRTEDEALRLANDTEHGLAAGIFTRDGARALRMSRAVRAGIVWVNTYRAISPVAEFGGMKGSGYGRESGFQAMYDYTRPKTVWMNASSEPLGSMFVAR

SEQ ID NO: 93561 - protein, 500 aa, Rickettsia typhi
MKSTSPSRSFKTKFRAAFWPVHNYELGKFIPISALMFCILFNQNILRILKDSILISEISAEIAGFAKVYCVTPVAALFVIIYAKMINHLTFEKIFYYLSAFFISCFILFAFVIYPNIHIFHVHPDTLSDWMNKYPHFKWYISLVGNWGYIVYYSLAELWPNIFYVLLFWQFTNELTTTEEAKRFYTLFSLFGNSSLILVGFLMMNLSSEDTIIKKFVSISDSKITLVQVSTTIVAIVAIICCLLVRFISKYIFTNPLFYAKIKKSRSTTQRMGLIKSFKYIAKSKYLWLLLICSAAFGFAINLVEAVWKAKIKELYPTVNTYAEFNSLYILWTGVAIIVMTIIGNNVMRMHNWFVAAVISPVIIMVTGILFFVLIVFDQQILSLFDGAILMSPLALAVSIGGIQNILAKGTKYSIWDTSREMLYIPLDDELKTKGKAAVDVISAKIGKSSSGLVQSIIFTLVPNATFTSISPILMVVFTFVCFAWIYAVRKIYFEYQKIA

SEQ ID NO: 93562 - protein, 1070 aa, Oryza sativa
MDGDADAVKSGRHGSGQACQICGDGVGTTAEGDVFAACDVCGFPVCRPCYEYERKDGTQACPQCKTKYKRHKGSPAIRGEEGEDTDADDVSDYNYPASGSADQKQKIADRMRSWRMNAGGGGDVGRPKYDSGEIGLTKYDSGEIPRGYIPSVTNSQISGEIPGASPDHHMMSPTGNIGKRAPFPYVNHSPNPSREFSGSIGNVAWKERVDGWKLKQDKGAIPMTNGTSIAPSEGRGVGDIDASTDYNMEDALLNDETRQPLSRKVPLPSSRINPYRMVIVLRLVVLSIFLHYRITNPVRNAYPLWLLSVICEIWFALSWILDQFPKWFPINRETYLDRLALRYDREGEPSQLAAVDIFVSTVDPMKEPPLVTANTVLSILAVDYPVDKVSCYVSDDGAAMLTFDALAETSEFARKWVPFVKKYNIEPRAPEWYFSQKIDYLKDKVHPSFVKDRRAMKREYEEFKVRINGLVAKAQKVPEEGWIMQDGTPWPGNNTRDHPGMIQVFLGHSGGLDTEGNELPRLVYVSREKRPGFQHHKKAGAMNALVRVSAVLTNGQYMLNLDCDHYINNSKALREAMCFLMDPNLGRSVCYVQFPQRFDGIDRNDRYANRNTVFFDINLRGLDGIQGPVYVGTGCVFNRTALYGYEPPIKQKKKGSFLSSLCGGRKKASKSKKKSSDKKKSNKHVDSAVPVFNLEDIEEGVEGAGFDDEKSLLMSQMSLEKRFGQSAAFVASTLMEYGGVPQSATPESLLKEAIHVISCGYEDKTEWGTEAMQLAMMHARGWRSIYCMPKRPAFKGSAPINLSDRLNQVLRWALGSVEILFSRHCPIWYGYGGRLKFLERFAYINTTIYPLTSIPLLIYCVLPAICLLTGKFIIPEISNFASIWFISLFISIFATGILEMRWSGVGIDEWWRNEQFWVIGGISAHLFAVFQGLLKVLAGIDTNFTVTSKASDEDGDFAELYMFKWTTLLIPPTTILIINLVGVVAGISYAINSGYQSWGPLFGKLFFAFWVIVHLYPFLKGLMGRQNRTPTIVVVWAILLASIFSLLWVRIDPFTTRVTGPDTQTCGINC

SEQ ID NO: 93563 - protein, 499 aa, Rickettsia rickettsii
MLRTSSRSFKNKFRAAFWPVHNYELGKFIPMSTLMFCILFNQNVLRILKDSILISEISAEIAGFAKVYCVTPAAALFVIIYAKMINYLTFEKIFYYLSAFFISFFVLFTFVIYPNIHIFHVHPDNLADWMERYPHFKWYISLVGNWGYIVYYSLAELWPNIFYVLLFWQFANELTTTEEAKRFYTLFSLFGNSSLILVGFLMMNLSSEDTIIKKFMSISDSKITLVQVSTTIVAIVAIICCLLVRFISKNVFTNPLFYAKAKSGRSTSERMGLIKSFKYIAKSKYLWLLLICSAAFGFAINLVEAVWKAKIKELYPTVNTYAEFNSLYILWTGVAIMVMTIIGNNIMRMHNWFVAAVISPVIIMVTGILFFVLIVFDQQILSLFDGAILMSPLALAVSIGGIQNILAKGTKYSIWDTSREMLYIPLDEELKTKGKAAVDVISAKVGKSSSGLVQSIIFTLVPTATFTLISPILMLVFTFVCLAWIYAVRKIYFEYQKIA

SEQ ID NO: 93564 - protein, 528 aa, Pseudomonas putida
MASVHGTTYELLRRQGIDTVFGNPGANELPFLKDFPEDFRYILALQEACVVGIADGYAQASRKPAFINLHSAAGTGNAMGALSNAWNSHSPLIVTAGQQTRAMIGVEALLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHQYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYFCAAGGLGFALPAAIGVQLAEPERQVIAVIGDGSANYSISALWTAAQYNIPTIFVIMNNGTYGALRWFAGVLEAENVPGLDVPGIDFRALAKGYGVQALKADNLEQLKGSLQEALSAKGPVLIEVSTVSPVK

SEQ ID NO: 93565 - protein, 418 aa, Bordetella parapertussis 12822
MSYQHIKVPTGGQKITVNADYSLNVPDQVIIPVIEGDGTGADITPVMIKVVDAAVQKAYAGKRKIHWMEVYAGEKATKVYGPDVWLPEETLDAVKDYVVSIKGPLTTPVGGGIRSLNVALRQQLDLYVCLRPVRYFKGVPSPVREPEKTDMVIFRENSEDIYAGIEYMAESEQAKDLIQYLQTKLGATKIRFPNTSSIGIKPVSREGTERLVRKALQYAIDNDRASVTLVHKGNIMKFTEGGFRDWGYALAQNEFGAQPIDGGPWCKFKNPKTGREIIVKDSIADAFLQQILLRPAEYDVIATLNLNGDYISDALAAQVGGIGIAPGANLSDSVAMFEATHGTAPKYAGKDYVNPGSEILSAEMMLRHMGWTEAADLIIASMEKSILSKKVTYDFARLLEGATQVSCSGFGQVMIDNM

SEQ ID NO: 93566 - protein, 314 aa, Streptococcus agalactiae 2603V/R
MDGKSISVKSYANIAIIKYWGKADAEKMIPATSSISLTLENMYTETRLTALGKDAKKDEFYISGVLQNDHEHDKMSAILDRFRQNRSGFVKIETTNNMPTAAGLSSSSSGLSALVKACNDFFGTNLSQSQLAQEAKFASGSSSRSFFGPVAAWDKDSGDIYKVHTNLDLAMIMLVLNDKRKPISSREGMKICTETSTTFNEWVRQSEQDYQDMLVYLKNNDFQKVGQLTERNALAMHSTTKTATPAFSYLTEETYKAMDVVKKLREKGHECYYTMDAGPNVKVLCLRQDLEALAAILEKDYRIIVSTTKELADG

SEQ ID NO: 93567 - protein, 498 aa, Rickettsia montanensis
MLSTSPSFKNKFRAALWPVHNYELGKFIPMSTLMFCILFNQNVLRILKDSILISEISAEIAGFAKVYCVTPAAALFVVIYATMINYLTFEKIFYYLSAFFISCFVLFTFVIYPNIHIFHVHPDNLADWMKRYPHFKWYISLVGNWGYIVYYSLAELWPNIFYVLLFWQFANELTTTEEAKRFYTLFSLFGNSSLILVGFLMMNLSSEDTIIKKFMSISDSKITLVQVSTTIVAIVAIICCLLVRFISKNVFTNPLFYAKAKSGRSTSERMGLIKSFKYIAKSKYLWLLLICSAAFGFAINLVEAVWKAKIKELYPTVNTYAEFNSLYILWTGVAIMVMTIIGNNVMRMHNWFVAAVISPVIIMVTGILFFVLIVFDQQILSLFDGAILMSPLALAVSIGGIQNILAKGTKYSIWDTSREMLYIPLDEELKTKGKAAVDVISAKVGKSSSGLVQSIIFTLVPTATFTSISPILMMVFTFVCLAWIYAVRKIYFEYQKIA

SEQ ID NO: 93568 - protein, 175 aa, Phillyrea latifolia
ACDDACSICPEAFFETDPSTMTSCKHEFHLQCILEWCQRSSQCPMCWQSVSLKDPSSQELLDAVEHERNIRMNPPRNTAIFHHPALRDFELQLLAVSAGDSELEERIIQHLAAAAAMGRARQLARREGERSGSSTRTHPRFLVFSSNPNPTSATSPALSPAQRGGPGPFHAAMIA

SEQ ID NO: 93569 - protein, 449 aa, Candida albicans SC5314
MVDRKRTAAIRAEDDDEENDNVPLQKKVKIEAKQKEEEEDGDKSGATETKSEVKQESKEETTQKENNEEDEEEEEEEDDEEAEEEKKRITNFNFDGEIYTFKERPSVIEEKEGKIEFRVVNNDNSRENLIVLTGLKNIFQKQLPKMPREYISRLVYDRSHLSMAVVRKPLTVVGGITYRPFNNRGFAEIVFCAISSTEQVRGYGAHLMNHLKDYVRATSPIKYFLTYADNYAIGYFKKQGFTKEISLDKSVWMGYIKDYEGGTLMQCSMLPSILRYLDSGKILLLQKAAIERKIRSRSKSKIVRPGLQVFKTNKNVTLDPKDIPGLAEAGWSEEMDKLAQKPKRGPHYNFMVTLFSEIQNHPSAWPFAVAVNKEEVPDYYRVIEHPIDLATIEQKLENNLYLKFTDFVDDLKLMFNNCRAYNSETTTYYKNANKLEKFMNNKLKDCSFV

SEQ ID NO: 93570 - protein, 560 aa, Triticum aestivum
  misc_feature (64)..(64): Xaa can be any naturally occurring amino acid
MDFDCNKAGESSAKHCSSICNEGTLIQANTLIHCGKAKKWNSLNKLNNPESSHGSLPRVNDPRXDGETGNDATASECSIMCFTDLPSALVCEVLARLDPKGLGVVSCVSTVLQTLATDHQGWKKFYCERWGLPNAPIGPLVPGGTPDGRSWKALFVDREFQSRSFMGRFSVDVLRGHNEDVRTVYLLASANLIFTGGHDSVVRMWNMEEGLLIDESRPFGCTIRAIAADSRLLVTGGSKAFIQCWRAIEGASHLFHISGNGTNQNSEFRLWGHEGPVTCLSLDSTRIYSGSWDMTVRVWDRAEMKCVQKFMHADWVLALAPHGNTVASTAGRDAYVWDIGNGELTTIISNAHVGNAYSVARTHLAGVLFTGGEDGAIRLFDVSEISDDENIKPAATWLPHSGPVHSLAFEYPWLVSASSDGRIALIDLRKILTPLNSSKRRFRVKPFDPSTVEPPQRMLHGFGCYLFSVGIGADRIICGGEDGSVRVWNFSEALEIEKKAQALRSLRQENRMRRRKAQVEMNANGRRVDHCSVAMKRNPLKGDKSVTWQIKRPISDKVKS

SEQ ID NO: 93571 - protein, 352 aa, Bacillus cereus ATCC 14579
MYKGLLKQYASYLPVNENTPDVSLMEGNTPLIPLLNISKQLGIQLYGKYEGANPTGSFKDRGMVMAVAKAKEEGSEAIICASTGNTSASAAAYAARLGMKCIIVIPEGKIAHGKLAQAVAYGAEIISIEGNFDDALKAVRNIAAEEPITLVNSVNPYRIEGQKTAAFEICDQLQNAPDVLAIPVGNAGNITAYWKGFCEYEKEKGYKKPRIHGFEAEGAAAIVKGHVIEEPETIATAIRIGNPASWSYAVEAAEQSCGEIDMVSDEEILHAYRLLAKTEGVFAEPGSNASLAGVIKHVKSGKIKKGETVVAVLTGNGLKDPDIAISSNQLDIASLSNDIEQIKDHIKGVIMS

SEQ ID NO: 93572 - protein, 228 aa, Staphylococcus aureus subsp. aureus MRSA252
MPKLILCRHGQSEWNAKNLFTGWEDVNLSEQGINEATRAGEKVRENNIDIDVAFTSLLTRALDTTHYILTESKQQWIPVYKSWRLNERHYGGLQGLNKDDARKEFGEEQVHIWRRSYDVKPPAETEEQREAYLADRRYNHLDKRMMPYSESLKDTLVRVIPFWTDHISQYLLDGQTVLVSAHGNSIRALIKYLEDVSDEDIINYEIKTGAPLVYELTDDLEVIDKYYL

SEQ ID NO: 93573 - protein, 410 aa, Oryza sativa Japonica Group
MDRASENRRLAAVGKPVPGIGEMGNRRPLRDINNLVGAPPHPSAIAKKPMLEKSGKEEQKPALVVSHRPMTRNFAASLTRKEQLDHQVSVADAAVVCTDPQKNPIPDGTVDDDVESCESNDYIAVDECNDTDEDESMMDIDSADSGNPLAATEYVEELYKFYRENEEMSCVQPDYMSSQGDINEKMRAILIDWLIEVHHKFELMDETLFLTVNIVDRFLEKQVVPRKKLQLVGVTAMLLACKYEEVAVPVVEDLVLISDRAYTKGQILEMEKLILNTLQFNMSVPTPYVFMRRFLKAAQSDKQLSLVEYQMLKYRPSLLAAAAVYTAQCALTRCQQWTKTCELHSRYTGEQLLECSRMMVDFHQKAGAGKLTGVHRKYSTFKFGCAAKTEPALFLLESGAGGYNLQKQPC

SEQ ID NO: 93574 - protein, 871 aa, Candida albicans SC5314
MNTFSSPPNVIREYNDSTYQSPLNSQFHQSPFLQTQSPDYVSLREEEDDNNDKNLDIMSSCIVDSVIYKSQKIAGPLLSQISNLNIQQALIIRELLFTLLGHEGHYIQYSKRYDPTSQISRIEGPDYKIAKNLDISLKVITKKLVKFGKFYSGLKSFIQVFDNNKFGKIVQKFCSEVRKFLSSYQQVLINVEHEFKFNKNFNLNMLDSLLHQEISNEMTHLYQIGIEISRITEERQKMSQAEIMGNFEPTTLANTSMNGINSEPNLYYGKFDCCKGGLLLQVIQERMVYYKGDPTSLDFLTQLFDIVSSDYIGMLNQWLLEGVINDPFDEFMIREKRVPDSFMEIFQSKSEYYWNELFLIKIDGLLNQFQNSTIQSKILNTGKYLNIFKRCTGLHNFESLKEKLTTITSLAAPDLELKIDEFYHRANKMLMKLLFDGYNFPSVVNIFQRLFLFADSFQIDNFIDSTFSELKRGKLKISVSRLQKQYDDIFKEKIENKVGVRPSVYDVLKKNQKLSVTSESLYKVVEELMEKNSDYLISDNNLRGIFHRVASLRDDSRLTISSTADSATENVKDEPTITSVDLTIPLPFPLNLVLNQQLSYQYEIMFKLLINIKFISKYNSSNWQEMNYSKIWTNSHFNSSVKKWILRCRVLHSRICSFIHELENYIVHDVIEHNFEEIKNLIHTTATNLATSELGSDINDEGDNIFNGSLIRGTFNNNSIFDSKVHKHRTTTYVEGISTVEQLIQKFLDYSSTLLNDSLLTREESLRQLRKMLDFIFHFNNYIVQVKKVLVLLNHELFNEYSKEFPTKFEKPMDQESIDKRFANLSDTFLMQYEKFGENLVTFLATIKQVGERENQGLLELSNRLELCFPE

SEQ ID NO: 93575 - protein, 223 aa, Arabidopsis thaliana
MEILPIPAESFKVGFIGAGKMAESIARGVVASGVLPPNRICTAVHSNLNRRDVFESFGVNVFSTSEEVVKESDVVIFSVKPQVVKKAVTELKSKLSKNKILVSVAAGIKLNDLQEWSGQDRFIRVMPNTPAAVGEAASVMSLGTGATEEDGAIVAMLFGAVGKILKADEKMFDAVTGLSGSGPAYIFLAIEALADGGVAAGLPRELALSLASQTVSSWSCNDG

SEQ ID NO: 93576 - protein, 221 aa, Herminiimonas arsenicoxydans
MPSYRIAPSILSADFARLGEEVRNVVAAGADIIHFDVMDNHYVPNLTIGPLVCEAIRPHVQVPIDVHLMVKPVDRIVPDFAKAGANIITFHPEASEHVDRTLQLIRDNGCKAGLVFNPATPLHYLEHVMDKLDIILLMSVNPGFGGQSFIPHTLKKIAAVRKLIDESGRDIMLEVDGGIKVDNIEAAARAGADTFVAGSAIFGKPDYKAVIDAMRNELAKV

SEQ ID NO: 93577 - protein, 73 aa, Cucumis melo
LPVPPVIGNPSPGAKKPCPPSGKETCPIDTLKLGGCVDLLGGLVHIGIGDPAANACCPIISGLAELEAAVCLC

SEQ ID NO: 93578 - protein, 294 aa, Glycine max
MEQYEKVEKIGEGTYGVVYKGRDRVTNETIALKKIRLEQEDEGVPSTAIREISLLKEMQHRNIVRLQDVVHDEKSLYLVFEYLDLDLKKHMDSSPEFAKDPRQVKMFLYQILCGIAYCHSHRVLHRDLKPQNLLIDRSTNALKLADFGLARAFGIPVRTFTHEVVTLWYRAPEILLGSRQYSTPVDIWSVGCIFAEMVNQRPLFPGDSEIDELFKIFRIMGTPNEDTWPGVTSLPDFKSAFPKWQPKDLKNVVPNLEPAGLDLLSSMLYLDPSKRITARSALEHEYFKDIKFVP

SEQ ID NO: 93579 - protein, 165 aa, Aegilops speltoides
VMASSATTVAPFQGLKSTAGLPVGRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNLRQVQCVSFIAFRPPGCE

SEQ ID NO: 93580 - protein, 695 aa, Nocardia farcinica IFM 10152
MVESAPSTVYIASPEGDTGKSTVALGVLQMLCATTARVGVFRPIARSTTEPDYILELLLEHSTADLDYAQSIGVTYEQVHADPDAAISEIVMRFHEVADACDAVVVIGSDYTDVASPSELRFNARIAVNLGAPVLLVVRGSGRTPVEVKQLVELCMSELHAEHAAAVAVIANRCDPDQLDDVCSVLGAFDVPSWALPEVPLLIAPTMAELCEAVGGEMYSGDPELLQREALKIMVGGMTAEHILERLVDGVVVIAPGDRSDVLLSVVNAHEAEGFPSLSGIIMNGGMRPHPAVARLMAGLKPRLPILTTDLGTYDTASAAYRTRGRMSAGNPRKVNTALALMEQHVDAPELLSRIRVRRSDVVTPQMFEYQLIERARADRKRIVLPEGDDDRILRAAGRVLQRKIADLVILGDETAIRARAAELGVDIAEAEVLDPRTSGHLESFAATYTELRKHKGMTLERARETVADISYFGTMMVYEGIADGMVSGAAHTTAHTIRPSFEIIKTVPGVQTVSSVFLMCLADRVLAYGDCAVVPDPTSEQLADIAISSARTAQRFGIDPRVAMLSYSTGESGSGADVEKVRVATDLVRERAPELLVEGPIQYDAAIEPTVADAKLPDSEVAGRATVFVFPDLNTGNNTYKAVQRSAGAIAIGPVLQGLRKPVNDLSRGALVADIVNTVAITAIQAQGIAEQEG

SEQ ID NO: 93581 - protein, 165 aa, Aegilops sharonensis
VMASSATTVAPFQGLKSTAGLPVSRRSSASLGSVSNGGRIRYMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCE

SEQ ID NO: 93582 - protein, 152 aa, Triticum aestivum
  misc_feature (75)..(75): Xaa can be any naturally occurring amino acid
  misc_feature (85)..(85): Xaa can be any naturally occurring amino acid
  misc_feature (112)..(113): Xaa can be any naturally occurring amino acid
  misc_feature (125)..(125): Xaa can be any naturally occurring amino acid
  misc_feature (127)..(127): Xaa can be any naturally occurring amino acid
  misc_feature (135)..(135): Xaa can be any naturally occurring amino acid
MPDWKAGEFEGKFKDEFARGNSNLQEDGAGPLNISNKKLKHGITTEENPQGVVSTATNSDSRKLNSDHIYSTCGXASDHVRDCKXESSAFPLSRDDTTSGQDPNRKLNNGQXXPSNGSTGLTSQXSXGGSQYGDXGLNLMDGLHWKFGCGTY

SEQ ID NO: 93583 - protein, 164 aa, Aegilops bicornis
VMASSATSVAPFQGLKSTGGLPVSRRSRGSLGSVSNGGRIRCMQVWPIEGIKKFETLSYLPPLSTEALLKQVDYLIRSKWVPCLEFSKVGFVFREHNSSPGYYDSRYWTMWKLPMFGCTDATQVLNEVEEVKKEYPDAYVRVIGFDNLRQVQCVSFIAFRPPGC

SEQ ID NO: 93584 - protein, 334 aa, Mannheimia succiniciproducens MBEL55E
MPFNLKNRHLLSLVNHSPREIKYLLDLARDLKRAKYAGTEQPRLKGKNIALIFEKTSTRTRCSFEIAAYDQGANVTYIDPTSSQIGHKESMKDTARVLGRLYDAIEYRGYKQETVEELAKFSGVPVFNGLTDEFHPTQMLADVLTMIEHSTKPLNEIKYVYIGDARNNMGNSLLLIGAKLGMDVRICGPKSLLPEENFVSICEEISKETGARLTVTDDIDLAVKDADFVHTDVWVSMGEPIEAWGERINLLMPYQVNTDLMKRTGNPNVKFMHCLPAFHNCETKVGREIAAAYPNLANGIEVTEDVFESPMNIAFEQAENRMHTIKAVMVASLA

SEQ ID NO: 93585 - protein, 418 aa, Cryptococcus neoformans var. neoformans JEC21
MLAYLHAAGMHNAYAALQHDAALADVDPRDRAVGLLEKKWTSVIRLQKKVIDLENRNAALLAELAAAARPAAPGPFLPRPPPRHTLASHRAPVTRLAFHPTWTLLASASEDATVKLWDWEAGDMERTLKGHTKAVMDVDFDPRGGLMATCSSDLTLKLWDTANQYTNVKTLHGHDHSVSSVRFMPDGETLVSASRDKTIRVWQVSSGYCIKTFSGHAEWVREAVPSEDGRWLVSASNDQTSRIWDFSTGETKMELRGHEHVVECAVFAPVNAYPAIRELAGLKPPAPRDTRAKSPGVYAATGSRDKTIKLWDALSGQCLRTLVGHDNWIRALVFHPSGKYLLSASDDKTIKVWDLANGRCTKTIEAHSHFVTSMTWGRAVGASGGIEKVNGDASSKEPRRINVLATGSVDQTIKVWTP

SEQ ID NO: 93586 - protein, 525 aa, Pseudomonas fluorescens PfO-1
MALDIHAHRILILDFGSQYTQLIARRVREIGVYCELHPFDMDEDAIREFAPKGVILAGGPESVHEANSPRCPQAVFDLGVPVFGICYGMQTMAEQLGGKVEGSELREFGYARVDVVGKSRLLDGIEDHIDADGLFGLDVWMSHGDKVTKMPSDFHILASTPSCPIAGMFNDERAYYGVQFHPEVTHTKQGGRILSRFVLDICGCEALWTPSKIAEDAIANIRAQVGTDNVLLGLSGGVDSSVVAALLHKAIGDQLTCVFVDNGLLRLHEGEQVMAMFAENMGVKVIRANAEDQFLNNLAGEADPEKKRKIIGRTFIDVFDAESCKLDNIKYLAQGTIYPDVIESAGAKSGKAHVIKSHHNVGGLPEEMNLKLVEPLRELFKDEVRRLGLELGLPYDMVYRHPFPGPGLGVRILGEVKKEYADLLRRADHIFIEELRKADWYHKVSQAFVVFQPVKSVGVVGDGRRYAWVVALRAVETIDFMTARWAHLPYELLETVSGRIINEIEGISRVTYDVSSKPPATIEWE

SEQ ID NO: 93587 - protein, 449 aa, Streptococcus agalactiae 2603V/R
MTSGKTYVASVLEKVKKQNEHEEEFLQAVEEVFESLVPVFDKYPQYIEENLLERLVEPERVISFRVPWVDDKGQVQVNRGYRVQFSSAIGPYKGGLRFHPTVTQSIVKFLGFEQIFKNSLTGLPIGGGKGGSNFDPKGKSDNEVMRFTQSFMTELQKYIGPDLDVPAGDIGVGGREIGYLYGQYKRLNGYQNGVLTGKGLTYGGSLARTEATGYGAVYFAKEMLAARGQDLTGKVALVSGSGNVAIYATEKLQELGATVVAVSDSSGYVYDPDGIDLETLKQIKEVERARIVKYTEKHPKANFTPADQGSIWSIKADLAFPCATQNELDEEDAKLLVENGVLAVTEGANMPSTLGAIKVFQKAGVAFGPAKAANAGGVAVSALEMAQNSSRRAWTFEEVDQELQRIMKTIFVNASEAADEFGDSGNLVLGANIAGFLKVAQAMSAQGIV

SEQ ID NO: 93588 - protein, 120 aa, Candida albicans SC5314
MATMDIIKLYGGEPANFLDCGGTATPETIEKAFELILSDPKVNGIFVNIFGGIVRCDYVAKGLIAATKNFNLDIPVVVRLQGTNMAEAKELIDNSGLKLYAFEDLDPAAEKIVQLAPKNN

SEQ ID NO: 93589 - protein, 498 aa, Geobacillus kaustophilus HTA426
MTMISAQTTEADLWIDGEWRPAASGERFDVIDPATGEVTARVANAGEDDVDAAVAIAEEAFSDRRWLAISPLERGRILRRIAELIRQHHCELAQLMTRENGMPINLALFIEIPLAADCFDFFASLVVKPQGEVLPFSVAGSAPDYMAWTMKEPIGVAGLITPWNFPLLMPTWKIAPALAAGCTMVVKPAPETPLTALKLAEICHEAGVPEGVINVLPGLDEAGKALVRHPRVPKIAFTGETETGRHILQAAAPHIKRVTLELGGKSPNIIFADADLEQAAKSALFGVFYNSGQVCQAGSRILVERTVYEPFVERLAERAKKLKVGPGTNPRSDLGPVISREQYEKVLRYIEIGKQEGARLAAGGRALDGGGGGYFIEPTVFADVSPSMRIACEEIFGPVAAVIPFADEEEAVRIANGTMYGLAAAVWTNDIKRALRLARRVKSGTVWLNTYQVLSPTAPFGGYKQSGLGRELGMQALDAYLETKTVICDLNDRPMTLF

SEQ ID NO: 93590 - protein, 498 aa, Yarrowia lipolytica CLIB122
MVRLTRTKVTKKPATTKAVSKKQSAKTAKVNGVKAAAAKQELEKKTVKEEKPIPAAKAPSRLRLSAIQRKHKHSPTLLPLPSINKVDCEVFAFGTGDMCELGLGPEKASTVKRPRLSPYLSKEIVDIAVGGQHGLVLDSQGRVWSWGGNDLGALGRDTSGHEVLKDMDADESDDEDDPKLNPAESIPALVDTDQRFVKIEASDSLSLALTAEGDVWAWGSFRNSQGTMGFSDKVKVQNRPVKIEELSNIAAIAAGRDHVLALTQWGTVHTWGDSENFRLGWKSNRSTLSPRELGLKNIVYVGAGEFHSFAIDTDGKVLAWGLNQYGQCGILGQSDNAAVDGPTYVDALDGKDIVAVTGGEHHSLALSKDGTVYSFGRYDYHQIGFTTKDLPEGTVRDDKGNPRFLPVPSPLSLGGEDDDEKLPKMRFIACGAHHSLIIDVDGRVWTWGFSSSFQTGHAEEDDVETPRKIMNTAIKPIDVKMAGGGGQFSVVAGVRKEE

SEQ ID NO: 93591 - protein, 368 aa, Geobacillus kaustophilus HTA426
MAKAAVLHRYGEPLSIEELDLASPKRGEVKVKMKAAGLCHSDWHVVQGQLPLPLPIVLGHEGAGIVEEVGEGVTSVKQGDHVVLNWVPSCGTCSYCRTGRPDLCEEAARLMATGTLPDGTTRFSLHGKPVYQFLTAGAFSEYTIVPEQAAIPIRRDVPFELAALISCSVMTGVGAAIHTAQVRPGSTVAVIGAGGVGFNIIQGAALAGAKQIIAVDIVEEKLAMTKTFGATHTVNAREDDAVSAVLDLTDGIGVDYAFEAIGRPETMADAYNMTRKAGTTVIVGIAAPHEAVEINAFSLPSQSKALTGSWLGQGNPPIDYPKLLDLYAAGKLKLEPLISAVYSLDQINDGFAALKSGQNIRGIIRFEE

SEQ ID NO: 93592 - protein, 622 aa, Streptococcus agalactiae 2603V/R
MSDFLVDGLTKSVGDKTVFSNVSFIIHSLDRIGIIGVNGTGKTTLLDVISGELGFDGDRSPFSSANDYKIAYLKQEPDFDDSQTILDTVLSSDLREMALIKEYELLLNHYEESKQSRLEKVMAEMDSLDAWSIESEVKTVLSKLGITDLQLSVGELSGGLRRRVQLAQVLLNDADLLLLDEPTNHLDIDTIAWLTNFLKNSKKTVLFITHDRYFLDNVATRIFELDKAQITEYQGNYQDYVRLRAEQDERDAASLHKKKQLYKQELAWMRTQPQARATKQQARINRFQNLKNDLHQTSDTSDLEMTFETSRIGKKVINFENVSFSYPDKSILKDFNLLIQNKDRIGIVGDNGVGKSTLLNLIVQDLQPDSGNVSIGETIRVGYFSQQLHNMDGSKRVINYLQEVADEVKTSVGTTSVTELLEQFLFPRSTHGTQIAKLSGGEKKRLYLLKILIEKPNVLLLDEPTNDLDIATLTVLENFLQGFGGPVITVSHDRYFLDKVANKIIAFEDNDIREFFGNYTDYLDEKAFNEQNNEVISKKESTKTSREKQSRKRMSYFEKQEWATIEDDIMILENTITRIENDMQTCGSDFTRLSDLQKELDAKNEALLEKYDRYEYLSELDT

SEQ ID NO: 93593 - protein, 311 aa, Robiginitalea biformata HTCC2501
MERDNVDVVAINDLLDVEHLAYLLEYDSVHGRFNGTIAVKDGNLVVNGKTIRVTAERDPANLKWDEVGADIVAECTGIFTTLDMAQKHLDGGAKKVVISAPSKDAPMFVMGVNHQDAKASDKIVSNASCTTNCLAPIAKVLNDSFGIAEGLMTTVHATTATQLTVDGPSKKDYRGGRSAMLNIIPAATGAAKAVTKVIPALEGKLTGMAFRVPTADVSVVDLTVKLEKDTSYEEVKQAMKTASEGPLKGILGYTEELVVSQDFVGDTRTSIFDADAGIELNSKFFKVVSWYDNEAGYSNKLVDLALHVHNL

SEQ ID NO: 93594 - protein, 452 aa, Staphylococcus aureus subsp. aureus MRSA252
MNYTQQLKQKDSEYVWHPFTQMGVYSKEEAIIIEKGKGSYLYDTNGNKYLDGYASLWVNVHGHNNKYLNKVIKKQLNKIAHSTLLGSSNIPSIELAEKLIEITPSNLRKVFYSDTGSASVEIAIKMAYQYWKNIDREKYAKKNKFITLNHGYHGDTIGAVSVGGIKTFHKIFKDLIFENIQVESPSFYRSNYDTENEMMTAILTNIEQILIERNDEIAGFILEPLIQGATGLFVHPKGFLKEVEKLCKKYDVLLICDEVAVGFGRTGKMFACNHEDVQPDIMCLGKAITGGYLPLAATLTSQKIYNAFLSDSHGVNTFFHGHTYTGNQIVCTVALENIRLYEKCKLLSQIETTSSTLEKQLHALKRHRNVGDVRGRGLMFGVELVTDKDSKTPLEIEKVERIVRNCKENGLMIRNLENVITFVPVLSMSNKEVKTMVRIFKKAVHNILDRKC

SEQ ID NO: 93595 - protein, 75 aa, Triticum turgidum subsp. dicoccoides
QGRNEFVIRLQPSEAMYMKLTVKKPGLEMATEQSELDLSYGMRYQDVKIPEAYERLILDTIRGDQQHFVRRDELK

SEQ ID NO: 93596 - protein, 358 aa, Desulfovibrio desulfuricans G20
MEMRICLLAGDGIGPEIMEQGVRVLETVAGKFGHDMEFTDALIGGAAIDETGDPLPQETVEACKAAQAVLLGAVGGPRWDNLTGAERPEAGLLGIRKALGLFANLRPAKLFPELASACFLRPDIVANGIDVMVVRELTGGIYFGTPAGEETRDGLRTAFNTMVYNEEEVRRIARVAFEAARKRSGRVCSVDKANVLAVSRLWREIVTATHADEFPDVELSHMYVDNAAMQLVRDPSQFDVIVTGNLFGDILSDEASVITGSIGMLPSASLGAGGPGLFEPIHGSAPDIAGQNKANPLATILSTAMMLRHSFGLEKEAEAVEGAVQQVLKAGYRTGDIMDQGGTLVGCNTMGNLVNERI

SEQ ID NO: 93597 - protein, 947 aa, Pneumocystis carinii
MILKILLTLTLYWIYLVRVRCETVPVDFENNDYYYYFHLLEDVDIEEFSRAIGFKYHMKVEYLDNHHIFFIEKGVLEDEIKEKIENYFGLEKGRNAIDGFNSDKLFYYEKQKLVKQENRGAIRDDIYFDNQDLYNDEVVNNVEVVNNVVKDPTGDDQAGKSTEDQVENSTEDQAGKSTGDLPGNPPVNLTQKLEEIKKQLNISDPWIRGKNVTVAIADNGIDYCNQDLAPNYNANASYNFDAGNSDPKPEKLDESHGTKCAGEVAAAKNTLCGLGVAYESKISGIRFLTSYLALVLEKDAVSYKPDLNHIYSCSWGPPDNGELAMPMMPTTYSAVIKGIKEGRNGLGSIYVFGSGNGGLLDDCNYDGYANSPYTVTIGAIDSEDKNFYFSESCPCILASTYSGGENESIYTTDIGKTNCTTEHSGTSASTAIAAGIIALVLSVNPNLTWHDIQALIVETAVPFNLKYPGWGELPSKRYYNNYFGYGKLDAYRMVERARTFKTLNAQTMFSTQLIRINMQFPGTTKHITSSFYIHSGYPEYYNFKNLEYVGVSFHYQHQRKGRLEFSITSPANVTSKLARVRIRDKEGGTFSWVFTTVKHWGESIVGNWTIDVEDKNMWNEQSSIFSWQLHFFGESINSSKAQPPPYPFAHKQPTTAPPPDPGATPPPDLDANPQPQPDPGSPPSSDPESPPSSEPGYQPPSKPGPQPPSEPQPPSKPDLNPPSDPSSQQDPDTSLSSNPTSTSSSEPSPPSPPPAPAPAPPAPPPPPAPAPAPPAPPPPPAPAPAPPAPPPPPAPAPAPPAPPPPPAPAPAPAPPPPPPPPPPRPELEPEPEPEPEPEPEPQPPQPQPEPPVPPPKPQPPPPPPEQKPTSITSSTSTTSSSKTKISTTRKASSTKTSSTTKTSARPSPTEGTFTGSSASHLSFFEKRHLLLQMILLLFFFLFLGYSF

SEQ ID NO: 93598 - protein, 522 aa, Zea mays
MDAPGASTTTLLLYGALLLVGFLFIAVARRRGRGSNAGLPPGPTGLPLLGSLPSLDPQLHVYFARLAARYGPIFSIRLGSKLGVVVTSPELAREVLREQDLVFSGRDVPDAARSISYGGGQNIVWNPVGPTWRLLRRVCVREMLGPAGLDNVQGLRAREFGATLAHLHAQARAAAPVDVGAQMFLTVMNVITGTLWGGNVGSEGERVALGREFRHLVAEITDMLGAPNVSDFFPALARFDLQGIRKKSDALKERFNQMFARIIEQRVHAERAGGEPPAPDFLEYMLKLEKEGGDGKASFTMTNVKALLMDMVVGGTETTSNTVEWAMAELMQKPELLAKVRQELDAVVGRDAVVEESHLPQLPYLHAVVKETLRLHPALPLMVPHCPSADATVGGYRVPAGCRVFVNVWAIMRDPAVWKDPRDFVPERFLDGAGEGRKWDFTGSEMEYLPFGSGRRICAGVAMAQRMTAYSLAMLLQAFDWELPAGARLELDEKFAIVMKKATPLVAVPTPRLSKPELYYSA

SEQ ID NO: 93599 - protein, 902 aa, Pneumocystis carinii
MTLKILFTLTLYWIYLVRVRCERKPVDFENNDYYHFHFSEDVDIEDFSRALGFKHYMKLEYLDNQHIFSIEKSVLEDEIKEKIENYFGLEKGRNAIDGFNSDKLFHYEKQKLVKREKRNVIKDDIYFDNQDLYNDEVVNNVVKDPMGDQAENQKGDQAEKPTVNPPVNLTEKLEEIKKQLNISDPFQYEKPWYRYKCYRCMVTRFDICVVDCLLMILGITGKNVTVAIVDNGLDYTNKDLAPNYNANASYDFASNDPDPKPDDPDESHGTKCAGEVAAARNTLCGLGVAYESNISGIRFLTSVFALFLEAEALSYKPNVNHIYSCSWGPPEYGSLAMPMMPTTYSAIIKGVKEGRNGLGSIYVFGTGNGGLLDDCNYDGYANSPYTITIGAINSEDERPYFSESCPCILASTYSGGGNGSIYTTDIGKTNCTTQHSGSSASTAIAAGIIALVLSANPNLTWRDVQALIVETAVPFRLDYHEWEQLPSKRYYHNNFGYGKLDAYRMVERAKTFKTLNPQTTFSTQLVIVNRKIPNPSRHIRSSFYIHSGYPEYYNFKNLEYVGVSFYYKHKKRGFLEFSITSPANVTSKLTRVRFRDTESGTFFWTFTTVKHWGESIVGYWTIDVKDRNSWDEESHIFLWQLHFFGESINSSKPQPHPQYPFKHILPTTAPPPDPTTAPPPNPITTPPPSSDPGSQPPSKPGPQPPSDPQPPSDLKPPSKPDARPRPPSDPSSQQDPDTSLSSNPTSTSSSEPPPPSPPPPPPPPPAPAPAPAPPRPELEPEPEPGPEPVPQPPQPQPPQPQPEPPAPPPKPQPPPPSPPEQKPTSITSSTSTTSSSKTKISTTRKASSTKASSTTKTSTRPSPTEGTFTGSSASHLSFFEKRHLLLQMILLLFFFLFLGYSF

SEQ ID NO: 93600 - protein, 169 aa, Glycine max
MASPTLITPKSVKSLSPIKPKATTTTTTIAATLTPSTTTHPRRRELLSIITTTWLLPLSPALASSDEEYVKETEEVINKVRTTIVMDKNDPNVATAVAELRETSNSWVAKYRREKALLGRASFRDIYSALNAVSGHYISFGPTAPIPAKRRARILEEVDTAEKALLRGR

SEQ ID NO: 93601 - protein, 473 aa, Methylococcus capsulatus str. Bath
MPSPDRGPQELRRVLGWTSAGAIMAGSVIGTAIFLVPSTIVRELDSVGWTFFVWVLGGLLSLGGALSYAELGAAFPEAGGEYAFLRRAYGPLWGFLFGWQQVVIGKTGSIATIATGFALFLGFFVDGLQREWLHLSWGEVGWGVTGLQFVAMTAVASFSLINCFGVGRGGAVQSFLTVLKVAAIVALAVLVLGAGGGSWDHFRQAPEHPAWTGWGAFAAALAAVLWAYDGWNNLTLVGSEIRDPDRTIPRVFLLGLLGVMGVYLLANLAYFYALPPEALKRSERVAQDVAQLVFGDFGGAAITAAAVVSTLAALNGSILSGARVSYAMARDGLFFSPLARLHPVHRTPVNALIVQASFASFLILLFGQDRAGFDRLFNYAVFGLWAFYGITALAVIVLRRTSPEVVRPYRVAGYPWVPLIFFAVAGLFCLGMIFQNPSETAIGLVFLLLGIPFYLYWCSGGKAEAHRKSSPGE

SEQ ID NO: 93602 - protein, 165 aa, Aegilops tauschii
VMASSATTVAPFQGLKSTAGLPVSRRSSGSLGSVSNGGRIRCMQVWPIEGIKKFETLSYLPPLSTEALLKQVDYLIRSKWVPCLEFSKVGIVFREHNSSPGYYDGRYWTMWKLPMFGCTDATQVLNEVEEVKKEYPDAYVRVIGFDNLRQVQCVSFIAFRPPGCE

SEQ ID NO: 93603 - protein, 165 aa, Triticum urartu
VMASSATTVAPFQGLKSTAGLPVSRRSSGSLGSVSNGGRIRCMQVWPIEGIKKFETLSYLPPLSTEALLKQVDYLIRSKWVPCLEFSKVGFVFREHYSSPGYYDGRYWTMWKLPMFGCTDATQVLNEVEEVKKEYPDAYVRVIGFDNLRQVQCVSFIAFRPPGCE

SEQ ID NO: 93604 - protein, 511 aa, Arabidopsis thaliana
MDIISGQPLFLIFCFILSCLLFFTTARSRRSPCQLSKSPPGPPRLPIIGNIHLVGKNPHHSFTDLSKTYGPVMSLKLGCLNSVVIASRDAVREVLKTHDQILSGRYISEATKSNNHHEFSVGWIHPSSSRFRMLRKLSATQLFSPQCIQATKALRMKKVQELVNFLSESCEREEAVDISHVSFVTALNIISNILFSVNLGSYDSKNSSAFQEMVIGYQESIGNPDLANFFPFMRFLDLQGNSKKMRESSGRLLQVFREFYDARIVEKSSRSVEKDVSSKDFLDVLIDLQQGDETEINIDEIEHLLLDMFVAGTDTNSSTVEWAMAELLGNPKTMTKVQDEINHVIGQNGDFQESDISKLPYLKAVVKETFRLHPAAPFLLQRKAETNVEILGFTVLKDSQVLVNVWAIGRDPLVWENPTHFEPERFLGKEIDVKGTDYELTPFGAGRRICPGLPLAMKTVHLMLASLLYTFEWKLPNGVGSEDLDMEETFGLTVHKTNPLLAVPLKKRAIN

SEQ ID NO: 93605 - protein, 165 aa, Triticum turgidum subsp. dicoccoides
VMASSATTVAPFQGLKSTAGLPVGRRSSGSLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAYRPPGCE

SEQ ID NO: 93606 - protein, 165 aa, Triticum aestivum
VMASSATTVAPFQGLKSTAGLPVGRRSSGSLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLIEVEEVKKEYPDAYVRVIGFDNLRQVQCVSFIAFRPPGCE

SEQ ID NO: 93607 - protein, 390 aa, Zea mays; identical to SEQ ID NO: 1378

SEQ ID NO: 93608 - protein, 179 aa, Zea mays
  misc_feature (77)..(77): Xaa can be any naturally occurring amino acid
  misc_feature (178)..(178): Xaa can be any naturally occurring amino acid
MARKFFVGGNWKCNGTAEEVKKIVNTLNEAQVPSQDVVEVVVSPPYVFLPLVKSTLRSDFHVAAQNCWVKKGGAFTXGEVSAEMLVNLDIPWVILGHSERRALLNETNEFVGDKVAYALAQGLSVIACVGETLEQREAGSTMDVVAAQTKAIADRVSNWSKVVIAYEPVWAIGTGKVXS

SEQ ID NO: 93609 - protein, 208 aa, Pseudomonas aeruginosa
QQIVTLTYPHIGNTGTTPEDAEANRVWAAGLIIRDLPLIASNWRSKQSLPDYLKANGTVAIAGIDTRRLTRILREKGSQNGCILAGADATEERALELARAFPGLKGMDLAKEVTTAERYEWRSSVWNLESDSHPEIPAGELPYHVVAYDYGVKLNILRMLVARGCRLTVVPAQTPASEVLALNPDGIFLSNGPGDPEPCDYAIQAIRE

SEQ ID NO: 93610 - protein, 382 aa, Pseudomonas fluorescens PfO-1
MITSKLPNVGITIFTQMSQLAAQTGAINLSQGFPDFDGPQALRDAVGRHIASGHNQYSPMTGLPALRQQIAAKIARSYGANVDADTEVTVTPGATQAIFCAIQAVIRTGDEVIVFDPAYDSYEPAVELAGGRCVHVQLGLKDFSIDFDRLSAALSPRTRMIILNTPHNPSGALISRAELDQLAALIRDRDIYVISDEVYEHLVFDGVPHVSVLAHEELYQRAFVVSSFGKTYHVTGWKTGYVVAPPALTAELRKVHQYVSFCGVTPLQYALADYMAEHPEHVEELPGFYQAKRDLFCDLLAPSRFSFTRVTGTYFQLVDYSQIRPDLNDVEMAMWMTREHGVASIPVSVFYQHPPEGQRLVRLCFAKREETLREAAAKLCVI

SEQ ID NO: 93611 - protein, 429 aa, Synechocystis sp.
MKRVLAIILGGGAGTRLYPLTKLRAKPAVPLAGKYRLIDIPVSNCINSEIVKIYVLTQFNSASLNRHISRAYNFSGFQEGFVEVLAAQQTKDNPDWFQGTADAVRQYLWLFREWDVDEYLILSGDHLYRMDYAQFVKRHRETNADITLSVVPVDDRKAPELGLMKIDAQGRITDFSEKPQGEALRGMQVDTSVLGLSAEKAKLNPYIASMGIYVFKKEVLHNLLEKYEGATDFGKEIIPDSASDHNLQAYLFDDYWEDIGTIEAFYEANLALTKQPSPDFSFYNEKAPIYTRGRYLPPTKMLNSTVTESMIGEGCMIKQCRIHHSVLGIRSRIESDCTIEDTLVMGNDFYESSSERDTLKARGEIAAGIGSGTTIRRAIIDKNARIGKNVMIVNKENVQEANREELGFYIRNGIVVVIKNVTIADGTVI

SEQ ID NO: 93612 - protein, 456 aa, Mycobacterium avium subsp. paratuberculosis K-10
MTKHFDAIIVGAGQAGPPLAGRLTAAGQRVAIIERKLIGGTCVNTGCIPTKTLVASAHAAHLARRGADYGVGTGAVSVDMAKVKARKDEIMLGDRKGVEDWLAGMAGCTVVRGHARFRDPHTLQVGEDLLRAERIFLNVGGRAVVPDIPGLAEVDFLTNVSILELDTLPTHLVIVGGSYIALEFAQMYRRFGAAVTVVERGPRLASREDEDVSAAVQEILRAEGIDIVVNADDVRIAKTGNGFELTPRDGAPPIRGSHLLLAVGRRPNTDDLDLAAAGVRTDARGYILVDDQLKTNVEHIWAMGDCNGRGAFTHTSYNDFEIVAANLLDDDPRRVSDRITTYALYIDPPLGRAGMTVAQVRASGRRALVGKRPMTRVGRAVEKGETQGFMKVVVDADTREILGAAILGVGGDEAIHGILDVMSAKAPYTTLSRTMHIHPTVSELIPTMLQEMSPLA

SEQ ID NO: 93613 - protein, 576 aa, Oceanobacillus iheyensis HTE831
MTKSNISKDNGPLDEVEGIKERSNFLRGTIAEGLEDRITGAISDEDNKLLKFHGSYQQDDRDLRDERRRKKLEPAYQFMIRVRTPGGVTTPEQWLVMDDLAHKYANGSMRLTTRQTFQLHGIVKWDLKKTMQGMNQALMTTIAACGDINRNVMCNVNPEQSDVHAEVYEWSKKVSDHLLPETNAYHEIWLEDKKIVDSREESEPIYGSTYLPRKFKIGIAVPPSNDIDIYSQDLGFIAIVEEGKLLGFNVAVGGGMGMTHGDTNTYPQISRVIGFCVPEKVTEVAEKVVTIQRDFGNRSNRKNARFKYTIDSRGIDWFIDELNERLGWELEGKRHYEFDSNGDSYGWIEGKDYWHLTLFIQNGRIKDVEDYPLMTGLREIAKVHTGDFRLTPNQNLIIANVSSDNKKQINDLVEKFNLTEGKTYSGLRRNSMACVAFPTCGLAMAESERYLPELLDKIEVILDESGLREEEIVIRMSGCPNGCSRPALAEIAFIGKAPGKYNMYLGGSFNGSRLNKLYKENIGEEEILNTLRPIFIDFAKDKQKDEHFGDFVIRAGYVEEVKSGLDFHSSKEDVRS

SEQ ID NO: 93614 - protein, 208 aa, Pseudomonas agarici
QQIVTLTYPHIGNTGTTPEDIESDRVWSAGLVIRDLPLVASNWRNTMSLSDYLKANNVVAIAGIDTRRLTRILREKGSQNGCIMAGENISEAAAIAAAQGFPGLKGMDLAKVVSTREKYEWRSTVWDLKTDSHATLEAVDLPYHVVAYDYGIKYNILRMLVARGCRVTVVPAQTPASDVLALQPDGVFLSNGPGDPEPCDYAIQAIKE

SEQ ID NO: 93615 - protein, 208 aa, Pseudomonas aurantiaca
QQIVTLTYPHIGNTGTTPEDAESDRVWSAGLVIRDLPLVASNWRNTLSLSDYLKANNVVAIAGIDTRRLTRILREKGAQNGCIMAGDNISDEAAIAAARGFPGLKGMDLAKVVSTKESYEWRSSVWSLKTDSHPTIEASELPYHVVAYDYGVKLNILRMLVERGCRVTVVPAQTPASDVLALKPDGVFLSNGPGDPEPCDYAIQAIKD

SEQ ID NO: 93616 - protein, 208 aa, Pseudomonas chlororaphis
QQIVTLTYPHIGNTGTTPEDAESDRVWSAGLVIRDLPLVASNWRNTLSLSDYLKANNVVAIAGIDTRRLTRILREKGAQNGCIMAGDNISDEAAIAAARGFPGLKGMDLAKVVSTKESYEWRSSVWNLKTDSHPTIEASELPYHVVAYDYGVKLNILRMLVERGCRVTVVPAQTPASEALALKPDGVFLSNGPGDPEPCDYAIQAIKD

SEQ ID NO: 93617 - protein, 370 aa, Oryza sativa Japonica Group
MSNGGNRRLVVSNGGNRRLATRIKSSVQQAALTGAGDGEDVDFFFFPFLVLYKSGRVVRFIGTDTVPASMDPATGVASKDVVIDADAGLAVRLYLPNVANLTAGKRGGGDKLPVVVFYHGGGFVTESAFSPTYHRYLNALVSKARVVAVSVEYHLAPEHRLPRAYDDAWAALRWVLENAGAGPEPWLSRHGDTARLFLVGDSAGGNIAHNVAMRAGGEGGLHGGAAIRGVALLDPYFWGKRPVPSETADPATRRWRERTWGFVCAGRYEVDDPVIDPVAMARGEWRRLGRARVLVTVASLDTLSARGRAYVAAARASGWGGEAVLYETPGENHVYFLVEPDGEKAAKEMDAVVAFINEGEQVITASRMDA

SEQ ID NO: 93618 - protein, 582 aa, Geobacter metallireducens GS-15
MSYLVLARKWRPQTFSDLTGQEHVSQTLQNAIDSGRIAHAFLFTGARGVGKTSSARILAKALTCEQGMSPEPCNVCPACTEITAGTAVDVLEIDGASNTGVDDIRELRENVKYLPSRLRYKIFIIDEVHMLSTNAFNALLKTLEEPPPHVKFIFATTEPHKVPITILSRCQRFDFRRIPLGKVVGRLRHIVDQEGIAISDASLTMVARKGDGSMRDSLSVLDQVLAFCGDQVRDEEVVSLLGVVDRRLLLDATAAVFGRDTRTVLDIVARVDEFGYNMRQFCGELIDHLRNLLILKAVGDGTDLLDLSEAELATLRQQAESVPLDDLQRHLTVLLRADGELGHTSFPRLVLEMALVKMATLAPAVPVDQLLERLNKIEEGSGGGVADARAQWRATPPAPAGSPTPARAPERTAATPPPRPAERQAAPSAPAPRREEAKPVSEPRRTGDSWADFVALVKGAKPRLGSMLEQGSPLVVSADRLEIGFPEGAFALASLRDSDSQAALKELARQFFLAEPVLVMRPLAPDAAEAPPNLLEKKRVEKEQQQTVLKQAATSHPAVADALDVFGGTLAEVEPLERKESR

SEQ ID NO: 93619 - protein, 88 aa, Phillyrea latifolia
MPGSLEPLDVGVQIPYHFRCPISLELRDPVTVCTGQTYDRTSIESWVACGNTTCPVTRSTLTDFTLIPNHTLRQLIQDWCVANRSFGV

SEQ ID NO: 93620 - protein, 199 aa, Neisseria meningitidis FAM18
MALKTSNLEHAMLVHPEAMSVGALADKIRKIENWPQKGILFHDITPVLQSAEYFRLLVDLLVYRYMDQKIDIVAGLDARGFIIGAALAYHLNVGFVPIRKKGKLPFETVSQSYALEYGEAAVEIHTDAVKPGSRVLLVDDLVATGGTMLAGLELIRKLGGEIVEAAAILEFTDLQGGKNIRASGAPLFTLLQNEGCMKG

SEQ ID NO: 93621 - protein, 229 aa, Saccharophagus degradans 2-40
MTDQKVIMIRHAQSEWNAKGLFTGWADPVLTPLGRKEAAEAASNLAKLGLKFDRIYTSVLQRATETASIIAKSLNCQVPLTKSWQLNERHYGVLQGKSKEALAKQVGAEQVWRWRRGFEDMPPPMPLASPMHARFDTKYDGVEPTSLPSVESLKHTQIRAVNYWQKEVLPSIRNNSSVLVAAHGNTLRALIMYLANMSVQEVEGFEIPTGIPIELNINKHGRCSSWRYI

SEQ ID NO: 93622 - protein, 738 aa, Methylococcus capsulatus str. Bath
MPMTRDFFATAPKGLEPLLVRELDGLGAESIKETRAGVEFRGTLETAYRVCLWSRLANRILMSLDRFAAATPEALYDGVQRTDWGRHFGPGATLAVDFSSRRSAITHTLFGAQKVKDAIADQFLEHCGRRPSVRLERPDIRINVHLDADQAVIGLDLSGDSLHRRGYRTEAGPAPLKENLAAAVLIRAGWPDIAARGGSLIDPMCGSATLLIEGALLAADIAPGSFREYFGFLAWKGHDLELWRKLLTEARERAEAGLARLPPILGYDLDRRAIHLALDNIDRAGLRGRIHVERKVAADVRPKGRPGLVVVNPPYGERLGDVESLIPVYREFGETLQRHFRGWNAALLTGNFELAFQIGIRAGRYHTLYNGALECRLFLFDIAPERFFTPRSGVPETEGQKKLRQIVEKARRGAIPAEQSEMFANRLRKNLRNLGTWARRNGVSCYRLYDADLPEFAVAVDIYQGEKLWVHVQEYEAPASVDPAKAQSRLAGAVAMIPEVLEVPREQIFLKVRRRQKGDAQYVKQGQTAHFHVVEEGGWRFWVNFEDYLDTGLFLDHRITRGLIQQVARDRHFLNLFAYTGTATVYAAGGGAASTTTVDMSHTYLDWAGRNLALNGFGERDHLRIQADCLDWLEQAVDRRRRYGLIFLDPPTFSNSKRMTGSFDIQRDQGPLLKKVVSLLEPGGMLIFSTNRRRFRLDETALAGCAVEDVSRVTLPKDFERNPRIHACWRILAPDRQR

SEQ ID NO: 93623 - protein, 210 aa, Brassica napus
  misc_feature (198)..(198): Xaa can be any naturally occurring amino acid
STHASALSSLSRVCHCDGLLLCTTEAYSWLAVWNPFTSQTRWICVEPISIRHRKIWYSHALGYEKGKSCRVYKILRFAGNVHEVYTLKSSDSWRALDVSPDWDIGYDNHGVSFQGNTYWYAKVAGGVGFLLCFDFTGERFGQLLPLAFECFSEDSVILSSVGGEQQQLAGLFQHRETVEMEVWVTTKVEPDAVSWSNXLAVDMGPLTGFR

SEQ ID NO: 93624 - protein, 524 aa, Erysiphe necator
MYIADILSDLLTQQTTRYGWIFMVTSIAFSIILLAVVLNVLSQLLFRRPYEPPVVFHWFPIIGSTISYGIDPYKFYFDCRAKYGDIFTFILLGKKVTVYLGLQGNNFILNGKLKDVNAEEIYTNLTTPVFGRDVVYDCPNSKLMEQKKFMKTALTTEAFHSYVTIIQNEVEAYINNCVSFQGESGTVNISKVMAEITIYTASHALQGEEVRENFDSSFAALYHDLDMGFTPINFTFYWAPLPWNRARDHAQRTVARTYMNIIQARREEKRSGENKHDIMWELMRSTYKDGTPVPDREIAHMMIALLMAGQHSSSSTSSWIMLWLAARPDIMEELYEEQLRIFGSEKPFPPLQYEDLSKLQLHQNVLKEVLRLHAPIHSIMRKVKNPMIVPGTKYVIPTSHVLISSPGCTSQDATFFPDPLKWDPHRWDIGSGKVLGNDAVDEKYDYGYGLTSTGASSPYLPFGAGRHRCIGEQFATLQLVTIMATMVRFFRFRNIDGKQGVVKTDYSSLFSMPLAPALIGWEKR

SEQ ID NO: 93625 - protein, 165 aa, Secale cereale
VMASSATSVAPFQGLKSTAGLPVSRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCV

SEQ ID NO: 93626 - protein, 164 aa, Bromus catharticus
VMASSATSVAPFQGLKSTAGLPVSRRSTGLGSVSSGGRIRCMQVWPIEGIKKFETLSYLPPLSTEALLKQIDYLIRSKWVPCLEFSKVGFVFREHNASPGYYDGRYWTMWKLPMFGCTDASQVIKELEEVKKEYPDAYVRIIGFDNLRQVQCVSFIAFKPPGCE

SEQ ID NO: 93627 - protein, 248 aa, Bacillus halodurans C-125
MIICKTERELEIMREAGRIVALTHQEIKLHIQPGITTKKLDEIAETFIRSHGATPSFKGYNGFTGSICASVNEELVHGIPGNRVLKEGDIISVDIGAKYNGYHGDSAWTYAVGNISDEDQDLLDVTETSLYKGLEQAKAGARLSDISHAIQSYAEPRGYAIVREYVGHGVGQNLHEDPQIPHYGPPGKGPRLKPGMVLAIEPMVNAGSRYVRTLSDNWTVVTVDGKKCAHFEHTIAITETGYEILTKA

SEQ ID NO: 93628 - protein, 380 aa, Methylococcus capsulatus str. Bath
MTMTTRYTGLIERYRDRLPVSAETRIISLGEGDTPLIRLENIPRLLGRRVELYVKYEGLNPTGSFKDRGMTMAVTRAVEEGSRAIICASTGNTSAAAAAYAARAGITAFVLIPDGKIAMGKLAQAMMYGSVVIQIKGNFDDGMRLVKEVAGEAPVTIVNSINPYRLQGQKTAAFEIVDELGRAPDYHCLPVGNAGNITAHWIGYSEYACGGRDCVTEACAFCNGECRFVSGGPVSTSRPKMVGYQASGSAPFLRGHMVDHPETVATAIRIGHPQSWEQAWQVSRESGGWFDECSDEEILAAQKLLTEREGVFCEPASATSLAGALRDIRSGKIPEGSTVVLTLTGNGLKDPDTAIAQCTQKPVTIEAELDSVKRAILDAL

SEQ ID NO: 93629 - protein, 429 aa, Mycobacterium sp. MCS
MPIIEQVGAREILDSRGNPTVEVELALTDGTFARAAVPSGASTGEHEAVELRDGGSRYGGKGVDKAVQAVLDDIAPAVIGMSADDQRLIDQALLDLDGTPDKSRLGANAILGVSLAVSKAAAESAGLPLFRYLGGPNAHILPVPMMNILNGGAHADTGVDVQEFMVAPIGAPSFKEALRWGAEVYHSLKSVLKKQGLSTGLGDEGGFAPDVAGTKAALDLISSAIEAAGFKLGTDVTLALDVAATEFYTEGTGYSFEKETRTAEQMAEFYASLLDAYPLVSIEDPLSEDDWDGWVSLTTQIGDRVQLVGDDLFVTNPERLEEGIERGAANALLVKVNQIGTLTETLDAVALAHNSGYRTMMSHRSGETEDTTIADLAVAVGSGQIKTGAPARSERVAKYNQLLRIEETLGDAARYAGDLAFPRFALETK

SEQ ID NO: 93630 - protein, 357 aa, Oryza sativa Japonica Group
MELFARAQVVRLKSHHDKFLYADEDEVHVTQDRNGAATNARWTVERVPHSPGVVRLRSRYGRYLSASNEPFLLGMTGRKVLQAPPPGGRATDSSLEWEPVKDGFQAKLKTRYGHYLRANGGLPPWRNSVTHDVPHRTATQDWVLWDVEIVQVLTPGHDRAPTSAAPPSPAHAPELKKPPPPPEAHHRPTKSYTGHPPPPPLEKDAPPQPPRPQEVHHRPTKSYTGNPPQPLEKDASPQPPPPKPAPSRLESSLSFSAPLHKVEGRAIYYHIADDKGDVDEDDETRSFTFNGSNLEELTHKLQEETGLHDIIICTRSPITGKLAPLRLQLPPNNAAMHIVLVQESSKVAKTFPWPYGP

SEQ ID NO: 93631 - protein, 313 aa, Bacillus cereus ATCC 14579
MRNVFCIGELLIDFVCRNTNVSLVNGSDFEKKAGGAPANVAAAITKLGGHATFMGQVGNDPFGEFLEQTLQRAQVDTSMLIKDKQTTLAFVSIDQDGERDFTFMRGADGEYQFNSIDLSKIQTNDLIHFGSATALLSSPLKETYFQLLQYAKDKGHFISFDPNYRSALITNTEQFSQDCLTFIKHAHFVKVSQEEATMLSKESDLQQAALKLLNYGAKVVAITLGKDGTLLATNEGQTIVSSISIQQVDTTGAGDAFVGAMLYQIAQSEHTLSYHFKDLTAFISFANKVGAITCTNYGAIASLPSLTDIKAYD

SEQ ID NO: 93632 - protein, 141 aa, Pseudomonas fluorescens PfO-1
MAVQRTFSIIKPDAVAKNVIGKITTRFEDAGLRVVASKLKQLSKAEAEGFYAEHSARGFFGELVAFMTSGPVVVQVLEGENAIARNRELMGATNPKEAAPGTIRADFAESIDANAVHGSDSEAAAAREIAYFFAATEVTTR

SEQ ID NO: 93633 - protein, 418 aa, Triticum aestivum
FGTRQSWEKTVDCYSPGQGLMPASFKIRTIPLDENNEAFEEILDPDFGESAIGRVAPVDSGLWWIILLRAYCKITGDYSLQERVDVQTGIKLILSLCLSDGFDMFPTLLVTDGSCMIDRRMGIHGHPLEIQALFYSALRCSREMIVMNEGSKHLLRAINNRLSALSFHIREYYWVDMNKINEIYRYKTEEYSHDATNKFNIYPEQIPSWLVDWIPEKGGYLIGNLQPAHMDFRFFSLGNLWAISSSLTTPTQAEGILSLIEEKWDDLVANMPVKICYPAMEYDEWRIITGSDPKNTPWSYHNGGSWPTLLWQFTLACIKMGRPELARRAIAVAEEKLSADKWPEYYDTRSGRFIGKQSRSYQTWTIAGFLTSKMLLENPELASILTCDEDLELLEGCACCLSKRTRCSRRAAKSDIIG

SEQ ID NO: 93634 - protein, 271 aa, Brassica napus
MGVVEEAHNVKVIGTGNQGTIVLGHGFGTDQSVWKHLVPHLVEDYRIVLYDNMGAGTTNPEYFDFDRYSTLEGFSFDLIAILEDLQIESCIFVGHSVSAMVGVLASLNRPDLFSKIVMISASPRYVNDVDYQGGFEQDDLNQLFEAMRSNYKAWCLGFAPLAVGGDMDSVAVQEFSRTLFNMRQHIALCVAQTFFQSDMRQILPLVAVPCHILQSVKDLAVPVAVFEYLHTNLGCESVVEVIPSDGHLPQLSSPDSVIPVLLRHIRNDIAV

SEQ ID NO: 93635 - protein, 266 aa, Robiginitalea biformata HTCC2501
MIDSHPQVLEAAIEAGKAILKVYNASETIEVTTKSDDSPLTAADQASNTVINSYLKDTGIPIISEENKQTDYEERKSWEKCWIVDPLDGTKEFIKKNGEFTVNIALCEKGKPIFGVIYVPVTRELYYGDTREGKSFKTVLDQNHTLPEKLGAPADRIEPAAEDPDTLRVVGSRSHMNAETENYIASMKDKYRDIEIVSKGSSLKFCLVAEGLADVYPRYAPTMEWDTAAGSAIAEAAGLKVIAQDTDAPLKYNKENLLNPHFLVCK

SEQ ID NO: 93636 - protein, 327 aa, Oryza sativa Japonica Group
MDAAPTAPPAASADDEIVYESMPCIRIYKNRVERYFGSEFVAASTDAATGVASHDRVISSNVSARLYLPRLDDSAAAKAKLPVLVYYHGGGFCLGSAFNPTFHAYFNTFAALANALVVSVEYRLAPEHPVPAAYADSWEALAWVAGHAAGDGDEAWLVDHADFSRLYLGGESAGSNIAHHIAMRVAEEGLPHGAKIRGLVMIHPYFLGTNRVASDDLDPAVRESLGSLWRVMCPATTGEDDPLINPLVDGAPALDALACDRVLVCIGEGDVLRDRGRAYYDRLTSSGWRGEAEIWQAPEKGHTFHLLEPHCDAAIAQDKVISGFLNR

SEQ ID NO: 93637 - protein, 391 aa, Geobacter metallireducens GS-15
MKFAISDQIRSVHAPPITEVKGWLASREPDPGRHLIDLCQAVPDYAPARQLTDYLATCLDDPAMAKYSPDEGLLEVREGVCARYGRVYGAAPAPEGVCLTIGASQAFWLAMVTLCRAGDEVIVPLPAYFDHPMALEMLGLRPVWLPFDEKRGGVVDPAAVERLITPRTRAILLVTPSNPTGVVTPPDVIHELYSLARRRGTALVIDETYADFIPGGAAPHDLFADPHWGDHLVQIMSFGKTYALTGYRAGCLVASDAFISHALKAQDTMAVCQPRITQHAVLYGVRHLDDWVAENRLMMERRHDLFRSVFTRPGNPFELAASGTFFAWVRHPFPGKTGREAARRLAVEAGVICLPGEVFGPGLEPYLRLAFGNIREEAIPEAVERFRGLAV

SEQ ID NO: 93638 - protein, 257 aa, Robiginitalea biformata HTCC2501
MAKNILELFSLEGKKALVVGGAGDLGKAMVEALAQAGAQTVIIDFDERVFELCDKFRADGLQVDPIRADVSEISQVRESYKEALEKLGGTIDILVNSAGIQRRYPSEEFPEEEWSKVIAINLDATFYYCKYAANDMIKNGGGKIINIASLMSFLGGITIPAYAASKGGVAQLTKALSNDWAAKGICVNAIAPGYMDTQLNTALIADKKRTDEVMLRVPMKRWGDGEDLKGLTVFLSSAASDYITGCVIPVDGGYLAR

SEQ ID NO: 93639 - protein, 388 aa, Arabidopsis thaliana
MVQAITRPIQYLIISYLRYLVGPPSLTHHDNQVTVIIEETSENGRINVIHGATQAYLFDKINLDFVEEREFDDIYQGAKLKWRIFVDKNNIGNIPKQCFELRFDEKHRDLVFDSYIPFVESKAKEIKSKKRILEMHTYSHCCDTWETKILDHHSSFETIVMKEDLKRRLIDDIDLFISKEDFYKRVGRHWMRYYLLHGLPGAGKTSLVAAIAKYLNFDVYNITQGVKTDFDTRRLIRRVEDSSILLVEDIDTSLEGSKVALSQLLSSLTWPWSNGKARVVIFTTNNKERFDQTLLCRMEMKIYMGHCCFEDFKTLASNYLGISHDNDAPHRLYPDIKRLIDGQAVTPGQVVEELMKSQDVDVALQSLVRTLEMTSIISNKIDEDDKDL

SEQ ID NO: 93640 - protein, 719 aa, Desulfovibrio desulfuricans G20
MPDPGQMKWICKESNVSKNLYITATESKSGKSAIVLGMMQLLLRDVRKVAFFRPIINNTSKEVRDHDINLILTRFGLDIPYEKTYAYSLHEARELINNGQHATLLENILNKYKALEAEYDFVLCEGTDFLGKDAAFEFDLNADIAANLGCPVLVVANGLDKNSEEIIGSTQLTIDQLDEKSLDVVAAVVNRASVTPAEKDNIIKSLECKVNCANPLAVYVVPEEPTLGKPTMGDVKKWLGASVLYGHGRLDTLVDDYIIAAMQVGNFLDYLGQGTLIITPGDRSDIILASLASRLSSSYPDISGILLTGGLEPAANVHRLIEGWTGVPVPVLCAKEHTYLTTQILNDLYGKIDPEDDRKIATALGVFEQNVDTAEISNRIISRRSSRITPKMFEYNLIEQAKKHKMRIVLPEGAEERILRAADILVRRGVADLILLGNADEVGKKIGDLGLDLDGVTIIQPELAPNFEDYVQTYYEARKKKGISMEQARDIMSDPTYYGTMMVHKNDADGMVSGAINTTAHTIRPAFEFIKTKPTASIVSSVFLMCLKDRVHVFGDCAVNPNPSAEQLAEIALNSSDTARIFGIEPKVAMLSYSTGSSGKGADVEKVIEATRIAKERAPELALEGPLQYDAAIDADVARTKMPDSNVAGQATVFIFPDLNTGNNTYKAVQRAAGAVAIGPVLQGLNKPVNDLSRGCLVPDIVNTVAITAIQAQAEKGLR

SEQ ID NO: 93641 - protein, 545 aa, Staphylococcus aureus subsp. aureus MRSA252
MIKDKQLHNEKINLSQLVLLGLGSLIGSGWLFGAWEASSIAGPAAIISWVLGFLVIGTIAYNYIEIGTMFPQSGGMSNYAQYTHGSLLGFIAAWANWVSLVTIIPIEAVSAVQYMSSWPWHWAKPMKHLMENGSISTYGLLAVYLIIVIFSLLNYWSVKLLTSFTSLISVFKLGVPMLTIIMLMLSGFDTSNYGHSASTFMPYGSAPIFAATTASGIIFSFNSFQTIINMGSEIKNPEKNIARGIAISLSISAVLYIILQSTFITSMPQSMLQHSGWNGINFNSPFADLAILLGINWLAILLYIEAFVSPFGTGVSFVAVTGRVLRAMEKNGHIPKFLGKMNEKYHIPRVAIIFNAIISMIMVTLFRDWGTLAAVISTATLVAYLTGPTTVIALRKMGPTMTRPFRAKILKVMAPLSFVLASLAIYWAMWPTTAEVILIIILGLPIYFFYEYRMNWRNTKKQIGGSLWIIVYLIVLSILSFIGSKEFKGLNMIHYPFDFIVIIIVALIFYYIGTTSSFESVYFRRATRINTKMRESLNNESKSSY

SEQ ID NO: 93642 - protein, 460 aa, Glycine max
MASRAIVQQQQARGEAVVGGGKQQKKNGVADGRNRKALGDIGNLANIRSAVEVKPNRPITRSFGAQLLANAQAAAAAGNNKKQACANVAGPPAVANEGVAVAKRAAPKPVSKKVIVKPKPSEKVTDIDASPDKKEVLKDKKKEGDANPKKKSQHTLTSVLTARSKAACGITNKPKEQIIDIDASDVDNELAAVELAAVEYIDDIYKFYKLVENESRPHDYIGSQPEINERMRAILVDWLIDVHTKFELSLETLYLTINIIDRFLAVKTVPRRELQLVGISAMLMASKYEEIWPPEVNDFVCLSDRAYTHEHILTMEKTILNKLEWTLTVPTPLVFLVRFIKASVPDQELDNMAHFLSELGMMNYATLMYCPSMVAASAVLAARCTLNKAPFWNETLKLHTGYSQEQLMDCARLLVGFHSTLENGKLRVVYRKYSDPQKGAVAVLPPAKFLLPEGSASQHS

SEQ ID NO: 93643 - protein, 460 aa, Saccharomyces cerevisiae
MMLEGYTVQPPQSTLIGDIEIQDENANQEVKNVLYQGVQKGIKRLEKRQRRVALGDVTSQKANKIHNAIHNKFHQTKNNFEIENIRSSALVKEQQRDVRHEDSDYFLIDSSEGSSTDDEQVNEDAIDDLLSRRVNDQQIQADEVYEDFDGEMQDVIEEDVDSQIEPLSPINNDEIQTELDRAFEKYFRSVPNPLDDDTHDVVMVVEYASDIFYYLRELEVKYRPNPYYMQNQVELTWPFRRTMIDWLVQLHFRFQLLPETLYLTINIVDRFLSKKTVTLNRFQLVGVSALFIAAKFEEINCPTLDDLVYMLENTYTRDDIIRAEQYMIDTLEFEIGWPGPMPFLRRISKADDYDFEPRTLAKYLLETTIVEPKLVAAAPSWLAAGAYFLSRTILGSNDWSLKHVFYSGYTSSQIIPLASLILENCKNASRRHHSIWKKYFDQKHYRCSQIVEEWIVSTEA

SEQ ID NO: 93644 - protein, 477 aa, Triticum aestivum
MQRLASSRRLLRAALAPGRAHSSLSAAAVAAAPENGAGAPKMPPFAYTPPPYDGPRVAEIAQKRAQFLSPSLFHFYDRPLNIVDGKMQYLFDEDGRRYLDAFGGIATVCCGHCHPDVIEAIVNQAKKIQHSTVLYLNHAIADFAEALASKMPGDLKVVFFTNSGTEANELALMIARLYTGSHDIISLRNGYHGNAAATMGATAQSNWKFNVVQTGVHHALNPDPYRGAFGSDGEKYARDIQETIDYGTTGRVAGFISEAIQGVGGIVELAPGYLPAAYDMVRKAGGLCIADEVQAGVARTGSHFWGFEGQGVIPDIVTMAKGIGNGIPIGAVVTTPEIAKVLTRRSYFNTFGGNPVSTAAGHAVLKVLEKEKLQENAFVVGSYLKEKLNALKEKHDIIGDVRGKGLLLGVELVTDRQKKTPAKAEIAQVMNHMKDMGVLVGKGGFFGNVFRVTPPLCFSKEDSDYMIEVMDIALSKL

SEQ ID NO: 93645 - protein, 534 aa, Triticum aestivum
MLRAVLLRSASGLRRSPMAAPLSTAAASWLAEGTSPSPPRVRLLIGGDFVESKATEHVDVTNPATQEVVSRIPLTTADEFRAAVDAARTAFPGWRSTPVTARQRIMFKYQELIRANMDKLAENITTEQGKTLKDAWGDVFRGLEVVEHACGMGSLQMGEYVSNVSHGIDTFSIREPLGVCAGICPFNFPAMIPLWMFPIAVTCGNTFVLKPSEKDPGAAMMLAELAMEAGLPKGVLNIVHGTHDVVNNICDDEAIKAVSFVGSNTAGMHIYSRASASGKRVQCNMGAKNHAIILPDADRDATLNALIAAGFGAAGQRCMALSTAVFVGGSEPWEDELVKRASSLVVNTGTANDADLGPVISRQAKDRICKLVQSGADSGARLVLDGREIVVPQFEDGNFIGPTVLADVKSDMECYQEEIFGPVLLLMKAESLDDAIQIVNRNKYGNGASIFTTSGVSARKFQTDIEAGQVGINVPIPVPLPFFSFTGSKASFAGDLNFYGKAGVQFFTQIKTITQQWKESSPQRVSLSMPTSQK

SEQ ID NO: 93646 - protein, 230 aa, Gloeobacter violaceus PCC 7421
MDLDILKQTAARRAVELVEDGMVVGLGTGSTAAFAVSVLAERVRLGLRVVGIPTSERTARQAEAEGIVLGTLAEQSRVDLTIDGADEVALGELALIKGLGGALLREKIVAAASERLIIIVDATKLVEQLGSHGPLPVEVAPFGWQATARALERLGAEVNLRAQHGQAFLTDGGHYILDCRFGPIARPAELEAAIDRIPGVVESGLFVGMASAVIVADEGGIEVLTPSAAP

SEQ ID NO: 93647 - protein, 326 aa, Mycobacterium sp. MCS
MGTEWTDNRKNLMLFSGRAHPELAEQVAKELDTPVTAQTARDFANGEIFVRFDESVRGCDAFVLQSHPAPLNQWLMEQLIMIDALKRGSAKRITAILPFYPYARQDKKHRGREPISARLVADLLKTAGANRILTVDLHTDQIQGFFDGPVDHMRAQKLLTGYIAEHYPSEDMVVVSPDSGRVRVAEKWADSLGGTPLAFIHKTRDPLVPNQVVSNRVVGDVRGKTCVLTDDMIDTGGTIAGAVKLLKQEGAGDVIIAATHGVLSHPARERLAECGAREVIVTNTLPIGEDKQFPQLTVLSIAPLLANTIRAVFDNGSVTSLFDGSA

SEQ ID NO: 93648 - protein, 128 aa, Pseudomonas fluorescens PfO-1
MAYSEKVIDHYENPRNVGKMNAEDPDVGTGMVGAPACGDVMRLQIKVNDQGVIEDAKFKTYGCGSAIASSSLATEWMKGKTLDEAETIKNTQLAEELALPPVKIHCSVLAEDAIKAAVRDYKQKKGLI

SEQ ID NO: 93649 - protein, 289 aa, Mycobacterium sp. MCS
MSDWTAADLPSFAGRSVIVTGANSGLGLVTARELARVGADVVLAVRNTAKGDEAAATMTGNVTVRKLDLQDLASVREFAAGTDRVDVLVNNAGIMAVPYARTVDGFESQIGTNHLGHFALTNLLLPKITDRVVTVSSFMHVLGRINLDDLNWKARPYSAWLAYGQSKLANLLFTSELQNRLRRAGSPVRALAAHPGYSHTNLQGQSGRKLGDALMAFGGEYFATDADFGARQTLYAVAQDLPGDTFVGPKFAMRGPTGPVWRTPLARDMKTAAALWELSEQLTGTRFPL

SEQ ID NO: 93650 - protein, 808 aa, Nicotiana tabacum
MTNKAESSDSKGTKRDYSTAILERKKSPNRLVVDEAINDDNSVVALHPDTMEKLQLFRGDTILIKGKKRKDTICIALADDTCDEPKIRMNKVVRNNLRVRLGDVVSVHQCPDVKYGKRVHILPIDDTIEGVTGNLFDAYLKPYFLEAYRPVRKGDLFLVRGGMRSVEFKVIETDPPEYCVVAPDTEIFCEGEPVSREDENRLDEIGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLAEEVDLERIGKDTHGYVGADLAALCTEAALQCIREKMDVIDLEDETIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEDSRHQIFKACLRKSPLSKDIDLRALAKYTQGFSGADITEICQRACKYAIRENIEKDIEREKRRSENPEAMEEDVDDEVAEIKPAHFEESMKYARRSVSDADIRKYQAFAQTLQQSRGFGTEFRFSETSTAGGTTGTADPFATSAGGADEDDLYS

SEQ ID NO: 93651 - protein, 258 aa, Pseudomonas fluorescens PfO-1
MFERLREDIQSVFHRDPAARNAFEVLTCYPGMHAIWIHRLAGMLWRNDLKWLARLVSNFGRWLTGIEIHPGAKVGRRFFIDHGMGIVIGETAEIGDDVTIYQGVTLGGTSWNKGKRHPTLGDGVVVGAGAKVLGPFTVGAGAKVGSNAVVTKEVPPGATVVGIPGRIIVKSDDEADAKRKAMAEKIGFDAYGVSEDMPDPVARAIGQLLDHLQAVDGRLEGMCGALKDLGSNYCAKDLPELREEDFACVKGKGESKLH

SEQ ID NO: 93652 - protein, 514 aa, Triticum aestivum
MANLVQELMLETPPRAWFLFLLPLLLLSLHYWFTRKTGSTGQRLPPSPPALPIIGHLHLVGALPHVSLRDLARKHGPDVMLLRLGAVPTLVVSSPRAAEAVLRTHDHVLASRPRSVVSDIIMYGSSDIGFAPYGEYWRQARKLVTTHMLSVKKVQSFRSAAAEEVSMAMAKINQAAAADAAVDMSELLHTFANDMACRIVSGKFFLKDGQSKLFGELIKDTSRLLGGFNLEEYFPAVGRVGVLKKAVCAKAERVRNRWADLLDKVIDDRVSKRKSTSDHKDGDFVDILLSVQQEYDLTREHMKALLTDVFFGATDTSANALEFTLAELMRKPHLMGKLQDEVRGIVPQGQEIISETDMNNMTYLRAVIKESLRLHPLAPLLAPHLAMADCIIDGYIVPAGTRVVINAWAIGRDPSSWEYAEEFIPERFTDEGSSMHVNFKGNDFQFLPFGAGRRMCPGMNLGIANVELMLANLVCHFDWQLPLGVERKDIDMTEVFGLTVHRKEKLLLIPKSRM

SEQ ID NO: 93653 - protein, 273 aa, Clostridium perfringens SM101
MDKIIIKDFEVFGNHGVFKEEKRLGQKFVLSIELFLDTREAGVTGDLSKSVHYGELAHKVEEEFKKQSYDLIETAAEKLCEFILLEYPLVKKVKVSLKKPWAPILRSLDTVSIEIERGWNEAYLSYGSNIGDKKYYIEEALKEINKAYHTEIIKKSNLIETEPWGYTEQDEFLNGACKIKTLLNPKELIKFLLSIEQKLKRERKIKWGPRTIDLDVIFFNDLISEDEEIILPHPRMHERSFVLEPLNEIAPYKIHPLYRKRVFELLEELNKNK

SEQ ID NO: 93654 - protein, 335 aa, Treponema denticola ATCC 35405
MSFVDEMKRKAKMYANRLVLPEGTEERTLKAARSIVDEKLVSELFLIGSDDAVYAAASKAGVKLGGIKIIDPKKSEWLDSFAESYYEKRKAKGMTLEQAKIEMSAELGFAAMMLVQDKADAMVAGALNTTADVLRAGLKVIGTLPGMKTASSCFLMDTKNPKLGANGVFIFSDCAVIPTPSSEQLADIACSAAISCRTFAGVEPIVAMLSFSTKGSGGDKDENILRVREAVKILQERKPDFVFDGEIQLDCAIVPSVMQKKAADSPVKGQANTLIFPDLGAGNIGYKLVQRIAGAEALGPFLQGFAKPISDLSRGCSVDDIITTSAVTLVQAGRK

SEQ ID NO: 93655 - protein, 374 aa, Bromheadia finlaysoniana
MAPVPFLPTAVTENTLRESFVRDEDERPKVAYNVFSHEIPVISLRGSTMREMEVEIEICWKIVAACEDWGIFQVVDHGVDAGLIADMTRLAREFFELPPEEKLRFDMSGGKKGGFIVSSHLQGEVVQDWREIVTYFSYPIRTRDYSRWPDKPEGWRAVVEEYSAKLMELACNLLGVLSEAMGLDREALAQACVDMDQKLVVNFYPKCPQPDLTLGLKRHTDPGTITLLLQDQVGGLQATKDGGETWITVQPVQNAFVVNLGDHGHYLSNGRFKNADHQAVVNSNCSRLSIATFQNPAPDGVVYPLAVREGEKPVMEEAITFAEMYRRKMSRDLELARLKKMGKMESKQKGAAGENAEAIGAAATKPKALNEILA

SEQ ID NO: 93656 - protein, 367 aa, Bacteroides thetaiotaomicron VPI-5482
MALQCGIVGLPNVGKSTLFNCLSNAKAQAANFPFCTIEPNVGVITVPDERLNALAELVHPQRIVPTTVEIVDIAGLVKGASKGEGLGNKFLANIRETDAIIHVLRCFDDDNVTHVDGSVNPVRDKEIIDYELQLKDLETIESRIQKVQKQAQTGGDKAAKQAYDVLIQYKDALEQGKSARTVTFETKDEQKIAHELFLLTSKPVMYVCNVDEASAVNGNKYVDMVREAVKDENAEILVVAAKTEADIAELETYEDRQMFLAEVGLEESGVARLIKSAYKLLNLETYFTAGVQEVRAWTYEKGWKAPQCAGVIHTDFEKGFIRAEVIKYDDYIQYGSEAAVKEAGKLGVEGKEYVVQDGDIMHFRFNV

SEQ ID NO: 93657 - protein, 152 aa, Triticum aestivum
  misc_feature (61)..(61): Xaa can be any naturally occurring amino acid
  misc_feature (77)..(77): Xaa can be any naturally occurring amino acid
  misc_feature (112)..(112): Xaa can be any naturally occurring amino acid
PSLFLLLQVSKSATTSEMSTVSRASLDQKLALAKRCSREATLAGAKAAAVATIASAIPTLXASVRMLPWAKANINPXTGQALIVSTVAGMAYSSPPDKKILSLAKRHSVRGXAPSNSKNTSFQGTGRPQPASQGNDEISIYRAGRQLIIIDQ

SEQ ID NO: 93658 - protein, 394 aa, Streptococcus pneumoniae
MKIAIAGSGYVGLSLAVLLAQHHEVKVIDVIKDKVESINNRKSPIKDEAIEKYLVEKELNLEASLDPAHVYKDVEYAIIATPTNYDVDLNQFDTSSVEAAIKTCMEYNDTCTIVIKSTIPEGYTKEVREKFNTDRIIFSPEFLRESKALYDNLYPSRIVVGTDLDDSELTKRAWQFADLLKGGAIKEEVPILVVAFNEAEVAKLFSNTYLATRVRYFNEIDTYSEVKGLNPKTIIDIVCYDPRIGSYYNNPSFGYGGYCLPKDTKQLKASFRDVPENLITAVVQSNKTRKDYIAGAILAKQPSVVGIYRLIMKSDSDNFRSSAVKGVMERLDNYGKEIVIYEPTIECDTFMGYRVIKSLDEFKNISDIVVANRMNDDLRDIQEKLYTRDLFGRE

SEQ ID NO: 93659 - protein, 144 aa, Glycine max
  misc_feature (75)..(75): Xaa can be any naturally occurring amino acid
  misc_feature (119)..(119): Xaa can be any naturally occurring amino acid
ECDLWENTVCQPRLQTRGHTLNWERTILQSLVTHGCIGTGHGIGSGVLEQPVIEKVTLGPECVLDLKKSRKSVPXYRVIMLNDKLNKPEYLVQVLMKDMTGMTLDYAVNIMQDVHYNGXLVVIMSLPAVAEDHCLHLRCLGLFN

SEQ ID NO: 93660 - protein, 514 aa, Photobacterium profundum
MKTLSQLVFNNTYSELPTTFGTAVIPQPLSDPFLVSVNPQVAEMLELDPLEAKTRLFINSFTGNKELAGTAPLAMKYTGHQFGHYNPDLGDGRGLLLGEVLTSTNAKWDIHLKGSGKTPYSRQGDGRAVLRSSIREYLGSAALNGLGIKTTHALALLGSTTLVSREKMERGATLIRVAESHLRFGHFEYLFYTHQHSELKLLADYLIKHHFPDLLTTESEQEDKQTASPNQHHNIYASMLTRIVELTAQLIAGWQSVGFAHGVMNTDNMSVLGLTFDYGPFGFLDDYNPDYICNHSDYSGRYAFNQQPSIALWNLSALGYALTPLIDKEDVDAILNRYHLTLQRDYSARMRNKLGLIEKREEDTVLFSSLFELLQSQMVDYTLFFRTLSSISATDLSVTSLPNSIERFDDLFTCTQPLEKWLKAYAVRLSFENDTSEKNGDTLRLTQMKLHNPKYILRNYLAQQAIDKAEDGDFTMIDELLQVLSSPFDEHLEFNQFADKPPYWGKKLEISCSS

SEQ ID NO: 93661 - protein, 357 aa, Saccharophagus degradans 2-40
MSKKIVLLPGDGIGPEIVAEAKKVLEAVDAKFKLGLKFEEDLIGGCAIDVHGVPLAQSTLDRCKAADAVLMGSVGGPKWDALDSNIRPEKGLLKIRYEMGLYANLRPAILYPQLADASSLKPEIVSGLDILIVRELTGGIYFGEPRGIRLLDNGERQGYNTYVYAEHEIERIGRTAFEMAMKRDKKVCSVDKANVLEATVLWREVIQSISKDYPEVELSHMYVDNAAMQLVRAPKQFDVVVTGNMFGDILSDTAAMLTGSIGMLPSASLNQDSKGLYEPVHGSAPDIAGQGVANPLATILSAAMMLRYSLNEAAAADAIEAAVGAVLDDGLRSADIFSEGMKKVSTQEMGDAVAAKI

SEQ ID NO: 93662 - protein, 587 aa, Sulfolobus tokodaii str. 7
MNANTSTSPTSSLLSTYINAIELGIIILTFVIPLIYFIYFMRMMRVGHSQQRQLERKMNRIPSITWDQIYDMEEIKARLDEIASYVMKKGKAYGVILFGPPGTGKTSIAKALANKLRWNYFELKSTDVMSKWYGESEYLLDNFFNVVELNAPAVVVIDEIDGFTLKREGDIHEVTHRLINIFLMRLQELHDKSLPVLIIGTTNIPQEIDEALLRPGRFDEVIYVPLPDENGREKIWCGYVQNVDCKELAKRSNRLSPADIKEIVEEVKIQCEKEGRTPTTQDFIKALENYKPSVSIQIIVKFENIAKKYSRHKLGERPYGVPDVRWDDLGDLEDVKRIIKDSIELPLKRKDLAEKLGIKPVKGLLLYGPPGTGKTSIAKALANELNASFIILSGEEISSAGPFNAGEIIAEKFHIARDNAPAIIFIDEIDMIARARGENEWRTALTELLNQMDGIRENEEIVVVGATNRPWDLDPAILRPGRFDKIIYVPPPDEKGRAEVLKVLCRGLTVDEETLQKVAKITDGYTPADLKLVVDEIRRNLLKEATITGVARTTLTFNDFIKILANVKPSVNKETLKMYEEFKIQRI

SEQ ID NO: 93663 - protein, 339 aa, Zea mays
MAFHRTMARCLWAGKNAAASGAAIPKPPSPHLPARRSLPAVDDCQTLAFLRPRPTPVGYATATVPLPAHCFPALPVGDHLFRRLQLDGLIPPVSTVARPPEDVGVTVEQARKVARAAEMEVARARLRSNAQSVVSGSEFAALCVDIAGGVEGGRRLARALDESGGVIVLGDVVFLCPDMVAKAIGSILPGKQQQLQAPRAGDGSEARKRELEAMEAQRAAIDAAAAAQVRRELWCGLGLLATQTLGFMRLTFWELSWDVMEPVCFYVTSLYFMSGYFFFMRTATEPSFEGFFRSRFASRQRRLMRARGFDVDRYNALRKGQGLGPLGDPDACRHVSHAQ

SEQ ID NO: 93664 - protein, 359 aa, Mannheimia succiniciproducens MBEL55E
MVIMTHKIAVIPGDGIGIEVINEGVKVLNCVSQLDPKIQFEFTHFPWGCEFYSKTGRMMDDDGIERLSKFDGIFLGAVGYPGVPDHISLWGLLLRIRKSFDQYVNVRPVKLLKGAPCPLKEKSPKDINMIFIRENSEGEYAGSGSWLYRDKPNEVVIQDGVFSRVGCERIIRYAFELARTEKKSLTSISKGNALNYSMVFWDQIFQQLSQEYPDVETHSYLVDAAAMLMITKPERFEIVVTSNLFGDILTDLGAAIAGGMGLAAGANLNPEGNFPSMFEPIHGSAPDIAGKQLANPLATVWSASQLLEFFGYKEWAARLIDAIEYLLVEQKTLTPDLGGTAKTADVGDAVVAYLQKHFA

SEQ ID NO: 93665 - protein, 295 aa, Magnaporthe grisea 70-15
MIRKQARERRDYLYRKVAILKDAEINEKKAKMRASLAQGRPLEKDIANDEKLRADYHYDESRIDREDLDLDDEYAQLSGLVDPRVMVTTSRDPSARLAAFAKEIRLLLPTAIRLNRGNLILPELVRSVQAAGLSDIVLLHERRGTPTALTISHMPHGPTVSFSLHNVLLRHDIPGSVRGTVSEAYPHLVFDGFTSKLGQRIVKVLKHLFPPREPITNKAKMSNRVITFKNIDDVIEVRHHVFVRTGHESVELAEVGPRMSMKVFEIRGGTLENKDGDVEWHLSQYTRTSRKKNYL

SEQ ID NO: 93666 - protein, 362 aa, Oryza sativa Indica Group
MPAILALTAQSAGAAVADVTVDALVAQNSITHQPLAADMQSLCGFSSSVGALLGFSISGLLVHSIGSQGALGLLSIPSALVFLAGVLLKERRVTDFDYKQVHRKFYKAIQSMGATLKCAEVWRPCVYMYVSLSLSLDIQAGMFYWYTDPIVGPGFSEEFIGLVYSVGSIGSLLGVLLYQISLKDCPFRGVLFWGQVLSSLAGMLDLIMVTRLNTRIGIPDYVFAVIDNSVSQMVGRLKWLPLLVLCSKLCPPGIEGTFYALLMSIQNAGLLMSGWWGGLMLQLLNSERNSMLLPAEMLQDNESTEARKGGQDTAEFSVLVADDSSCHALNVAVEDERIKVVDAGTGTVELIPLMNELQDRGS

SEQ ID NO: 93667 - protein, 413 aa, Clostridium perfringens SM101
MIVNEQNLKEEALRCLMCKNPRCKANCPISTPIPEVIGLFKEDKIKEAGEILFENNPLSVVCSIVCPHENQCKGNCIKGIKDTPVNFSEIEREISEEFLDNLELTQDTILEDKIAIIGGGPAGITAAFILAKKGYQVTIFDENDKIGGVLRYGIPEFRLSREIIDKYEEALIKLNVKIRPNTLIGTVITLDMLKSDGYKAIFIATGVWNPKTLNVKGETLGNVHYAIDYLKAPKSYNLGERVVVIGAGNVAMDAARTAKRNGADTYVLYRKSFEDMPATKVEIEEAKEDGVKFELYKAPLEIYEDGVKYIQTERVISEDGRVSFKTLEGSEGIFKCDSIIVAISQAPRTNIVSSSRELSTDKYGLVVTDEKGITTLNGVFASGDVVSGPKTVVEAVANSKKVAHAIDEFCKNN

SEQ ID NO: 93668 - protein, 89 aa, Oryza sativa Indica Group
MKRLLAYALIALIETLLWFVDVTCTRLPDTLVTPNAHFQKDLGLDSLDTVEIVMAFEEEFGFEIPDNEAEKIDSIKTAVDFVASHPQAK

SEQ ID NO: 93669 - protein, 244 aa, Oryza sativa
KKLCGSLQKKSNTPSYQNRCVLRLILYHVCVNLPVMVLSYPAFKFMGLRSSLPLPHWTVIVSQVLFYFVLEDFIFYWGHRALHTKWLYKHVHSVHHEYVMLHLGLILLHFVIVPVLLNNNFLGRYATPFGLTSEYAHPAEILFLGFATIVGPALTGPHLFTLWLWMVLRVLETVEAHSGYHFPWSPSNFLPLYGGSDFHDYHHRVLYTKSGNYASTFVYMDWLFGTDKDYRNAKAIEEKDGKHL

SEQ ID NO: 93670 - protein, 256 aa, Streptococcus pyogenes M49 591
MKIGIIGVGKMASAIIKGLKQTPHELIISGSSLERSKEIAEQLTLPYAMSHQDLIDQVDLVILGIKPQLFETVLKPLHFKQPIISMAAGISLQRLATFVGQDLPLLRIMPNMNAQILQSSTALTGNTLVSQELQARVRDLTDSFGSTFDISEKDFDTFTALAGSSPAYIYLFIEALAKAGVKNGMPKAKALEIVTQTVLASASNLKTSSQSPHDFIDAICSPGGTTIAGLMELERLGLTTTVSSAIDKTIDKAKSL

SEQ ID NO: 93671 - protein, 534 aa, Arabidopsis thaliana
MEGVNSSSSISDLDELARLLDRPRVNIERKRSFDERSFSEMGIFDNVNSPGGWETPVSSARNSFEPHPMVAEAWDALRRSLVYFRGQPVGTIAAYDHATEEVLNYDQVFVRDFVPSALAFLMNGEPDIVKNFLLKTIQIQGREKRIDRFKLGEGAMPASFKVIHDPIKETDSINADFGESAIGRVAPVDSGFWWIILLRAYTKSTGDTSLAETSECQKGMRLILSLCLSEGFDTFPTLLCADGCSMIDRRMGVYGYPIEIQALFFMALRSAMSMLKHDAEGKEFMERIVKRLHALSFHMRSYFWLDFQQLNDIYRYKTEEYSHTAVNKFNVIPDSIPEWVFDFMPLRGGYFIGNVSPARMDFRWFALGNCVAILASLATPEQSASIMDLIEERWEELVGAMPVKICHPAIESHEWRIVTGCDPKNTRWSYHNGGSWPVLLWLLTAACIKTGRPQIARRAIDLAEARLLKDGWPEYYDGKSGRFIGKQARKFQTWSIAGYLVAKMLLEDPSHLGMISLEEDKQTKPVIKRSYSWT

SEQ ID NO: 93672 - protein, 392 aa, Triticum aestivum
  misc_feature (224)..(224): Xaa can be any naturally occurring amino acid
  misc_feature (230)..(230): Xaa can be any naturally occurring amino acid
  misc_feature (264)..(264): Xaa can be any naturally occurring amino acid
  misc_feature (320)..(320): Xaa can be any naturally occurring amino acid
MAMASLARRRAAEAVLLRRPHAAAWASACRGYAASGEESDVVVIGGGPGGYVAAIKAAQLGLKTTCIEKRGALGGTCLNVGCIPSKALLHSSHMYHEAKSSFAHHGVKFSNLEVDLPAMMAQKDKAVSGLTKGIEGLFKKNKVEYVKGFGKLVSPSEVSVDLVDGGSTIVKGKNIIVATGSDVKSLPGVTIDEKKKIVSSTGALALTEIPKKLGGHWELGYIGXEMGSVXNRLGSEVTVVEFAPDIVPINGMEKLREQFQAYAXEKQKFKFMLKTKVVGVDTSGSGVKLTVEPAAGGEQTVIEADVVLVSAGRVPYTAGXLGLDAIGVETDKGGRVLVDNRFMTNVKGVYAIGDAIPGPMLAHRAEEDGVACVELSGRAVNNDWWSHKCRAR

SEQ ID NO: 93673 - protein, 480 aa, Oryza sativa Japonica Group
MAAPQVSPSPSAQVVGNAFVQQYYQILHQSPDLVYRFYQDASRLGRPPADRYGDMVSVTTMEAINEKIMAMDMSRAEIKTVDSQESLGGGVTVLVTGHLTVRDGVCREFSQSFFLAPQEKGYFVLNDMFRYVGDGPTPAAAAAAEVQPEADAVAPPLANGTATAPLQPAAPDYDAMPHEEPDVVENVAVPPEEEEEVYNPPLEEVEGGAVEEEQSVPEVINEVPNNVVPVVAPADAPVSHEEAPKKSYASIVKVMKEAPVPAPIPATRPAPAARPAPPKPEKQSPAPPAPAPVADATPFSSNAESSNTHEPEVDAHAIYVRSLPLNATTTQLEDEFKKFGTIKPDGIQVRSHKIQGFCYGFVEFEEATAVQSAIEASPVMIGGRQCFVEEKRTPGSRGSSRGGRFAPGRGNNNFRADGMRGRGNYSGGRSYGRGDFSYRSDYGGRGGGRGGSARGPDVGYQRVDGGRGGRTSAGPGAPAK

SEQ ID NO: 93674 - protein, 125 aa, Phillyrea latifolia
TVTKLGRLVRDGKIKSIEQIYLHSLPIKEYQIIDILIGPSLKDEVMKIMPVQKQTRAGQRTRFKAFVVVGGGNGHVGLGVKCSKEVATAIRGSIILAKLSIIPVRRGYWGNKIGKPHTVPCKVTV

SEQ ID NO: 93675 - protein, 121 aa, Zea mays
MPRQFFVGGNFKMNGVTDSIKSIVSNINNSKRDPSTEVVIAPPAIYLALTRELADPSVGVSAQNVYDKPSGAYTGELSAEQLKDAKIDWTIVGHSERHVLLREDDDFVARKTKAAIDGRLS

SEQ ID NO: 93676 - protein, 340 aa, Robiginitalea biformata HTCC2501
MKILVTGAAGFIGFFATRLLAEKGHHVVGLDNINDYYDPELKFGRLRELGIDRGSAETFGQETESSTLTNVAFVRLNLEDREELRALFERHSFDAVCHLAAQAGVRYSLENPEAYIDSNIVGFLNILENCRHCGIGHLVYASSSSVYGQNEKIPFETTDRVDHPISLYAATKKSNELMAHTYSHLYGFATTGLRFFTVYGPWGRPDMALFLFTRAILEGRPIQVFNNGEQERDFTYIDDIAEGVVRVLEDDLSGRRDHREKYKLYNIGNGSPVKLMDFIEAIEKHTGKTAIREMLPAQPGDVTRTWADTGGLQKDYGYRAGSDLDDGIGKFVDWYVNYYS

SEQ ID NO: 93677 - protein, 282 aa, Aspergillus nidulans FGSC A4
MQLRDASIAEKRAQLKESLATGKQLDPSIANDRKLREDFKFDESLPTADKKDKDADLLDLDDEYALTSGIIDPRPIVTTSRSPSVRLGTFAKEIRLLLPTSIRLNRGNLVLPDLVASANSASLTDMVILHEHRGTPTAMTISHLPHGPTASFSLHNVVLRADIPNAARGTVSESYPHLIFEGFKTKLGKRVVQILKHLFPPREAGKVGNRVVTFVNKEDSIEVRHHVFVKTGYKDAELAEVGPRMTMRLFEIRGGSLEKGSSGDVEWALTQYTRTSRKKDYL

SEQ ID NO: 93678 - protein, 481 aa, Salmonella enterica subsp. enterica serovar Paratyphi A str.
MTIWENAMQYQLLINGVLVDGEGERQSVYNPATGEVILEIAEASPAQIDAAVQAAVNTFAEWGQTTPKARAECLLKLADSIEQNALEFARLESQNCGKPLHCVINDEIPAIVDVFRFFAGAARCLSGLAAGEYLEGHTSMIRRDPIGVVASIAPWNYPLMMAAWKLAPALAAGNCVVIKPSEITPLTALKLAALAKDIFPPGVLNVLFGRGQTVGDVLTGHEKVRMVSLTGSIATGEHILRHTAPAIKRTHMELGGKAPVIVFDDADLDAVAQGVRTFGFYNAGQDCTAACRIYAQRGIYDALVEKLGNAVSSLKMGAPEDESTELGPLSSLAHLKRVTAAVEEAKALSHIRVITGGSQTEGKGYYFAPTLLADAKQEDAIVQREVFGPVVSITVFDDEDQVLRWGNDSRYGLASSVWTQDVGRAHRLSARLQYGCTWINTHFMLVSEMPHGGQKQSGYGKDMSLYGLEDYTLVRHIMVKH

SEQ ID NO: 93679 - protein, 288 aa, Oryza sativa Japonica Group
MAAAAAACVESPDEGVEIREVWAGNLEAEIAAIRDEVDRYPYVAMDTEFPGIVCRPVGNFRTTDEFNYANLEANVNMLKLIQLGLTLSDEGGDLPRRGTGGRRCIWQFNFRGFDPRTDPSNADSIQMLRTCGIDFDRFAAEGADPIRFAELLMSSGVVLNADVQWITFHSGYDFGYLLRLLTGRNLPDNMPAFFDLIRIYFPVLYDIKHLMRFCSNLHGGLSRLGELLDVKRVGTCHQAGSDSLLTLGCYNKIKEVYFKGSTEKHAGVLYGLVIEDGVNRPPPTQPNE

SEQ ID NO: 93680 - protein, 443 aa, Salmonella enterica
IGVVGMAVMGRNLALNIESRGYTVSVFNRSREKTEEVIAENPGKKLVPYYTVKEFVESLETSRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQLAGDKAEFIEKVRRALYLGKIVSYAQGFSQLPAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYF

SEQ ID NO: 93681 - protein, 548 aa, Zea mays
MAEGMQQEAARRTRRRRDTRGVARPRSGGRGGAAKRGHVGLFHSHADWWVRSGGSTPAPAAGIWRLALVWRLTRGGHNTAAEIIPTGPSAQQLPPQAKGREKAIVLVSRHESRDGAHGGDGSGAPEFDDAKLVYFDNGATSQKPCSVMKTLDEYYRSYNSNVHRGIHALSAKATHAYEDARRKVANFVNAADSREIVFTRNATEAINLVAYSWGLSNLKEGDEIVLTVAEHHSAIVPWQFVSQKTGATLKYVGLTKENVPDIEQLKGFLSNKTKIVVVHHVSNVLGSMLPIEEIVTWSNRVGAKALVDACQSVPHMPVDVQKLGADFLVASSHKMCGPTGVGFLHGKFEILSSMEPFLGGGEMIADVFEDKSTYAEPPSRFEAGTPAIGEAIGLGAAIDYLSCIGMEQIHEYEVNTNLGPVVRAIPTIASSLLLASAFQKELGTYLYESLLSVPNVQIYGPAPSQTVHRAPLCSFNIENVHPTDIAEILDLQHSVAIRSGHHCAQILHRTLGINASARASLHFYNTKDEVDTFVDALKATVDFLTDRY

SEQ ID NO: 93682 - protein, 477 aa, Oenococcus oeni PSU-1
MTQADFGVVGMAVMGRNLALNVESRGYTVAIFNRSRSKTDDVMAKHSDKKLIPSFTIEDFVKSIAKPRRIMLMVKAGAGTDAVINELIPLLDKGDILIDGGNTFFKDTIARNARLADSGINFIGTGVSGGELGALKGPSLMPGGQKEAYELVRPIFEQIAAKATQDGKPCVTFCGENGAGHYVKMVHNGIEYGDEELIDETYNIMRNVLGLSVDEMADIFKEWNKGELDSYLIEITADILTRKDDLGSDKPIVDMILDRGNNKGTGRWSSGDALEVQVPQSVITEAVYARYISMMKDERVAASKVLNGPAKKVELPEDKKELVEKIRQALYFAKIMSYAQGFEQLRFAAKQYNWDFDYGKLAQIWRAGCIIRAGFLQNITDAYDKKPDLTNLLMDDYFKDIANKYQEAVRDVVALAVKAGVPVPALSAAVIYFDSYRSEVLPANLLQAQRDYFGAHTYQRVDKPFDQAFHYPWYAEG

SEQ ID NO: 93683 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIGSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRTGCIIRAQFLQKITDAYAENAGIANLLLAPYFKKIADEYQQALRDVVAYAVQNGIPVPTFSAAVAYYDSYRAAVLPANLIQAQRDYF

SEQ ID NO: 93684 - protein, 448 aa, Mycobacterium sp. MCS
MNGLHENLQGIFEEVARRNPGETEFHQAVYEVLQSLGPVVAKHPEYADSAIIRRLCEPERQILFRVPWVDDSGAVQMNRGFRVEFNSALGPFKGGLRFHPSVYLGIIKFLGFEQIFKNSLTGMPIGGAKGGSDFDPKGRSNGEIMRFCQSFMTELYRHIGEYTDVPAGDIGVGMREIGYLFGQYKRITNRYESGVLTGKGITWGGSLVRTEATGYGTVYFIADILKSRGESFEGTRAVVSGSGNVAIYAIEKIQHLGGTVIACSDSDGYVVDPDGIDLALLKEVKEVQRGRVADYAEMRCGRARFVHGNVWDVECDIAVPSATQNEINGADAAALVKGGCRIVAEGANMPCTPEAVKLFAEAGTVFAPGKAVNAGGVATSALEMQQNASRDSWTFDETEDKLAEIMGRIHDRCLQTAEEYGQPGNYVAGANIAGFTRVADAMLALGII

SEQ ID NO: 93685 - protein, 141 aa, Glycine max
  misc_feature (28)..(28): Xaa can be any naturally occurring amino acid
  misc_feature (78)..(78): Xaa can be any naturally occurring amino acid
  misc_feature (119)..(119): Xaa can be any naturally occurring amino acid
  misc_feature (121)..(121): Xaa can be any naturally occurring amino acid
MLHSTSLRARAKMESDALTWGDKLMLWXLSFHGFHGAKPEERTLGQKFFIDIDAWMDLKAAGKSDHLSDTVCYTEEIXMTKEVLEDSPHNLLESLAQKIAITTTNHKEISAVRVKVGKXHXYCLGVEILGRSFIFTAAEFL

SEQ ID NO: 93686 - protein, 353 aa, Aspergillus nidulans FGSC A4
MGCGMSTEDKEGKARNEEIENQLKRDKMMQRNEIKMLLLGAGESGKSTILKQMKLIHEGGYSRDERESFKEIIYSNTVQSMRVILEAMESLELPLEDARNEYHVQTVFMQPAQIEGDSLPSEVGNAIAALWQDAGVQECFKRSREYQLNDSAKYYFDSIERIAQSDYLPTDQDVLRSRVKTTGITETTFIIGDLTYRMFDVGGQRSERKKWIHCFENVTTILFLVAISEYDQLLFEDETVNRMQEALTLFDSICNSRWFVKTSIILFLNKIDRFKEKLPVSPMKNYFPDYEGGADYAAACDYILNRFVSLNQAEQKQIYTHFTCATDTTQIRFVMAAVNDIIIQENLRLCGLI

SEQ ID NO: 93687 - protein, 392 aa, Oenococcus oeni PSU-1
MNKATHPLSDRIKNIPHDPMLDFLDKVEQSDDLVDLGFGDPDFAVSKKTKEAFKTAIDADRSHYADGQGILELREAAKGFYNKKYDCRIESANDVLVTVGAAEGINLALLALANPGDGVMIVEPEYSQYSTASCLARAAKIPIDTKQTAFKLTPELIKNAYNDAISKGINPIAIVINYPNNPTGITYNRSELNALANVFRELKIWVLSDEIYAEQTYIGNHVSLYSILPEQTILITGLSKSHSMTGYRLGFVISHGQVMKAMRKIHDTLLTCVATPIQDAAAFALKNDPDAGVKTRSTYLERVTKVTNALNALGFQVKLPQGAFYVWAKIPDKFGDDADNFCLDLAQRARVQIFPGSIFSDTAKNYVRISCAGSDARLDSALRRITDYLQNC

SEQ ID NO: 93688 - protein, 121 aa, Brassica napus
KEDWEHTKYFSNLGICQVVGDDLLMSNSKRVERAIQESACNALLLKVNQIGTVTEAIEVVKLARDAQWGVVTSHRCGETEDSFISDLSVGLATGVIKAGAPCRGERTMKYNQLLRIEEEPG

SEQ ID NO: 93689 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIGSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSALRAASDEYHWDLNYGEIAKIFRAGCSIRAQFLQKITDAYSENAGIANLLLAPYFKKIADEYQQALRDVVAYAVQNGIPVPTFSAGVAYYDSYRAAELPADLSQAQRDYF

SEQ ID NO: 93690 - protein, 393 aa, Oenococcus oeni PSU-1
MSNFILPLNKTVDNLRRDPILDFQAKIRNIDDLIQLTFGEPGFTVDDRIKAVAKVSIDHDRSHYANSQGEINLRRAAVSYFNRHFQLNLKGVNDVLVTQGVSEAINVVFMTILERGDGVIIPEPSYSPYSTSLALAGGVKVPLDTCEHNFKITPELIEKTIDNANIPVKAILINYPANPTGVTYSKEELLAIADTLKKHKIWVISDEIYAALTYSGEHTSLYKIIPEQSILLTGLSKSHAMTGYRIGFIFASSELIEKMLTVHEALAFAVSTLSQDAAFAALTVGEDVPEYALKAYRKRRDRLLKKLTELGFESVNPQGAFYVFTKIPKSFGNNGYKFAVDLANNAKVAVLPGEAFSKNAKNYIRISYASSDSDLDEALRRMTNYIEKGTKYE

SEQ ID NO: 93691 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGVGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAKRVAASKVLSGPKAQPAGDKAEFIGKVRRALYLGKTVSYAKGFSQLAARSDEYHWDLNYGEIAKIFRAGCIIRAEFLQKITDAYAENAGIANLLLAPYFKKIADEYQQALRDVVAYAVQNGIPVPTFSAAVAYYDSYRAAVLPANLIQAQRDYF

SEQ ID NO: 93692 - protein, 434 aa, Mannheimia succiniciproducens MBEL55E
MNNAVLNQPNKYDLVKDTLVLILAGGRGSRLHELTDKRAKPALYFGGNRRIIDFALSNCINSGLNRIGVITQYAAHSLLRHLQTGWSFLPQERGEFVDMLPARQQIDDNTWYRGTADSVYQNLAIIRGHYKPKYVLILAGDHIYKMDYSQMLLDHVSSGAKCTVGCIEVPREEAKEFGVMAVNETLKVKAFVEKPQDPPAMIGKPNSSLASMGIYVFNADYLYEALDRIKTPNTSHDFGKDVMPLALNDGVLYAHPFDRSCKGRNTEGAIYWKDVGTLDSFWQANIDLVSEEPQLDIYDQTWPIRGNPVQAYPSKFFYDEPNCKQVDNSLIAGGCMVKNASISYSVLFDNVSVNAGSSIEQSVILPQVKIGKNCMLRRCIIDRHVQIPDGMQIGVDLELDSKRFRISKNGIVLVTESMLHKLNGKSVASEAHLD

SEQ ID NO: 93693 - protein, 116 aa, Oryza sativa Japonica Group
MSTTVTRAHLEQRLALAKRCSREANLAGVKAAAVATIASAVPTLASVRMLPWAKANINPTGQALIICTAAGMAYFVAADKKILSLARRHSFENAPEHLKNTSFQGTGRPHPAFFRP

SEQ ID NO: 93694 - protein, 1230 aa, Cryptococcus neoformans var. neoformans JEC21
MSSFTPAFRLHHTHSSSVSPTASNDVAPSSPTPNQPHQLAARSPLYATSPNCASKITKGSSLSSSTAHHGLKYVRPSTSPLLRSPKGESFSAYLGNWGSQELITFLNIHKCGQYLAIFQKNDINGKILLDLDMTALKSMGIGKISERVRLIGGIKDLRRCVADESIRAPFTQRSYPSERTLLPSLPSHSNVLLDKWDCSSSASRLGKRQITLRPPPLDLQGHMPPRLLSHASLGIATIDTHDIHTTNSKIEVYIQQNPPGQPQSMPTKRSDSLTLCAAPSRNVGRRSPSSRHFEGCKSQTDGLTTLNLTLDRQVPSSTMNNVTLREDCHLQREERLPLSHQVPHSRNAFASPHKTSLSGRCPLARGDTTSHQPSGPAIAEQDSPVNYRISNTVTNTKEISQGDLKQPFVMKSLESQSHLLAGVSDMSHDPVTDGFKPKGKASVPLTVMSSSDISAVNANPAALSLADLRRQLVKFINTEDDTIRTVNVMHVTSGVEILERALKKFGKFGTGIHGSPDVYGDEDGDGTLEIDGWEVYTESTPDESSKPLSEFNLLKTCTFHREGTAIQDKGLFLRKKQRMQKRKNIQDFFGETPPPSMSPTSPTLITGPHLSLVQGKSQPTSGSAFSSSSRLSTLTHKGRNRASMISVMSGLGVPIINTLPSPQGNGLRLTGSVHSHEKKSMYNFFGHRPPSELISNHLTDYFPSAKKSDVEKARHSLLRLSGGTVAYKKSGIYEGDSTPDHWSKPGDNQPPSLPPFEPSQDTLSDSLQAFASSTPVHLSRPKHTVALRRRRDSDSSSRSHTSMLMQTRRNRDHSDTTSLLTVDEITAEVENRRVSTIQRGDYIEETEDSSSIEGDTLPQDDESKGVLRAICSDSNKLVDSGKSYQGDSDIDQQHELEDEEEDKLDDDEEEEEEEEEEDNEQGKAFTSTGSKRIIKWIKGALIGAGSFGSVYLGMDAQSGLLMAVKQVELSAGSAKNEDRKRSMLSALEREIELLKELQHENIVQYLDSSVDANHLNIFLEYVPGGSVAALLNNYGAFEEALVRNFVRQILTGLNYLHMRGIVHRDIKGANILVDNKGGIKISDFGISKKVENSLITGLRTNRPSLQGSVFWMAPEVVKQTSYSPKADIWSVGCLVVEMLTGTHPWADLTQMQAIFRIGSLARPAPPSDISVQADEFLRKTFEIEHAKRPTAAQLLKHPFIGSPRVRTAASNFINGAIASETMEVQVVEES

SEQ ID NO: 93695 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENADIANLLLAPYFKKIADEYQQALRDVVAYAVQNGIPVPTFSAAVAYYDSYRAAVLPANLIQAQRDYF

SEQ ID NO: 93696 - protein, 352 aa, Bacillus anthracis str. Ames
MTIDRVCTIGPASNNKETLAKLINNGMKIVRLNLSHGTHESHKDIIRLVKSLDDSIKILGDVQGPKIRLGEIKGEQITLQAGDSFMLRTQPVTGSSTEASVDYEGIANDVKVGSRILMNDGEVELIVEKVSTDKIETKVKTGGNISSHKGVNLPGAIVSLPAITEKDKKDIQFLLEEDVDFIACSFVRKPSHIKEIRDFIQQYKETSPNLIAKIETMEAIENFQDICKEADGIMIARGDLGVELPYQFIPLLQKMMIQECNRTNTYVITATQMLQSMVDHSIPTRAEVTDVFQAVLDGTNAVMLSAESASGEHPVESVSTLRLVSEFAEHVKKDGPFVMKDVLELLHKSLDE

SEQ ID NO: 93697 - protein, 395 aa, Pseudomonas fluorescens PfO-1
MTAALMNTYQPLDLSFIKGLGTRLWDLSGREYLDAVAGVAVTNVGHSHPRIVSAISEQAGLLLHTSNLYSIDWQQSLARKLTQLAGMERAFFNNSGAEANETALKLARLYGWHKGIEQPLVVVMANAFHGRTLGTLSASDGPAVRLGFNELPGDFVKVPFGDLEALEQVQRKHGQRIVAILVEPIQGESGVQLAPPGYLKALRELCNRHAWLLMLDEIQTGIGRTGRWFAFQHEGIVPDVMTLAKGLGNGVPIGACLARGRAADLFTPGSHGSTFGGNPLACRVGCTVLEIIEEQGLLENARVQGERLLTRLRAELADNPNVLAIRGQGLMIGIELKQPIRDLTLIAARDHGLLINVTRGKTIRLLPPLTIDEREVGMIVRGVGRSLSHVSSLGQ

SEQ ID NO: 93698 - protein, 347 aa, Pichia stipitis
MSIPTTQKAVIFETNGGPLLYKDIPVPKPKPNELLINVKYGVCHTDLHAWKGDWPLDTKLPLVGGHEGAGVVVALGENVTGWEIGDYAGIKWINGSCLQCEYCVTAHESNCPDADLSGYTHDGSFQQYATADAIQAARIPKGTDLALIAPILCAGITVYKALKTAQLQAGQWVAVSGAAGGLGSLAIQYAKAMGYRVVGIDGGADKGEFAKSLGAEVFVDFLSSKDVVADVLKATNGGAHGVINVSVSERAMQQSVDYVRPTGTVVLVGLPAGAKVSASVFSSVVRTIQIKGSYVGNRADSAEAIDFFTRGLIKCPIKIVGLSELASVYELMEQGKILGRYVVDTSK

SEQ ID NO: 93699 - protein, 276 aa, Zea mays
MLLMLHETLPFVRPSSCRDPKLSEKSASALHGKLGCSAVCSSAEGHRVQKPHIVHSYKVSFTRTSHHLCKSLNERTTRHCLHRFHVNASPDDDDFRSSRNIAISLFKRYKNVIDRGGGENLNEFVSAGVTAYALGCTDEGLRKELMDIEDSGLEIEGLGSLGGTSLKFKVHSFEIRECILWLSIVFVTILCTPQLTVIRWSPNPPVSADVLHQWKGFCALIANAYYVKGMAWLPVKTLQLEQMAVTGSSEKPSVVASRMQLVFSTLEVVSPQWPRV

SEQ ID NO: 93700 - protein, 405 aa, Triticum aestivum
NKFVQKSRLVPVRNSRDIVDPRVRRKGDLFLVRGGMRSVEFKVIETDPAEYCIVAPDTEIFCDGEPVKREDEERLDDVGYDDVGGVRKQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLAEDVELEHISRDTHGYVGADLAALCTEAALQCIREKMDIIDLEDETIDAEILNSMAVTNDHFKTALTTSNPSALRETVVEVPNVSWEDIGGLENVKRELQETVQYPVEHPEKFEKFGMSPSKTKNMKLAEDVELEHIS

SEQ ID NO: 93701 - protein, 229 aa, Thermotoga sp. RQ2
MGGKTKKHAMRLFDRIAERYDFLNRIISFGMDTKWRKRVVELILEVNPEKVLDLATGTGDVARLLKRKAPHLEITGLDSSSKMLEIAEKRLKDGEFIVGDAHNLPFYDRSFDAITVAFGFRNFSDRRRVLRECRRVLKRKGRLVILELLPPNTKRFTGKIYSFYLKTWVPFVGGLLSGDFHAYRYLSTSVLNFLRPDQIVEMMKEEGFKASFEPLFFSVAGIFIGDLIL

SEQ ID NO: 93702 - protein, 516 aa, Oryza sativa Japonica Group
MGMEVAAARLGALYTTSDYASVVSINLFVALLCACIVLGHLLEENRWVNESITALIIGLCTGVVILLMTKGKSSHLFVFSEDLFFIYLLPPIIFNAGFCLLEFYSWSIYSAAIAIFSRMNIGTLDVGDFLAIGAIFSATDSVCTLQVLNQDETPFLYSLVFGEGVVNDATSIVLFNALQNFDLVHIDAAVVLKFLGNFFYLFLSSTFLGVFAGLLSAYIIKKLYIGRHSTDREVALMMLMAYLSYMLAELLDLSGILTVFFCGIVMSHYTWHNVTESSRVTTKHAFATLSFIAETFLFLYVGMDALDIEKWEFASDRPGKSIGISSILLGLVLIGRAAFVFPLSFLSNLTKKAPNEKITWRQQVVIWWAGLMRGAVSIALAYNKFTRSGHTQLHGNAIMITSTITVVLFSTMVFGMMTKPLIRLLLPASGHPVTSEPSSPKSLHSPLLTSMQGSDLESTTNIVRPSSLRMLLTKPTHTVHYYWRKFDDALMRPMFGGRGFVPFSPGSPTEQSHGGR

SEQ ID NO: 93703 - protein, 472 aa, Silicibacter pomeroyi
MTIAIPFDNSYARLPGGFYTAQAPQPVRAPRLVAFNADLARLLGIAPGEVEEMAQVFAGNAVPQGAEPLAQLYSGHQFGNYNPQLGDGRAILLGEVLGSDGIRRDIQLKGAGRTPYSRGGDGRAWLGPVLREYVVSEAMAALGIPTTRALAAVETGETVRRESALPGAVLTRVAQSHLRVGTFQVFAARGEIAHLKRLTDYAIARHYPDAQGPMGLLAAVRDAQARLIARWMGVGFIHGVMNTDNSSIAGETIDYGPCAFMDTYHPDTVYSSIDRYGRYAYSNQPDIAVWNLAQLATALIQQAEDKEAVVEEATEIVHAMPELLERAWLEVFAAKIGIARPGEGDKALVSELLTRMAREQADFTNTFRALGAPRARDQFTDPTAYDSWAEDWRQRLTQEATPEAVIRAANPAFIPRNHRIEQMITAAVEGDYTLFERLNTVLARPYADQPDHIDLTRPPSASEIVPATFCGT

SEQ ID NO: 93704 - protein, 358 aa, Saccharophagus degradans 2-40
MLQLLVEFFSLTENQAYNNMSSKYTVTVLGGGSFGTAVANIIATNGHVSRLWMRDAARAERCQASRENTEYLPGYPLHDNLVATTDLIGSVSTSDIVVISVPSQSFREVAKLAAPHLRKDTIVISTTKGIDADGFFLMSQILEQELTDVRIGVLSGPNFAKEIVQNQYTGSVVASEHDEVLKCVQQVFSSNTFRIYSNPDRYGVELGGALKNIYAMVTGMAAALGCGHNTMAMLLTRSLAEMGRFARELGADSMTFLGLAGMGDLVLTCTSDLSRNYRVGFAVGRGKSLEQAVQEIGQVAEGVNTLRIVKKKAEELNVYMPLVDGLHAVLFDKQDLQQVIQGLMTGEMSSDVDLQGGL

SEQ ID NO: 93705 - protein, 251 aa, Robiginitalea biformata HTCC2501
MAKSKILKKRNIMILDSAEDKVEQLNKMAHFDAFEKLEDCVPQADMIFVAVKPHHSKSLFEDMAGLTTKGQIIISIMAGVSIDFIRKATGLKKIVRAMPNLPAQVGKGLTSYIASDEVSRIESLTIEDLLNTTGKSILVSKEKYIDASTGISGSGPAYVFYFMQSMMEAALQMGFSANDSKVLVSQTFEGAIELFNQSDLTPDGWMKKVASKGGTTQAALDSMEDNKLNELIKEAAFAAFNRAVELGEAHV

SEQ ID NO: 93706 - protein, 388 aa, Saccharophagus degradans 2-40
MNLHEYQGKQLFAEYGLPVSKGIAAETPAEAAAAADIIGGDKWVVKAQVHAGGRGKAGGVKLVSSKAEIEEFAKKWLGNNLITYQTDENGQPVSRILVESCTDIADELYLGAVVDRSTRRVIFMASTEGGVEIEKVAEETPEKILKAIIDPLTGAQPYQARELGFKLGLNPVQIKQFTQIFLGLAKMFVDKDLALLEINPLVITDEGNLHCLDAKVAIDGNAMYRQPALKEMHDPSQEDEREAHAAKWELNYVALDGNIGCMVNGAGLAMGTMDIVKLHGGQPANFLDVGGGATKERVVEAFKIILSDDNVKAVLINIFGGIVRCDLIAEGVIGAVEEVGVKVPVVVRLEGNNAELGAKVLADSGLNIIAAESLTDAAVQVVKAAEGK

SEQ ID NO: 93707 - protein, 534 aa, Solanum lycopersicum
MGLDAVARLGVSILSDGDQVSVDSITLFVALLCGCIVIGHLLEESRWINDSITTLVIGLSTGGIILLTTKGKSSHLLEFDEQLFFIYVLPPIIFNAGFQVKKKQFFRNFVTIMLFGAVGTLISFSIISFGAKELLGKLDIGFLELRDYLAIGAIFSATDSVCTLQALNQDETPRLYSLVFGEGVVNDATSVVLFNAIQKLDLSHINSRAALVFTGNFLYLFLASTFLGVLIGLLSAYLIKKIYLGRHSTDREVALMILMAYLSYVMAELFDLSGILTVFICGIVMSHYTWHNVTFNSKVTTRHAFATLSFIAEIFIFLYVGMDALDIEKWRFVKDSPGKSVGVSAALLGLVLVGRACFVFPLSLFSNCLKRSEHDKFGLKLQVTIWWAGLMRGSVSMALAYNQFTRFGHTQQPGNAVMITSTITIVLFSTVVFGLITKPLVRFLLPSSQGFNNLISSEQSFARPLLTNEQELELEMGNVDPVRPSGLSILLKEPSYTIHNHWRRFDDAFMRPLFGGRGFVPDAPELSKGGCDQY

SEQ ID NO: 93708 - protein, 709 aa, Shewanella sp. MR-4
MEKTFNLTRREDGIAILTMDVPGETMNTLKAEFGPEISEILSEIKRDSSIRGLVLISGKKDSFVAGADISMLDACQTAGDAKALSQQGHVVFNELEALNIPVVAAIHGACLGGGLELALACHQRVCSDDGKTMLGVPEVQLGLLPGGGGTQRLPRLVGITTALDMMLTGKQIRPKQALKMGLVNDVVPQTILLQTAVEMALAGKRTAKPVKKSLVNQLLEGTGFGRNIIFDQAAKQVAKKTQGNYPAPAKIIDCVRQGMAKGMQKGLEVEASHFAELVVSKESEALRSIFFATTEMKKETGAEGATPRKVKKAVILGGGLMGGGIASVTTTKAKIPARVKDINEKGLSNALSYAYKLLDKGVKRRHMTPAVRDNLMALMTTTTEYKGVKDADIVVEAVFEDLALKHQMVKDIERECGEHTIFASNTSSLPIGQIAQAASRPENVIGLHYFSPVEKMPLVEVIAHAKTSPETIATTVAFARKQGKTPIVVQDGAGFYVNRILALYMNEAAQLLLEGQSIEHLDKALVKFGFPVGPITLLDEVGIDVGAKIAPILEKELGERFKAPAAFDKLLSDDRKGRKNGKGFYQYAAGNKAPSKKKAVDESVYGVLGIKPGIDKEMSAVAERCVVQMLNEAVRCLDDGIIASPRDGDIGAIFGIGFPPFLGGPFHYIDTLGADNLVKILERYQAQYGDRFEPCPRLKEMAAEKTRFF

SEQ ID NO: 93709 - protein, 444 aa, Neisseria meningitidis FAM18
MTDLNTLFANLKQRNPNQEPFHQAVEEVFMSLDPFLAKNPKYTQQSLLERIVEPERVVMFRVTWQDDKGQVQVNRGYRVQMSSAIGPYKGGLRFHPTVDLGVLKFLAFEQVFKNALTTLPMGGGKGGSDFDPKGKSDAEVMRFCQAFMTELYRHIGADTDVPAGDIGVGGREIGYLFGQYKKIRNEFSSVLTGKGLEWGGSLIRPEATGYGCVYFAQAMLQTRNDSFEGKRVLISGSGNVAQYAAEKAIQLGAKVLTVSDSNGFVLFPDSGMTEAQLAALIELKEVRRERVATYAKEQGLQYFENQKPWGVAAEIALPCATQNELDEEAAKTLLANGCYVVAEGANMPSTLGAVEQFIKAGILYAPGKASNAGGVATSGLEMSQNAIRLSWTREEVDQRLFGIMQSIHESCLKYGKVGDTVNYVNGANIAGFVKVADAMLAQGF

SEQ ID NO: 93710 - protein, 354 aa, Bacillus halodurans C-125
MKALNLYGIQDLRFEETPAPSIEHDDDIIIKVKAVGICGSDLSRYKKLGPYVPGMTFGHEFAGEVVKIGRSVTGFSIGDRVAACPTYTCGQCRYCQLGEPTRCERLSVIGARHPGAYAEYVKLPAKHVIPLPNVVNYDEAALIEPASVVAHGFYRTNIKPGASVAIMGVGSIGLLAVQWAKIFGATTVFAIDIDEQKLNVANQLGADVLISSLQRPAHKQILEYTNGIGVDVAVESAGTPSTSAQVFALPKKGGEVVFLGIPYADVQIERFYFEKIVRNELHVYGSWNALSSPFPGKEWATTIHYMSSGQLNVAPMISYRLPLAKGPETFQQIAKGELKPTKVLFYPEKLSERK

SEQ ID NO: 93711 - protein, 484 aa, Saccharophagus degradans 2-40
MSNKYDVIVIGSGPAGYVAAIRCAQLGLKTACIEKWKDKDGKGVNGGTCLNVGCIPSKALLDSSHRYEDAHKGFASHGIKAPNVEIDVPSMIARKDKIVKQMSGGITGLFQANKVTSLYGTGKLLAGRKVQYVALDGKEEVLEAENVILASGSIPVNIPVAPADGDVIVDSTGALEFQAVPERLGVIGAGVIGLELGSVWGRLGSKVVCLEAMDSFLAMMDQQIATEAKKILVKQGLDIRLSCRVTGTEVVEAKGKKEVIVTYTDKDGNEAKETFDKLIVCVGRRPFTDGLLSEDSGVKLDERGSIYVNDLCSTSAPGVWAVGDVVRGPMLAHKGSEEGVMVAERIAGQKTVMNYDIIPNVIYTHPEIASVGKTEEQLKADGEAYEVGTFPFLAIGRAVAADCAEGMVKMIAHADTDRVLGCHIVGPNAADLVQQVAIAMEFGATSEDIGMTVFGHPTFSEAVKEAALAVHGHAIHMPNRKKRK

SEQ ID NO: 93712 - protein, 531 aa, Solanum lycopersicum
MEDHLQISPAGAKAIPGKEQQAAGYGILLQIMMLVLSFVIGHVLRRRHFYYIPEASASLLIGLIVGGLANVSDTETSIRAWFNFHEEFFFLFLLPPIIFQSGFSLSPKPFFSNFGAIITFAILGTFIASFVTGILVYLGGVTYLMYRLPFVECLMFGALISATDPVTVLSIFQELGTDVNLYALVFGESVLNDAMAISLYRTMSLVRSHMSTDQNYFMITIRFVETFMGSLSAGVGVGFVSALLFKYAGLDIDNLQNLESCLFVLFPYFSYMLAEGLGLSGIVSILFTGVVMKRYTYPNLSESSQRFVSAFFHLISSLAETFVFIYMGFDIAMEKHSWSHVGFIFFSILFIVIARAANVFGCAYLVNLVRPPHQKIPAKHQKALWYSGLRGAMAFALALQPVHDLPEGHGQAIFTATTAIVVLTVLIIGGSAGTMLEALEVVGDGQSGSMDETFEGNNGYIAPSYRDESYDGEPSSGNRFRMKLKEFHKSTTSFSALDKNYLTPFFTTQGGDEDEDEPIMHSSRRAGYDGH

SEQ ID NO: 93713 - protein, 96 aa, Glycine max
MDSGNTQTDGSQPAAPKNPAMTSCRKKKTDDDVTFLEDVKEHIDEFVHASMDEHKTCFKKTIQKMFGMSKVVAERSAAAKEAEVESALPLQTSVSQ

SEQ ID NO: 93714 - protein, 343 aa, Bacillus halodurans C-125
MKALVKTQHGTGHFAVQEKPEPTPGKHQVKIKVKYTGVCGSDIHTYEGHYPVAAPVTLGHEFSGEIVELGEGVTGFNVGDRVTSETTYSICGKCSYCTSGDYNLCSHRKGLGNQQDGSFAKYVIARQESLHHLPAGVDDRSAAMTEPLACTHHAIAKTSINKGDLVVVTGPGPIGLLAAQVAKSHGGTVIITGLSNDQVRLKKAKEVGIDYAIDTQEVDIKELVSELTDGYGADVVLECSGAVPAAKQGIDLLRKKGQYAQVGLFAQPEIQFNFEKIIQKEISVVGSRSQKPADWEPALSLLNEKKVNAKTLVTHEYTISEWDKAYHAIKSGEAIKVLLTPID

SEQ ID NO: 93715 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKKQPTGDKAEFIEKVRRALYLGKIVSYAQGFSQLRAASDEYHWDLNYGEIAKIFRAGCINRAQFLQKITDAYAENAGIANLLLAPYFKKIADEYQQALRDVVAYAVQNGIPVPTFSAAVAYYDSYRAAVLPANLIQAQRDYF

SEQ ID NO: 93716 - protein, 443 aa, Salmonella enterica
IGVVGMAVMGRNLALNIESRSYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLRGGLNLSNEELASTFTEWNNGELSSYLIDITKDIFTKKDEDGNYLVDVILDEAANKGTGKWTSQSALDLGEPLSLITESVFARYISSLKAKRFAASKVLSGPKAQPVGDKAEFIGKVRPALYLGKTVSYAQGFSKLRAPSDEYHWDLNYGEIAKIFRAGCIIRAQFLQKITDAYAENAGIANLLLAPYFKKIADEYQQALRDVVTYAVQNGIPVPTFSAAVAYYDSYRAAVLPANLIQAQRDYF

SEQ ID NO: 93717 - protein, 569 aa, Physcomitrella patens subsp. patens
MRVRSPSVSDGYEESFSSSPSFANRNVELAAYAHDSDASVFLPKSVTLSHVEEPKEDVVETHEHGKQTVDAAGAWISQAWRFLVQPFRWISMLCRELDGTFVFGVMVVYGISQGIGYALSRVVVDYYWRDVQGKEPSTVQFYRGITVIPWDVKPLYGLLTDLLPFFGYHRRPYFILAGLITLSTYLSLVLGGKFLASTALAMFVGASAAAAIADVTIDALVAMKSREKPELGTHIQSLCGSCSSIGSLSGFLLSGLAVHIFGSQGALGVMIVPGILLLILGFTINEPRLPRHLWRSGQVGKQMKQACSTMWATLKIPQVWQPTIYMYLSWALSPDISEGKFYWYNDFVVGPGFSEEFVGVIYAMGSVGTLLGVGIYHKYLRHWTFRTLLMWAQVLLALSGMLDLVMVTRVNRKLLIPDTVFAVVDEGVSSAIGRIKWMPLLVLAARLCPPGIEGTFFALLMSIDNLGTLSSSWVGSVILRLTGIRRTNFQFLWLTVLIRNGMRLLPLPFLFLVPNTDPEQPLLPPDILGYAEPTLHDVLEGESEDEEDTETVKLAVLAPPSGDNQVEHP

SEQ ID NO: 93718 - protein, 447 aa, Prochlorococcus marinus str. MIT 9215
MKLPDINNSNIAILGMGYVGLPLAVEFGKNKNINKSGLRKIIGFDIDESRINQLKLGFDKTGEISKDEIDQAKILNFNSNISSLLDIDIFIVTVPTPIDSLKNPNFSPLENACKMIGKILLERNLKLERKDIQPIIVFESTVYPGATEEICVPIIESNSNLRFNSDFFVGYSPERINPGNSAYKLTNIVKVTSGSTPYVAEKVDMLYRMIIKAGTYLAPSIKVAEAAKVIENTQRDLNIALINELAIIFNKIGIDTHDVLKAASTKWNFINFRPGLVGGHCIGVDPYYLTYKAKELGYYPEVVLAGRKINDSMANWIAKEIIAELYKRNLNLDDKDVLVLGITFKENCPDIRNTKVIDLINELERYNFKIRVVDPIADINETYRSYKINIEKEIPLDKKFDIIISAVAHNAFIQEDINFWKNLIKKENSIFFDLNNLIPRDLNPLRL

SEQ ID NO: 93719 - protein, 341 aa, Prochlorococcus marinus str. MIT 9215
MKILITGCAGFIGYHLSKRLIQEKYHVVGIDNLNNYYDPNLKKARLEELNKLAKEKNQEFNFDSFGIENSNLLEDFFKKYKPSRVINLAAQAGVRYSIENPSAYIQSNIVGFCNILELCRHTEVKHLVYASSSSVYGGNTKMPFSEEQSVAHPVSLYAASKKSNELMAHTYSHLYNLPATGLRFFTVYGPWGRPDMALFLFTNAILSGKKIQVFNQGNMIRDFTYIDDIVESLFRLIFKEAKPDENFDTSKPSLSTSWAPHRIFNIGNSKPVQLMEYINALENSLGVSAIKEFLPMQPGDVPATSADTSALEDWIGFKPNTAITDGINRFVDWYRNFYSVF

SEQ ID NO: 93720 - protein, 301 aa, Sulfitobacter sp. EE-36
MRDFDIICIGEPLVEFNQIKGTQWHQGFGGDVSNVAIGAARLGARSAIATRLGDDGFGQELRNLWSREGVDASCVATDASAPTGLYFVRHGSDGHRFEYRRAGSAASRMTADSLPVEAIERARFTHLSGITLAISASARDAGLDAMRIARAAGRQVSFDPNLRLALWPLEQARSVIIQALGLADIALPGLDDARQITGLDTPEDIVRAFHKMGPDIVALTLGEDGALLGHAGTITHIPGVRVTALDATGAGDCFDGAFLTRLSKGDTPEAACRYAVAASALSVQGYGAVAPLPTVADMAAG

SEQ ID NO: 93721 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKGKRVAASKVLSGPKAQPAGDKAEFIEKVRRALYLGKIVSYAQGFSQLRAASDEYHWDLNYGEIAKIFRAGCIIRGEFLQKITDAYAENAGIANLLLAPYFKKIADEYQQALRDVVAYAVQNGIPVPTFSAAVAYYDSYRAAVLPANLIQAQRDYF

SEQ ID NO: 93722 - protein, 353 aa, Coccidioides immitis RS
MPATTADTLSLVTRTVSVAPLVLLSVADHYGRTAKGTRRRVVGVLLGQNDGKNVRVSNSFAVPFEEDDKDPSVWFLDHNFVESMNDMFKKINAREKLIGWYHSGPKLRASDLEINELFKRYTPNPLLVIIDVQPKEVGVPTDAYFAVEEIKDDGTTTSKTFVHTPSIIEAEEAEEIGVEHLLRDIRDVAVGTLSTRITSQLQSLQGLHLRLRDIGQYLQKVLDRELPVNHAILGNLQDIFNLLPNLAAAKQRSSGNASEQPQIENTELARAMNMKTNDQLMSIYISSLIRAITAFHDLIENKIQNRQQQEEQEAKLEEGKDEKAVTNGNTEEKKKNNSEPKDESDSSKNKKKG

SEQ ID NO: 93723 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGVGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAKRVAASKVLSGPKAQPAGDKAEFIGKVRRALYLGKIVSYAQGFSQLPAASDEYHWDLNYGEIAKIFRAGCINRGEFLQKITDAYAENAGIANLLLAPYFKKIADEYQQALRDVVAYAVQNGIPVPTFSAAVAYYDSYRAAVLPANLIQAQRDYF

SEQ ID NO: 93724 - protein, 509 aa, Oceanobacillus iheyensis HTE831
MDYIQELQQRIEKIEKGGKQKYHDSNTDKGKLFARKRIELLFDQDINVEDALFANHSAEDLPADGVITAIGKINGQTVCVMANDSTVKAGSWGKRTVEKILRIQETAEKMEVPILYLVDSAGARITDQVEMFPGRRGAGRIFYNQIKLSGRVPQICLLFGPSAAGGAYIPAFCDIVVMVDGNASMYLGSPRMAEKVIGEKVTLEEMGGANMHCSVSGVGDVLVESEEEAIAFARTYLDYFPANFRQKPLPKEARLPKQQDKTIEEIIPTNQNAAFDMYELINRTIDEDSFCEIKKKFAPELITGLARLNGKSVGIIANQPRVKGGVLFTDSADKAAKFIQLCDAFEIPLLFLTDVPGFMIGTGVEKQGIIRHGAKMLFAMSEVTVPKISVIVRKAYGAGLYAMSGPAFEPDCCLAFPNAQIAVMGPEAAVNAVEANKIAKLPEEERAAFIKQKQDEYKENIDVYRLASEMVIDDIINPNELRQELIQRFSIYENKKMTFTERKHGVYPV

SEQ ID NO: 93725 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGPDGAGHYVKMVHNGIAYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVPASKVLSGPKAQPAGDKAEFIGKVRRALYLGKTVSYAQGFSQLPAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYF

SEQ ID NO: 93726 - protein, 264 aa, Mycobacterium avium subsp. paratuberculosis K-10
MTAMTAGTPAPDSAGDRETELTHALAAVRSRLAAAAEAAGRNVAEIEVLPVTKFFPATDVVTLSRLGCRAVGESRDQEATAKVAEVTRLLATSARTNVAIPRWHMVGHIQRNKARSVARWAHTAHSVDSTHLVSALDRGVAAALADGGRTDPMRVYVQVSLDGDESRGGVDISRPGAVDEVCAQVAAANNLDLVGLMAIPPLNSDPDEAFDRLQSEHRRVLETHRNAVGLSAGMSDDFEIAVKHGSTCVRVGTALLGRRPLPSP

SEQ ID NO: 93727 - protein, 532 aa, Physcomitrella patens subsp. patens
MASAHSHTRRWWSQEAHGIRVSGEGTIATLLISSLVIYVTVVYQRRKKLPPGPWPWPVVGNLAVLAGLPHRNLQNLAAKYGGLMYLQLGQVPCLVVSTAAAAKELFRTHDVIFSYRPKRLDHEIISGKSYKSLTSAPYGPYWRQIRRICNTELFSPAIHASHVSVRSEEIHSMMKVLLAESRTEKAIDLKSWLTGVTANNMTRMLINKRFFGTGVSDQQEKKDFEEIFDHIFAAAGTFFISDFIPKLRFVEMLQGKIAKLTAFRKFLHSVIGKIFEVEKHRQRALERGNDPIYVPDFVDVLLNTPLDNGERLTDREIISILSSMIGAGTDTTATTVVWAMSELMVNPKIRKQAQEELDAVVGDSRLVEESDIPNLPFLRTIVKETFRLHAPVPLSLPRCSEQPCEVAGSQFPANTRLILNVFAIHRDPIVYENPDSFQPSRFVDHPEVDHMSGKDFYGLIPFGAGRRMCPGYHLGNVMVSLMLAHLLHSFDWRLPAGVTEENLDMSETYKLVGLRKKPLFLIAKPRSPAYLY

SEQ ID NO: 93728 - protein, 285 aa, Nicotiana excelsior
MENKEEDVRLGANKYSERQAIGTAAQSDKDYTEPPPAPLFEAGELTSWSFYRAGIAEFMATFLFLYITILTVMGVSKSESKCSTVGIQGIAWAFGGMIFALVYCTAGISGGHINPAVTFGLFLARKLSLTRAVFYMVMQCLGAICGAGVVKGFGKTLYQTKGGGANVVNHGYTKGSGLGAEIVGTFVLVYTVFSATDAKRSARDSHVPILAPLPIGFAVFLVHLATIPITGTGINPARSLGAAIIYNQDHAWDDHWIFWVGPFIGAALAALYQQVVIRAIPFKSK

SEQ ID NO: 93729 - protein, 172 aa, Prochlorococcus marinus str. MIT 9215
MLSDKLKDKIGNYQDFPTTGILFRDITPILRDQKLFSELIEKMSESDILKKADCLVAIDARGFIFGSSIALNLSKPFILARKPGKLPGELIQSSYKLEYGENSLVFQLDSLKNFKSFGIIDDLLATGGTVNAVANLLNQKNKIITGLSVVVELTELNARSNFNFEVSSEVKY

SEQ ID NO: 93730 - protein, 307 aa, Oceanobacillus iheyensis HTE831
MRVVNDVTELIGQTPMVKLNRLQPENAADIYVKLEMFNPSGSVKDRAASHMIRVAEEQGLIKQGATIIEPTSGNTGIGLAMAASAKGYKAIMIMPDNSTMERRNILKAYGAEVVLTPSEEKMPGSIRKALELQKSIPNSFIPQQFENVANPDVHRISTALEILEQMDNQLDAFVCTAGTGGTVTGTGETLKEKLPHVHVAVVEPEGSPVLSGGKPGPHKLVGTSPGFVPDILNTDVYDEIIQIKDEQAVTLLKDLAQKEGIFLGPSGAAAVYAAMEVAKKLGPNKKLVCIAPDTGERYLSMDMFDEK

SEQ ID NO: 93731 - protein, 287 aa, Nicotiana excelsior
MAENKEEDVKLGANKFRETQPLGTAAQTDKDYKEPPPAPLFEPGELSSWSFYRAGIAEFMATFLFLYITILTVMGLKRSDSLCSSVGIQGVAWAFGGMIFALVYCTAGISGGHINPAVTFGLFLARKLSLTRAIFYMVMQCLGAICGAGVVKGFMVGPYQRLGGGANVVNPGYTKGDGLGAEIIGTFVLVYTVFSATDAKRNARDSHVPILAPLPIGFAVFLVHLATIPITGTGINPARSLGAAIIYNDEHAWDDHWIFWVGPFIGAALAAVYHQIIIRAIPFHKSS

SEQ ID NO: 93732 - protein, 339 aa, Thermotoga maritima MSB8
MKVVTFGEIMLRLSPPDHKRIFQTDSFDVTYGGAEANVAAFLAQMGLDAYFVTKLPNNPLGDAAAGHLRKFGVKTDYIARGGNRIGIYFLEIGASQRPSKVVYDRAHSAISEAKREDFDWEKILDGARWFHFSGITPPLGKELPLILEDALKVANEKGVTVSCDLNYRARLWTKEEAQKVMIPFMEYVDVLIANEEDIEKVLGISVEGLDLKTGKLNREAYAKIAEEVTRKYNFKTVGITLRESISATVNYWSVMVFENGQPHFSNRYEIHIVDRVGAGDSFAGALIYGSLMGFDSQKKAEFAAAASCLKHTIPGDFVVLSIEEIEKLASGATSGRVER

SEQ ID NO: 93733 - protein, 447 aa, Treponema denticola ATCC 35405
MKIKENEKLGLGSCVTILVGGCIGSAIFSLSGMTMYYAGPAALITWFVAALILGLYGIQVAELSIRYPKSGGVFVFPAKAMGKNEREGKVWGFISAWGYVISNIIAVAFSAIYVAVYLGVGFQALAGFRIPLAIISIVICTALNLIKVTSAGKYNNVLVALLVITMLTFVSIAMFAGRWNPQNMVPFFTQGAKGVAGFIQAIPNAMVGYGSVVAIAFMVGEVENPNRTVPKSLAISLILVVLLYQLMILGTMGNITTEFLIKNPGMRFIPMFAAAFTSLNMFPWLSKLISISALLALLTTMLVVGFLNARAVCSMANAKMLPAFFGKVNKNGVPSTACLTLSACTIVLSCFPSITELLVNLGSISAAITIVIVCFSLIASRKKLPHVEGNYAAPGGNIVSILTIILILVCYIPAIFNGSVYMWLFTFILYGIGGIIMFIMMKKNKAD

SEQ ID NO: 93734 - protein, 340 aa, Glycine max
  misc_feature (88)..(88): Xaa can be any naturally occurring amino acid
  misc_feature (161)..(161): Xaa can be any naturally occurring amino acid
MGKVKIGINGFGRIGRLVARVALQRDDVELVAVNDPFITTDYMTYMFKYDSVHGHWKHHDVTVKDEKTLLFGDKPVTVFGHRNPEEIXPWGSTGADIIVESTGVFTDKDKAAAHLKGGAKKVIISAPSKDAPMFVVGVNEHEYKPELDIISNASCTTNCLXAPLAKVINDRFGIVEGLMTTVHSITATQKTVDGPSAKDWRGGRAASFNIIPSSTGAAKAVGKVLPALNGKLTGMAFRVPTVDVSVVDLTVRLEKEASYDEIKNAIKEESEGKLKGILGYTEDDVVSTDFVGDSRSSIFDAKAGIALNKNFVKLVSWYDNEWGYSSRVIDLLVFVAKKSF

SEQ ID NO: 93735 - protein, 771 aa, Ustilago maydis 521
MAFRQRVLPLLGASAVGVGIGYYVFDPLLQQYAKDTNGTYVAGPPGTNSLPDLKPHPGATTELHERPPLGSSAARGISGPIARPGVDLKHNEANQLPGSVPYGTVSKEIEQLRRNVNDKIGYAEHKLQDAKHGIENKYRDVKDEVKDTYRSARGTAQDAVDTAANKAENVKHDVKSGWFSAKNTVEQKASEAEAEVKKGWFAARDKAEQAGDQAKSTLYSAKDATQQKADEAADQAKKGWFAAKDTAAEAGEQAKSSWFSTKSAAEQKADEAADKAKQGWFAAKDKAAEAEEQAKSSWFSTKSAAEQKADEAADKAKQGWFAAKDKAAEAEEQAKSSWFSTKSAAEQKADEAADKAKQGWFAAKDTAAEAGEQAKSAWFSTKSAAEQKADEAADKAKQGWSAAKDTAAEAGEQAKSSWFSTKSAAEQKADEAADKAKQGWSAAKDTAAEAGEQAKSSWFSTKSAAEQKADEAADKAKQGWFAAKDTAAEAGEQAKSSWFSTKSAAEQKADEAADKAKQGWFAAKDTAAEAGEQAKSSWFSTKSAAEQKADEAADKAKQGWFAAKDKAAEAEEQAKSSWFSTKSAAEDKYENAKDEAQKGWFNLKSKAEDAADDARSSLEHNAQQKILAAQYNAEVRAGEARGQLIQNDHLKGDFKDIKQTGKDWKSELEAKAHEARNAAESEYRHLRDQSQQGYRNLKDEANSSLYNLRDKADSGYESLRAKAAEGLDYAGDKLHSGARKIEGDQKPQSTGLWNWIFGNGRATESVASNLE

SEQ ID NO: 93736 - protein, 909 aa, Robiginitalea biformata HTCC2501
MKTLTATQKELSVYRYGDKRADGTREMKNLLGGKGANLAEMSRIGIPVPPGFTITTEVCTLYTQEGKEAVLKKIEIEVREAIAAIEESMGTTFGDPQNPLLLSVRSGARVSMPGMMDTVLNLGLGEQTLEGIIKKTGNERFAWDSYRRFIQMYSGVVMGLKPETKQDLDPFEEIIDHLKDKRNIRHDTEFTVQDLKDLVYDFKDIVRKRTGKEFPTDPWEQLWGAVFAVFNSWNGDRAVYYRKMNGYPEHWGTAVNVQAMVYGNMGTDSGTGVCFTRDAATGENKFNGEYLINAQGEDVVAGVRTPQQITRHGSEQWAKLAQVSESDRRENFPSLEELMPDIYKELFEYQQKLETHYLDMQDMEFTIQKGKLWILQTRNGKRTGSAMVKIAMDMLREGSIDRETALLRIDPAKLEELLHPVFDPAAIKEAQVIAQGLPASPGAATGQIVFFADEAGKFKNSILVRVETSPEDLEGMHLARGFVTARGGMTSHAAVVARGMGKCCVSGAGALKIDYANRILRVGDHEYHEGDWISINGTTGNILEGKVATREPELSGEFAELMELSDTFARMEVRANADNPTDARVARNFGARGIGLARTEHMFFEVDRIKAMREMILADTVKGRRQALKELLPMQQKDFEGIFRAMEGLPVTIRLLDPPLHEFVPHQLATQKELAEDLHISLDAVKSKVAELEEFNPMLGHRGCRLGNTYPEITEMQTRAILQAALALKVEGIETRPEIMVPLVGTVEEFVQQKAIIDQTAAEVFRQRKDSVEYSVGTMVEVPRAALLADKIAEHADFFSFGTNDLTQMTFGYSRDDSGKFLPVYLEKGILPADPFEKLDQEGVGLLVRMGTELGRRGRPGIKTGICGEHGGEPTSVEFCHRTGLDYVSCSPFRVPIARVAAAQAVLRD

SEQ ID NO: 93737 - protein, 518 aa, Xanthomonas campestris pv. vesicatoria str. 85-10
MTHLHFDNRLRQQLPGDPEEGARRREVGAAWSSVLPTPVAAPYLIAHSAEMAQVLGLEAAEIASAQFAQVFGGNALYPGMQPWAVNYGGHQFGHWAGQLGDGRAISLGEAIGTDGGRYELQLKGAGPTPYSRGADGRAVLRSSIREFLCSEAMHHLGVPTTRALSLVGTGEAVVRDMFYDGHPQREPGAIVCRVAPSFIRFGNFELPSARGDIALLKQWVDFTIARDFPALAGAGEALYADWFAQVCERTAVMVAHWMRVGFVHGVMNTDNMSILGLTIDYGPYGWVDDYDPDWTPNTTDAQGRRYRFGTQPQVAYWNLGRLAQALAPLFADQALLQYGLDRFRDTYLACDRRDTAAKLGLAECRDEDLQLIDALRALMRESEMDMTLTFRGLIDLSPEHPDPAQLRDAFYDEDKRLVDAPQLQQWLQRYAARLQQDPLSPEERRARMRLANPRYVLRNYLAQQAIDRAEQGDPSGVQELLEVMRRPYDDQHGRDAFAARRPDWARDRAGCSMLSCSS

SEQ ID NO: 93738 - protein, 494 aa, Treponema denticola ATCC 35405
METLKYVKKEPYQLFIDGKYIPSENGSIVDVINPVNNLPFAKAYRGTKTDCEKAIAAARKAFDEGPYRKMSAKDRSKLLLKAAQILERRAEELAVIETLECGKNYSACRYWEVPMAIDSFEFFAGKARCLDGKVVPSEYGTLNYVTWNPCGVVGEILPWNGPFLMGCQKVNAILAAGNTVVIKPPSWGVLSMILMASIYEEAGFPSGVVNVVTGSGAEVGNCLVESELVDMVSMTGGVETGREIIAHSAKLVKDIALELGGKSPNIFFEDVDIEQAARFAVYGFTNHAGQICVSGTRILVQRRIYEPFIKAMVETAYKLKPGDGFDPSTTINTLISREHANTVWEYIEKGKKQNARLVCGGNPYSEPLLKKGNFIPPTIFADVTPEMEIFQNEIFGPVACITPFDTEEEAISLANATKYGLAGGVFTKDIKRAIRVADRINSGQIYINNYFSKGMIESPGTGWKESGIGIAGIHKYMISKTVFVETVDNVLLPI

SEQ ID NO: 93739 - protein, 306 aa, Glycine max
  misc_feature (129)..(129): Xaa can be any naturally occurring amino acid
  misc_feature (155)..(155): Xaa can be any naturally occurring amino acid
MKSGYQHGGVDITHTKAFLTSLSAMVAETTTFPIDLIKTRLQLHGESLSSSHPTSAFRVGLGIIREQGALGLYSGLSPAIIRHMFYSPIRIVGYENLRNVVSVDNASFSIVGKAVVGGISGVLAQVIAXAPADLVKVRMQADGQRVSQGLQPRYXGPFDALNKIVRAEGFQGLWKGVFPNIQRAFLVNMGELACYDHAKQFVIRSRIADDNVFAHTFASIMSGLAATSLSCPADVVKTRMMNQAAKKEGKVLYNSSYDCLVKTIKVEGIRALWKGFFPTWARLGPWQFVFWVSYEKFRKFAGLSSF

SEQ ID NO: 93740 - protein, 403 aa, Saccharophagus degradans 2-40
MTIEIKAPTFPESVQDGTVATWHKQPGEACSRDELIVDIETDKVVLEVVAPADGSIAEIIKGEGEIILSGEVIAKFVAGAAGSAPAPAAAEAAPAASEASEDVIAAPAARKLAAEKGIDLALVKGTGKDGRITKEDVAGYKPAAAAAPAPAAAPKAAAPASTGAVAPTGLREEKRVPMTRLRARIAERLLDANNNTAMLTTFNEVNMAPVMNLRKQYKDLFEKTHNGSRLGFMGFFVKAAVEALRRFPAVNASIDGNDMVYHGYQDVGCAVSTDKGLVVPVLRNAENLSIAEIENGIRDFGLRARDGKLGIEEMTGGTFTITNGGVFGSLLSTPILNPPQAAILGMHKIQERPMAVNGEVKVLPMMYLALSYDHRIIDGKEAVQFLVTIKDLLEDPARMLLEV

SEQ ID NO: 93741 - protein, 552 aa, Burkholderia mallei ATCC 23344
MRSAPARRTRPDRRRSASIRAVRVPRARAGAGSATHPTQHTNSGNTAMKHDSNVTPPLGHLIDGKRVDGGERVQPVFDPATGASTKRVRMADRPSVEAAIAAAQAAYPAWRNTPPLKRARVMSRFKTLLEEHANELCALITAEHGKVLADAMGELQRGIENVEYASYAPELLKGEHSKNVGPAIDSWSEFQALGVVAGITPFNFPIMVPLWMWPMAVACGNTFVLKPSERTPSSTLRMAELALEAGLPPGVLNVVNGDKEAVDTILTDSRVKAVSFVGSTPIAESIYATGCAHGKRVQALGGAKNFAIVMPDADIGNAVNALMGAAYGSCGERCMAIPLVVAIGDDTAEQVVDGLKAEIAKMKVGPGTGEQVDMGPLVTRQHFEKVTGFVEAGIAAGATLVVDGRGVKVDGHEGGYYLGPCLFDHVKPGMPIYQHEIFGPVLGVVRVASLAEAMALVDAHEYGNGTCLFTRDGEAARFFSDNIQVGMVGINVPLPVPVAYHSFGGWKRSLFGDLHAYGPDAVRFYTKRKTITQRWPSAGVREGTVFSFPSSR

SEQ ID NO: 93742 - protein, 451 aa, Burkholderia mallei ATCC 23344
MNAPTEPTAPDTTVRTDAEWLDAHWMPFTANRQFKRDPRIIVEGKGAYYTAADGRQIFDGLSGLWCCGLGHGRAEISDAVARQVARLDYSPAFQFGHPQSFELANRIKAMTPAGLDYVFFTGSGSEAADTSLKLARAYWRAKGKGTKTRLIGREKGYHGVNFGGISVGGIGPNRKLFGQGIDADFLPHTQLPENRFSRGLPERGAELAERLLDLIALHDASNIAAVIVEPFSGSAGVVVPPKGYLQRLREICTAHDILLIFDEVITGFGRTGAMTGAEAFGVVPDIMNVAKQVTNGAQPLGAVIASKDVYDAFMAAGGPDYMLEFSHGYTYSAHPVACAAGVAALDLLVKEDALGRVRELAPYFEAAVHGLKGVRHVADIRNCGLAAGLTIEHAPGEPARRPYEIAMHCWKNGFYVRYGGDTIQLAPPFIAEKREIDSLIGALNDALLATD

SEQ ID NO: 93743 - protein, 272 aa, Saccharomyces cerevisiae
MSRVGVMVLGPAGAGKSTFCNSIISHMQTVGRRAHIVNLDPAAEATKYEFTIDIRDLISLDDVMEEMDLGPNGALIYCFEYLLKNLDWLDEEIGDFNDEYLIFDCPGQIELYTHIPVLPNIVRHLTQQLNFNLCATYLLEAPFVIDSSKFFSGALSAMSAMILLELPHINVLSKLDLIKGDINKKKLKRFLNPDAMLLMETEGMNQASNPKFLRLNQCIANLVDDFGMVQFLPLESNNPDSIETILSYVDDITQWAEGQEQKEPNDQIDVEE

SEQ ID NO: 93744 - protein, 375 aa, Mesorhizobium sp. BNC1
MRTRAAVAVAAGKPLEIMEVDLDGPREGEVLVEVKATGICHTDDFTLSGADPEGLFPAILGHEGAGVVVDVGPGVTSVKKGDHVIPLYTPECRQCPSCLSRKTNLCTAIRATQGQGLMPDGTSRFSLNGEKVHHYMGCSTFSNFTVLPEIAVAKVNPDAPFDKICYIGCGVTTGIGAVINTAKVEIGSTAIVFGLGGIGLNVIQGLKLAGADMIIGVDLNNDKKEWGERFGMTHFVNPKEVGGDLVPYLVNLTKRGADTIGGADYTFDCTGNVTVMRQALEAAHRGWGESIIIGVAGAGQEISTRPFQLVTGRVWKGTAFGGARGRTDVPKIVDWYMDGKIEIDPMITHILSLDEINKGFDLMHSGESIRSVVVY

SEQ ID NO: 93745 - protein, 387 aa, Saccharomyces cerevisiae
MSTATTTVTTSDQASHPTKIYCSGLQCGRETSSQMKCPVCLKQGIVSIFCDTSCYENNYKAHKALHNAKDGLEGAYDPFPKFKYSGKVKASYPLTPRRYVPEDIPKPDWAANGLPVSEQRNDRLNNIPIYKKDQIKKIRKACMLGREVLDIAAAHVRPGITTDELDEIVHNETIKRGAYPSPLNYYNFPKSLCTSVNEVICHGVPDKTVLKEGDIVNLDVSLYYQGYHADLNETYYVGENISKEALNTTETSRECLKLAIKMCKPGTTFQELGDHIEKHATENKCSVVRTYCGHGVGEFFHCSPNIPHYAKNRTPGVMKPGMVFTIEPMINEGTWKDMTWPDDWTSTTQDGKLSAQFEHTLLVTEHGVEILTARNKKSPGGPRQRIK

SEQ ID NO: 93746 - protein, 359 aa, Saccharomyces cerevisiae
MALVSRRSTRSESTSITKEEHTGEGSLTKLFFRWLVTLEGDQDINDGKGYISLPNVSNYIFFLGGRFRTVKGAKPLWLGVLLAIVCPMVLFSIFEAHKLWHTQNGYKVLVIFFYYFWVITLASFIRTATSDPGVLPRNIHLSQLRNNYQIPQEYYNLITLPTHSSISKDITIKYCPSCRIWRPPRSSHCSTCNVCVMVHDHHCIWVNNCIGKRNYRFFLIFLLGAILSSVILLTNCAIHIARESGGPRDCPVAILLLCYAGLTLWYPAILFTYHIFMAGNQQTTREFLKGIGSKKNPVFHRVVKEENIYNKGSFLKNMGHLMLEPRGPSFVSARKPHEAGDWRFMDLSPAHSFEKIQKI

SEQ ID NO: 93747 - protein, 260 aa, Gluconobacter oxydans 621H
MTGAAEETSITDRSSDLVAFWKDMQSQACSCHDPLIQDVFSTNIGDHPDFASALASLLGTKLADRSIPATTITRLVASILSAEPDIAEAAAADILATYDRDPACPDLVTPFLFFKGWQALQAYRISHHLWTKGRQHLAHHFQSRINELFAIDIHPAARLGRRLSIDHGTGIVIGETSIVEDDVSLFQEVTLGGTGKLTGNRHPIVRRGVMIGSGAKVLGRLIIGEYARIGAASVVLEDIPAYSTAVGNPARIVGTVPRPA

SEQ ID NO: 93748 - protein, 146 aa, Oryza sativa Japonica Group
MAYMRVTHRDEEGKKVTEKVPIPETRRPDTARHFERKLEEQGFHRLERHPANGPARAGIGAPPPKSGRGGKFTWEGPDGPVDAQLQPAPPAVDPNDPNYDEGDGAGVDEEVAKEVVIGEVEVAKVAEARDGVDVVAPAPLLQQEQQ

SEQ ID NO: 93749 - protein, 490 aa, Bacillus halodurans C-125
MKRDHYRMVINGERVDSDETFETFNPAKGEILATVAKASREHAEKAVQAARHAFDHGKWRKYPVGKRARVLNQIAAIMRERFQELVEIEVLNSGKAISAAQAQINQAIEDFEFYAGAIVGHRGTVNNVPNGFLNYTQKEPVGVCAQIIPWNYPLMMAAWKVAPALAAGCSVVVKPASLTPITAILLNEICHEAGVPEGVVNTVAGAGSVVGDYLVGHEDVNKVAFTGSTPIGKDIMEKASHTLKRVTLELGGKSPNLVFADADMEAAVAGSLFGIYFNTGQSCEARSRLFVHEEIYDEFIEEFITRAKKLQLGDPFDKGTHVGSIISRDQLEIIDSYVRSAEEEGATIALGGKERRVEGFENGHWYEPTVITNVTPDMKAVQEEIFGPVVVVETFQDEREVIKRANDTKFGLGSAIWTKDQGRATRVAHQLEAGIVMVNCPFSAFPGTPFGGYKESGFGRELCVETLDLYMEDKSILSYYGPKPINPFGV

SEQ ID NO: 93750 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEVGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAGFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYF

SEQ ID NO: 93751 - protein, 287 aa, Nicotiana excelsior
MAENKEEDVKLGANKYRETQPLGTAAQTDKDYKEPPPAPLFEPGELSSWSFYRAGIAEFMATFLFLYITILTVMGLKRSDSLCSSVGIQGVAWAFGGMIFALVYCTAGISGGHINPAVTFGLFLARKLSLTRALFYMVMQCLGAICGAGVVKGFMVGPYQRLGGGANVVQPGYTKGDGLGAEIIGTFVLVYTVFSATDAKRNARDSHVPILAPLPIGFAVFLVHLATIPITGTGINPARSLGAAIIFNHDQAWDDHWIFWVGPFIGAALAAVYHQIIIRAIPFKTKS

SEQ ID NO: 93752 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAADKAEFIEKVRRALYLGKIVSYAQGFSQLRAASDEYHWDLNYGEIAKIFRAGCIIRAQFLQKITDAYAENADIANLLLAPYFKKIADEYQQALRDVVAYAVQNGIPVPTFSAAVAYYDSYRAAVLPANLIQAQRDYF

SEQ ID NO: 93753 - protein, 354 aa, Physcomitrella patens subsp. patens
MTSNFEKTNPYADELKKTAAFISAPGKGILASDESNATTGKRLATVGLDNTVENRQAWRELLYSAPGLGNYISGTIMFDETLFQSSRAGVPFVDILKEQGILPGIKVDTGLQPIDGTDGETATQGLDGLAERCQRYYKQGARFAKWRAVLKVDNEVLPSSTAILENAHGLARYAQICQANGLVPIVEPEVTLGEGDYSIERTAYISEKVNSHVFRLLNEYNVILEGILLKPNMILPGLDVPTPAPEEVARYTVRTMFRSVPGAVPGIHFLSGGMSEEEATLNLQALQVLSAYGPTPWSLTFSYGRALQSSTLKMWAGQEENWQAAQERLVALAKANSDAQVGLQNVACVFIVCV

SEQ ID NO: 93754 - protein, 290 aa, Mycobacterium sp. MCS
MPAAGLGTRFLPATKTVPKELLPVVDTPGIELVAAEAAEAGAERLVIITSEGKDGVVAHFVEDLVLEGTLEARGKKTMLEKVRRAPALIKVESVVQAEPLGLGHAVSCVEPTLSDDEDAIAVLLPDDLVLPTGVLETMSKVRAKRGGSVLCAIEVPPEKISAYGVFDVEEVPDATNPNVLRVKGMVEKPKAEDAPSPYAAAGRYVLDRAIFDALRRVKRGAGNEIQLTDAIALLIEEGHPVHVVVHRGTRHDLGNPGGYLKAAVDFALERDDYGPELRQWLVERLGLTEN

SEQ ID NO: 93755 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAHRVAASKVLSGPKAQPAGDKAEFIEKVRRALYLGKIVSYAQGFSQLRAASDEYHWDLNYGEIAKIFRAGCIIRAQFLQKITDTYAEKAGIANLLLAPYFKKIADEYQQALRDVVAYAVQNGNPVPTFSAAVAYYDSYRAAVLPANLNQAQRDYF

SEQ ID NO: 93756 - protein, 315 aa, Zea mays
MAATSLTAPPSFSGLRRISPKLDAAAVSSHQSFFHRVNSSTRLVSSSSSSHRSPRGVVAMAGSGKFFVGGNWKCNGTKDSIAKLISDLNSATLEADVDVVVSPPFVYIDQVKSSLTDRIDISGQNSWVGKGGAFTGEISVEQLKDLGCKWVILGHSERRHVIGEKDEFIGKKAAYALSEGLGVIACIGEKLEEREAGKTFDVCFAQLKAFADAVPSWDNMVVAYEPVWAIGTGKVASPQQAQEVHVAVRGWLKKNVSEEVASKTRIIYGGSVNGGNSAELAKEEDIDGFLVGGASLKGPEFATIVNSVTSKKVAA

SEQ ID NO: 93757 - protein, 189 aa, Triticum aestivum
MNAAAKVAQQVLGTEPTNLSHNYKEHPTEKMKACRWQAAAKVSLDEVPAPMITDPKDVILHVTGTTVCGSDLHIYHKDLLQQKSGMILGHEFCGIVADVGPGVTKFKKGDRVVSSFQIACGDCDMCRRGLTSMCDKTNDSTVQARLYGGKFGGIFGYTDFTGGYAGGQAEQVRVPFADSNLLKIPDNIP

SEQ ID NO: 93758 - protein, 141 aa, Triticum aestivum
HNIGVAMATAQGLVVPSIKKVQSLSILEITKELSRLHEMALQNRLSTNDITGGTITLSNIGAIGGKFGSPVLNLPEVAIIALGRIQKLPRFDDEENVYPSSTINVTVGADHRVVDGATVARFCNEWKSLVEKPELLLLHMR

SEQ ID NO: 93759 - protein, 440 aa, Nocardia farcinica IFM 10152
MRCTVFGTGYLGATHAACMAELGHDVVGVDIDPGKVAKLSDGVVPFYEPGLEAVLRRNLDAGRLRFTTSYAEAADHGRVHFLGVGTPQKKGEYAADLKYVHAVVDSLAPLLSEPSVIIGKSTVPVGTAAALGERARALASTEVEVAWNPEFLREGFAVQDTLHPDRLVLGVDRERANADWVEDLVRELYAQLLDEQVPFLSTDLATAELVKVSANAFLATKISFINAVSEVCEATGADVTVLADALGYDARIGRRFLNAGLGFGGGCLPKDIRAFMARAGELGADHAVAFLREVDNINMRRRTKVVDMAAAACGGSLLGANVAVLGAAFKPESDDVRDSPALNVAGMIQLHGAVVTVYDPKALENSRRVFPTLNYATSVAEACDRADVVLVLTEWDEFTALVPGDLDGIVRARSIIDGRNCLDRDRWRAAGWVYAGLGTP

SEQ ID NO: 93760 - protein, 651 aa, Magnetospirillum magnetotacticum MS-1
MAAKTSAETITEGRNFRRYADGDFKPSHWQEEIFKAGWSHKCPTYVLRTPPCSGSCPSGHDIRGWLDIVRGVEKPPAGMAWQEYAFRRMVEANPFPAIMGRVCPAPCESGCNRNMVEEHVGINSVEHHIGDWAIANKLTFPKPEIETGRQVAVVGGGPAGLSAAYQLRRQGHAVTLFEEKAELGGYVRYGIPGYRTPRDVLDAEINRIIDMGITVRTKCRIGTDITVSELEEKYDAIFWGIGTHAGRGLPIPGWKDTVNCVSGVAFLKAFNEGRLQHVPGRIIVVGGGDTSIDVASVARRLGHIDTVSEQDRADNVILGHVAHDVAATARREGSQVTLTSLFPVEKMFAAQREIDDAKREGVDIRGGIMPLEVILGSDGRATGLKLCQCTMEGMTPKPIPGTEFILDADLVVSAIGQSGDLADLPEMDNGKGFINADKAYRVPGRPKHFVGGDVVKPHLLTTAIGHGRVASAGIAEFLDHGDVAKRPKVDVHHFNLLAKLHESNLDPAPYQPGPVRGTFEAKFAVHNFENRSAEQIIPHDDLFLGHFTRTARHHRHEVHIDADKVIGNFDERLLLLTDAEVVDEAKRCMSCGLCFECDNCVVFCPQHAVDRVKKSERTTGRYVETDYSKCIGCHICKDVCPTGYIQMGLGE

SEQ ID NO: 93761 - protein, 767 aa, Pyrus communis
MAVLLSTLATEIVIPVAAVVGIVFSLVQWFLVSLVKVTPERNAPPSGPNSNKNGCNDYLIEEEEGLNDQNVVVKCAEIQNAISEGSTSFLFTMYQYVGVFMVVFAILIFLFLGSVEGFSTKSQPCTYDAAKTCKPALATAIFSTVAFVLGGITSVLSGFLGMKIATYANARTTLEARKGVGKAFITAFRSGAVMGFLLAANGLLVLFITINLFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHEFTPMLYPLLISSVGIIVCLITTLFATDFFEIKAVKEIEPALKKQLIISTVLMTIGIAIVSWIALPSSFTIFNFGVQKVVKNWQLFLCVAVGLWAGLIIGFVTEYYTSNAYSPVQDVADSCRTGAATNVIFGLALGYKSVIIPIFAIAVSIYVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGTAKPDYATCVKISTDASIKEMIPPGALVILTPLIVGTFFGVETLSGVLAGSLVSGVQIAISASNTGGAWDNAKKYIEAGASEHARTLGPKGSDPHKAAVIGDTIGDPLKDTSGPSLNILIKLMAVESLVFAPFFATHGGLLFKIF

SEQ ID NO: 93762 - protein, 388 aa, Saccharophagus degradans 2-40
MKIVVVGTGYVGMSNAVLLAQKYPVVALDVVPERVEMVNSKLSPIQDVEIEDFLAHKPLNLVATLDKAAAYEGADFVVIATPTDYDPETNYFNTNTVESVIKDVMTHNPSAVMVIKSTVPVGYTVDVRARFGTPNVIFSPEFLREGRALYDNLHPSRIIVGERSERAAKFAELLQSCAIKQDVEVLFTDSTEAEAIKLFSNTYLAMRVAYFNELDTYAETHGLDSKQIIEGVALDPRIGKHYNNPSFGYGGYCLPKDTKQLLANYADVPNNLIRAIVDANTTRKDFIADSIIKKNPEVVGVYRLIMKTGSDNFRASAIQGIMKRIKAKGIRVVVFEPVLEEETFFGSDVIADFDEFKALSSVILANRMVEELADVRDKVYTRDLFNND

SEQ ID NO: 93763 - protein, 377 aa, Xylella fastidiosa Dixon
MNSFAAVPVLIEEIRAGRMVVIVDDEDRENEGDLIMAAELVAPKDINFMVTHARGLVCLSLTRERCAQIGLSPMVQRNTTRLQTNFTVSIEAAEGLTTGISAYDRAHTIRTAVRPNAKPSDLHQPGHIFPLIAQPGGVLTRAGHTEAASDLPMLAGMEPAGVLVEIMNADGTMARRPQLEVFAQQHGLKIGSIADLIAYRLANEHTVERVDERVIETEYGSFLLVTYRDRIAHDLHFALVRGTLDASIPTLVRVQVENPLADMLHWRREDFGVAASDALRMIAAAERGVMVMLAAPRDSDVLLARLRSEPEVVSNVKDVGQWRRNGAGGQILADLGLAKLRVLGTPRRQIALAGFGLEVLEYVECRGGVPVAPQGVD

SEQ ID NO: 93764 - protein, 798 aa, Oryza sativa Japonica Group
MQDMSSEVVDSNPYSRLMALQRMGIVDNYERIRDYSIAIVNSVEGWWLSSSPAVIASCRRPPSPLVVASGRRRNPSLLVAGLRNPSLLVAGLRLAPLVTGLRPPSPLVVGLRTSSTLVAGASAWVLGRRRLGRSVSVSPIRIWIGSHWAQHMRLHMRGQRLWDVLSGELPFPPCPIAPTMPSLASQATDDDRAKAKEQFDDAMENYQSQFALYKAWLDEDARASAILVASMEIHLTGEVVTLTSAHLMWTHLRDRYAPTSDALYLAMVRQEQSLQQGDSTVDEFYTQLSSIWRQLDSLGPAICHTCQCCQRQRSHMDLRRIYDFFTRLRSEYESTRAQLLARHPRVTIMEALTEIRSEDIRLREAVVPSGRGHLHFTYYDKDGHVESFCFRKKDLRRGNSSKGTSGSSQKSAGGSDSQEILMLLRRLTASAATGSVGSVALPSAQFGSAVLGSSSSTEGPSSAPGGVGSVAAEMLTRCGIGRLLLYDYDTVELANMNRLFFRPDQVGMTKTDAAVQTLSGINPDVTLESYSLNITTVKGFETFLGSLKARSSDGRNTGVDLVLSCVDNYEARMVVNQACNELGQTWMESGVSEDAVSGHIQLLVPGETACFACAPPLVVASGVDERTLKREGVCAASLPTTMGVVAGLLVQNALKYLLKFGQVSPYLGYNSLKDYFPTMEMKPNPQCSNPACVQRQKEYMQSKPARDAAAKAKMEAEASAADECPVHLDNDWNISVVDDSDTVTPSILSTGADSLPEGLVRELPTADSYQEPVAPVTSGAIDDDLEELQRQLDALNSS

SEQ ID NO: 93765 - protein, 473 aa, Beta vulgaris
MEPRVGNKYRLGRKIGSGSFGEIYLGTNIQTNEEVAIKLENVKTKHPQLLYESKLYRILQGGTGIPNVRWFGVEGDYNVLVMDLLGPSLEDLFNFCSRKFSLKTVLMLADQMINRIEFVHSKSFLHRDIKPDNFLMGLGRRANQVYVIDFGLAKKYRDTTTHQHIPYRENKNLTGTARYASMNTHLGIEQSRRDDLESLGYVLMYFLRGSLPWQGLKAGTKKQKYEKISEKKVSTSIEALCRGYPTEFASYFHYCRSLRFDDKPDYAYLKRIYRDLFIREGFQFDYVFDWTILKYQQSQLAAPPARTGAGAGTSAGVPTPPVANPERKLGEEEGRAGGLSTGDGLRRRMSGSLLNSGSLLKQKSPLANDPTVSKDPTLSSTNLTGRSSGFLKRAAIPSSREAVTGGNESDPSRSRTAEASPSTMQRFSSGQRSSPVGSSDAKQQSSGRITSIKNYESTLKGIESLHFDDERVH

SEQ ID NO: 93766 - protein, 509 aa, Oryza sativa
  misc_feature (169)..(169): Xaa can be any naturally occurring amino acid
MDELFYQSLLLSVAAVTVLQLLKLLLVRHRRPRTPPGPWRLPVIGSMHHLVNVLPHRKLRELAAVHGPLMMLQLGETPLVVATSKETARAVLKTHDTNFATRPRLLAGEIVGYEWVDILFSPSGDYWRKLRQLCAAEILSPKRVLSFRHIREDEVMMRVNEIRAAGPTXPVNLSVMFHSVTNSIVSRAAFGKKRKNAAEFLAAIKSGVGLASGFNIPDLFPTWTGILTTVTGMKRSLRAIYTTVDGILEEIIAERKGIRDEKISGGAENVDENLVDVLIGLQGKGGFGFHLDNSKIKAIILDMFAGGTGTSASAMEWGMSELMRNPSVMKKLQAEIREVLRGKATVTEADMQAGNLRYLKMVIREALRLHPPAPLLVPRESIDVCELDGYTIPAKSRVIINAWAIGRDPKYWDNPEEFRPERFEDGTLDFTGSNYEFIPFGSGRRMCPGFNYGLASMELMFTGLLYHFDWSLPEGVNEVDMAEAPGLGVRRRSPLMLCATPFVPVVSAN

SEQ ID NO: 93767 - protein, 349 aa, Cryptomeria japonica
  misc_feature (169)..(169): Xaa can be any naturally occurring amino acid
LRDHDASQHLFQVSSGLDSLVLGEGQILAQVKQVHKVGQGVVGFGRNIGGLFKHAITAGKRVRSETSIAAGAVSVSSAAVELAVMKLPKDGIFSARMLVIGAGKMGKLVIKHLIAKGSKRIVVVNRSEERVSLLQEELTGAELIYQPLTEMLSNAAEADVVFTSTASEXPLFLKEHVENLPPVASNVGGIRLFIDISVPRNVGPCVSEVNLARVYNVDDLKEVVEANKEVRQKKALEAQMIIDEELRQFDAWRDSLETVPTIKKLRAYAERIRMAELEKCLSKLGDDVSKKNRKLVDDLSRGIVNKLLHGPMQHLRCDGSDSRTLSETLENMHALERMFNLETEISVLE

SEQ ID NO: 93768 - protein, 1141 aa, Aspergillus nidulans FGSC A4
MTYAATSSTSAVHGDPQASLKLAASRPRPKLHHIFTSSAIPAALAPTYASSYTTTPTSLPPSCTPSNDSSPLGTPFLSAVDSLRDRVTPLPPTSAPSLELGDSIMAVPATISASYPGDTVIPNSIKGTGLMRRISRGAANKLTRRRTSNSHNDKRDRSSGPVIMRRRSDSKTGTQTGRDSALDSSYEEDSNDALDALGGWAGSEASSVPNDNTPTVPRNPAVVAPTVDSAIQRGTILTKVTKKRRKQVRFLLNLDAGKVYWDPSNPAKRFYIDDVKEIRVGADARNYREEHQVSQDAENRWFTIVIADAERSKGRPVKTIHLIAPNERLLKLWTTTLEYISRYRVGLMAGLAASNQNESVLKAHWQREMTRLFPNGMKAGDTETLDFAAVESVCQSLHINCSQNMLRAHFLKADTGKHGKLNFDEFKDFVTRLRERRDVREIFRSHADDHREGLTLEEFLIFLRDVQKEDIDSDRAYWISVFDKLVRKSKSRTQSPTGTSSEDQSSRMSLDAFSSFLASARNGVYASRSPQSRFDRPLNEYFISSSHNTYLLGRQVAGSSSTEAYISALTQGCRCIEIDCWDGADGRPIVSHGRTMTTSVLFADCITVINRYAFFSSEFPLVISLEVHCNPEQQIAMVKIMKETFGEKLILEPLSNSFVLPSPEELKRRILIKVKTCDETENIRQDPITSFHGRKRSSSSPFIRPSMSDGPTLPNLPSLSSPPTIGADCPGPFLVPERRSLTTTSISSATEDSDGGLVSVRKERRRRQKSKITKPLSDLGVYTRGYKWHSFASAESQAFNHVYSFAERSFESICREPSNKALFEKHNSKYLTRVYPSGFRLRSSNFDPLKFWRRGVQMAALNWQTYDIGMQMNQAMFAAGSDRTGYVLKPESLRVVSSEKDTRITERKLVRFSVDVISAQQLPRPQNMSSDGNINPYVEIEMFSADDRGQSFAFGEGGMNASARNGMSGIGFPHRRRTKIEQRNGYSPNFNESFRLSLETKYPDLVFVRWTVWSSLDGRSTGTNGSVQLATFTAKLTSLSQGYRYLPLYDGSGDQYIFSTLFCKISKEEPISVRRLNADELRAERLGILRQIGQTVFKRTSSTEREKQDQSDKGTETPICLEGKEISPALTPTISTTSTAS

SEQ ID NO: 93769 - protein, 173 aa, Gluconobacter oxydans 621H
MDVSKISPGKDLPNDINVVIEIPQGSQVKYEVDKDSGALVVDRFLFTPMAYPAAYGFIPGTLAADGDPADALVLTPAAVVPGSVIRARPIGMLKMEDESGQDEKIICVPHDKVHPQFSNVHSVDDLPEITKKAITHFFERYKDLEPNKWVKVTGWADKAEAGKVIMEALAAAK

SEQ ID NO: 93770 - protein, 175 aa, Bacillus halodurans C-125
MIFRYKDFSPKVDTTAFIAESATVIGNVEIGAYTTVLFNAVIRGDEGLIKIGRRCNIQENVMCHLYEQYPLVLEDEVSLGHHAIVHGCTLKQGVLIGMGATVLDGAEIGEYSIVGAGSVVPPGKVIPPRSLVLGSPGKVVREVTEQDLAMIEETVETYVRNGQEFKRSDVLERIR

SEQ ID NO: 93771 - protein, 308 aa, Prochlorococcus marinus str. MIT 9215
MLNPIKLASKNFLSSLDTTLEEFLHILELAKNFKNKDLNIKLKEKVLGLIFDKSSTRTRVSFQVAMSRLGGTTVDLNPTTSQIGRGEPIRDTARVLSRYCDVLAIRTFKQTDLEEYAKWSSKPVINALTDLEHPCQALADFMTIKEEFLDFNDVVLTFIGDGNNVANSLVLCGALLGVEVRIACPKGYEPNSALIKKAYEIYKNKNLLKITNDPHSAVLGANVLYTDVWSSMGEENQKDEKEKVFNGFSIDSDLVSKADKDAIILHCLPAYRSKEITDEIFESQKSRIFDQAENRLHAQQALLSCLLQ

SEQ ID NO: 93772 - protein, 414 aa, Bacillus halodurans C-125
MVEFRLPDVGEGMHEGEIISWFVQEGDHVKQDEPVVEVQTDKMNAELTAPVSGKIKRVYYKVGEVAEVGSLLFTIDENLSTFKSETHERTKRENSTEQTRPISNISLTSQQKAPVRKGLATPYVRQLAREMNINLEDVVGTGPGGRVLEQDLQNDTNLQKVKTVPSGVANVQESIERTGSSAEKRIPLKGIRKAIAEKMIKSVATIPHVTHVDEIEMDALKELREQLKHYSEQKGIKLTFLPFFIKAIVSALKEFEYFNASIDEETNEIVLKKDYHIGIATDTEKGLIVPVIQNADQKSLLELAGEITQLSTQARKGTLNVQQMTGSTFTISNVGPIGGLHATPIINYPEVAILALHKMEPRNVVREWESVIKLMMNMSLSFDHRLVDGATAVRFTNRMKELIENPNLLLMELR

SEQ ID NO: 93773 - protein, 469 aa, Alkalilimnicola ehrlichei MLHE-1
MSNVFQFLEVPRQDPDKERAEVRARQFKEIYRQFDPEVASAQAARCLDCGNPWCEWKCPVHNYIPHWLRLVAEGNLFEAAELSHKTNSLPEVCGRVCPQDRLCEGACTLNDGFGAVTIGSVEKYITDEAVKQGWRPDLSGVVATGKKVAIVGAGPAGLGCADILARNGVRPVVFDKYPEIGGLLTFGIPPFKLEKEVIRTRREIMEGMGVEFRLNTEIGKDIEFQQLVDDYDAVFLGMGTYTYMRGGFPGEDLPGVYEALPFLVSNINRLMGFQQDNGDYIDMKGKRVVVLGGGDTAMDCNRTSIRQGARSVTCAYRRDEANMPGSRREVANAKEEGVEFLWNRQPVEIVGDEKVEGVKVVRTQLGAPDERGRRRPEPVPGSEEVIPADRVLIAFGFRPSPAPWFEQFGISTDERDRVTIAKGGQTPWGQTSNEKVFSGGDMVRGSDLVVTAVFEGRQAAEGILDYLQV

SEQ ID NO: 93774 - protein, 473 aa, Bacillus halodurans C-125
MVVGEVAVEVDTVVVGGGPGGYTAAIRLGQLGKSVVLIEKNQLGGVCLNRGCIPSKALIQMAEKFDELTHLKEMGVELPGKPASIDLHKWQKWKQEITTKLNTGIHQLCQQNGVTVVTGEAHFLSSHRVGVETGNAFDVYKFEHAIVATGSSPRSLPFAEVDHTYILDSTSALELTEVPRSLSIVGGGYIGMELGLAFAKLGSAVTIVEMSPHILPATAPHISREVLNKAEKLGVTIKSSTSVEHLTVNDGYVELIVQSNGEQETLQSEKALMTVGRSPNTKGLGLEQVGVFFNEDGTLPINEECRTNIDHIFAIGDVTEGPALAHKASKQGIVAAEVIGGLPSAIDSSYIPYVVFTDPQIAGVGLTAKQAQEQGHRVKTARFPFQANGLALVASKPDGFAEVIVDEESHLLLGFHIVGADASNLIGEGVLALELGARVEDVALTVHPHPTFSEGWLGAAEAALGHAIHVVNK

SEQ ID NO: 93775 - protein, 74 aa, Triticum aestivum
APKIQRLVTPLTLQRKRARIADKKKRIAKKKSEAAEYQKLLAQRLKEQRDRRSESLAKRRSKLSSAAKAAASTA

SEQ ID NO: 93776 - protein, 395 aa, Bacillus cereus ATCC 14579
MQKWTGVNDPLIKVKVGADAMLFYFELVVILLCTKLAGDISVRLGQPSVLGKLIVGIIIGPAVLGIINSSELIDELSEIGVLLLMFMAGLETDLEELNRNLKSSFAVAAGGIIFPFIGGYVTGLLFGLIQSHAIFLGLLLCATSVSITVQTLRDLGKMNTRESTTILGAAVFDDVIVVILLAFVMSFLGTQDVNITLVIVKKIIFFVSIVFIAWKVVPWIMKMLVPLRVTEALISAALIICFSFSYYSEMMGIAGIIGAFAAGIAISQTEYKHEVEHKIEPIAYAIFVPVFFVSIGMEITFQGIGSQLWFIIIMTLVAIFTKLIGSGLGARLTGFNRQSSISIGAGMVSRGEVALIIAANGLTANLLAKENFTAIVIVVILTTIITPPLLKKYFV

SEQ ID NO: 93777 - protein, 133 aa, Glycine max
SARAPPAQKEAIEALPTVIINENSQCSVCLDDFEVGSEAKEMPCKHRFHSGCILPWLELHSSCPVCRLQLPLDESKQDSDLSRDSRSQREDESIEHDNDEERDGEGRNASGGRRFSFPWPFNGLFSSSNSSSS

SEQ ID NO: 93778 - protein, 290 aa, Oceanobacillus iheyensis HTE831
MQNKTIIVTGANTGMGLATTIELAKKGIHVIMACRDTKRGNEAKEKAMEESNSTNISLYQCDLGSMESISKFADQIKEDFDKIDGLINNAGVVSLKHTKTEDGFESMTGVNHLGHFLLTHLLLDVLKKSEQARIINVASGAYKAGTLDYNDMHFNNRSFNVIKGYGQSKLCNILFTLELNKHLEGTNVSTFALHPGAVSTSLGVDRQTGFGEKVHLLLRPFFLTSEEGAETAIYLATEPKIDHLSGRYFYKKKLQPTKYNKVNEDEAKKLWDWSIKELGMEHKAIEEVAP

SEQ ID NO: 93779 - protein, 485 aa, Chlorokybus atmophyticus
MTTTNAVKTKNIGYITQIIGPVMDVKFSPGKMPNIYNALIVNGKNEAGDEISVTCEVQQLLGDNKVRAISMSGTDGLMRGMEVLDTGAPLSVPVGEATLGRIFNVLGEPVDNLGPVANKSTLPIHRDPPAFTELDTKLSIFETGIKVVDLLAPYRRGGKIGLFGGAGVGKTVLIMELINNIAKAHGGVSVFGGVGERTREGNDLYQEMKESKVINEENLSESKVALVYGQMNEPPGARMRVGLTALTMAEYFRDVNNQDVLLFIDNIFRFVQAGSEVSALLGRMPSAVGYQPTLSREMGTLQERITSTKKGSITSIQAVYVPADDLTDPAPATTFAHLDATTVLSRGLAAKGIYPAVDPLDSTSTMLQPWIVGEEHYDTAQRVKQTLQRYKELQDIIAILGLDELSEEDRLTVARARKIERFLSQPFFVAEVFTGSPGKYVSLADTIKGFLMILSGELDSLPEQAFYLVGDIGEAIAKAEKLKDK

SEQ ID NO: 93780 - protein, 182 aa, Geobacillus kaustophilus HTA426
MIYPYKGKTPQIAASAFIADYVTITGDVVIGEETSIWFNTVIRGDVAPTVIGNRVNIQDNSILHQSPNNPLIIEDGVTVGHQVILHSAIVRKNALIGMGSIILDRAEIGEGAFIGAGSLVPPGKKIPPNTLALGRPAKVVRELTEDDIREMERIRREYVEKGQYYKALQQQRTSCADKKELP

SEQ ID NO: 93781 - protein, 491 aa, Robiginitalea biformata HTCC2501
MTITIENILLIGSLLLLISVIVGKPSYKFGVPTLLIFLAIGMLAGSEGIGGIYFDDPKIAQFIGIVSLNFILFSGGLDTNYEAVKPVLKEGLSLSTLGVLLTAGTLGTFVWLITDFTVYESMLLGSIVSSTDAAAVFSILRSKNLALRENLRPTLELESGSNDPMAYVLTIACLTLVMNQDQNILSILPFFFLQMILGGLAGWGFGRLSKMVVNRIRLDFEGLYPVLVIALMFITFSATDFVGGNGFLAIYICAVYLGNQDLIHKKTIMRMYDGLAWLMQIVLFLTLGLLVFPSEIVPVLGVGLLVSLFLILVARPVGVLISLSFFRMKMRRRLYISWVGLRGAAPIVFATYPLLAGMDKANMIFNIVFFISVTSVMIQGTTISTFAKWLNVALPDGSKILTPTDTFLADNPKAAMKEIEITPSCRSVDRKIVDLHFPGNAIIAMIHRDGTYLVPNGSTEIRAGDTLIVLSDTQDGLDQVDACLLRSEPAG

SEQ ID NO: 93782 - protein, 651 aa, Ostreococcus tauri
MRPRSRVIGRTFRANVSRVGTAANAVALGASFVNATGSRRARRRRRGEFLNDPDRACTDGIIVATCGAFALQLLTRQTLTGFGVKINEKIAAGELWRLVTPMFLHGGLPHLMVNMYSLNSIGPLVEATFGREQFCATYLAAGLAGNYASYRFCPTPSLGASGAVFGLAGALAVYLQRHKHLLGERADMQLKQIGSALAVNMAFGLTSARIDNWGHGGGLLGGAASAYFTGPNLVLESDDPSGRSMRRKIVNKPVVQSFTTRRTNSGLGTYTSSSDAMSHARRKLIVDTDPGIDDAFALAIAAQTMREEIEIVGVTTMFGNVRRDEATRNAKLMTQLTSIPGDERGFKVPVVDGSRVPIGMLAHGDREGRGAHDADDSQVFVADFVHADDGFGGARARVETEAFEKEKAYAYEAGKEAADFIAETCARYPGEVTVLALASLTNVALAFRRYPECLHTMGELVVLGGAFSVNGNVNPAAEANILGDPNAADEVFRTFERTYVVGLDVTTRVQLHSSDLARLARPFHSDGNGDLNDGKKCSDRVRLFLHDAAQFYKEYHLNAAGLDGIYMHDPTALLLAVPSIRNRVFTLHEGAVRVVTEGISRGQTILDVRRKWHVPNEWTSAPKCRVALDVDVDAALVELRSRLGCAPEDER

SEQ ID NO: 93783 - protein, 185 aa, Oryza sativa Japonica Group
MEHHHHHVRPDGELRLLLLPATAPTTPRDDDGAAATLFPPAQPPRDHPQLDLSLSIRIGPPPPPPSHTRTATATAQAQAGQQKKASAAAGFHDGDGDHVRALKQQAAEQARLASAERAYAERVMELARRELEVAEREFARARAIWERARGEVHKVERMKEVAAARRIGAAALEITCHACMQRFHS

SEQ ID NO: 93784 - protein, 346 aa, Robiginitalea biformata HTCC2501
MKKVVTFGEIMLRLAPPNFLRFSQANSFDVVYGGGESNVAVSLANYGVPVDFVTRLPDNDIGHCALMEMRKRGVGTDKIIFGGDRLGIYFLETGAVSRGSKVVYDRAHSAMAEIRKGMVDWKEVFNGVKWFHWTGITPAISQGAADACLEAVKVASDMGVTISTDLNYRAKLWKYGGDREAIMTELTSYCDIVLGNEEDAEKHFGIKPEGLDITTQGEHVKAEAFLSVCEQMMKKFPKAKKVITTLRGSISASHNTWAGVLYDGEKMYKSPEYQITHIVDRVGGGDSFMGGLIYGLLKYPEDDQNALNFAVAASCLKHTIKGDANLVTVAEVEKLMGGDASGRVAR

SEQ ID NO: 93785 - protein, 55 aa, Glycine max
MRLFDPWAEFFKIECTRNWSFLVGFSITVTLMTKLSLGLSDEEAKTSKFVQAHIM

SEQ ID NO: 93786 - protein, 367 aa, Haloarcula marismortui ATCC 43049
MVLSPSVAGQVAVAGYGLPVVESSEFIELGAELGIVFLLFFLGLEFNLDRLLDSWERITRAGTIDLGINFGVGLVLGFALFRDPLAAFLVAGIVYISSSAIITKSLIDLGWIANDEANPMLGTLVFEDLFIAVYLTIAAALVTGGSDLGAAATSVGVALSFIVALLLLARYGTPWFERALQTTSNEFTVVRAVGITVFISGLALAIGVSEAVAAFFIGMAFAPTTHTHKLERLLEPLRDTFAAVFFFWIGVETDPRLFAGVAELVVAAIVVTTPTKILSGYLSGRAYALTPRRSMRVGLGMVTRGEFSLIIAAVALTGAGASLSTELANAVYSFTVAYVLLMSILGTMLMQYSAPFEAFATARFGAE

SEQ ID NO: 93787 - protein, 197 aa, Triticum aestivum
MASEFSFARGVSLPAAAHWPPLAFTSYRLRHSAACTRANPRVVAAARAVSVAAARRMPGSVRYGGARVAALRAEEAEVAVPPSVSVRVAYELQLAGHRYLDVRTEGEFGGGHPAGAVNVPYMYSTGSGMAKNPHFLEQVSAIFGRDDEIIIGCQSGKRSLMAAAELCSSGFTAVTDIAGGFSTWRENGLPVNGRGLL

SEQ ID NO: 93788 - protein, 633 aa, Oryza sativa Japonica Group
MDDHNLDYKGSGALEELEMLTVNAKEAQELILTKILERNQATEYLSKFMNGSTNISAFKRHVPVVTYDKVHPYILRIATGEESSILCGEYILELLRRLLLMTVINPEAQTELRLGKIVYIYFLECARLEMTGHTKLLAFSGTSRGEPRLMPSILKDLDRRTYLYSLIMPIMNKYISGLGEGKAMYLLFVKAETLTDSGIPVRSVLTSYYKSPHFLHRKHDLYNNYTSPDEVILCPDSQQSMYCQLLCGLVERQHVLRIGAVFASAFLRSISFLEQHWRDLVNDIRIGQLNSSITSPACRLAMLNFLALPNPELADQVEAICSCGSWKGILGRLWPNVKYIEAVLTGTMAQYIPMLEFYGGGAIPFVCTMYASSESYFGVNLSPLCSPADVSYTILPNMAYFEFIPLEDGLRLTDHEEVIENDKLVSLVDVKVGCYYELVVTTFSGLYRYRVGDVLQVTGFYNRAPQFKFICRRNVILSIDSDKTNEEDLHNSVTTAKKILENQNYLLLEYTSYTDISTVPGHYVLFWEIKSTHDERPAPLDAQLLESCCAAVEESLDYVYRRCRAHDRSIGPLEIRLVEAGAFDALMDLLVSHGSSINQYKTPRCIESSLALKLLNSKVIACFFSPQDPECGM

SEQ ID NO: 93789 - protein, 464 aa, Saccharophagus degradans 2-40
MENVVPVILSGGSGSRLWPKSRKAYPKQLHRLYGDATMLQHTVKRVDHLGAPIVVCNNDQRFMVADQLQETCGDASQIILEPIGRNTAPAIAVAAMRAVQQVGDNAIIVILAADHLIKDMPGFRATLDIAIKKATEGKLVTFGVVPTHPETGYGYIKAAEPLAGNTQGATVAEFVEKPNLETAQKYLAEGSYTWNSGMFVFPAKTLLEELTRLNAELVKQSQISLDKSEQDLDFIRLNEQAFAQCQDISIDNALMEHTNKAWVVPLNAGWSDLGSWQSLWESSDKDEYGNVVVGDAYMRNCTNSLIHSDGRLVAAIGLDDVVIIDSDDALLVVNKNKTQDVKHVVDWLKANNRSESQHHREVHRPWGSYDSIDSGERYDVKSLKVKPGASLSLQMHHHRAEHWVVVRGTAQVERGDEKFLVTENESVYIPLGEPHRLTNPGKVPLYLVEVRSGEYLGEDDIVRL

SEQ ID NO: 93790 - protein, 238 aa, Methanosarcina barkeri str. Fusaro
MGHLILVRHGEPGLKPEERLAGWVDISLSRKGIEEALQCAAELEKFELDLAFASNLVRTQETLFLILSGQKKTGVVVHESTGKKGNPGKTDWYSYPEKLGKKLIPIYFTPYLNERYYGKLQGRKKQKMEEKYGAEKLASWRWNFQPGPPEGESLKVVYERAVPYFKEKILPAVKAGKNVLICAHQGSLRALVKYIEEISDEDIKEVKFSTGELAIYRYSEGKLIRENAEMSSEIKRNL

SEQ ID NO: 93791 - protein, 374 aa, Mycobacterium smegmatis str. MC2 155
MKTKGALLWELNSPFKVDEIDLGDPVADEVQIRLHAAGMCHSDYHITTGATPIGLPALGGHEGAGVVTKVGKNVTGIEEGDHVILAFIPACGECPPCLKGFRSLCDRGAVLLGGKAIADGTSRIHAGSHEVSPMNLLGTFAPYMTVHKDSVVKIDKDIPFETAAIMGCAVPTGFGSATNVAQVQAGETVIIVGVGGIGMSALQGAVISGAKQVIAIDPNEWKREQAVKFGATHVYPTMAEAIAPVIDVTHGLMADKVIIAVGEMKGEYIEEALILTAKTGTCVVTGMGAMTDVDVKLNLFLFTMLQKTLKGNIFGGGSSHIETPRLAALYKSGLLNIDDMVTRTYKLEDINSGYQDMLDGKNIRGVIKYDESDW

SEQ ID NO: 93792 - protein, 530 aa, Mycobacterium sp. MCS
MALKSTLDPSSPGYAAAADAMAAKLAELETEHAKALAGGGAKYVERHHARGKLTARERIELLLDPDSPFLELSPLAAWGSEFTVGASVVTGIGAVSGVECLLVANDPTVKGGTSNPWTLRKILRANQIALQNPLPVISLVESGGADLPTQKEVFIPGGQMFRDLTRLSAAGIPTIALVFGNSTAGGAYVPGMSDHVVMIKERSKVFLAGPPLVKMATGEESDDESLGGAEMHARTSGLADYFALDELDALRIGRRIVGRLNWRKQGPAPAPVTEPLFDSEELLGIVPADLRIPFDPRDVVARIVDGSEFDEFKALYGSSLVTGWARLHGYPIGILANARGVLFSEESQKATQFIQLANRSNTPLLFLHNTTGYMVGRQYEEGGMIKHGSMMINAVSNSTVPHLSLLIGASYGAGHYGMCGRAYDPRFLFAWPSAKAAVMGGTQLAGVISIVGRAAAEARGQVVDEDADAALRAAIEAQIEAESLPMFLSGRLYDDGVIDPRDTRTVLGMCLSAIANGPIEGTSNFGVFRM

SEQ ID NO: 93793 - protein, 385 aa, Aspergillus nidulans FGSC A4
MANLPSHASPNFGAQSASIAPPVDDISLTSEQQTSSTSVQPNEFTLGNLPEVGAMGSTPGDLTPGVPASLLSPSFTPPATPGGTLNTERLLQQISPQPVSHAKPPKLLPRLPNVECIVRARIPTTTGAEMFLHLYHNDIDNKEHLAIVFGNTIRSRSLDRVKPGETEMDRMIRGAYIGKLHPGRVSSWHDSTQGSATDRSIEGSEGGAVHNTESMQERLNEAPLVRIHSECYTGETAWSARCDCGEQLDEAARLMSLPMETLNEIASQQSRSVPSNVSGGVIIYLRQEGRGIGLGEKLKAYNLQDLGSDTVEANLLLRHPADARSYGLATAMLVDLGLGKDANPHGIRLLTNNPDKVRAIEGPGREVIVKDRVPMVPLAWQTGDF

SEQ ID NO: 93794 - protein, 586 aa, Oenococcus oeni PSU-1
MTKMIAGRALVKALEDWGVDHVYGIPGGSINHTVEGLYLEQDKVKYIQVRHEEVGALAASADAKFTGKIGVAFGSAGPGATHLFNGLYDAKMDHVPLLAIIGQVPQETMNTNYFQEMDEVPLFSDVSVYNRTVTTAEQIPYVINQAIREAYRQKGVATVVLPENLAAKEIDYKETKTPKVVANNFSQKVDSKAVSDTLAMLKAAKHPLIYAGRGLLGARDVLTKFSEQFNIPVMNTVPATGVISTDDPNFIGTFGRLGSKSGFEALQHTDLILFLASEFPFAGFWPKNIKVIEVNNNPFDIGKTVDVDYAVISDAKSYLQALINTGQTLPAGNWLKANQENKRNWDNWLAELAKDESDGLNPESVTAKIASMVGPNDTYAVDTGNVSEWGARGLPMNHNQRFAISGLFATMGFGLPGGLAGALSVPDGQAWSLSGDGGFSMVVQDLITEVRYGLPVINIVFSNDRFGFIYHEQVQTKQHFYGVDLTGADWAKVSEGLGAISFTVKTIADIDQVFTKIKKLQESGNKKPIVVNAVIKKDDPFPTDYMPLDPKLYGQDAVDQYAEKYHFDLEKQPSLGALLRAQGDNL

SEQ ID NO: 93795 - protein, 129 aa, Yersinia pseudotuberculosis
IGVVGMAVMGSNLALNIESRGYSVSILNRSSDKTDEVVAENPGKNLVPSYTVEEFVDSLEKPRRILLMVKAGEATDKTIASLTPHLDKGDILIDGGNTYYKDTIRRNRELSAQGFNFIGTAVSGGEEGP

SEQ ID NO: 93796 - protein, 371 aa, Streptococcus pyogenes M49 591
MALTAGIVGLPNVGKSTLFNAITKAGAEAANYPFATIDPNVGMVEVPDERLQKLTELITPKKTVPTTFEFTDIAGIVKGASRGEGLGNKFLANIREVDAIVHVVRAFDDENVMREQGREDAFVDPIADIDTINLELILADLESINKRYARVEKMARTQKDKESVAEFNVLQKIKPVLEDGKSARTIEFTEDEAKVVKGLFLLTTKPVLYVANVDEDKVANLDGIDYVKQIRDFAATENAEVVVISARAEEEISELDDEDKEEFLEAIGLTESGVDKLTRAAYHLLGLGTYFTAGEKEVRAWTFKRGIKAPQAAGIIHSDFERGFIRAVTMSYDDLMTYGSEKAVKEAGRLREEGKEYVVQDGDIMEFRFNV

SEQ ID NO: 93797 - protein, 325 aa, Mycobacterium smegmatis str. MC2 155
MLTAHAIKVHESGGPDVLVNEEIDVPEPGSGQVLVRNEAIGLNFLDTYLRSGRYAAETPFVPGHEGAGVVERVGAGVTDIGVGDRVGYIDPIGAYADLVVRPADRVIPLPPGISTRLAAGMLMKGMTSEYLVRRTYPVRQGQTILVHAAAGGVGQILCQWARYLGATVIGTVGSAAKRQIAANAGCEHVIVNDEEDLVAAVRDITAGRGVPVVYDGVGGDGFAKSLDCLAPLGTLVAFGAASGPIPPLDVQTLGPKGSLYVTRPMIGPYVATTAELRASAQALFELVLDGYIEVDIANSYPLTEAAGAHADLEARKLTGSTVLIP

SEQ ID NO: 93798 - protein, 270 aa, Zea mays
  misc_feature (265)..(265): Xaa can be any naturally occurring amino acid
MQFALALDTNSGPHQIRSCEGDGIDRLEKLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVEIDHTGPALQFFEXPKGAD

SEQ ID NO: 93799 - protein, 300 aa, Coccidioides immitis RS
MCLLRLVPGTVSSFEKANEMDHLSLHTLSPKTNFMNTAARFISLARASQCGTKREDGAENATLKLTNQVTCLLLFSVHRPICLFTKSSSSAYLYGLHVSSHLPSDRPVRLASTASTAFRPYTRRKMEYQAGCFTCGDSAHQVNMMRAPFVARDCPKKGSVICYNCGGRDCNEPAKEKSCYRCGLTGHISRDCPQAGESGGARGQECYKCGQVGHISRECPQGGESGEARGQECYKCGQVGHISRNCGQYSGYNGGGYNAGSYRYGGETGHVSRDCTTEGKGERVCYKCKQPGHVQAACPN

SEQ ID NO: 93800 - protein, 363 aa, Populus trichocarpa
MALVQVLRRVLGASGSTQISSTARAFSSAPAPIIATLFPGDGVGPEIAESVKQVFQAAEVPIEWEEHYVGDQIDPRTQSFLTWESLESVRRNRVGLKGPMATPVGKGHRSLNLTLRKELNLYANVRPCYSLPGYKTRYDNVNLITIRENTEGEYSGLEHQVVRGVVESLKIITRQASLRVAEYAFHYAKTHGRERVSAIHKANIMQKTDGLFLKCCREVAEKYPEITYEEVVIDNCCMMLVKNPALFDVLVMPNLYGDIISDLCAGLVGGLGLTPSCNIGEAGIALAEAVHGSAPDIAGKNLANPTALLLSAVTMLRHLELYDKAERIQDAILNTIAEGKYRTADLGGSSSTTDFTKAICGHL

SEQ ID NO: 93801 - protein, 645 aa, Coccidioides immitis RS
MLLRNTFYRCVPTILQSRLARMASHLSNGPQTANTSGLSLEDIPKTNNFTTKLPPDPAFQTPESSNNAPREELGPRMVKGALYTFVRPEPQDDLELLDVSPRAMRDIGLKDGEEKTKAFKDMTAGNKIFWSEEHGGIYPWAQCYGGWQFGAWAGQLGDGRAISLFETVNPTTGTRYEIQLKGAGRTPYSRFADGKAVLRSSIREYVISEALNALGIPTTRALALTLLPDVAVRREKIEPGAIVTRFAESWLRIGTFDLLRARGDRDLTRKLANYIAEDVFSGWESLPAALKFSDDGPPPVDVDNPPRGVPKDEMQGEQGAEQNRFSRLYREIVRRNAKTVAAWQAYGFMNGVLNTDNTSIFGLSLDYGPFAFMDNFDPNYTPNHDDELLRYSYRNQPSIIWWNLVRLGESFGELIGAGDKVDDETFVSKGITEDFAPILIKRAETIIDNASKEYRTVFLNEYKRLMTARLGLKTQKDSDFEKLFSDLLDTLEALELDFNHFFRKLSGFSLSDIESEEKRKEVASVFFHQEGVGGIGNTEESARERLAKWLSAWRDRVIEDWGSDSDVERQTSMKAVNPKFLPRSWVLDEVIQRVQHQGDRDILGRVMHMALHPFQEEWNWNREEEERLCGDVPQFKRMTMCSCSS

SEQ ID NO: 93802 - protein, 166 aa, Prochlorococcus marinus str. MIT 9215
MTSKSPKFRIGNGYDIHRLEIGRKLIIGGVKLNHPDNLGLDGHSDADVLSHSIMDALLGALSLGDIGKYFPPSDEKWKDVDSLILLSKVIDLVRKQGWEINNIDSVIVAERPKIKPYVEIMKRNLSKTLKIDDSFIGIKATTNEKLGPEGREEGISCHSVVLLEKK

SEQ ID NO: 93803 - protein, 549 aa, Mycobacterium sp. MCS
MNPARLLPRRSDYADLPTSWRRDVLAGVTVGVVALPLALAFGISSGVGAAAGLITAVVAGVVAAVFGGSHVQVSGPTGAMAVVLAPIVAAHGLGSVALVTVVAGLLVAGCGIAGLGRTVTFIPWPVIEGFTLGIAVIIFAQQLPAALGVSAPAGGRTLTTALHVLTHADWAAAAKTLVVVGFVAVVMVALPRLHPGAPASLLAVVGATIGVIALHVPVAAIGELPSHLPAPVLPTVDVDSLRTLLSAAVTVAALAAIESLLSARVAATMSPTGPYDPDRELLGQGLASVASGVFGGMPATGAIARTAVNVRSGARTRVAAIVHSIVLLGVVYLLSGPVSQIPLAALAGVLMVTSFRMISAATVRSILRSGRSDALTFVVTAVITVSFDLIEAVMIGVLAAAFFALRNVAGRSSVTREQLPGPNRDGDEHIALLRLDGAMFFGAAERISTEIAEAFGTPGGPAAAGIRVVIIRMSQLGMLDATGARTLAEITAELEARGITVIIKGVRPEHLNMITSVGVLDSLRHENHLMDSLDDAIAHARTHVAEHPS

SEQ ID NO: 93804 - protein, 261 aa, Oenococcus oeni PSU-1
MKYGFLGAGNLSSAIIMGLLKAGFRSEDIFVSSPHSAALLSKRLAINNVDEDRLLADCDLIVLAFLPEQLGSIVQQVGSEKFANKLIVSVLGSTSLKELTEFLPTAKIVRVLPNVNAEFNNSLTSVAFGQNLSNEDLKLTKNFLQAFGTIIELAERDFPAFSAIAGSGPAFVALFIKALQEAGIKQGIDSKESLQIALHTIKGSTENILQSGKTADQLVKKVASPGGSTADGVESLEENHFIETVNNAILATINHGRKKFR

SEQ ID NO: 93805 - protein, 319 aa, Oceanobacillus iheyensis HTE831
MSKQTEIATFAGGCFWCMVEPFDQRPGVIDIRSGYTGGHVENPTYEQVCTNTTGHVEAVQITFDPEIMPYKELVETFWQQIDPTDAGGQFNDRGESYQTAIFYHTEEQKKIAEDSKKALDESNRFKMPIVTPVLPAKPFYEAEEGHQDYYKKRSFHYRMYKKGSGRQDFIKNNWQNTIDKNELKEKLTPIQYHVTQENGTERPFDNEYWNNTQEGIYVDIIKGNVLFSSKEQYDAGCGWPSFTKPVDPYQIEDKVDKTHGMVRTEIRSKQSDSHLGHVFEDGPQDKGGLRYCMNSAAMRFIPKEKMEEEGYSKYLYLFN

SEQ ID NO: 93806 - protein, 515 aa, Thermotoga sp. RQ2
MSLRDKIEELKKIEKEIEQGGGPEKVEKQHESGKLTAWERLELLLDPGTFVEFDKFVRHRNTYFGLDKLKLPRDGVITGVGEINGRKVAVFSQDFTVMGGSLGEMHAKKIAKLLDLALKMGIPVIGINDSGGARIQEGVDALAGYGEIFLRNTLASGVVPQITVIAGPCAGGAVYSPALTDFIVMVDQTARMFITGPNVIKAVTGEEISQEDLGGAMVHNQRSGNAHFLADNDEKAMSLVRTLLSYLPSNNAEEPPVEDPDTSLETPEDILDILPDNPNKGYDVREVIKRVVDHGEFFEVQPYFAKNIVIGFARIQGKTVGIVANQPSVLAGVLDIDSSDKAARFIRFLDAFNIPILTFVDTPGYLPGVAQEHGGIIRHGAKLLYAYSEATVPKITVILRKAYGGAYIAMGSKHLGADMVLAWPSAEIAVMGPEGAANIIFKREIEASSNPEETRRKLIEEYKQQFANPYIAASRGYVDAVIDPRETRKYIMRALEVCETKVEYRPKKKHGNIPL

SEQ ID NO: 93807 - protein, 464 aa, Clostridium difficile 630
MNLKYEFKNAWDFERKENTIEQIMQYSSNYMEFLSKSKTERLSVKEIIKLAKENNYISIDEAMEKGSISCGDKIYVINKEKAVALFVIGKNYIEKGMKIIGSHIDSPRLDLKPNPLYQESNLGFFKTHYYGGIKKYQWTAIPLALHGIVILNDGTKVDISIGEEDSDPVFCVTDLLIHLAGDQMQKKLSEGISGEALNILIGNIPLEDEEKEPITANILKILNEKYNIVEEDLLSAEIEVVPAGKARDLGLDRSMVLGYGHDDRVCSYAAVKAILETEQPEFTSVALCVDKEEIGSKGNTGMHSKFFENTVAELIALEGDYCDIKVRRALANSKVLSADVSAGYDPNFGEAYEKRNSAYMGNGVVLTKYTGSRGKSGCNDANAEFMSEVKGIFNKGNVIWQTAELGKVDQGGGGTIAHILANQGAEVIDCGVGVLNMHAPHEIVSKVDIYEMYKGYKAFFNINL

SEQ ID NO: 93808 - protein, 443 aa, Shewanella oneidensis MR-1
MSQQKPGLKQSLNLWQVVVMGLAYLTPMAVFDTFGIVSEITSGHVATSYLLALAGILFTAFSYGHLVRKYPYAGSAYTYAQKNFSPNVGFMVGWSSLLDYMFMPMINMLLAKIYLTAMFPNVEPWIFIFGLVTVMTVLNLRGIDLVANFNGVIVFAQIAIILVFIGLMAHSLSLGEGEGVIASVRPFYSEQVTLAPLFTGATILCFSFLGFDGLSSLSEETKDAKRVIPRAILLTALIGGVIFVSVSYFLQLYFPDISRFEQLDAVLPEIALYVGGNLFQSIVLVATTIAVLASGMAAHAGVARILYVMGRDNMLPNKGFGYVHPKWRTPAFNVVLVGLLALSAVSFDLEMALALVNFGALVAFTFVNLSVIVQFYIKEKRNQSLKEHLQYFVLPLCGAATIGVLWINLEPQSLELGLIWGAVGMLYLALRSLRLRKAVELQS

SEQ ID NO: 93809 - protein, 308 aa, Haloarcula marismortui ATCC 43049
MSRKVFFDTDPGCDDAVMLAMALGHDAIDVVGLSTVCGNTTIENTTRNAHAILGLGGYDVPVSRGCGRPLVDDLTTAEWIHGENGLHGDIPDADGNTRDIHGADAIVEAAHEYGDELTIAAVGPLPNLAIALAKEPRLPDLVDDIYLMGGAAMTTGNVTPMAEANFHNDPAAASRVLQDATTRMVGLDVTNHATVSPEFIEEFRTADGIRGTVAQWLDYRPDSGTYPLADAPAIHDAAVVADIIDETVLTFEEYYLEVDTTGGPCHGAVICDEYGTTDNEPNSRVAVDIDVDRYREVLEAGVRAYAAE

SEQ ID NO: 93810 - protein, 652 aa, Vibrio vulnificus YJ016
MVCFCSSKAHFYDCLRIGENSEVQVFSVLSNDYHGKSRMIIIKEAFMSSATLQQINVYPVKSVGGIALTSAWVEKQGLAFDRRFMVATALGEMVTARKYPQMVTIRSALVADGIVFTYPDKPALMLKYQDFKRQETPAQVWKDNFTAYTTTDEADDWFSDILGIRVELLFSGEQSNRVREKIGHNVSFADGYPLLVISDASLKELNRRSPETHSMDQFRTNLVVSNCDAFAEDGWKKIRIGEVIFEAVKPCERCILTTVDVEKGQFRANKEPLNTLLTFRANEQGGVFFGQNLVALNEGMIQVGDRVEVLEVKEKEVYPDSACHDIRLTCVEKEAIARDFVTFWLEPEHGQLPAYLPGQHLPVEITVDGDTISRRYTLSSSPSRPGRYAISVKRIDGGRVSNWLIDHLEVGDELFAQSPQGQFHIQEDKHQPLLLLSAGSGVTPMLSMLRYLADHDLVEDVVFYHQCRSVEDIPCKEELDALKSRYPGLTVKISLTQAPIDWFGLKGRLSLSHLKQIKAVESRQVFVCGPEGFMQKAKNLLLKKGLPESHYHQEAFGVSTSPNSERKTVELEFNGETFTADNQQTLLEHVENHGLTIAHSCRAGFCGACKVNVISGQVHQPEVPALTEQEKREGKALACCCVPLTDVRFQSL

SEQ ID NO: 93811 - protein, 481 aa, Haloarcula marismortui ATCC 43049
MTQTYENYIDGEWTGSGETQEVTNPADETDVVSTVPVASAADADEAVAAAAAATDEWGEMPGPERGAILRETGEILKSRKDELAETLTREEGKPLGEAEGEVQRAIDIFYYYAEKARDFGGTVKQPSGGRAGLQTKKEPMGVAALITPWNYPIAIPAWKIAPALAVGNTVVIKPAMQAPTVGAMIVEALDEAGIPDGAINLVCGPGSEVGEQLTTHDDVDVVSFTGSASVGEHVYEQATSNGKRAQAEMGGKNPTVVMPSADVDKAADIVGAGAFGGTGQACTATSRAIVHEDVYDEFLDAIVDYAESLEIGDGLDRAGMGPHVSEDELAGSLEYIDVAQSEGATLETGGEELTSGEYDGGNFISPAVFSDVEPDMRIAQEEVFGPVLAVMSVSDFDEGVEVANDIDYGLSASIVTDRIKEENEFIERSESGVVKVNEKTTGLELHVPFGGLKRSSTNTYREQGDAGLEFFSYIKTVYRNS

SEQ ID NO: 93812 - protein, 484 aa, Arabidopsis thaliana
  misc_feature (12)..(12): Xaa can be any naturally occurring amino acid
MIARRIWRSHRXFLRPFSSSSVCSPPFRVPEYLSQSSSSPASRPFFVHPPTLMKWGGGSRSWFSNEAMATDSNSGLIDVPLAQTGEGIAECELLKWFVKEGDSVEEFQPLCEVQSDKATIEITSRFKGKVALISHSPGDIIKVGETLVRLAVEDSQDSLLTTDSSEIVTLGGSKQGTENLLGALSTPAVRNLAKDLGIDINVITGTGKDGRVLKEDVLRFSDQKGFVTDSVSSEHAVIGGDSVSTKASSNFEDKTVPLRGFSRAMVKTMTMATSVPHFHFVEEINCDSLVELKQFFKENNTDSTIKHTFLPTLIKSLSMALTKYPFVNSCFNAESLEIILKGSHNIGVAMATEHGLVVPNIKNVQSLSLLEITKELSRLQHLAANNKLNPEDVTGGTITLSNIGAIGGKFGSPLLNLPEVAIIALGRIEKVPKFSKEGTVYPASIMMVNIAADHRVLDGATVARFCCQWKEYVEKPELLMLQMR

SEQ ID NO: 93813 - protein, 443 aa, Brassica oleracea
RGVIPNYHHSYTLLFFVILVLFPHVFSTNTLSPNEALTISSNKTLVSPGDVFELGFFKTTTRNSPDGTDRWYLGIWYKTTSGHRTYVWVANRDNALHNSMGTLKISHASLVLLDHSNTPVWSTNFTGVAHLPVTAELLANGNFVLRDSKTNDLDRFMWQSFDYPVDTLLPEMKLGRNRNGSGNEKILTSWKSPTDPSSGDYSFILETEGFLHEFYLLNNEFKVYRTGPWNGVRFNGIPKMQNWSYIDNSFIDNNKEVAYSFQVNNNHNIHTRFRMSSTGYLQVITWTKTVPQRNMFWSFPEDTCDLYKVCGPYAYCDMHTSPTCNCIKGFVPKNAGRWDLRDMSGGCVRSSKLSCGEGDGFLRMSQMKLPETSEAVVDKRIGLKECREKCVRDCNCTGYANMDIMNGGSGCVMWTGELDDMRKYNAGGQDLYVKVAAASLVPS

SEQ ID NO: 93814 - protein, 258 aa, Xylella fastidiosa Dixon
MTQSRWRLDGRTALITGASTGIGLAVARELLGLGADVLLVARDADLLGRVRDELAEEFPERELHGLAADVADDVDRRAILDWVEDCSNGLHVLINNAGGNVTRAALEYTEDEWREIFEINLFSAFELCRYTQPLLACHASTAIVNIGSVSGLTHVRSGVPYGMSKAALHQMTRNLAVEWAEDGIRVNAVAPWYIRTRRTSEPLSDVCYYEQVIERTPMRRIGEPEEVAAAVAFLCLPASSYVTGECIAVDGGFMRYGF

SEQ ID NO: 93815 - protein, 313 aa, Marinobacter sp. ELB17
MFRHLREDIASVFRRDPAARNTFEVLTNYPGLHALLLHRVAHWLWGVGLKWLARTLSTLTRWFTGIEIHPGATIGRRFFIDHGMGVVIGETTVIGDDVTLYQGVTLGGTSWNKGKRHPTIGDGVVVGAGAKILGPFEVGAGAKVGSNSVVTKAVPAGATVVGIPGRVIEKDKDERSSRRREMEERMGFDAYGVTEEMPDPLARAMRSLLDHMHAVDDRMEIMCKALRKVSADYPNGDLPVLSEDDFDCLRDTDSDAARKKTREDAKVVAAAAVEPSTKASSIISAHESAKKSAEESAEEGTKKNASEPTKDSR

SEQ ID NO: 93816 - protein, 212 aa, Gluconobacter oxydans 621H
MQSRHLHLGEKWHMSGRLERKDMTTMFIETEDTPNPATLKFLPGRSVTGDARPVDFGDADVAAGRSELASALFDQPNVRRVFLGGDFVSVTKSDDISWGDLKPVVLGTITTFFESGRPVLSGTQAAPEHDVSPEDAEVVSRIQDLLDTRVRPAVAGDGGDIAFRGYKDGVVYLAMQGACSGCPSSRATLKHGVENMLRHYVPEVASVEQVED

SEQ ID NO: 93817 - protein, 505 aa, Sulfitobacter sp. EE-36
MNTPKPVVLCILDGWGLRDDPQGNAPLLAKTPHVDRIMQSCPSATLTTFGPDVGLPQGQMGNSEVGHTNIGAGRVVAMDLGQIDLAIEEGAFATHQPLLDFAETLKQTGGTAHVMGLVSDGGVHGHLTHMIAAVRTLRAQGIPVVIHALTDGRDVAPRSALGYFETLQAALPDGASIATVSGRYFAMDRDNRWDRVAKAYEAIVQGKGSAAPTARDAVNDAYGLDENDEFITPTVLEGYTGVQDGDGIFCLNFRADRAREIMSALADPEFDAFDTGARPAWSAVMGMAEYSDAHGAFMTTMYPKPEIVNTLGAWVAQHGLRQFRLAETEKYPHVTFFLNGGEETPTTGEDRYMPKSPNVATYDLQPEMSCAEVTDRFVQAIKDRYDLIVVNYANPDMVGHTGDLDAAIAACEAVDTGLGRVLEALEDVGGAMIVTADHGNCETMIDPETGGAHTAHTLNPVPVAVVGGPDGASLRSGRLADLAPTVLQLMGLDQPAEMTGKSLLE

SEQ ID NO: 93818 - protein, 159 aa, Salmonella enterica subsp. arizonae serovar 62:z4,z23:--
MRIGHGFDVHAFGGEGPIIIGGVRIPYEKGLLAHSDGDVALHALTDALLGAAALGDIGKLFPDTDPAFKGADSRELLREAWRRIQAKGYILGNVDVTIIAQAPKMLPHIPQMRVFIAEDLGCHMDDVNVKATTTEKLGFTGRGEGITCEAVALLMKAAK

SEQ ID NO: 93819 - protein, 142 aa, Marinobacter sp. ELB17
MANERTLSIIKPDAVAKNVIGKITSRFENADLHVVAAKMMHLSQDQAEGFYAEHKERPFFNDLVAFMTSGPVVVQALEGEGAILKNRDLMGATNPKEAEAGTIRADFASSIDANAVHGSDSAASAEREIAYFFNDNEICPRG

SEQ ID NO: 93820 - protein, 357 aa, Mycobacterium smegmatis str. MC2 155
MPPARLVRAVERARHHVRRLWLRSVPPEAAMLELLLGAWLAQGITAAAQLGVADALSGGPLRADELARRVGADADALDRLMRALVGEGVFRRTRDGRYALNPLGDTLRTDAQVSMAGMAKFVGAAQHREHWSHLADAVRTGESAIRTLRGMEPFDYIASQPELGTIFNDAMTSMSELAITPLIAAYDFTRFGTIADVGGGHGRLLSAILGSAPQAKGVLYDLPNVVEGAPEMLARHGVADRVQVIPGSFFDEVPDGADLYVMKNIIHDWADAPAAEILRNVRAAARTGATLLLVEGVIPDHDRAFPLKWVDMEMLIGNAARERTEAQYRKLYTEAGFRLTRVVPTACPYSLIEGVAI

SEQ ID NO: 93821 - protein, 210 aa, Xanthomonas oryzae pv. oryzae KACC10331
MKLTIPTWLTLLRILMIPVLVVVFYLPYTWTNFASAGVFALAAITDWLDGWVARRYHQHSAFGAFLDPVADKLMVAVALFLIVQGHPTPWMAFWAAVIVGREIAVSALREWMAEIGQRAKVRVAAIGKIKTTAQMVALLFLLYSVTPGQMPTHEIWLGNLIFRAGYWTLAIAALLTLWSGFQYLQAAWPSLRADEKAAISSKPKKIESNS

SEQ ID NO: 93822 - protein, 296 aa, Pseudomonas fluorescens
MKSFNGRVAAITGAASGMGRALALALAREGCHLALADKNAQGLEQTLALIKTSTLSPVMVTTQVLDVADRQAMEAWAARCVAEHGQVNLVFNNAGVALSSTVEGVDYADLEWIVGINFWGVVHGTKAFLPHLKASGDGHVINTSSVFGLFAQPGMSGYNATKFAVRGFTEALRQELDLQRCGVSATCVHPGGIRTDICRSSRIDANMTGFLIHSEQQARADFEKLFITDADQAAKVILQGVRKNKRRVLIGRDAYFLDLLARCLPAAYQALVVLASKRMAPKQRRPVFETNDEPRL

SEQ ID NO: 93823 - protein, 271 aa, Triticum aestivum
  misc_feature (149)..(149): Xaa can be any naturally occurring amino acid
RAEFGTSKGPELLTMWFGESEANVREIFDKARGSAPCVLFFDELDSIATQRGSSVGDAGGAADRVLNQLLTEMDGMNAKKTVFIIGATNRPDIIDPALLRPGRLDQLIYIPLPDVESRHQIFKACLRKSPLAKDIDLSALAKYTQGFSXGADITEICQRACKYAIRENIEKDIERERRRKDNPEAMEEDEVDEVAEIRAAHFEESMKYARRSVSDADIRKYQAFAQTLQQSRGFGSEFRFPDQPAAGAASAAAADPFASAAAAAEDDDLYS

SEQ ID NO: 93824 - protein, 335 aa, Brucella abortus
MAVRVAINGFGRIAVTILRAIVESGRTDIQVVAINDLGPVETNAHLLRYDSVHGRFPKEVEVAGDTIDVGYGPIKVHAVRNPAELPWKEENVDIALECTGIFTSRDKAALHLEAGAKRVIVSAPADGADLTVVYGVNNDKLTKDHLVISNASCTTNCLAPVAQVLNDTIGIEKGFMTTIHSYTGDQPTLDTMHKDLYRARAAALSMIPTSTGAAKAVGLVLPELKGKLDGVAIRVPTPNVSVVDLTFIAKRETTVEEVNNAISEAANGRLKGILGYTDEKLVSHDFNHDSHSSVFHTDQTKVMEGTMVRILSWYDNEWGFSSRMRDTAVALGKLI

SEQ ID NO: 93825 - protein, 610 aa, Oryza sativa Indica Group
MGYLSCRADSSVATCRSITAISPLPLSRRSGVGGRRRALPAAAREGDGGEASSAAATIERFAYDELEAATSHFADAALLGRGSHGAVYKAVLASGRAVAVKRPSPRRPEVDNEIRILSSVRGPRLVNLLGFSDSGAGAGADQQQQQHRPRLLVVEYMPNGTLYELLHSNPRPPGWPRRVRLALQTARALRALHDADPPVIHRDVKSANVLLDANLDARLGDFGLALRVPKRLPGDAAANAAATPAPAGTLGYLDPAYVTPESLSTKTDVFSFGILLLEIMSGRKAIDVQHSPPSVVEWAVPLLRKGKVASLFDPRVAPPRDPVTRRDLAALAASCVRSCRERRPSMADIVDRLVVLSKAVSGKMWNGLAVVGNPCAVVDVQKTIAKRAAAAAAGDRAASQRELTSALAFDDDEKKEEEDAPNAGALEEDEVPLVGAKKAPRPLKNGKMFSEPGARERRNLLELMARIDGVAGQRFGITRARTVRAASESIEKDAAVLLLRRNQTVKVLGSEALSKADIFSSLDAKIKHELGKEQQEEAGKIKHELVKEQQEKAGNIKQELVKEQQEKAGNIKQESGEEQERQGKPSMMQGKGMLRRQWESILKQGRSRRK

SEQ ID NO: 93826 - protein, 84 aa, Populus trichocarpa
MAVGGTAPPRGSAAAAASMRRRRTVSGGASGGAGAAGTMLQFYTDDAPGLKISPNVVLVMSIGFIAFVAILHVVGKLYLVRREA

SEQ ID NO: 93827 - protein, 292 aa, Zymomonas mobilis
MKPVRKAIFPVAGQGTRFLPATKAMPKEMLPVVDRPLIQYAVDEARAAGIEELIFVTGRGKQAIEDYFDIAYELEASLTAKGKTGMLDLLEGTRVAPGRACFIRQQEPLGLGHAVWCARDLIGDEPFAVLLPDELLWNPKRPSLVQLVETYNQKGGNVVTVMEVPEEHTHRYGIVDPGKTDGEVTEVKGLVEKPEKAPSRLAMTGRYILQPDIMPLLAQDNRGVGGEIQLTDSMAQLIGKQPFHACRFGGIRHDCGDKAGFIQANVALALERPDIGLRLETIYIAKIFNLMD

SEQ ID NO: 93828 - protein, 559 aa, Bacteroides thetaiotaomicron VPI-5482
MKLFEFKPKLVSCLKNYSKETFMADLMAGVIVGIVALPLAIAFGIASGVSPEKGIITAIIAGFIISLLGGSKVQIGGPTGAFIVIIYGIIQQYGEAGLIVATLMAGVLLILLGVFKLGAVIKFIPYPIIVGFTSGIAVTIFTTQIADIFGLSFGGEKVPGDFVGKWMIYFRHFDTVNWWNTIVSIVSIIIIAITPRFSKKIPGSLIAIIVVTVAVYLMKTYGGIDCIPTIGDRFTIKSELPDAVVPALDWEAIKNLFPVAITIAVLGAIESLLSATVADGVIGDRHDSNTELIAQGAANIVAPLFGGIPATGAIARTMTNINNGGKTPIAGIIHAIVLLLILLFLMPLAQYIPMACLAGVLVIVSYNMSGWRVFKALLKNPKSDVTVLLITFFLTVIFDLTVAIEVGLIIACVLFMKRVMETTEISVITDEIDPNKESDIAVNEENIMIPKGVEVYEITGPYFFGIATKFEETMAQLGDRPNVRIIRMRKVPFIDSTGIHNLTTLCEMSQKEKITVILSGVNEKVYKVLEKSGFYELLGKENICPNFKIALDRAEEVMK

SEQ ID NO: 93829 - protein, 211 aa, Zea mays
MRDAAVVVAVPGPGAATGGRGGGGGKPGAAGAAPCAACKLLRRRCAAGCVFAPYFPPGEPHKFASVHKVFGASNVSKLLQEIPAQHRGDAVSSLVYEANARVRDPVYGCAGAVSSLQQRVEALQAQLALAQAEVVRLRMSNDYVLRRLKAAGGGSSSSYAGSPSSMSSLKTAAAAAAEPDARCRATTPELLVLDMVVDQPGMDDDAHFWSY

SEQ ID NO: 93830 - protein, 531 aa, Zea mays
MQGASHMLLEEPFRLASVLSPAKPKVFPSLTKIVGTLGPNSHSVEIIQECLTAGMSVARFDFSWMDAAYHQETLDNLRKAAQNVKKLCPARVETQQKPQVKVQVMLDTLGPEIQVHNSTGEPIELKAGNHVIITPDICKALSAEILPIKFGDLAKAVKKGDTLFMGQYLFTGSETTSVWLEVVETSGENVNCLVKNAATLDGPIFTLHASQVHINLPTLSEYDKHVISTWGSCNSVDIISLSHTRSAEDVRELRAFLQAHALPDTQIYAKIENSEGLDHFDDILNAADGIIISRGDLGIDLPPENVFMFQKTAIHKCNLEGKPVIITRVVDSMIDNLRPTRAEATDVANAVLDGTDGILLGAETLRGLYPVDAAETVYNQPLQFKKVMWHVGDPMPHEESVASAAVGSAIKVKAAAIVVFTFSGRAARLVAKYRPTMPILAVIFPREGSDPSKWRSYGTTQARQCFAVRGVYPLMGSTDEAETGGLTKEEYGIKLAMSYGRSVGIVKPFDRLIIFEKIGDSSVVKIIECEG

SEQ ID NO: 93831 - protein, 151 aa, Pisum sativum
ALKEIRMDNEREGFPITAIREIKILKKLHHENVIKLKEIVTSPGPEKDDQGRPDGNKYKRLAIYMVFEYMDHDLTGLADRPGMRFTVPQIKCYMRQLLTGLHYCHVNQVLHRDIKGSNLLIDNEGNLKLADFGLARSFSNEIMQTLQIESL

SEQ ID NO: 93832 - protein, 447 aa, Bacteroides thetaiotaomicron VPI-5482
MKYQVIIIGGGPAGYTAAEAAGKAGLSVLLIEKNNLGGVCLNEGCIPTKTLLYSAKTYDSARHSSKYAVNVSEVSFDLPKIIARKSKVVRKLVLGVKAKLTSNNVAMVTGEAQIIDKNTVRCGEETYNAENLILCTGSETFIPPITGVETVNYWTHRDALDSKELPASLAIVGGGVIGMEFASFFNSLGVQVTVIEMMDEILGGMDKELSALLRAEYAKRGIKFLLSTKVVALSQTEEGAVVSYENAEGKGSVIAEKLLMSVGRRPVTKGFGLENLNLDKTGRGAIKVNEKMQTSLSGVYVCGDLTGFSLLAHTAVREAEVAVHSILGKEDAMSYRAIPGVVYTNPEIAGVGETEESASAKGITYKVVKLPMAYSGRFVAENEGVNGVCKVLLDEQERIIGAHVLGNPASEIITLAGTAIELGLTAAAWKKVVFPHPTVGEIFREAL

SEQ ID NO: 93833 - protein, 424 aa, Glycine max
MAKKAVLIGINYPGTKAELKGCINDVWRMHRCLIDRYGFSEDDITVLIDTDESYTEPTGKNIRSALTRLIRSARPGDVLFVHYSGHGTRLPAETGEDDDTGFDECIVPSDMNLITDDDFREFVDGVPRECKLTIVSDSCHSGGLIDGAKEQIGTSTKGEGQQHSGSGSGFGLSSFLRRSVEDAIESRGVHIPSALRHHRHKHEHEADDDRDIELPHVDHGYVKNRSLPLSTIIDILKQKTGKNDIDVGKLRLSLYDIFGEDASPKVKKFMKVILNKLQQGDGGSGKQGGILGLVGSLAQEFLKQKIDSSDDGGYAKPAMETKVESKYEAYAGTSSAKPRLSDGGILMSGCQTDQTSADASPAGNSASAYGAFSNAIQAVIEESDGAVTNQEIVLKAREKLKRGGFKQRPGLYCSDDHVDGPFVC

SEQ ID NO: 93834 - protein, 344 aa, Rhodobacter sphaeroides
MRIQRDLAEAIGNTPLIRLRKASELTGCEILGKCEFLNPGQSVKDRAALYIIRDAVAKGLLQPGGTIVEGTAGNTGIGLSLVGASMGFRTVIVIPETQSQEKKDMLRLAGAHLVQVPAGPYRNPNNYVRYSGRLAEALARTEERGAILANQFDNTANRQAHVETTGPEIWEQTDGKVDGFICAVGSGGTLAGVAMALQPRGVKIGLADPEGAALHSFYTEGTFEAPGSSITEGIGQGRITANLEGLTPDFSYRIPDAEALPIIFDLMQEEGLCLGGSSGVNIAGAIRMAREMGPGHRIVTVLCDYGNRYQSKLFNPQFLRDKGLPVPQWLDEAPPAIPAVFEDL

SEQ ID NO: 93835 - protein, 381 aa, Haloarcula marismortui ATCC 43049
MPPRFESVPTTGGSVTEKREYKDDYQDKTLYLPGPTEVREDVIEAMAEPMFGHRMDRMTDLYTTIVEDTKEFLGTENDVIVLTASGTEFWESTTLNLVEDSMLVPTSGAFSERQANVAERLGKDVDRIEYDWGTAVKPDDIRDALESGDYDAVGAVMNETSTGVRNPIEEIGDVVAEYPDTYFIVDAISCLGGDQIDIEGHGIDAIFTSTQKAFAMPPGLAVCAVSDAAYERELEKESASWYGGFQRCLDYYDRKGQTHSTPATPLMLAYRKQMKHMLDETHDARDQRHQEMAEYTREWAREHFDLYPEEGYESQTVTCIENTQDINVAETVEAVSEEYDMVFSSGYGDISEESFRIGHMGEHTVESIKELTDAIEDVADL

SEQ ID NO: 93836 - protein, 98 aa, Triticum aestivum
  misc_feature (81)..(81): Xaa can be any naturally occurring amino acid
MSSGWMCRRRLARSAQNRPVFPNAINRHEESRDAKDTQNMETSGKFVDHRSIETQTNPIDRSIALLLFHQPSDQVAGAVDXSSPLKSHNENHKAYAKN

SEQ ID NO: 93837 - protein, 406 aa, Oryza sativa Indica Group
MVTHGGGGGGGARTIWDDEAAAAAGVMRRSPRCVGEFIGDPLLGRDIVLGLWDSRPISRVSLHRRPMKSPVERRSVVGTLGESRREHTTDLCGGGEERRGEKPRRRQRGERMPRPEVQAPPEIFYNESEARKYTTSSRIIEIQSRITERALELLALPNDGVPKLLLDIGCGSGLSGETLTEQGHHWIGYDISKSMLDVALEREAEGDLLLADMGQGLGLRPGVIDGAISISAVQWLCNADKSCHNPRLRLKAFFGSLYRCLARGARAVLQFYADNVKQSEMIVTAAMRAGFAGGVVVDWPHSSKAKKSYLVLTCGPPSLNSSLPKGKGQDGAMCSDDDESDDGSGDEDGAQTVGIYERNRPKKRQKTKKNGKGKAWLLNKKEQLRRRGREVPADTKYTGRKRKSYF

SEQ ID NO: 93838 - protein, 373 aa, Saccharophagus degradans 2-40
MSDKSEPISAEEAALLGELRVKIDDIDQQIGDLICARANCAVEVAHVKKRFSNITEPKFYRPEREAQVLRNAMARNKGPLSNEEFARLFREIMSACLALEAPVKVAYLGPEGTYTQQAALKHFGHSAQAVSLPAIDEVFREVASGAAHYGVVPVENSTEGVVTHTLDNFLGSSVKICGEVVLRIHHHLLVSDVTHVQNISRIYSHAQSLAQCRKWLDAHYPRAERIAVSSNAEAARRIKGEWNSAAIAGAMAADLYGLTSHAQNIEDQPDNSTRFLIIGAESVGASGEDKTSIVVSMKNEPGALHNLLEPFHQHGIDLTRVETRPSPTGAWNYVFFIDFAGHASEPVAKKVLEEVGRRASDLKILGSYPKGVL

SEQ ID NO: 93839 - protein, 528 aa, Ustilago maydis 521
MIYAPIAKTQLEWYASLNPLEHGVDNKFFRKTSIIATIGPKTNNVEMLGALRQAGMNIVRLNASHGSHEYFKSVVDNARAVVAKTPGRPLAIALDTKGPEMRTGVMVNGEDVKISMGHEFYVTTDDAYAEKCSLDYLYIDYKNLAQKVEVGRTIFIDDGILSLQVLAIESDKLVKVRAVNNGVLSSKKGVNLPMTEVDLPAISDKDRKDIEFAVEQDLDMIFASFIRRGSDVRTIREILGEKGAHIKIISKVENHQGVQNFDEILKESDGIMVARGDLGIEIPAPQVFMAQKMMISKCNIAGKPVICATQMLESMIVNNRPTRAEVSDVANAVLDGADCVMLSGETAKGAYPIEAVKMMAETAYLAEQSVSYVPLFNEMRTLTSIPTDTNETIAMAAVAASLEQHAGAILLMSTSGTTARLVSKYRPSCPILTITRNSHTARDVHLYRGCYPFLYPHARPEDNSKWQEDVDNRIKYGLAEALALGIIEKGDVVITLQGWRAQSGSTNTIRILSVPESARDFKLEGTQV

SEQ ID NO: 93840 - protein, 515 aa, Zea mays
LFPWNFELWKMPRRTGNAAPTKSAELVKQDQLEFDDPDEVDEEEEVEYEEIEEEVEYEEVEEEEEEEDEEDEEMEGVHEIDANDESKMVDADGKVENEKEKHAELLALPPHGAEVYVGGISSDVSSEDLKQLFESVGEVVEVRMRGKGDNRTYAFINFRTKAMALKAIQNLSNKDLKGKKIKVSPSQAKNRLFIGNVPHDWTHDDFKTAVEEVGPGVLKVELMKAPGLDRNKGYGFIEYYNQACAEYAKQKMSTPEFKLDTNAPTVSWADPKNANEATSTAQVKSLYVKNLPKTVTQEQLKKLFEHVGEITKVVVPPAKSGHENRYGFVHFKERYMAMKALKNTERYELDGQLLDCSLAKPPADKKDSTVSTPTAKGGPLLPSYAPLGYGLVGAYNPRGKGLADAYNNPLGNGLAGAYGVLSARAAQPMVYAPGAPPGSTMIPMVLPDGRLVYVPQAAGQQSVHATSPLPQQGGRRFGGSGSGGGGSSSSGGKRQRGDDRGSNSNNSRRGRHRPY

SEQ ID NO: 93841 - protein, 369 aa, Candida albicans SC5314
MFRQVTKSAPVIRTTQRLFARSYIAGQFTGSKGSDGKYTVTLIEGDGIGPEISQAVKDIYAAADVPIHWEPVDVTPLLIDGKTTLPQPAVDSVNKNLVALKGPLATPVGKGHTSMNLTLRRTFNLFANVRPCKSIVGYETPYENVDTVLIRENTEGEYSGIEHTIVPGVVQSIKLITKPASEKVIRYAFEYAKSINKPHVLVVHKASIMKLSDGLFVNTAKEVAQEYPDVSLDFELLDNTSLRLTADPSQYKNVVMVMPNLYGDIMSDLSSGLIGGLGLTPSGNMGNKVSIFEAVHGSAPDIAGKGLANPTALLLSSCMMLRHMSLNSDADRIENAVLKTIASGPENRTGDLKGTATTTRFTEEVIKNL

SEQ ID NO: 93842 - protein, 389 aa, Neorickettsia sennetsu str. Miyayama
MSAVLGFSRKFPVKIVRAKGIYLFDSNGKQYCDFTSGIATVNFGHCNEYINKKISEQIHTLWHCSNLFSSEIQEQTATKLVNSTNFGDKVFFCSSGLEAIEAAVKFIKRYFYECGDTARTEILTLKNGFHGRSAAGISAGGTEEARRGFAPLVKGFTQIEANNVDKLKAKVSHNTAAVVLELIQSEGGIYEITNDYLENLQILREKFGFLLCFDEIQTGFGRIGQLFHYENLGVEPDLLTCAKGMGNGFPVGGCIVSKDIASVLPLGAHGGTYSGNALAMAAVDATLDLLNKEFLHNVTKMSEYLSSSLKEIAALLPDQITDIRGRGLLMGVEIAQNVDTWDLLLKCLKSGLALNRTSKKQVLRILPPLIVEKSNIDFAVEVLYKHLKS

SEQ ID NO: 93843 - protein, 261 aa, Anabaena variabilis ATCC 29413
MIIGLNSFIIINPGQAGVLSILGKARDGALLEGIHLKPPLISAIDVYDLTVQKFEVPAESSTKDLQNLSARFAINFRLDPIQVVDVRRKQGTLENIVSKIIAPQTQEAFKIAAARRTVEEAITKRSELKEDFDNALGDRLDKYGIIVLDTSVVDLTFSPEFARAVEEKQIAEQRAQRAVYVAREAEQEAQAEINRAKGKAEAQRLLAETLKAQGGQLVLQKEAIEAWKTGGAQMPKVLVMGGESQGSVPFIFNLGNTQNLN

SEQ ID NO: 93844 - protein, 669 aa, Aspergillus nidulans FGSC A4
MYLRAVHAEAQISILQQLIRDNPLGILTTAIKSPLYPLIQSSHIPFVLDAPETSDGSLSNGVLRGHMAKQNPQAKALIEALTAQQEQGNTSLELSDEVLVLFNGPHHHYVTPKFYTETKPATGKVVPTWNYAAAQAYGKIRIYCDSKSEETMTFLQKQIEELSHQSETSIMKYSSPWQVSDAPVSYVELLKKNIIGIEITIDRLQGKFKMSQEMGQGDRDGVISGFENLGTDAGKCIANINTRGGIDIKMASNTNPSPKPKIDLSQKLSELRAARAKTQSPREPAPVTPPLSKPPDLSSHSYSRPVRRILSKNDHETFLSSSTYTLVLAFIFGLSDSVRGRAAPDANAEPGYSPKISKILSVVDNIRTLVESHPSIDQGGSRFGNPAFRDLFDDVAAQSPAWLRDILGIEDAAAVNEISTYLIHSLGSRDRLDYGSGHELNFMMWLLCLRQLGLFSEPDFEAIVFHVYVRYMRLMREVQSTYYLEPAGSHGVWGLDDYHFLPFLFGAAQLVGHPYITPLAIHNTAILDEEGDRYLYLDQVRWVDSVKTVKGLRWHSPMLDDISGAKNWTKIESGMKKMFVKEVLGKLPIMQHFLFGSLLPAEPGMGEGEAEEEGEHTHAHGHSHVHDHSQQLDWFGDCCGIKVPSTVAAGQEMRKRMGGGSSLRPIPFD

SEQ ID NO: 93845 - protein, 398 aa, Lactococcus lactis subsp. lactis Il1403
MFQYNKVEEALAALKAGEMIIVSDDENRENEGDLICAAEFISPEIINFMASEAKGLICAPLSETYAKNLQLEAMVEKNTDNHGTAFTVSVDHIETSTGISAFERALTIKKLVDAESLPSDFRRPGHVFPLIAKKNGLFERNGHTEATVDLLRLAGLKEVGVCVEIMDEDGTMMHKEKLKEKAQEWGLKYITIKAIQEYLKQNELQVEQVTRAKLPTKYGMFDILGFVNKINGEHHVALVKGDIGDGQAILCRVHSECLTSDAFGSLKCDCGGQLEEALKKINDEGRGVLLYLRQEGRGIGLINKLRAYSLQDEGLDTVEANLALGFEEDEREYSIGAQILKIIGVKSLKLMTNNPQKINDFQKYGLVVEERVALQIKDNPFDLDYLKVKQNKMGHLFD

SEQ ID NO: 93846 - protein, 640 aa, Vitis vinifera
  misc_feature (378)..(378): Xaa can be any naturally occurring amino acid
  misc_feature (392)..(392): Xaa can be any naturally occurring amino acid
  misc_feature (409)..(409): Xaa can be any naturally occurring amino acid
  misc_feature (429)..(429): Xaa can be any naturally occurring amino acid
  misc_feature (434)..(434): Xaa can be any naturally occurring amino acid
  misc_feature (452)..(452): Xaa can be any naturally occurring amino acid
  misc_feature (477)..(477): Xaa can be any naturally occurring amino acid
  misc_feature (600)..(600): Xaa can be any naturally occurring amino acid
  misc_feature (614)..(614): Xaa can be any naturally occurring amino acid
MSASTVSITANTAARRRPVVIGEKKPNIELLSGDAGVSQFNGIAGEBKLTGGGGKDLSHSIRGETILERSKEVVQIKKTSANAATEPRRTRKVVSKSERPRWVTAVSIFTKNLVLLVVILGLVQMIRKLALKSADSSGGSLVAVPDFERRIAEVESFLKTTTKMMQVQVEVVDRKIESEVGGLRRELSKKIEEKAGDFNNHLEKLDSKSETLEKKLGELGAMEFLRKEDFDKIFDELKNAKSADYGDREMSLDEIRGIAREIVEKEIERHAADGLGRVDYALSSSGAMVVRHSEPYILGKGSGWFPKTSLTGVHRDSERMLKPSFGEPGQCFPLKGDSGFVQIRLRTTIIPEAITLEHVDKAASGLRINLAKSEIIPXGEVEEIEEMAAELXCRFKVGKGTKVNFWTDXWCGNATLSQSFPQLYALAVXRNATXNEVWDSNFGQGGWNLRFXRGFNDWELDLIGDLLTMLRDFRISXEEESVFWKGGENGKFGVKEAYNLLIAPNEFAFPKKTLRVSIKALATYIKCLFFIGVCYARGKMVAYDRSSAPKDCRVYGWHQGHDTDIAAETGSMFLLAEFSYDLEKSNAQTFNVLDLVGSGXVDMVRFDFASNHGXPSHTCIYRLRVHGHEPDSVSMLAMQS

SEQ ID NO: 93847 - protein, 387 aa, Mycobacterium sp. MCS
MDLFEYQAKELFAKHNVPTTPGRVTDTAEDAKAIAEEIGKPVMVKAQVKVGGRGKAGGVKYAATADDAFTHAQNILGLDIKGHVVKKLLVAEASDIAEEYYISFLLDRANRTYLAMCSVEGGVEIEEVAATKPDRLARIPVDATKGVDEAFAREIAEKGHLPAEVLDAAAVTIAKLWEVFVGEDATLVEVNPLVRTPDDQILALDGKVTLDANADFRHPEHAEFEDRDATDPLELKAKENDLNYVKLDGQVGIIGNGAGLVMSTLDVVAYAGEKHNGVKPANFLDIGGGASAEVMANGLDVILNDSQVKSVFVNVFGGITACDAVANGIVKALEILGEEANKPLVVRLDGNRVEEGRKILADANHPLVVLAQTMDEGADKAAELANK

SEQ ID NO: 93848 - protein, 154 aa, Lactococcus lactis subsp. lactis Il1403
MTIIEGNLRTENAKYGIVVAQFNEFINAKLLSGALDALKRHGVQEEEIDIAWVPGAFEIPIIAQKMATSNKYEAIICLGTVIRGSTSHYDFVCNEVSKGIAHVSLNSNIPVMFGVLTTENIEQAIERAGTKAGNKGFEVAVGAIEMVDLMRKIG

SEQ ID NO: 93849 - protein, 292 aa, Brassica napus
  misc_feature (4)..(4): Xaa can be any naturally occurring amino acid
  misc_feature (18)..(18): Xaa can be any naturally occurring amino acid
  misc_feature (35)..(35): Xaa can be any naturally occurring amino acid
  misc_feature (102)..(102): Xaa can be any naturally occurring amino acid
  misc_feature (266)..(266): Xaa can be any naturally occurring amino acid
PIPXHAYVRSLNHEEDAXEPLLRSEIAEETVVVGXAAAADNELPPSPKLLKEEEEKKRPVLGDEHTIVEAMLTVDFWVLFVSFLCGVGTGLAVMNNMGQIGXALGYTDVSIFVSMTSIWGFFGRILSGTISEHFIKKYGTPRPLWNAASQIIMAVGYLVMALAMPGSLYIGSMVVGVCYGVRLAITVPTASELFGLKYYGLIYNILVLNLPLGSFLFSGLLAGLLYDAQATPTPGGGNTCVGAHCFRLIFIVMAITSIVGVALDIXLAFRTKDIYAKIHGSKNAKKPSGNHR

SEQ ID NO: 93850 - protein, 157 aa, Vitis vinifera
MENAICGRLALSPNHVFNSKSGDKHSLLKGPCTNRSFLMAISASGPGKGGLLERPVIEKVTPGRESEFDLRKSRKIAPPYRVILHNDNYNKREYVVQVLMKVIPGMTLDNAVNIMQEAHYNGLSVVIICAQADAEDHCMQLRGNGLLSSIEPASGGC

SEQ ID NO: 93851 - protein, 323 aa, Rhizobium sp. TAL1145
MTDHLDLVPLGFFPTPIDKWDNLGRELSISLSAKRDDLSGLGGGGNKIRKLQYLLAEAKAEKATTLITAGATQSNHVRQTAAVARKHGMRPLALLRGQLPPSPSGNLLLDELLGAQLEFHDRDDFNAMVVDLMLERKAELEASGERAYVIPIGGSSPLGALGYVDCAKEMREQFDARRQRHPDYIVVAMGSGGTYAGLVAGCARYLPNTQVLGIVITTAAFASRDCAASLLNDTARLAGVDRRWDAEDPLLNYDHIGPEYGVPSQEGNAAIRKVAEAEGVFLDPTYTGKVCAGLIAAVGETIPAGSDVIFVHTGGSPALFAAR

SEQ ID NO: 93852 - protein, 102 aa, Oryza sativa Indica Group
LRQVDEIFVQAIKDAGLYDIIWQAFAVFLPVQTVGVQGDQRTHSNAVALRAITSEDGMTADWYYFEREFLVDVVNKICNNVRGVNRVVQDITQKPPATVEWE

SEQ ID NO: 93853 - protein, 618 aa, Zea mays
MSSFFAVAVALVLSSLIHGTTMATASSEESFFQKCPASSCSEGGPEIRFPFRLATSPLSCGAPGMELVCSKADTVLVHPNLGLCKVTAIWYGGSTITIVPLAAEPEPKCPFQKIISTNLSTDVYRPYGDRATLVSCSAEFIVPSHPASLAGPISCLTNASRRFTYLVPSFRPMDFLPLDCTVLSNSISVPYPASVNAGFNGTARGAVAFGETMLEWRVPNITDVCRDCEAEGRLCGFSSESRQAFCKSKNHSSRLKVIAVTTPVAAVLVLSAMAGAALLHLALKSKYDDEIHRKVEMFLETYRTLKPRRYTFSEVRKMTRRFSSRLGQGGFGSVYKGELPNGGVPVPVAVKMLEDSTGEEEFISEVATIGTIHHANVVRLLGFCSERSRRALVYEFMPNASLEKYIRCSSQEQSLIPTASKMLEIATGIARGIEYLHQGCDQRILHFDIKPSNILLDYNLNPKISDFGLAKLCARDQSVVALTAARGTMGYIAPELYSRNFGTVSCKSDVYSFGMVVLEMVVVSAKRRKYSPAETEDQNDDVCVPEWIYEEIVTGQEPREMARGERDMVRKLAIVALWCIQWNPPNRPSMTTVVNMLTDSLQSLKIPPKPFVSSFVGQ

SEQ ID NO: 93854 - protein, 476 aa, Mycobacterium sp. MCS
MKSVPTGLWIGGEEREAKSTFNVLDPSSDEVLVAVGDATAEDAVAALDAACAVQAEWAATPARKRGEILRSVFETLTDRADDIAALMTLEMGKVLAESKGEVTYGAEFFRWFAEEAVRIGGRYTPSPAGTGRIIVTKQPVGPCYAITPWNFPLAMGTRKMGPAFAAGCTMIVKPAQETPLTMLYLAKLMAEAGLPKGVLSVLPTSSPGPVTEALVDDGRLRKLTFTGSTGVGKSLVKQSADKLLRTSMELGGNAPFIVFDDADVDAAVDGAMLAKMRNGGEACTAANRFHVANSVREEFTEKLVKRMSEVTLGNGLDESATLGPLINNKQLQKVTELVSDAVSRGATVAVGGVAPGGPGNFYPATVLADVPADARILKEEVFGPVAPITGFDSEEEGVAAANDTEYGLAAYVYTRSLDRALRVAEAIESGMVGINRGVISDAAAPFGGIKESGFGREGGTEGIEEYLDTKYIALTK

SEQ ID NO: 93855 - protein, 554 aa, Mycobacterium sp. MCS
MTADDQLTDISATSAWQALQRHHGEIAGRHLRELFAEDPSRGTELTVSVGDLYIDYSKHRVTRETLRLLVDLARAAGLEKRRDAMLSGVHINTSEDRAVLHTALRLPRDASLTVDGQDVVADVHEVLDRMGDFTDRLRSGEWTGATGERIRTVVNIGIGGSDLGPAMVYESLRHYADAGISARFVSNVDPADLVAKLDGLDPATTLFIVASKTFSTLETLTNATAARRWLTNTLGDAAVARHFVAVSTNQKLVDEFGIDTANMFGFWDWVGGRYSVDSAIGLSVMAAIGRERFAEFLAGFHLVDEHFRTAPLEANAPALLGLIGLWYSNFFGAQSRAVLPYSNDLSRFAAYLQQLTMESNGKSVRADGTPVSTDTGEIFWGEPGTNGQHAFYQLLHQGTRLVPADFIGFSQPTDDLPTADGTGSMHDLLMSNFFAQTQVLAFGKTAEEIAAEDTPADVVPHKVMPGNRPTTSILATKLTPSVVGQLIALYEHQVFTEGVVWGVDSFDQWGVELGKTQAKALLPVITADDSPAEQSDTSTDALVRRYRAERGRSA

SEQ ID NO: 93856 - protein, 549 aa, Geobacillus stearothermophilus
MLTFHRIIRKGWMFLLAFLLTASLFCPTGQHAKAAAPFNGTMMQYFEWYLPDDGTLWTKVANEANNLSSLGITALWLPPAYKGTSRSDVGYGVYDLYDLGEFNQKGTVRTKYGTKAQYLQAIQAAHAAGMQVYADVVFDHKGGADGTEWVDAVEVNPSDRNQEISGTYQIQAWTKFDFPGRGNTYSSFKWRWYHFDGVDWDESRKLSRIYKFRGIGKAWDWEVDTENGNYDYLMYADLDMDHPEVVTELKNWGKWYVNTTNIDGFRLDAVKHIKFSFFPDWLSYVRSQTGKPLFTVGEYWSYDINKLHNYITKTNGTMSLFDAPLHNKFYTASKSGGAFDMRTLMTNTLMKDQPTLAVTFVDNHDTEPGQALQSWVDPWFKPLAYAFILTRQEGYPCVFYGDYYGIPQYNIPSLKSKIDPLLIARRDYAYGTQHDYLDHSDIIGWTREGVTEKPGSGLAALITDGPGGSKWMYVGKQHAGKVFYDLTGNRSDTVTINSDGWGEFKVNGGSVSVWVPRKTTVSTIARPITTRPWTGEFVRWTEPRLVAWP

SEQ ID NO: 93857 - protein, 479 aa, Prochlorococcus marinus str. MIT 9215
MTDSIFDFDLIVIGAGYGGFDAAKHAAGKGLRVAIVESSDMGGTCVNKGCVPSKALLAASGKVREIADYEHLAKFGIHASPVRFERSKIADHANNLVLNVRENLTKTLKRSGVEIILGIGRIEGNQKVGVRDKNGIDKIFTCKNIVIATGSSPFVPRGITLDNRTVFTSDDAVKLEWLPRWIAIIGSGYIGLEFADVYTALGCEVTMIEALENIMPTFDPDITKIAKKNLIQARDIDTKSNVFATKITPGCPVKIELTDAKSKEVLETLEVDAVLVATGRSPNSNNLNLESVGIETVKGFIPVDDQMRVKNGDEIIPNIWAVGDITGKLMLAHTAAAQGTIAVDNICGGNVEINYKSIPAATFTHPEISSVGLSEAEAKELSSAENFTLGVVKSFFKANSKALAELESDGLLKLIFNKDNGKVLGAHIFGLHAADLIQEISNAISRDQGVIELAKEVHTHPTLSEVVEVAYKQAASQIK

SEQ ID NO: 93858 - protein, 211 aa, Triticum aestivum
ASCLKSSKLNTIVLSGLSGSGKTTLFYQLRDGSSHQGTVTSMEENSDTFVLHSEQEKKGKVKPVHIVDVPGHARLKPKLDEVLPKAAGVVFVVDAQDFLSSMQAAAEYLYDILTKATVVKKKVPVLIFCNKTDKVTAHSKEFIKKQLEKELNKLRESRTAISSADISDEVQLGVPGEAFNFSQCQNKVAVAEGAGSAGNVLAVEQFIREHV

SEQ ID NO: 93859 - protein, 145 aa, Brassica napus
MEDVTMDLIGGIDKRSECFYGDNARDEYVGPELGLSLKRSCSGSFEKQDQTTKQQKLSLSDESVGIITLTCRDENSQAAEKGDVGVEPSSSGEPKTPSKSHEKLRCDRGSVTTSSNHENMGSSSISGQNELSFRSQVGSESTNDV

SEQ ID NO: 93860 - protein, 291 aa, Medicago sativa
GENVEKIGEGTYGVVYKARDRVTNETIALKKIRLEQEDEGVPSTAIREISLLKEMQHRNIVRLQDVVHSDKRLYLVFEYLDLDLKKHMDSSPEFIKDPRQVKMFLYQMLCGIAYCHSHRVLHRDLKPQNLLIDRRTNSLKLADFGLARAFGIPVRTFTHEVVTLWYRAPEILLGSRHYSTPVDVWSVGCIFAEMANRRPLSPGDSEIDELFKIFRILGTPNEDTWPGVTSLPDFKSTFPRWPSKDLATVVPNLEPAGLDLLNSMLCLDPTKRITARSAVEHEYFKDIKFVP

SEQ ID NO: 93861 - protein, 148 aa, Pisum sativum
VVYKARDRVTNETIALKKIRLEQEDEGVPSTAIREISLLKEMQHRNIVRLQDVVHSEKRLYLVFEYLDLDLKKHMDSSPEFVKDPRQVKMFLYQMLCGIAYCHSHRVLHRDLKPQNLLIDRRTNCVKLADFGLARAFGIPVRTFTHEV

SEQ ID NO: 93862 - protein, 601 aa, Epichloe festucae
MSLFVLAETPAGYGLFKAADKKLFKNKDLAAELGRPEKLVEMLKLKKFVKFESAAMALEEAASLKEGKVPEFLTTLLDELKTEKKASLAVADMKLGTAISNLPQFNISPVSGSETMEVFRGIREHLSSLIPGLEQEIVDRMSLGLSHSMSRHKLKFSADKVDSMIIQAVKLLDDMDKELNVYAMRTKEWYGWHFPEMAKILNDNLAYARVILAVGMRTNVSDTDLSEILPEEVEVAIKAAAEISMGTEIMDEDLENIKLLAEQVIKYSEYRAELSSYLETRMRAIAPNLSALVGYLVGARLIAHAGSLLNLAKSPGSTIQILGAEKALFRALKTKHDTPKYGLITTLPLLGQATGRNKGKIARMLTAKTALVLRVDALGDDDEDDEEERAMLGLTARIKLENHLRRLEGKPPLPKGASVAPSGDITGVGSFMLKETKRYNTDADGITNEDVNGDATPKKEKKDKKDKKPKIEVVVEDSDDEMKDGEDDESDDNDATTPANKVTKLSSAEYERLAELSGLSVKKFKRKYERGDVQVSADGTPKVFSKKELKKLRKAEAQSTPSKVEPSSEKKKKRKHDEDVDEADLQKEKKQKKKKRHSIVE

SEQ ID NO: 93863 - protein, 433 aa, Salmonella enterica subsp. enterica serovar Typhi str. CT18
MKNELMQRLRLKYPPPDGYCRWGRIQDVSATLLNAWLPGVFMGELCCIKPGEELAEVVGINGSKALLSPFTSTIGLHCGQQVMALRRRHQVPVGEALLGRVIDGFGRPLDGCELPDVCWKDYDAMPPPAMVRQPITQPLMTGIRAIDSVATCGEGQRVGIFSAPGVGKSTLLAMLCNAPDADCNVLVLIGERGREVREFIDFTLSEETRKRCVIVVATSDRPALERVRALFVATTIAEFFRDNGKRVVLLADSLTRYARAAREIALAAGETAVSGEYPPGVFSALPRLLERTGMGEKGSITAFYTVLVEGDDMNEPLADEVRSLLDGHIVLSRRLAERGHYPAIDVLATLSRVFPVVTSHEHRQLAAILRRRLALYQEVELLIRIGEYQRGVDTDTDKAIDTYPDICTFLRQSKDEVCGPELLIEKLHQILTE

SEQ ID NO: 93864 - protein, 336 aa, Oryza sativa Japonica Group
MHFFSLFASLSLSLSLSFVLADITDNPCLPLIFFAGNLISLMVFLSPLPTFYRVYRKKSTEGFQSTPYVVTLFSCMLWMYYAFVKSGAELLVTINGVGCVIETVYLAMYLAYAPKSARMLTAKMLLGLNIGLFGVIALVTLLLSRGELRVHVLGWICVAVSLSVFAAPLSIIRLVIRTKSVEFMPFSLSFFLVLSAVIWFLYGLLKKDVFVALPNVLGFVFGVAQMALYMAYRSKKPLVASSSSAVVAAGLEIKLPEHVKEVQAVAKGAVAAAPEGRISCGAEVHPIDDVMPSEVVEVKVDDEETNRTDEMAGDGDHAMVRTEQIIKPDMAIVVEV

SEQ ID NO: 93865 - protein, 206 aa, Brassica napus
GRVGWDAAYADPGNYIGDYRADWGPMSFLSDFLRPSYSEGSSWFALLKKAGGGCNDLLYSGHMLVAVLTAMAWTEAYGGFSSALIWLLVAHSAQREIRERHHYSVDCVVAIYVGILLWKMTGFIWSNKRKSKQTVRLEKIQNRLIHAAKDSDMETVRRLVEEMEVSLGEEKQSGVVSKRAMTVFACATVITTLGIVILALTLTSDG

SEQ ID NO: 93866 - protein, 243 aa, Thermotoga sp. RQ2
MHKTIAEAKKFVSLLVNELHDVKEFEIVVCPPFTALSEVGEILSGRNIKLGAQNVFYEDQGAFTGEISPLMLQEIGVEYVIVGHSERRRIFKEDDELINRKVKAVLEKGMTPILCVGETLEEREKGLTFCVVEKQVREGFYGLDKEEAKKVVIAYEPVWAIGTGRVATPQQAQEVHAFIRKLLSEMYDGETAESIRILYGGSIKPDNFLGLIVQKDIDGGLVGGASLKESFIELARIMRGVIS

SEQ ID NO: 93867 - protein, 392 aa, Mesorhizobium sp. BNC1
MLQTVAAFDRIGEENAFAVLARATELAHQGRDIINLGIGQPDFHTPEHIVEAAVKALRDGHHGYTPANGILAAREAVARRTLATTGVEVSPENIMILPGGKPTMFAAILMFGEPGAEILYPDPGFPIYRSMIEFTGAKPVPVPIREENGFAFSAEETLSLITPKTRLLILNSPANPTGGVAPREEIARLVKGLEAHPQVAILSDEIYDVMTYDGEKATSLLTFPEIRDRLIVLNGWSKTWAMTGWRLGWSIWPDRLYGLVRKLAVNCWSCVNAPAQYAGIAAIDGPQDDVEKMMRAFASRRKLVVEGLNGLPGVTCLTPKGAFYAFPNIRGTGWKAKKLAAALLDEAGVALVGGPDFGVLGEGYIRLSYANSEENILRAIGRMGDFLARTGQ

SEQ ID NO: 93868 - protein, 365 aa, Marinobacter sp. ELB17
MSDEQARLAELRDEIDSIDQQIMKLISARARCALEVARVKMAANPGQDVVFYRPEREAQVLRRIIEQNPGPLPGEEMARLFREIMSVCLALEKPMHIAFLGPLGTFTQAAALKHFGHSVVSVPMPAIDAVFREVESGAAHYGVVPVENSTEGMINHTLDMFMSSPLKICGEVQLRIHHHLMVAPQHDGQEITRIYSHQQSFAQCRQWLDTHRYGIERISVSSNAEAARRAAAEPGAAAIAGDMAAELYGLVKLANSIEDRPDNTTRFLIIGREAVTPSGHDKSSVLVSMRNKPGALYQLLEPFHSHGISLTRIETRPSQTGTWAYVFYIDFEGHMDDEPARKVLAEVDVEAVELKRLGSYPIGVL

SEQ ID NO: 93869 - protein, 453 aa, Bradyrhizobium sp. BTAi1
MVSDPIRLTAPRRNSLTHIPGDEGWPIIGKTFEVLADPKGHVERNARKYGPVYRSHMFGEVNVVLLGPEANELVLFDQAKLFSSAHGWGHILNLLFPRGLMLLDFEEHRMHRKALSVAFKAGPMKSYLTGLDRGIAARIAQWKQTPGEMLFYPAIKQLTLDLAATSFLGTEIGPEVDAINRAFVDMVAASVAPIRKPLPGTQMARGVKGRQRIVAYFSEQIPLRRAKGDGDDLFSHLCRATDDHGALLSTQDIVDHMSFLMMAAHDTLTSSITSFIAQLAAHPEWQQKLRDEVASLGLVAGAPMASEHLEKMKLTEMAFQETLRLMPPVPSLPRRPIRDFTFKGYAIPAGTGVGVNPMFTHHMPEIWPEPERFDPLRFTDEAQRGRHRFAWVPFGGGAHMCLGLHFAYMQVKCFARHFLSNIEVSFAPGYRPNWQVWPIPKPRDGLRVMLKAV

SEQ ID NO: 93870 - protein, 95 aa, Arabidopsis thaliana
  misc_feature (4)..(4): Xaa can be any naturally occurring amino acid
  misc_feature (6)..(6): Xaa can be any naturally occurring amino acid
  misc_feature (9)..(9): Xaa can be any naturally occurring amino acid
  misc_feature (15)..(15): Xaa can be any naturally occurring amino acid
  misc_feature (21)..(21): Xaa can be any naturally occurring amino acid
  misc_feature (40)..(40): Xaa can be any naturally occurring amino acid
  misc_feature (43)..(43): Xaa can be any naturally occurring amino acid
  misc_feature (50)..(50): Xaa can be any naturally occurring amino acid
  misc_feature (75)..(75): Xaa can be any naturally occurring amino acid
  misc_feature (81)..(81): Xaa can be any naturally occurring amino acid
  misc_feature (83)..(83): Xaa can be any naturally occurring amino acid
  misc_feature (85)..(85): Xaa can be any naturally occurring amino acid
KARXIXDSXGNPTVXVLIHTXNGVKVTAAVPSGASTGIYXALXLRDGGSXYLGKGVSKAVGNVNNIIGPALIGKXPTQQAXIXNXMVHELYGTQN

SEQ ID NO: 93871 - protein, 606 aa, Marinobacter sp. ELB17
MHSHLQAPDSKTDSNTRSGRLKATVLGAFAISTKLVAVSARLIVISTSLAVSYGAHADAILEGERFNPVTATQGMVSTSHALATEVALQILKDGGNAVDAAVTAGFALAVTQPRSGNIGGGGFMLIAPGDGAAPEAIDYRETAPAAATEDLFLDDDGNVVQNRSRFTHKAAGVPGTVAGLALALERHGSISLKQALAPAIKLASDGFIVPRRFNEGLEQARERMTLWPATLKTFYKEDGSAWQPGERFRQPELAATLQRIADQGTDGFYKGETARLIAEEMARHDGLITEADLAGYKPVVRTPVHGTYRGYDIYSMSPPSSGGVHIVQILNIMEGFPIAEFGHNSASAIHYMAEAMKLAYADRTQYLGDTDFVDVPVAGLISKGYAEELRGTIRAEKARPASEIKPGQPAAYESPETTHFSVVDRWGNAVSNTYTINFSYGSGITVAGAGFLLNNEMDDFSAKPGVPNAYGLIGGAANKIEPGKRMLSSMSPTVVRKDGRNFLVTGSPGGSRIITTTLQVIMNVIDHGMNIQSAVSVPRIHHQWLPDQIRIEQGISADTVKLLESKGHTVVTDSAMGAIQSIMIGEDGTLYGGADPRRSTSSAQGF

SEQ ID NO: 93872 - protein, 422 aa, Oryza sativa Japonica Group
MVLPGSKESQNYDSNNQKVHPQPIDENMNQNMGSMDTMIGRIFNNISSLKSAYIQLQEAHTPYDPDKIQAADQLVIEELTKLSELKHAYREKNPKPVAATPQDARLLSEIQEQQNLLKTYEVMVKKFQSQIQTRDTEITHLQQQIDEAKLRKSKLEKKLKQRGLLNKESEESDDEDNYFSIELTPSLFTSAVDNAYQSIHDFSKPLINMMKAAGWDLDAAANAIEPAVVYTRRAHKKYAFESYICQRMFGGFQEESFSVKAANITVSNEAFFHQFLAVRAMDPLDVLSQNPDSVFGKFCRSKYLLLVHPKMEGSFFGNMDQRNYVMSGGHPRTPFYQAFLKLAKSIWLLHRLAYSFDPKVKVFQVKKGSDFSEIHMESVVKNIILDEGAERPKVGLMVMPGFLIGTSVIQSRVYLSGVKSAD

SEQ ID NO: 93873 - protein, 368 aa, Streptococcus pyogenes MGAS315
MEHKWKLWLFIVGVVLLIGGASVLIQKGQAKAFSQGKPQLPAKKVKSTKVDPNAPVDQKVIYLAEGCFWGVEEYFSQVDGVLDAVSGYANGRGDTTNYQLIHQTGHAETVEVTYDANRISLKELLLHFFRIIDPTSLNKQGNDRGSQYRTGIYYTDKADLAIIDEVFKEKAKDYKKKIVVEKAPLKHFIKAEEYHQDYLKKNPNGYCHIDINQATYPVIDESKYPKPSATEIKAKLSADEYRVTQKNETEKAFSNRYWDSFDAGIYVDVVTGEPLFSSKDKFESGCGWPSFSRPISPDVVRYKEDKSFNMTRTEVRSRSGNSHLGHVFTDGPKDQGGLRYCINSLSITFIPKADMEAKGYGYLLSSVE

SEQ ID NO: 93874 - protein, 439 aa, Sulfitobacter sp. EE-36
MKIAMIGTGYVGLVSGVCFSDFGHEVVCVDKDPSKIEKLEKGIVPIYEPGLDDLMAKNVAAGRLSFTGDLASAVDGADAVFIAVGTPTRRGDGHADLTYVMAAAEEIASVLTGYAVIVTKSTVPVGTNRQVKQVVAKANPEAEFDVASNPEFLREGAAIDDFMRPDRVVVGTQNERAEQVMKDIYRPLSLREFSIMSTDLESAEMIKYAANAFLATKITFINEIAALCERTGADVKMVSKGMGLDNRIGSKFLHAGPGYGGSCFPKDTQALARMGQDHSVPMQLTETVIKVNDEVKRRMIDKVVDICGGSVNGKTIAVLGVTFKPNTDDMRDSPSLTIVPSLVGNGAKVRVVDPQGKREGEALLPGVSWLEDAYKAAQNADALVILTEWNEFRALDLKRMAKRMTTPAMADLRNIYSPKDAKRAGFSAYVSIGREGFGA

SEQ ID NO: 93875 - protein, 375 aa, Mycobacterium smegmatis str. MC2 155
MKTKGALIWEFNQPWSIEEIEIGDPVKDEVKIQMEASGMCHSDHHLVTGGIPMGGFPVLGGHEGAGIVTEVGPGVEGIEPGDHVVLSFIPSCGSCPSCQAGLRNLCDLGAGLLGGVAVADGTHRIHANGKPVFPMTLLGTFSPYMVVHKSSVVKIDKSIPFEVACLVGCGVTTGYGSAVRSGDIRPGDDVAIFGIGGVGMGALQGAVNAGARYIFAIDPVEWKRDQALKFGATHVYPDVFSAMAGIAEVTAGGMAKKVIVTVGELHGEDIDNYLNVTSKGGTCVVTAVGSMLDTNANINLAMLTLLQKNLQGTIFGGGNPHHDIPQLLSMYKAGKLNLDDMVTRQYRLEQINDGYQDMLEGRNIRGVIRYTDADR

SEQ ID NO: 93876 - protein, 320 aa, Streptococcus pyogenes M49 591
MSYSDLKLFALSSNKELAEKVASAMGLQLGKSTVRQFSDGEIQVNIEESIRGHHVFILQSTSSPVNDNLMEILIMVDALKRASAEKISVVMPYYGYARQDRKARSREPITSKLVANMLEVAGVDRLLTVDLHAAQIQGFFDIPVDHLMGAPLIADYFDRHGLVGEDVVVVSPDHGGVTRARKLAQFLQTPIAIIDKRRSVDKMNTSEVMNIIGNVSGKKCILIDDMIDTAGTICHAADALAEAGATAVYASCTHPVLSGPALDNIQRSAIEKLIVLDTIYLPKERLIDKIEQISIADLVAEAIIRIHEKRPLSPLFEMGN

SEQ ID NO: 93877 - protein, 391 aa, Prochlorococcus marinus str. MIT 9215
MNTYSRFDISFKKGKGCWLWDKKGKKYLDAVAGIATCSLGHSNRILRRKLSAQLKKIQHISNLYNIEEQEQLSRKLTNISCAESVFFCNSGAEANESAIKLIKKFGNKTNEGKESIILAAESSFHGRTLASLSATGQPKYQKGFEPMVKGFKFFEFNKFDSVKKLFEDCENNNQKISGVLVEPIQGEGGVIPGNKIFFKSLKDICDKYNSLLILDEVQSGVGRTGKMWGYENLGIEPDGFTLAKGLGGGHAIGALLVKGKANIFTPGDHASTFGGNPFACKAALTVLEEIDRRNLVKNVYLRGEQLRAGFEELSKKFPNIIKGKRGLGLIQGLVINEDYADAKKITLKAFDKGLLVVPAGGNVVRIVPPLVISQREINILLDRLNSIFDEL

SEQ ID NO: 93878 - protein, 413 aa, Oryza sativa Indica Group
MGSGSSKAGASSASSSSSASASASASGGDEAMALTSSKGEENGSLPSIAQMDKSEEDAPTIPKSHPALLQAISWLAIALWPAISLPVLTIFLLLSNFGASICEVANDAIVAEAGKQATSSSGSGQLQSFAWMFGSSAGALGNLVGGIALSYFSPKIMFLFFAILLVLQFCTTVAIPESSLQLPKADTNLSAVSSVRKQIKELSYALCMPEIFWSVIWFSLSYAAIPFLLGTMFFYQTEVLRLDSSVIGLSKVFGQVTLLAWSVAYNKYFKTTPAQKVLSVLQFLPALVMLSDVLFVQGIYRNFGIPDSMYTIVFSGLLEGLMLFKVLPFSVLVAKLCPSGCEGSLMAFVMSALALATIISGYLGVALAEFMGVSGGDFSALPTCLLIEAACTMLPLFFSSLIKERREKEKKEE

SEQ ID NO: 93879 - protein, 412 aa, Coccidioides immitis RS
MSQTVTRADSVEEQDPHNSREDKKPKSRRPANTAFRQQRLKAWQPILTPKTVLPLFFAVGIIFAPIGGLLIWASSQVEEIVIDYSKCETDAPLGSGNARSIPEENVRASFRSQKPISQLQWYRTENQAVQLHSGVVKNDTTVCSLIFEIPNDIGPPVYFYYRLDKFYQNHRRYVKSLDLEQLKGKALSNGTIGSSACDPLRLNPDGKAYYPCGLIANSLFNDTFSSPVKVGTSPNETFEMTNQGISWASDRELYGPTEYSYDQVVPPPNWKEMYPDDYTEDYPPPNLREWEEFQVWMRTAGLPTFSKLARRADNKTMTAGLYRIDINYYFPVLKYDGKKSIVLTTTTVMGGKNPFMGIAYVVVGGLCIVLGALFTLAHLIKPRKLGDHRYLTWNNEQSPTAMTTGRDAGFGG

SEQ ID NO: 93880 - protein, 524 aa, Xanthomonas oryzae pv. oryzae KACC10331
MGVSVPPPPPPRCAHASVAQEQTYRPPAIRRLSDKLLITMSPESETRSMHNTLILFGATGDLAQRYLFPSLLRLYIDGLLPEDFRIRALALSPHDTEAFRDVLRPRLTEALPIATPEQIQALLQRVDYRSVDLRNAESVADAVRELASRQIVSYLAIPPGLYISTCQGLALGGALAAPHRLMLEKPIGHDSDSARDILQSIGALIDEDRVFRLDHYLGKAAVQNLIALRFGNTLLEAVWNRTYIESVQILIAESEGVDGRDAYYARSGALRDMVQSHILQLLCLVAMEPPASLEADRIRDEKVKVLRALRPMTAEHAAHDSVRGRYTAGSINGQPAQAYHPPEGSDVETFIAVTAHIDNWRWAGVPFHLCTGKRLAERSTRIVVTLKPVTHWLFERPDRQNAVPNRLTFQLQPQENIELGLMSSLAGPEWGAIELQPLELELSVPTGLHRRIAYERLFVDAFNGNPALFVRDDEVKAAWSWIDSVSDAWKDAALPLQPYPAGSWGPESATHFLPPATDAQANNA

SEQ ID NO: 93881 - protein, 199 aa, Streptococcus pyogenes M49 591
MAEEQVLNTHNASILLSAANKSHYPQDDLPEIALAGRSNVGKSSFINTILGRKNLARTSSKPGKTQLLNFFNIDDKLRFVDVPGYGYAKVSKSERAKWGKMIEEYLTTRDNLRAVVSLVDLRHAPSKEDIQMYDFLKYYDIPVIVVATKADKIPRGKWNKHESVVKKALNFDKSDTFIVFSSVERIGIDDSWDAILEQV

SEQ ID NO: 93882 - protein, 216 aa, Mycoplasma hyopneumoniae 232
MKRKIISPSLLNIKKSSRLKSTRIFLNLGIKWFHFDFMDGIFVKNVAISIPEIKNIIKKSKEFISDVHLMSVNPEEQIKQLLGYVNFATIHFESRNYAQIKEIISKYSRKIKIGIAIKPETKIEQIYDLLPEIQLVLIMSVEPGKGGQAFIENTYKKIEELSKIIQENNYKIIIQVDGGIKDFNSKKVFDSGADVIVVGTFLAEKPTKLKIKKLIN

SEQ ID NO: 93883 - protein, 108 aa, Zea mays
  misc_feature (46)..(46): Xaa can be any naturally occurring amino acid
  misc_feature (70)..(70): Xaa can be any naturally occurring amino acid
MAMTMSQVGSHSMHGENMDSIHMDSYYKDLLHKKGDHPPQPPTTQXCQELSKQIFYTRLGSLRGRYETFXKDLAGAKQVWNNMTDLSAHDLVIATLCAAELNAWIWQR

SEQ ID NO: 93884 - protein, 480 aa, Botryotinia calthae
VVVAAGVAAFIVLSVVLNVLNQVLFANPNEPPMVFHWLPVIGSTITYGMDPYKFFFDCRAKYGDIFTFVLLGKKTTVYLGRKGNDFILNGKLKDLNAEEIYTVLTTPVFGKDVVYDCPNAKLMEQKKFMKIGLSTEAFRSYVPIIQMEVENFMKRSSAFKGPKGTADIGPAMAEITIYTASHTLQGKEVRDRFDTSFASLYHDLDMGFSPINFMLHWAPLPHNRCRDHAQRTVAKTYMDIIQNRRAQATEAESKSDIMWQLMRSSYKDGTPVPDKEIAHMMIALLMAGQHSSSSSISWIMLRLASRPDIMEELYQEQIQVLGADLPALKYEDLSKLSLHQNVLKETLRLHTPIHSIMRKVTTPMPISGTKYVIPTSHTLMASPGCTSRDDEFFPEALEWDPHRWDLGSGRVIANDQDEEFQDYGYGMISKGASSPYLPFGAGRHRCIGEQFATVQLVTIMATVVRLFKFKNVDGSKDVIG

SEQ ID NO: 93885 - protein, 467 aa, Pseudomonas putida
MQQAQGLKRGLNARHIRFMALGSAIGTGLFYGSASAIQMAGPAVLLAYLIGGAAVFMVMRALGEMAVHNPVAGSFGHYASTYLGPMAGFILGWTYAFEMVIVAIADVTAFGIYMGFWFPEVARWIWVLGIVFLIGGLNLCNVKVFGEMEFWLSLLKVGAIVAMILAGLGIMAFGFSQVGTGHAVGVSNLFDHGGFMPNGVGGLIASFAVVMFAFGGIEIIGVTAGEAKDPQRVIPKAINAVPLRILLFYVLTLFVLMCLYPWPQIGSEGSPFVQIFSNLGIGSAAAVLNVVVISAAISAINSDIFGAGRMMYGLAHQGHAPRSFGKLSKHGVPWMTVVVMGAALLIGVLLNYLIPENVFLLIASIATFATVWVWLMILLTQVAMRRSMSREEVAQLKFPVPFWPYGPAMAIAFMVFIFGVLGYFPDTQAALIVGVIWVVFLVASYLLWCKPRAGQGQPVAEPVELHR

SEQ ID NO: 93886 - protein, 389 aa, Solibacter usitatus Ellin6076
MKANCWRGKKKMEVEQVPDPKILNSQDAIVKITSTAICGSDLHLYNGFVPSMQDGDIVGHEFMGEVMEVGKDVGKLKVGDRVVVPFPISCGKCFFCEKQMYSLCENSNPNAWLAEKLWGHSPAGLFGYSHLLGGFAGGQAEYARVPFADVGPIRIENGFTDEQVLFLSDIFPTGYMAAEACDIQPGDTIAVWGCGPVGLFAIKSAFLLGAERVIAIDRFPERLKMAREKCGAVTLNYEHVDVLDTLKEMTGGRGPDSCIDSVGMEAHGHGAMYAYDRAKQALMLESDRPIALREAIMACRNGGTVSVPGVYGGLVDKLPMGSVMNRSLVIKTGQTHVQRYLRPLLQRIENGEIDPSFVVTHRLPLDEAPKAYDMFLNKTDDCIKVVLKP

SEQ ID NO: 93887 - protein, 399 aa, Thermotoga sp. RQ2
MEKMTIRDVDLKGKRVIMRVDFNVPVKDGVVQDDTRIRAALPTIKYALEQGAKVIFLSHLGRPKGEPSPEFSLAPVAKRLSELLGKEVKFVPAVVGDEVKKAVEELKEGEVLLLENTRFHPGETKNDPELAKFWASLADIHVNDAFGTAHRAHASNVGIAQFIPSVAGFLMEKEIKFLSKVTYNPEKPYVVVLGGAKVSDKIGVITNLMEKADRILIGGAMMFTFLKALGKEVGSSRVEEDKIDLAKELLEKAKEKGVEIVLPVDAVIAQKIEPGVEKKVVRIDDGIPEGWMGLDIGPETVELFKQKLSDAKTVVWNGPMGVFEIDDFAEGTKQVALAIAALTEKGAITVVGGGDSAAAVNKFGLEDKFSHVSTGGGASLEFLEGKELPGIASIADKKK

SEQ ID NO: 93888 - protein, 333 aa, Thermotoga sp. RQ2
MARVAINGFGRIGRLVYRIIYERKNPDIEVVAINDLTDTKTLAHLLKYDSVHKKFPGKVEYTENSLIVDGKEIKVFAEPDPSKLPWKDLGVDFVIESTGVFRNREKAELHLQAGAKKVIITAPAKGEDITVVIGCNEDQLKPEHTIISCASCTTNSIAPIVKVLHEKFGIVSGMLTTVHSYTNDQRVLDLPHKDLRRARAAAVNIIPTTTGAAKAVALVVPEVKGKLDGLALRVPTPDGSITDLTVLVEKETTIEEVNAVMKEATEGRLKGIIGYNDEPIVSSDIIGTTFSGIFDATITNVIGGKLVKVASWYDNEYGYSNRVVDTLELLLKM

SEQ ID NO: 93889 - protein, 272 aa, Oryza sativa
MADYLASIFGTEKDKVNCSFYFKIGACRHGEKCSKVHNKPTFSQTVLLKNLYINPLSTTVYSWDHKVIDPNNAEQVQKNFDDIFEELFLEMEHKYGEIEEMNICDNLSEHLAGNTYVKFRYEEDAEKACQDLNNRWFGGRPVWAELSPVTDFHEACCRQYQMGECPRGGFCNFMHLKPISNTLRRRLYNLKQMARKLHRYRDDFDSDRDEFGSGGNYFNANGYGNEFTMGGYTKDGHLRERTRSRYAPSRSRSPSRSRGRGGRNRNPESQPY

SEQ ID NO: 93890 - protein, 427 aa, Burkholderia mallei ATCC 23344
MNNADLHARKNAATPRGVGVMCDFYAARAENAELWDVEGRRFIDFAAGIAVLNTGHRHPRIVKAIADQLGQFTHTAYQIVPYASYVELAEKINARAPIAQPKKTAFFTTGAEAVENAVKIARAYTGRPGVIAFAGGFHGRTMMGMALTGKVAPYKIGFGPFPGDVFHAPYPNALHGVTSADSIAAVETLFKADIDPKRVAAIIFEPVQGEGGFNPAPAEFVRALRKLCDAHGILLIADEVQTGFARTGKLFAMEHYDVSADLMTIAKSLAGGMPLSGVVGRADVMDAAAPGGLGGTYAGNPLAVAAAHAVLDVIDEEKLAERATVLGDKLKAKLAALRAELPQIVDVRGPGAMVAAEFVDPHTRASDAAFTKRVQTLALERGLLLLICGVDANVIRFLFPLTIEDAVFDEALGILESVLREAVGVPA

SEQ ID NO: 93891 - protein, 489 aa, Burkholderia mallei ATCC 23344
MTTAHETLALKDPALLRERAFVAGEWQAADGGATLEVRNPATGALIGTVPAMGAAETRRAIDAANAAWPAWRKKTAKERAAILRKWHDLMIAHADDLALILTTEQGKPLAEAKGEIGYAASFLEWFAEEGKRVYGDTIPTPAADKRIVVTKEPVGVCAAITPWNFPAAMITRKVGPALAAGCPIVVKPAEATPFSALAMAVLAERAGVPAGMFSVVTGEPKAIGGELTSNPIVRKLSFTGSTPVGRLLMAQCAATVKKVSLELGGNAPFIVFDDADLDAAVEGAIASKYRNSGQTCVCTNRFYVHEKVYDAFAEKLTAAVAKLKVGPGTEAGVVQGPLINGAAVRKVEAHIADALDKGARVTTGGQRHPLGHGFFEPTVLTGVTPDMKVAKEETFGPLAPLFRFSTEEEAIRYANDTEFGLAAYFYSRDIGRVWRVAEALEYGMVGINAGIISNEVAPFGGVKQSGLGREGSHYGIDDYVVIKYMCVAV

SEQ ID NO: 93892 - protein, 310 aa, Debaryomyces hansenii CBS767
MDSTLGSDSLEPEKRTTIDSEGLNHRNPERFEGENRLSPDLEAQGIEEEALAVNPAREPLYKFTIFFTEDEKRVSIYGAEFFGTYVFLLSAYLVASVANLQAIAAEDGFYAPRVYNISFGFGISLLVVAACTSNFSGGHLNPAVVWGLFLNGNISMFRFLLESLVQVIAGMAAAGTASAMYPGPVTFANAKDASVSVSRGLFLEAFGVALLVFTVLFTAIEVSPFGGMAYLPIGLSLFLGHMICVPTTGAGLNPARSFGPAIAARDFPGYHWIYWLGPVIGGAVAVVAYKMIKLGHRGTILQEARMKSNS

SEQ ID NO: 93893 - protein, 442 aa, Triticum aestivum
  misc_feature (22)..(22): Xaa can be any naturally occurring amino acid
MPALYQLQQVPGITDLGLMPRXKVSNVAIVGGGLMGSGIATALILSHYPVILKEINEKFLNAGIGRIKENLQSRVRKGKMTKEKYDKTLSLLTGVLDYEKFKSVDLAIEAVVENVKLKQQIFAELEQHCPSHCILATNTSTIDLNLIGEKTNSQERIVGTHFFAPAHIMPLLEIVRTPRASLQAVVTLLDVGKKIKKTPIVVGNCTGFAVYRMFFPYTQAALLLVDHGMDVYKIDQACTEFGMSIGPFRMTDLVGFGVALATGMQFLENFPELVYKSMLIPLMVEDKRTGEASQKGFYRYEGKRKASPDPEIMNYVNESRRIAGATPDPELLKLDNSAIAEMVFFPVINEACRVLGEGIAFKASDLDIASIFGMGFPPYRGGIMHWADSIGARRICTMLSEWEMEYGQFFKPCSHLLERAAEGLPLSASATKTMNNQAKGKL

SEQ ID NO: 93894 - protein, 133 aa, Ashbya gossypii ATCC 10895
MVRAVKKKVAGMQAAGPVVGNVLEQFREALQITWRAYSRDLKSDQRLLLIDTLCGGLVTIGLVQVLFIAVIRDTFPFNAFLAGFISCVGQFVLLISLRLQLREQFAGISSQRAFGEFVLASLVLHFICLHFIN

SEQ ID NO: 93895 - protein, 469 aa, Burkholderia mallei ATCC 23344
MAIISESSSAAAAAAPGGARAPDTLARSLNVRDVVMITVSGVTPASSIFVIAPFAIQQAGSGAVMSFVLGGLLAFAFALCYAELSAAHRSAGGEYVMVKRVFGALPGYLTFVAVLAVNVFIPAVLASGAAPYLNAALGTQLGNQSVALAIVLASYALGILNIRTNAWITGAFLVIEILVLALIAYLGFSEPHRSPLALVHPVVANGAALVPATLAAIMPAVGTAIFCYNGFGAAVFLAEDLEGGNRDIAKAVICSLAVILVVELVPLTAIVLGAPSFVELAKSADPIGYVVRALSNPGVSRVVSGGIFLSVFNAIIAIVIMVGRFLYSSGRHALWSHACNGAFTRIHPRLESPWIATLTLAVPSTLLVFVLSLDALTAFTVDLLLLVYLAVGVAALASRVMRRDVDHHYRMPWWPLPPIVAIAGAGYTLYTTIAAATKPTDLYIIAGLAAVSLAAYARWARRSAAFREL

SEQ ID NO: 93896 - protein, 224 aa, Haloarcula marismortui ATCC 43049
MSRSEETAVDADSVADAVAAFARGEPVLIHDAADREGETDLVYPAGAVSPDAVARMRNDAGGLVCVALSDRVAEALELPFMQEVLSHPTAADHDLAYDERSSFSLTVNHRDTFTGITDDDRSLTIQELAAVAADPDPDAFSDAFRSPGHVHLLRAAPDGLADREGHTELALALAAAADQPEAAVVCEMLDDETGAALPPAAARAYAEREGLVYVEGASLLERFD

SEQ ID NO: 93897 - protein, 447 aa, Neorickettsia sennetsu str. Miyayama
MYQHNKTVNLSVRDKSLIWHPLTQEKTSSPSIAIIRGEGEYLYDEQNKKYLDLISSWWVNLHGHANPAIAHAIYEQALKLEQVIFAGFTHDQAIQLCENLKVELPENLTRFFFSDNGSTSVEVALKIALQFWKNSGEKQRDIFISFDKGYHGDTVGAMSLGASSGFFDQYKKILFETVHVPFPATWENDPDVEIKEEASLNTIQNFLEQNLNRVAGFIAEPLVQGAGGMRMCRYKYLEQCVKLFKEYGILTIFDEIMTGFYRTGKMFASDYILSKPDILCLSKGLTGGFLPLSLTITTERVYNAFLSDNFSSALIHSHSYTGNPLGCAAAIASLELLKSTSTLDKIAKIEQLHRSFICDLKLTLPEIIKAERVCGTIVAFNLFSEECNYNHTIAVKLREIFMKEGLLIRPLGNTIYLMPPYCISEKALKEAHCKVMELISSIAGSFT

SEQ ID NO: 93898 - protein, 369 aa, Magnetospirillum magnetotacticum MS-1
MAAKKLLILPGDGIGVEVMAQVRRIIDWMARKRKVEFEITEGLLGGAAYDVHGTPYPAETLEAALAADAVLLGAVGGPKWDDLPFDKKPERGLLGIRKDMGLFANLRPATVLDALADASTLKNEVVSGLDIMILRELTGGLYFGQPRGIDTLPDGTRKGYNTLVYTTPEIVRIGRVAFDLARKRNKKLCSVDKANVLECTVLWREEMIKLQKEEYPDVELSHMYVDNAAMQLVRNPKQFDVMVTENMFGDILSDCAAMLTGSLGMLPSASLGEADANGKRKALYEPVHGSAPDIAGKDMANPLATIMSFAMCLRYSFDMVAEADLIETAVKNVLKGGLRTADIMQPGKAKVSTTVMGEAVVRELDKLNS

SEQ ID NO: 93899 - protein, 278 aa, Bacillus clausii KSM-K16
MKEHNKVVLITGANSGIGLELTKNLLLQGWEVAALIRSDFPNEQPIIIDALKKNHLRVYKADLADFSSLRNALDEIKKSETKIDMLFNNAGVSFAEYKHSKQGRELHFEVNTLVPFIITMELKELLLKGQNKTIINTSSNSLLFLKQFDLNTIINPKTPFKKLIGPYANSKLALSLWTNGIAPELSSEGIKIRSVCPGPNKTRLTKGKGMPSYILLIRNLMFTPPSKGASRLYDAAFNNEITGIFINKGKETAIKLSGHEEEVLNRLYDIYKNEFLVL

SEQ ID NO: 93900 - protein, 425 aa, Shigella flexneri 2a str. 301
MTRRGKCRGALPSDTLSRGFRMGQSSQPHELGGGLKSRHVTMLSIAGVIGASLFVGSSVAIAEADPAVLLAYLFAGLLVVMIMRMLAEMAVATPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYAEVSGISRLWDSGGFMPNGFGAVLSAMLITMFSFMGAEIVTIAAAESDMPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAAFLTVVVNYYAPAKVFKFLIDSSGAIALLVYLVIAVSQLRMRKILRAEGSEIRLRMWLDP

SEQ ID NO: 93901 - protein, 349 aa, Taxodium distichum var. imbricarium
  misc_feature (84)..(84): Xaa can be any naturally occurring amino acid
LRDHDASQHLFQVSSGLDSLVLGEGQILAQVKQVHKVGQGVVGFGRNIGGLFKHAITAGKRVRSETSIAAGAVSVSSAAVELAXMKLPKDGIFSARMLVIGAGKMGKLVIKHLIAKGCKRIVVVNRSEERVSLLQEELTGAELIYQPLTEMLSNAAEADVVFTSTASETPLFLKEHVENLPPVAANVGGIRLFIDISVPRNVGPCVSEVNLARVYNVDDLKEVVEANKEVRQKKALEAQMIIDEELRQFDAWRDSLETVPTIKKLRAYAERIRMTELEKCLSKLGDDVSKKNRKLVDDLSRGIVNKLLHGPMQHLRCDGSDSRTLSETLENMHALERMFNLETEISVLE

SEQ ID NO: 93902 - protein, 476 aa, Sulfitobacter sp. EE-36
MAHITNHMPTAELQSLDAAHHMHPFTTNDELAEKGARIITRAKGVYLTDSEGNEILDGMAGLWCVNIGYGRQEMADVAARQMLELNYYNTFFMTSHVPAIALAKEIASLAPGDLNHVFFAGSGSEANDTNIRMVRTYWAMKGKPEKSHIISRKNAYHGSSMGSGSLGGMSYMHEQGGMPIPGIHHINQPDWWVEGGDLTPEAFGLARAQELEAKILELGADNVAAFIGEPIQGAGGVIVPPSTYWPEIQRICDKYNVLIIADEVICGFGRTGSWFGSETMGIKPHIMTIAKGLSSGYQPIGGSIVCDEIAQTIGSGEFNHGYTYSGHPVCSAVALENLRIMQDENILDHVNNVAAPALKEGLAKLAEHPLVGTVNVAGLMASLPLSPRKETRSKFAGDAGTVGYMCRERCFANNLVMRHVGDRMIISPPLVITPEEIKVFMTRATKALDETYTAVKEGGLLKAAEDHAQDAESPLG

SEQ ID NO: 93903 - protein, 589 aa, Gluconobacter oxydans 621H
MGLGPAGRVEELPLPDITERYSAIGPEAEGVRLDEAIARALHQIEKMRDRLVGLPEEGREEIASLLMVYERMLGPSRLLRQVRSRIADEGLCAEAAVSEVTRELALQVSRMAEAVARENNNTQEADANLRLAGEFEEIGRRLVRNLTGISYRAFSSLPPGSVLVAEQLRPADVAMIDPARIAAVVTQGGGGADHTAILLRALDIPAILAVPNLMAQVQEGEMVVVDGHLGTVTLSPNETELRLAAESAQREVKEKRAFGRLKRLPAQLQSGEDIELSANLELPAELPMLMRNGAKGIGLLRSEFLFGEREDLPDEDGQTDAYRAIVQAMDGRPVTIRVLDWGGEKGRACMRRLGLAEQVADGDNPALGLRGVRLLLRVPEVLETQFAAILRAAEPAEGVPPGRVRILLPMVTSSDEIVDAREIYDRVVRRLKRKGHMLPDPLPPLGIMVETPAAALTVDTLARHADFMALGTNDLTMYTLAVDRADSMVADRYSPLHPGVLRLIEAAADSALRARRPISVCGEMASDPRVVALLIGLGLRSFSMNSASLPRVKRLIRTLTLEDCDQLRRQVMLETDPVVIRDLVRQFAT

SEQ ID NO: 93904 - protein, 478 aa, Mycoplasma hyopneumoniae 232
MNDMKNYISKRTKIIATIGPSTQDYEVLKKLVLSGVSVIRANFSHGNYQEQKQKFDSARKLSNELKIPISIMLDTKGPEIRIGKILEGSQKILANQRLTVLTDSDSYQNFQGTAQIITVSHQIDKDLKIGDKILFDDGKLQSVVIEIEPGKVVVRTKNSHVLKSNKRLNLPGVAFSLPFLSQKDIDDILFGINENVNYIAASFVNSGENVRELRTLLDQNGGGHIQIISKIESRLGLENIDEIIELSDGIMIARGDLGLEVPYEEVPFQQKRIIRKCRFAGKTVVVATQMLDSMEKSSQPTRAEVTDVYWATELGADATMLSGESAQGQFPIESVQVMAVINKRAEKEFYNKLFYAKQLAVITENSRGLRAKIAHKLAHLAYEKEIKYTVVLSRTGQLLREIAKFRPNTAVIGVINNEKLINGFGITSSVFVSINSISEFTAIKNDFSLARNVLEPFGVEKGDTFLVVENEKMVQFVY

SEQ ID NO: 93905 - protein, 516 aa, Mycobacterium smegmatis str. MC2 155
MTAVNDRPDTTWHNPLRDKRDKRMPRIAGPCGVVIFGVTGDLARKKLMPAIYDLANRGLLPASFALVGFARRDWEDEDFGQVVYDAVRQHARTPFRQEVWDRLAEGIRFVQGTFDDDTAFTRLAETLDKLDIERGTGGNHAFYLSIPPNAFPVVCEQLRKSGLAKPRDGRWSRVVIEKPFGHDLGSARELNSVVNSVFPEESVFRIDHYLGKETVQNILALRFANALYEPIWNNNYVDHVQITMAEDIGLGGRAGYYDGIGAARDVIQNHLLQLLALTALEEPVSFSPHELQTEKIKILSAVKLAEPLDETTARGQYAAGWQGGEKVVGLLDEEGFAKDSTTETYAAITLEVNTRRWAGVPFYLRTGKRLGRRVTEIALVFKRAPHLPFDATMTEELGQNALVIRVQPDEGITLRFGSKVPGSAMEVRDVNMDFSYGSAFAEDSPEAYERLILDVLLGEPSLFPVNEEVELSWEILDPVLEYWAQHGKPEPYESGTWGPPSADAMLRRTGREWRRP

SEQ ID NO: 93906 - protein, 125 aa, Oryza sativa Indica Group
MAARKFFVGGNWKCNGTGEDVKKIVTVLNEAEVPSEDVVEVVVSPPFVFLPQVKGLLRPDFSVAAQNCWVRKGGAFTGEISAEMLVNLQVPWVILGHSERRALMGESSDPEFVDIIKSATVKSSA

SEQ ID NO: 93907 - protein, 328 aa, Populus trichocarpa
MASDTLVLRGTMRAHTDQVTAIATPIDNSDMIVSSSRDKSIILWSLTKDEKTYGVARRRLTGHSHFVQDVVLSSDGQFALSGSWDGELRLWDLATGVSARRFVGHTKDVLSVAFSIDNRQIVSASRDKTIKLWNTLGECKYTIQEAESHTDWVSCVRFSPNTLQPTIVSASWDKTVKVWNLTNCKLRSTLAGHGGYVNTVAVSPDGSLCASGGKDGVILLWDLAEGKRLYSLDAGAVINALCFSPNRYWLCAATENSIKIWDLESKLVVDDLKVDLKAEAEKSEGTTGTAASTTKKIYCTCLNWSADGSTLFSGYTDGVIRVWGIGRY

SEQ ID NO: 93908 - protein, 192 aa, Solibacter usitatus Ellin6076
MRLPFFYKEQIVKALKAFDQKSGHFHVIIDTPKGHRNKYHYEEDKDLFLLKSVLPAGMVFPFDFGFVPGTHGDDGDPLDILVLTDEPAIQGSLVMTRLLAVIEAEQTEQGETNRNDRLIGIAAASREYQSVESLDQLNPNLIEEIKHFFVTYNELSGKAFRPLGAAGADRARKLIESAAKRAPRSAGRGKRR

SEQ ID NO: 93909 - protein, 716 aa, Oceanobacter sp. RED65
MKRLILLCAIFTTVIAFFALDLHQWLTLEALKGGLGQFNQWLEQSPVIVGAAFFVIYVAVTALSLPGAAVMTLAAGAIFGLAWGLLLVSFASSIGATLAFLVSRYLLHDTVQQRFGDRLKAINEGIKKEGAFYLFTLRLVPIFPFFLINLVMGLTPIKAWTFYWVSQVGMFAGTIVYVNAGTQLAQIDSLSGILSPDLILSFALLGIFPLLAKKLISIIKARRVYKNWKKPKSFDRNLIVIGAGAGGLVSAYIAAAVKAKVTLIEANKMGGDCLNYGCVPSKALIKTAKVAKQMRHASQYGLNDQEPQFSFKKVMERIHNVIKSIEPHDSVERYEGLGVEVLQGYGRLIDPWTVEVKLHDGSVQTLTSRSIVIAAGAEPFVPPLDGIDDVNYVTSDTLWDRFAEYDELPKRIVVLGGGPIGSELSQAFARLGSDVSQVEMGERIIAKEDLDVSEYAKEKLESDGVTVLIKHKAIHCGIEHGDKYIVLEHDGEEKRVYFDELICAVGRTARLKGYGLEELGIETDRTVITNEYLQTLYPNIYAAGDVAGPYQFTHTASHQAWYAAVNGLFGQLKKFKVDYRVIPWVTYLDPEIARVGLSESEAIEQGIDFEVTRYGIDDLDRALAESEATGFVKVLTPPGKDKILGVTIVGSHAGELLTEFVLAMKYGIGLNKILGTIHAYPVWSEANKFAAGQWKQSNKPEKVLKWVEKYHNWMRS

SEQ ID NO: 93910 - protein, 569 aa, Ehrlichia ruminantium str. Gardel
MHDSKYLLDIITLLSAAILIVVLFWKLNISPVLGYFVAGTLIGAHGLNLVESSVIIQNLGEFGVVFLLFLIGIELTFERLIAMRLHVFGFGTLQVIVTTLAIWYIANKFGIDSKGSIIIGGALALSSTAIVLQVLQEKGCQSTQVGRLSIAILLLQDLAVVPLIVLLPLLSGESHHSIPISLLYSFIKAAVALTLIFITGRLLLRPLFNTIAAIKSSEIFIATTLLIVLGSAFITENFNLSMALGAFVSGLLVAETEYRHDVEQVVLPFKKLLLGLFFMTVGMSIDIKFVVNKLPIIGLISFSLITLKSLIIFILCRFFKFHVAAAIQAGLLLSQGGEFAFILFGLAAEKNVLPSDLAQTLMMITTVTMAFTPPLAALGDWIAKLITKKKISLNSQELTLDTKDLDQHVIVVGFGRVGRMVAKVLVAEHVNYIASDIQPKTVKDGRDAGFPVYLGDLTKLATLESMAISRAKMIIIAINNEVTIKKIISLVAQRFPNIIIIVRLPDLNNAEVYKELGAHYLIHETYEVGLQLGAIALSNTGFSNHAISLLKDRFRTVNYAAVKNKEANE

SEQ ID NO: 93911 - protein, 383 aa, Zea mays
IHTLHHPESRTDAHASLACRSPLLFPRCPPLDSASSRPRTPCPLRPRPWPPRSSPAVALLSLRRRAPAAAPIRFPGLRVGSGCRHIAMASAAHARAPTDPLPKGADLFFRAVISNMEKVYLSRNPTAKTILELVNGYGINSLSDFFTDFGYLPREELRFPAKKLRALWFSPPTNDGYSGTGTYGPLPRIFISELLVDELTTQSQEIIHKYIKTSGNGNNHAAIASTSGELTWEKPIYSDFQILSRESEYAAWTLVNGYALNHATIATHRLESDIRSINKFNKFVEDNGFKLNSEGGILKVSPDGLLQQSSTVADSSLFTFADGITESIPRSYIEFAERLLLPQFKDLQDEEVKEYHRRDGFEVGNADKIFESTSKDQLTRRSA

SEQ ID NO: 93912 - protein, 477 aa, Corynebacterium glutamicum ATCC 13032
MGVDRRTKIVCTLGPAVASADGILRLVEDGMDVARLNFSHGDHPDHEQNYKWVREAAEKTGRAVGILADLQGPKIRLGRFTDGATVWENGETIRITVDDVEGTHDRVSTTYKNLAKDAKPGDRLLVDDGKVGLVCVSVEGNDVICEVVEGGPVSNNKGVSLPGMDISVPALSEKDIRDLRFALKLGVDFIALSFVRSPADAELVHKIMDEEGRRVPVIAKLEKPEAVTSLEPIVLAFDAVMVARGDLGVEVPLEEVPLVQKRAIQIARENAKPVIVATQMLDSMIENSRPTRAEASDVANAVLDGADAVMLSGETSVGKDPHNVVRTMSRIVRFAETDGRVPDLTHIPRTKRGVISYSARDIAERLNARALVAFTTSGDTAKRVARLHSHLPLLVFTPNEAVRSELALTWGATTFLCPPVSDTDDMMREVDRALLAMPEYNKGDMMVVVAGSPPGVTGNTNMIHVHLLGDDTRIAKL

SEQ ID NO: 93913 - protein, 494 aa, Zea mays
  misc_feature (184)..(184): Xaa can be any naturally occurring amino acid
  misc_feature (187)..(187): Xaa can be any naturally occurring amino acid
  misc_feature (199)..(199): Xaa can be any naturally occurring amino acid
  misc_feature (216)..(216): Xaa can be any naturally occurring amino acid
  misc_feature (476)..(476): Xaa can be any naturally occurring amino acid
MGRNLPAEQVEAPRSSKMDKKRKKDKKRKLAAEAEEEEEATVTATEETVKNSKKKRVENEPGAGAGEAENGAEKTVAVTGKGSEDPKYAPLRSFSAAELPSQVLECCSAFARPSPIQAHAWPFLLDGRDFIGIAATGSGKTIAFGVPALMHIRKKVGGKAGKKAVPRCLVLSPTRELAQQISDXTLXEAGAPCGIKSVXLYGGTSKGPQISSLKSXVEIVIGTPGRMKDLIEMGVCRLNEVSFVVLDEADRMLDMGFEPEVRAILSQTSSVRQMVMFSATWPFAVHQLAQEFMDPNPIKVVVGSEDLAANHDVMQIVEVLDDRARDSRLVALLDKYHRAQSNRVLVFVLYKKEAGRVEAMLNKRGWKAVSVHGDKAQHDRTKALSLFKEGKCPLMIATDVASRGLDIPDVEVVINYSFPLTTEDYVHRIGRTGRAGKKGVAHTFFTQADKGLAGELVNVLREADQVGPPPLTKFGXHMLKKKGSKIFGFPLSRK

SEQ ID NO: 93914 - protein, 799 aa, Vibrio sp. Ex25
MVGIVVVSHSRRLAEGVAELATQMTQGKAKLAIAAGIDDPENPIGTDAIAVMEAIEQAHDQQGVVVLMDLGSALLSTEMALDLIDDHVRENVTLISAPIVEGTMAASVAAAAGLPLSTVVEEAQNALSVKREHLGDQPLTSAEIAPVLENFEHERTFDWVVQNPHGLHARPAAAIVGALAPFDCQLWLKKGERRVNAKSLNSIAKLGVRSQETITLCALGPQSSEAIKAFEALASEHFGEKETVEQGIVEPEESTDTLLDDMASSQIEGAVVGIRVNDGIATAPAVLFTHEMPAVPERDFQSEQDEIERVKRAIGVVVQHLQEQAKQPKGEIFSAHSMMLSDPELWASVESRIQTGMIAEQAWIESLQTLAEEFRQAESQYMREREADVHDIARQVMVEMTGVTPNAIDIQEPSILLARDLMPSDVAGLDKSKVLGICLSEGGKTSHSAILARAMGIPAIVKAQGCLDAVRAGQVVTIDGFRGHLWFSPSDSVQQELEAQQIEWQSTRQSALASAQQAAVTCDGVHIPVFANIGGPKDIDDALTSGAEGVGLFRTEFLFQNSDELPTEEAQYQVYRDIAAALGDKPLTIRSLDVGGDKPLAAYPMPSEDNPFLGLRGVRLCLQHESLFTAQLRAILRAFYEQPNIQLMIPMVAQVEEVRKVKALLAHQANQLGLDATHLPVGIMIEVPAAVLNADALAQEVDFFSIGTNDLTQYVMAADRGNAAVAELVNYFEPSVLKAIELTCAAGDRAGIPVSMCGEMAGDPNATETLLRVGLRKFSASSSMLPGLKAQIRQLSVDV

SEQ ID NO: 93915 - protein, 293 aa, Bacillus clausii KSM-K16
MVKRKVAVIGSINMDMVTSTDHVPAQGETVMGKGFKTVPGGKGANQAVAAARLGADVRMIGRVGDDAFGELLKQGLQDEGVCVDHVEPVTHCSSGVATILLSDGDNRIIVTAGANEYVNEAFLSTCEEVIADSDIVLIQLEIPLKAVEYAIALCKKHQVPVILNPAPAQKLSQQTYENSTWITPNESEQAQLFANTNVHLKEKLIVTQGAAGVIWTENGVEQRIAGHRVMPVDTTGAGDTFNGALAVALASGKPMREAVMYANAAAALSVQSFGAQGGMPSKEEVAAFLLERQ

SEQ ID NO: 93916 - protein, 349 aa, Taxodium distichum var. imbricarium
  misc_feature (190)..(190): Xaa can be any naturally occurring amino acid
LRDHDASQHLFQVSSGLDSLVLGEGQILAQVKQVHKVGQGVVGFGRNIGGLFKHAITAGKRVRSETSIAAGAVSVSSAAVELAVMKLPKDGIFSARMLVIGAGKMGKLVIKHLIAKGCKRIVVVNRSEERVSLLQEELTGAELIYQPLTEMLSNAAEADVVFTSTASETPLFLKEHVENLPPVAANVGGXRLFIDISVPRNVGPCVSEVNLARVYNVDDLKEVVEANKEVRQKKALEAQMIIDEELRQFDAWRDSLETVPTIKKLRAYAERIRMTELEKCLSKLGDDVSKKNRKLVDDLSRGIVNKLLHGPMQHLRCDGSDSRTLSETLENMHALERMFNLETEISVLE

SEQ ID NO: 93917 - protein, 181 aa, Ashbya gossypii ATCC 10895
MYIPPLNFALVVSRDVSLYRSGYPMPLNYPFIKTRLQAGTVIYVGDKDISEEYKAFLESEQIRYHHIYMQSCRDDNIQESMEQVLRLVLNVDNYPILIHSNKGKHRVGVVVGIIRKLLQGWSVTGIYQEYGIFSGGQKDQADLEYITMFGTKLMVPMDKVPGFVQFIGTTPSTDYSSDLSA

SEQ ID NO: 93918 - protein, 294 aa, Mesorhizobium sp. BNC1
MKKIRKAVFPVAGLGTRFLPATKALPKEMLTVVDKPVIQYVVDEAREAGIEHFIFVTGRNKTAIEDHFDVAVELYETLSRRGKTEILERLKAMQPEPGQTGYTRQQVPLGLGHAVWCARELVGNEPFALLLPDMIMQSEPGCMKQMVELYMETGGNILAVEECDPAETQKYGIVGRGKETHGGFEITSMVEKPKPKDAPSNFYINGRYILQPEIFSLLEDQETGAGGEIQITDAMLRLHAKEPFYAHIFRGRTFDCGSPEGFIKANIALALQQETLKPQVLGFLKDFLEEEGLA

SEQ ID NO: 93919 - protein, 317 aa, Bacillus clausii KSM-K16
MANKLLVFADTGIDDAMAIIYALQHPDVELAGIVGDFGNVIRDQALRNASYLLSLADRKGVPVIAGATRALNGEEPEFFPDIHGEEGLGPIRPPIPAERYANRTNFSRLFQVIKENPNEITIVVLGRCTTLAMAWMINPAVMKRVKATFLMGGAFLVPGNETELAEANFLGDATAANFVCTHAPNVTIVPLNVTRDALLTPADVNLINSKATTPLLRTIKPMLDFYYESYQVLEPGIQGTPQHDLTALMAAIDVPNLLDYKRRNVQIEDQGRYSSGLSIADFRPASGACSGPYCPRIAVRLDFSVFRTNVLDIFTRS

SEQ ID NO: 93920 - protein, 303 aa, Acinetobacter sp. ADP1
MPHQHKGIDKAKILTEALPYIQRFSGKTLVVKYGGNAMTDPELESSFARDIVLLKTVGLNPIVVHGGGPQVDSLLKRLGQVSDRIDGMRVTDEATMEVVEMVLGGSVNKSIVNLINQHGGRAIGLTGKDGNLIRARKLLMEKHDEQGDIKHIDLGLVGEVVGIKTDVLEMFTQSDFIPVIAPLGVDESGNTYNINADLVAGKVAEALGAEKLILLTNISGVLDENKNLLTGLSTQEVDRLIATGVIYGGMIPKVGCALDAVKGGVVSAHIVDGRVPHATLLEIFTDHGVGTLITNRLHAKSEH

SEQ ID NO: 93921 - protein, 561 aa, Physcomitrella patens subsp. patens
MAVAVAGQLNLDETPTWGSRSVDVYEKIEQIGEGTYGQVYMAREIATGEVVALKKVRMDNEKEGFPITAIREIKILKKLQHANVIKLKEIVTSKGPEKEDNIKPGEANKFKGSIYMVFEYMDHDLTGLSDRPGMRFSIPQIKCYMKQLLTGLHYCHVNQVLHRDIKGSNLLIDNNGILKLADFGLARSFSNDQNGQPLTNRVITLWYRPPELLMGSTKYTPAVDMWSVGCIFAELLNGKPILPGRNENEQFHKICELCGSPDETNWPRVSQLPYYNQFKSERPFKRRVKDVFKHFDRHALDLLERMLTLDPDHRICAKDALDAEYFWTEPFPCQPSSLPKYEASHEFQTKKKRQQQRQQQEEQAKRMKVQHHPAPHTRLPPIQQQPLRPGSHQPGHNLGAPVHANGVPNQHNNNYNNSQGGNNQGRAPGGRPPHGGPSQNGGFGGPNRNGPGGVYGAPGQQQPGAYTAPNMGHQGGRGGGYGGPAGGAYAAGPYGGGKVPPVGRGQQFGGMPGGPQPPAYGYMQQPTAQYVDIDGAYARASHSGFQPPSPPHRPDYRQQQR

SEQ ID NO: 93922 - protein, 484 aa, Mesorhizobium sp. BNC1
MGKVTGFLEIDRQENKYQPASDRIRHFREFTIPMSDQEVSKQAARCMDCGIPYCHGPTGCPVHNQIPDWNDLVYQGDWEAAIRNLHSTNNFPEWTGRICPAPCEEACTLNLEDVPVTIKTIEQAIGDKAYELGFVRPQPADRKTGKRVAIIGSGPAGMAAAQQLGRAGHDVHVYERESRPGGLMRYGIPDFKIEKRYVDRRVEQMQGEGVTFFCGVNVGVDKPVSELLAEYDAVLYCGGSEKPRPAGIPGVELNGVYDAMPYLVQQNRRIGGENTQSVAWASVPILASGKHVVVVGGGDTASDCVGTAFRQGAVRVTQLDIRPKPPEKEDKLTVWPYWATKMRTSSSQAEGAEREFQVATLEFIGEDGQLTGVKCCQVDERRKPIAGTEFIIKADLAFIAIGFAGPLETGILDELGEKLTTDVDRRSSTNVVANDRDYRTSLDKLFAAGDVRRGQSLVVWAIREGRQAARAIDEFLMGSSVLPR

SEQ ID NO: 93923 - protein, 499 aa, Candida albicans SC5314
MFKKALPLVSKLTTPKGITYNQPLGLFINNEYVHPKQQKTFEVISPSTEEKITDVYEALEEDIDTAVEAAQAAYHNGWAQGPPEQRSKVLFKLADLIEENAELLAQIETWDNGKSLQNARGDVALTAAYFRSCGGWADKILGSQINTGNTHFNYTQRVPLVCGQIIPWNFPLLMASWKLGPVLATGSTTVLKTAESTPLSALYLSQLLVEAGMPKGVINIVSGFGATAGAAIAKHPKIEKVAFTGSTATGKIIMKLAAESNLKKVTLELGGKSPNIVFNDADLDKTIQNLIVSIFYNSGEVCCAGSRLLIQSGVYDQVVEKFKEAAESVKVGNPFDEDTFMGAQVSDVQLSKILKYVESGKSQGATVVTGGARADGKGYFVKPTIFADVKKDMDIVREEIFGPVVTLIKFDTVDEAVELANDSDYGLAAGIHSADVNKCIDVANRVKAGTVWVNTYNDFHPMVPFGGFSASGIGREMGEEVLHEYTQVRAVRMKINPPN

SEQ ID NO: 93924 - protein, 172 aa, Neorickettsia sennetsu str. Miyayama
MKHYSCIRQPENFPLEANVVVEISAGSSGVKYEINDDGLVCVDRFIAVSMHYPCNYAFIPNTLGGDGDPLDALVVTRSPLMPGSLIRVKVIGAFVMRDEKGEDEKLLTVPISKIDPYYTNFNEPGDFPSIFLEQIEHFFRHYKDLEKDKFVEVVGWTNSEATRRAITKLLKT

SEQ ID NO: 93925 - protein, 413 aa, Salmonella enterica subsp. enterica serovar Paratyphi A str.
MPQQNYLDELTPGFTPLLAIKEASRCLLCHDAPCSQDCPAQTDPGKFIRSIYFRNFKGAAETIRENNALGAVCARVCPTEKLCQRGCTRSGIDKPIDIARLQRFITDFEQQTAMQIYQPGSKTRGKVAIIGAGPAGLQASVTLTHLGYDVTIYEKQPQPGGWLRHGIPAFRLPQSVLDQEIARIVEMGVNIKCNCEVGGSLSLAQLKAEYRAVLMTVGMSCGSDLPLFEQASHVEIAVDFLQRARQADGDISVPRSALIIGGGDVAMDVASTLKILGCPSVTCVAREELAQFPASEKEFTSTQALGVSIIDGFTPVAVSGNKVTFHHVRHSGELTLEAENIILAVGQHARLDNFAEIKAQHNIIDTHNYQTDDPAIFAAGDIVKGDKTVVYAVKTGKEAAQAIHHYLEEACSC

SEQ ID NO: 93926 - protein, 313 aa, Glycine max
MASQITREWSGINTFAPATQTKLLELLGKLKQENVNSLTILVMGKGGVGKSSTVNSIIGERVVSISPFQSEGPRPVMVSRSRAGFTLNIIDTPGLIEGGYINDMALDIIKRFLLNKTIDVLLYVDRLDVYRVDNLDKLVAKAITDSFGKGIWNKAIVTLTHAQFSPPDGLPYDEFFSQRSESLLKVLRSGARIKKEAFQAASIPVVLVENSGRCNKNDSDEKVLPNGTAWIPNLVQTITEIALNKSESIHVDKNLIEGPNPNQRGKLWIPLVFALQYFLIMKPIKGLIEKDIANERKPTWERRDAAFRKRDLY

SEQ ID NO: 93927 - protein, 176 aa, Arabidopsis thaliana
MTHRIAPRCFSTIMLLCLLYTSPLDVIAQGQGGQGGIPVVNPTAPGGSTTTPTITQPSPPSLTFPGPTTPTGGYPPLDGTTPTGGYPPLYGTTPPGGGDVGGGGGGYGGGTPGGGGGGGGDTGASAGGGGYGGGGDTRAGAGGGGGGGALGRGTPGGGGGGGGELVHVLEVGVMVE

SEQ ID NO: 93928 - protein, 412 aa, Triticum aestivum
  misc_feature (317)..(317): Xaa can be any naturally occurring amino acid
MQRYSRAADVLGFVYLHPLSKCVASPAAAVSKVAGQPLEMEEVEVAPPRAHEVRIRILCTSLCHTDVTFWRLKDFPGQHPIILGHEAAGVVESVGEHVHEVAVGDTVVPVFSAQCGDCPDCLSDRSNICSGLPARPGMPRDGTTRFSFAATGEPIHNFIGVSSFTEYTVVDVARVVRIGPGVPPEKACLLSCGVSTGVGAAWKVAAVEPGSSVAVFGLGVVGLAVAQGCRMRGAKQIIGVDLNPEKWDIGKRLGITDFVNPNDIGEKAVSEVIKEMTGGGADYCFECIGSTSVMAEAFQSSRKGWGKTVVLGVSSGXAPISIPPHDILWGRSVVGSLFGGLKPKADIPILAQKYLDKELELDEFVTHEMGFHDINAAFELLTQGKCLRCIIWMDGAKANGVEALDNGRACKA

SEQ ID NO: 93929 - protein, 333 aa, Physcomitrella patens subsp. patens
MSHPCELTEILWRNQKCPYCWNRSSSRDFWFDASLLYVRVTNCQLTGDCTLPEVLNVHFPPREIATCMEVNGGRIPPSEEVSLVLRRNRIESETADAFMYVSTDNLRMSSTLHFQILDQDTLLVSGILEKLAYSPRPAAATPAVPTRNDLGWIMATTCEIGSLGCAFVKAKYELFKHGLCINFPNTNTAMEICVVGRFKSEPVILTQTLMLTVKRRSASFCTLNAIPEDNEDDKESCQMYATAMVSNDFLDEADSQKELAAGDYVSKMLTLDSSLYLPDVVDQEETWYNKGISRGIKLGFGIGIGMCVGLGIGLGLIIRKFRVTTKELYRITV

SEQ ID NO: 93930 - protein, 165 aa, Triticum aestivum
MEITINSLTYKGSIPDAINQSRRKKKLFVIYISGQDETSSSLEQSTLVDEHVAAVISRCCIFLQLKQGDVDALQFSAIYPQKSVPSISVVGLSGAMLWNHEGYISPEDLKESIDKAWAALQLQETAATLLAASLASRMSEPANTASTTMPGEDGSSTSENHSNSS

SEQ ID NO: 93931 - protein, 363 aa, Ehrlichia ruminantium str. Gardel
MGLNCGIVGLPNVGKSTLFNALTCTTVAEVANYPFCTIEPNIGKALVKDDRLKTLAQMASSKKIIYNQVECVDIAGLVSGASNGEGLGNKFLSHIREVDAIIHVLRCFSDQNISHVNQSIDPIGDAEIVEMELILADIESLKRRLITMEKAVKANKEPKKKLDNMLEVLSILEAGNLAKNAQHIDNNELKQLNLITTKPMMYVCNVEESNVITGNTLSEKVKIMAKNNNNKFCCISAKLEADVASLDTEEEKLSFLAEFNLKEAGTTSVVKTMYELLDMITFFTLGPQEARAWPIKRLSTASTAAGVIHTDFEKGFIKAELISFDDYIKYNGEAKCKEAGKVRFEGRDYIVQDGDIIHFRHSN

SEQ ID NO: 93932 - protein, 184 aa, Ehrlichia ruminantium str. Gardel
MLPMSPIYKCFMSKHTNIPMFRIGIGYDVHRFDNINNDDSNTSITICGIEINYHKKIIAHSDGDVGLHALADAILGAVGCGSIGQHFPNTDQKWKNAKSSHFVIEAQKKAQERGYIISNADIIIICEQPKIMPYALEMQHYIAQFTSIDPSFINIKATTTEKLGAIGRNEGIAAQAIVLCSQQY

SEQ ID NO: 93933 - protein, 141 aa, Triticum aestivum
  misc_feature (14)..(15): Xaa can be any naturally occurring amino acid
  misc_feature (50)..(50): Xaa can be any naturally occurring amino acid
  misc_feature (58)..(58): Xaa can be any naturally occurring amino acid
  misc_feature (65)..(65): Xaa can be any naturally occurring amino acid
  misc_feature (69)..(69): Xaa can be any naturally occurring amino acid
  misc_feature (80)..(80): Xaa can be any naturally occurring amino acid
KKYGGGTRGEAAEXXQLTPATGWGARDLRRRRRRQRQGGSSREGAGDEPXAQQQKSSXGAAPLNXKSWXDVEDDDDDDYXATTAPPAPIWGNDHAAAKTAKEEEEDEVDAVHAALPEEIESEDEEHDGLNTIKLELEGGKE

SEQ ID NO: 93934 - protein, 234 aa, Acinetobacter sp. ADP1
MRTLSMNHFKDARNQVLHQIQVACEQAQRDPATVQLLAVSKTHPDSALREMYQLGQRAFGENYLQEALDKIEALDDLDIEWHFIGHVQRNKTKLLAEKFDWVHGVDRLIIAERLSSQRLQTQPPLNLCIQVNIDHQDSKDGCQPEDVAQLVEEISQLPQVRLRGIMVIPAPDQITAFTDAKQLFEQVKSHHQQPQDWDTLSMGMSGDLQQAIAAGASIVRIGTALFGARDYAKP

SEQ ID NO: 93935 - protein, 388 aa, Pyrococcus horikoshii
ALSDRLELVSASEIRKLFDIAAGMKDVISLGIGEPDFDTPQHIKEYAKEALDKGLTHYGPNIGLLELREAIAEKLKKQNGIEADPKTEIMVLLGANQAFLMGLSAFLKDGEEVLIPTPAFVSYAPAVILAGGKPVEVPTYEEDEFRLNVDELKKYVTDKTRALIINSPCNPTGAVLTKKDLEEIADFVVEHDLIVISDEVYEHFIYDDARHYSIASLDGMFERTITVNGFSKTFAMTGWRLGFVAAPSWIIERMVKFQMYNATCPVTFIQYAAAKALKDERSWKAVEEMRKEYDRRRKLVWKRLNEMGLPTVKPKGAFYIFPRIRDTGLTSKKFSELMLKEARVAVVPGSAFGKAGEGYVRISYATAYEKLEEAMERMERVLKERKLV

SEQ ID NO: 93936 - protein, 484 aa, Prochlorococcus marinus str. MIT 9211
MAGRFSQQHKRLRPNSNEDAVIKRAQEHFERSLVEISGSISGSVAALEHPANNDALNYGEIFLRDNVPVMIYLLTQNRYDIVKKFLTVCLDLQSTTYQTRGIFPTSFVEENGELIADYGQRSIGRITSADASLWWPILCWLYVRKSKDTNFGVSQQVQRGVQLLLDLVLHPTFEGTPVLFVPDCSFMIDRPMDVWGAPLEVEVLLYACLSSCIELMDLSSKHQVSRLLDQRLLLTRQWVHDLRQFLLKHYWVTSKTMQVLRRRPTEQYGEDQHQNEFNVQPQVVPSWLQDWLENRGGYLIGNIRTGRPDFRFYSLGNSLACMFGVLTAPQQRALFRLVLHNRQHLMAQMPMRICHPPMEVEEWQNKTGSDPKNWPWSYHNGGHWPSILWFFGASILMHEKRYPKADVLLMGQMRTLLEECYWSQLNQLPKQKWAEYFDGPTGTWVGQQSRTYQTWTIVGFLLLHHFLKVCPDDISMLDLDLEKT

SEQ ID NO: 93937 - protein, 158 aa, Triticum aestivum
  misc_feature (18)..(18): Xaa can be any naturally occurring amino acid
  misc_feature (38)..(38): Xaa can be any naturally occurring amino acid
  misc_feature (43)..(43): Xaa can be any naturally occurring amino acid
  misc_feature (94)..(94): Xaa can be any naturally occurring amino acid
  misc_feature (104)..(104): Xaa can be any naturally occurring amino acid
MATTERTFIAVKPDGVQXRGLIGHIISRFEARGFKLSXIKLVXPIEQKLKEHYQDLSDKPFFSGLITYMGSGPICAMIWEGRDAVKTGRTILGXATNPLASLPXGTIRGDYALDVGRKCMPRVSDSVENAQKEISIWFSEGEIQSWKSAQNDWVYEKP

SEQ ID NO: 93938 - protein, 449 aa, Prochlorococcus marinus str. MIT 9211
MLEPVISGLTRSENWRRIQLKRLTAITEEHESEILSSLATDLGKPPTEGLFEIISLKQELKVAQKNLTDWMRPKLVNVPLFLKPGKAKLQNEPLGCVLIIGAWNYPFMLTLQPLISALAAGNTAVLKPSEFAPSTSNLIARLISKHFPKDIVRVLEGDSEFSKQLMNNKFDHIFFTGGSKTGAKIMEAAAKHLTPVTLELGGKNPAIVLKGSDLKTTAKRLVWGKSINSGQTCLAPNHLLVEEGIKDDLVECMCKSIIEFYGENPLDSPDLGKIINSNQFNRLIDLLNQIKTKNQILFGGDVDNKNKRISPTLIELDSINDPLIEEELFGPILPILSIPNLDFAISEIRKQPKPLAIYMFGGSGEQQKTLLDKSSSGGVCFNDVVMQAAIPELPFGGVGNSGMGRYHGKAGFDNFSHQKSILERPFWLDIQFRYPPYKIDISLFKKLFR

SEQ ID NO: 93939 - protein, 678 aa, Arabidopsis thaliana
MSKKHLKPLETCFEDEEDDVIYLPPGLVTGATSKKNEEFCGGSGKVQPSEMKRRSEGTSTDMTSKRAKKVSAEDEKKVGEWTKNPYFQRLWSEEDEIVMLQGIIKFEDVTGKSPFEDRHGFIEFVKNSISFEASVQQYIGKISQLKRKYTRKRKNGFSEGHEQKCFKLAMSIWGTKETSKKTDLCSSPKGKKVKEEDGDVTNSDWFENSFLLPSIESLGVDSVKRKWNVVPMEFKKKIEERLELLEADESECKKMEEMLKVKNSECVKQKTNLLNELLQDAVPNICVSRLRFPAMALQATTTTFCFSGPTFRSTPHSLTSKRPISIKATTSSPSRLSNSRSNLKGRALSSDGSTQESPYVVCFGEMLIDFVPTTSGLSLADAPAFKKAPGGAPANVAVGIARLGGSSAFIGKVGEDEFGYMLANILKDNNVNNDGMRFDPGARTALAFVTLTNEGEREFMFYRNPSADMLLEESELDFDLIKKAKIFHYGSISLITEPCKSAHISAAKAAKEAGVILSYDPNLRLPLWPSADNAREEILSIWETADIIKISEEEIVFLTKGEDPYDDNVVRKLFHPKLKLLLVTEGPEGCRYYTKDFSGRVHGLKVDVVDTTGAGDAFVAGILSQLANDLSLLQDEERLREALMFANACGALTVKVRGAIPALPTKEAVHEALLKAVV

SEQ ID NO: 93940 - protein, 431 aa, Salmonella enterica subsp. arizonae serovar 62:z4,z23:--
MKTPRLLQYLAYPQKITGPIIEAELRDVAIGELCEIRRGWHQKQVVARAQVVGLQRERTVLSLIGNAQGLTRDVVLYPTGRALSAWVGYSVLGAVLDPTGKIVERFTTEVAPISEERVIDVAPPPYASRVGVHEPLITGVRAIDGLLTCGVGQRMGIFASAGCGKTMLMHMLIEQTEADVFVIGLIGERGREVTEFVDMLRASHKKEKCVLVFATSDFPSVDRCNAAQLATTVAEYFRDQGKRVVLFIDSMTRYARALRDVALASGERPARRGYPASVFDNLPRLLERPGATGDGSITAFYTVLLESEEEADPMADEIRSILDGHLYLSRKLAGQGHYPAIDVLKSVSRVFGQVTTATHAKQASSVRKLMTRLEELQLFIDLGEYRPGENIDNDRAMQMRDSLKAWLCQPVTQYSSFDDTLSGMNAFADQD

SEQ ID NO: 93941 - protein, 292 aa, Alkalilimnicola ehrlichei MLHE-1
MSRKYPIIAVTGSSGAGTSTVKDAFEHIFHREHVAPCIVEGDSFHRYNRQEMKQAIKQANEDGRNLSHFGPEANLFDKLESTFREYSETGSCERRYYVHNDEEAEHRGVAPGEFTAWERVESGTDLLFYEGLHGGVVTEEVDVARWVDLLIGVVPIVNLEWIQKIHRDQAERGYAAEKTVDTILRRMEDYVTCLTPQFSRTDINFQRVPTVDTSNPFIARDIPTHDESFVVIRFRKPEKFGIDFPYLLNMIKDSFMSRRNTIVVPGGKMGFAMELILTPIIHDLVERRTRLT

SEQ ID NO: 93942 - protein, 230 aa, Alkalilimnicola ehrlichei MLHE-1
MTDYKIAPSILSADFARLGEEVDNVLSAGADMVHFDVMDNHYVPNLTIGPLVCEALRKHGVTAPIDVHLMIKPVDRIIPDFAEAGANYITFHPEASEHVDRSLQLVRDCGCKAGLVFNPATPLDVLKYVMEKVDMVLLMSVNPGFGGQKFIPGTLDKLREARALIDASGRDIRLEVDGGVKVDNIRAVAEAGADTFVAGSAIFGTDDYRKTIESMRAELAQAERPGPTAS

SEQ ID NO: 93943 - protein, 448 aa, Mycobacterium smegmatis str. MC2 155
MTIAEIAGRTLTQERRLVTAIPGPISQELQARKQSAVAAGVGVTLPVYVVAAGGGVLADADGNQLIDFGSGIAVTTVGNSAPAVVDAVTQQVAAFTHTCFMVTPYEGYVKVAEHLNRLTPGDHEKRTALFNSGAEAVENAVKIARAYTRRQAVVVFDHAYHGRTNLTMAMTAKNQPYKHGFGPFANEVYRVPTSYPFRDGETDGAAAAAHALDLINKQVGADNVAAVVIEPVHGEGGFVVPAPGFLGALQKWCTDNGAVFVADEVQTGFARTGALFACEHENVVPDLIVTAKGIAGGLPLSAVTGRAEIMDGPQSGGLGGTYGGNPLACAAALAVIDTIERENLVARARAIGETMLSRLGALAAADPRIGEVRGRGAMIAVELVKPGTTEPDADLTKRVAAAAHAQGLVVLTCGTYGNVLRFLPPLSMPDHLLDEGLDILAAVFAEVK

SEQ ID NO: 93944 - protein, 656 aa, Coccidioides immitis RS
MIRGNGSPGAASSNRSSDEAASHNGSPETKLTAFSPEDARIKSLLDNSGAIGLHRHETMTFTSVHKPGIGQDAFRTISGPNARIQLSPTASPFTPASYIQGRFTGNESVSAFLKQNDVSPATISYLAANSDPETPFTPNGSFARNSPPRFGPIAPGGPVHLTYPKQDEAARSKMSYLTATSELEIPFTPNGSLARNSPPRFGTIGHPYVAPTPIHMAYCQFGTFDKINRSRAFTIEGAPTDLAHLTIVSLFDRHEFSTLKGPILTELGTHGKIYVGFTDSRDAKAAFDKVKKQYPAWYLQALTAKEFTGKHDATYVGATSDYEGYIFASVYFNGNNPAADGCVISHNFKNILEKFGDIKAFCTIPTEQRHVVDFMVEFFDTRAAENVASTLNGSSVDECILEINLYRPDVVENHYIDFEHKDASDAVTKQSVGRRDSFGQPYVKLSPTGRSTIPVGDPASEFGWLRKAENNLSYRHRHEVGRRQDSRPNNQNYVDIEKIRLGLDVRTTIMLRNIPNKIDQVMLKNIVDETSFGKYDFMYLRIDFANNCNVGYAFINFEDFANARAGRTCDKVAEISYATIQGRDCLVQKFRNSSVMLEHPSFRPKLFYTGSGPLAGTEEPFPGPDNPSKMRRSVENAEHVGMYKLVKTSVPKPGLY

SEQ ID NO: 93945 - protein, 582 aa, Candidatus Pelagibacter ubique HTCC1002
MENFKLLKIEDSLKNSLEKMKFTKPTPIQAMAIPVALEGKDILGTAQTGTGKTLAFSIPLINKLILDKNAFALVMCPTRELATQVMAAIKSIISDKINIKTALLIGGEAMQKQLRQLGNRSRIIVGTPGRINDHLKRKSLNLSATKYLVLDETDRMLDMGFTPQIELILKFVPKDHQTLLFSATLPQNIVRISERYLNKPQRISTGSTSVPIAKIKQETLQVFKENKYDQLVDQFIARKGSILVFVKTKRGADKMVKRLKEEGHSADAIHGDLRQSKRDRVITSFRKGLKRILIATDVAARGLDIPLIQHVINFDLPQVPEDYVHRIGRTARAGTEGSALTFLTPDDRSMWNEISKLIDPNFKPAPRGARGDSRGGKRGKAPYNKKRKFRDEKKSFGKGRPDRSSRDGEKKSFGYKGKSSFGDKSKPSSYGRSSSSSRDGEKKSFGYKGKSSFGDKSKPSSYGRSSSSSRDGEKKSFGYKGKSSFGDKSKPSSYGRSSSSSRDGEKKSFGYKGKSSFTKKDNSKPTGFTNNPKYFGKKTSESSSTSGEKKSSSFDGKKKFKSRSDRPKSFTFKKHSQKRAKV

SEQ ID NO: 93946 - protein, 127 aa, Oryza sativa
KEKPNNFVGMHGENVGLGFVARDSAAKQQEQTNQITFRVIRNDQNPENLKFLLDLKNIFARQLPKMPKEYIVKLVFDRNHESMIILRNNTKVVGGICFREFKQERFAEIAFLAITSTEQIKGFGTRL

SEQ ID NO: 93947 - protein, 336 aa, Alkalilimnicola ehrlichei MLHE-1
MAIKVAINGYGRIGRNVLRALYEAGRTDEIQVVAINDLGNAETNAHLTRFDSVHGRFNGEVQVEGDSMIVNGDRVRVLAERDPARLPWGELGVDLVMECTGLFTTREKASAHLQAGAKKVLISAPGGKDVDNTVVFGVNHDTLTPEHTVVSNASCTTNCLAPLVKPLHEAIGVERGLMTTIHAYTNDQVLNDVHHKDLRRARSATMSQIPTSTGAAAAVGLVLPELNGKLDGYAIRVPTVNVSIVDLTFTAARETSVEEINQIVRGAAEGPLKGILAYNDAPLVSIDFNHDPASSTYDASLTKVNGNLVKVTAWYDNEWGFSNRMLDTALAMAQAG

SEQ ID NO: 93948 - protein, 93 aa, Zea mays
CLEHNTEYISVFTSALLQRSLSVVSSTYYNSSTLVLTMWLAMACLLRDQHEQWKHKYGNPCRSVKIFRCQLPRNNAFYSAPPPKHDGSDKPLC

SEQ ID NO: 93949 - protein, 250 aa, Oryza sativa Japonica Group
MDPGGLRPAPQSAAAAAAAAAAGAGAGASAADEPRDARVVRELLRSMGLSEGEYEPRVVHQFLDLAYRYVGDVLGDAQVYADHAGKPQLDADDVRLAIQSKVNFSFSQPPPRECSEFFHSDQDFRSRSLPSDNPLFFSMVLLEVARNRNKIPLPKSIAPPGSIPLPPEQDTLLSQNYQLLAPLKPPPQFEETEDDNAGANPTPTSNPSNPSPNNLQEQQQLPQHGQRVSFQLNAVAAAKRRGTMDQLNMG

SEQ ID NO: 93950 - protein, 392 aa, Alkalilimnicola ehrlichei MLHE-1
MAVIKMTDLDLKGKRVLIREDLNVPLKEGKVADDTRIRASLPTIRHALESGARVMLLSHLGRPKEGEPDPAASLRPVAEHLATLLGQEVPLAEDWLDGVEVAEGQAVLCENVRFNVGEKANDEALAKRMAALCDVYVMDAFGTAHRAQASTHGVGQYAPVACAGPLLAAELEALGKALEAPARPMTAIVGGSKVSTKLDVLETLSEKVDQLIVGGGIANTFIAAAGHPVGKSLYEADLVDKARQLMDTARANGGEIPVPTDVVVGREFSADTQAVVKRVDEVDDEDMIFDIGPETAQRYAGMMREAGTIVWNGPVGVFEFDQFGEGTRKLGEAIAESDGFSIAGGGDTVAAVEKYGLADRISYISTGGGAFLEFLEGKTLPAVAMLEARASD

SEQ ID NO: 93951 - protein, 182 aa, Oryza sativa
  misc_feature (22)..(22): Xaa can be any naturally occurring amino acid
MASYHQQQGGSTFMAIPTINFXGDDEWWEYIPCPFCYIEVEVHFLCDHLQEEHCFDMKNAVCPICADNLDKDTDEHFRVQHSHLLKRRKSSSFSCKPSSAAADKGSYEEDSYFEAPSHCMGRPAPDSSPDPLLSQFICCSLAPPVDSPRRSEADAEGHGSSSSDDQKRREQGVMDDASKGEL

SEQ ID NO: 93952 - protein, 490 aa, Arabidopsis thaliana
MSVFLCFLCLLPLILIFLKNLKPSKWKLPPGPKKLPIIGNLHQRRELHPRNSRNLSEKYGPIVFLRYGFVPVVVISSKEAAEEVLKTHDLECCSRPETVGTRAISYNFKDIGFAPYGEDWRTMRKLSVVELFSSKKLQSFRYIREEENDLCVKKLSDLASRRSLVNLEKTLFTLVGSIVCRIGFGINLRECEFVDEDSIDDLVHKSEDVIRNSIFSDFFPGLMGRLIEWIFSERKRLNRLYSEVDTFFQNILDDHLKPGRESSDIIDVMIDMMKKQEKEGDSFKFTTDHLKGMISDIFLAGVGTSSTTLIWAMTELIRNPRVMKKVQDEIRTTLGDKKERITEEDLNQLHYFKLMVKEIFRLHPAAPLLLPRETLSHVKIQGYDIPAKTQIMINAYAIARDPKLWTNPDEFNPDRFLDSSIDYRGLNFELLPFGSGRRICPGMTMGIAIVELGLLNLLYFFDWGLPEKEEAKEIITGNEVALDLVQVFLH

SEQ ID NO: 93953 - protein, 690 aa, Zea mays
  misc_feature (172)..(172): Xaa can be any naturally occurring amino acid
  misc_feature (216)..(216): Xaa can be any naturally occurring amino acid
  misc_feature (365)..(365): Xaa can be any naturally occurring amino acid
MWRRALAMVLFMVGAALLAGAAGAGAQQGVWSIITRPMFQSMLSHRGDSGCQGAFYTYDAFIEAASKFPGFGTTGDEQTRRRELAAFFGHTTHETTGGWATAPNFFLPPHPPSVSTNTNSSPSLWTTTIRGSRRNSCRIAGPAGFPLEPRVRDVIRMGIAEDFVRQMEPRYXQALLDMRALEKGANTNPDEGRMVVHYWLRDPALAPNSSLRNKSXTALDRILAFSQDVVSGKILSPSGRFTSILSIGIGGSALGPQFVAEALAPDNPPLKIRFIDNTDPAGIDHQIAQLGPELATTLVIVISKSGGTPETRNGLLEVQKAFRDAGLQFSKQGVAITQENSLLDNTARIEGWLARFPMFDWVGGXTSKMSAPRVRPAASRGIDIKEMLAGAALMDEGTRNTVVKANPAALLALCWYWASEGIGNKDMVVLPYKDSLLLLSRYLQQLVMESLGKEFDLDGNRVNQGLSVYGNKGSTDQHAYIQQLREGVHNFFVTFIEVLRDRPAGHDWELDPGVTCGDYLFGMLQGTRSALYANDRESISVTVQEVTPRAVGALVALYERAVGLYAFLVNPTRPHQPGVEAGKKAAGEVLALQKRVLTVLNEATCKDPCEPLTIDEIADRCHCPEDKHNAFPPSITHAQRLLPQIEMIYKIVQHMAANDRAIIAEGSCGSPRSVKVYLGECNVDEDLQAA

SEQ ID NO: 93954 - protein, 415 aa, Haloarcula marismortui ATCC 43049
MGHAESEVLDVERLREDFPILQREFGGEQVVYLDNAATTQTPEPVVETIADYYRTTNANVHRGLHQLSQEASVAYEDAHDRVAEFIGASGEREEIVFTKNTTESENLVAYAWGLNELGPEDEVVLTEMEHHASLVTWQQIAKKTGATCRYIRVDEDGTLDMDHAREIITDDTAMVSVVHVSNTLGTVNPVSELADIAHDHDSYIFVDGAQSVPNRPVDVEAIDADFLAFSGHKMAGPTGIGVLYGKKHILEEMEPYLYGGEMIKKVTFEDASWNDLPWKFEAGTPVIAQGIALAEACDYLDNIGMERIQRHEEQLAQYTLEQLREEGDVETYGPSVGTERGGLVSFNLDSVHAHDLSSILNDSAVAIRAGDHCTQPLHDKMGVPASARASFYIYNTREEVDKLVSAIDDARQLFA

SEQ ID NO: 93955 - protein, 343 aa, Antirrhinum majus
MYQQNSPSLCFDALYCEEEQNWDNGEIINDCFIEEQEPFSDLLKHDLLCGVDDDDDDKEELSSLLCKEQEYELYRVLEDNPSLAKARDEAVEWMFKVIGYYSFSALTAVLAVNYLDRFLCTFQFQQDKPWMYQLAAVACLSLAAKVEETQVPLLLDLQVEESKYVFESKTIQRMELLVLSTLKWKMNPVTPISFLEYIARRLALKSHLCKEFLNRCECLLLSLITDCRFMCHLPSALATATMLYVISSLEPCIGVEYQDQLINILGINKDKVEECCKLIQEVATSVHFQSGNKRKFGSLPYSPKGVVDISFSCDDSWPLDSTASVSSSPEHLSKKIKTQNPDH

SEQ ID NO: 93956 - protein, 495 aa, Pseudomonas aeruginosa UCBPP-PA14
MLQTLKQNWFSNIRGDLLAGLVVALALIPEAIAFSIIAGVDPKIGLYASFSMAVVIAFAGGRPGMISAATGAMALLMVNLVKDHGLQYLLAATLLCGVLQILAGYLRLGSLMRFVSRSVVTGFVNALAILIFMAQLPELTDVGWPVYAMTAAGLAIVYGFPHLPRIGRLLPSPLVCILVLTGISIYLGLDIRTVGDMGQLPDSLPLFLWPDVPLNLDTLLIVLPYSAALAVVGLLESLMTATIVDEMTDTGSDKNRECKGQGLANIATGLLGGMAGSAMIGQSVINVKSGGRSRLSTLVAGVTLLLMVVFLSDWVGRIPMAALVAVMIMVSIGTFRWESIRNLKRYPLSTNLVMLVTVGVVLATHNLAFGVVAGVLLASLFFANKIGHYLDIDSERSADGTRRHYQVSGQVFFASSGRFVAAFDLKETLEHVLIDLRHAHLWDVTAVAALDKVVLGFRQRGVQADVLGLNAASATLVDRFGAYDKPGAVDILSDH

SEQ ID NO: 93957 - protein, 361 aa, Antirrhinum majus
MLFSHSQQTHLQNPIFDALLCNEEHFDEDLDLGSGLKDPGFINQIHHNQKKEEPFTTFLFEHDLLWEDDELVNLLSKEKEQEQQAHLGYDDVMDSDGFLKRVRNEGIKWMLKVIGHYGFNAMTAVLAVNYYDRFITNVGFQKDKPWMSQLAAVACLSVKVEETQVPLLLDFQVEESKYVFEAKTIQRMELLVLTTLKWKMNPVTPISFFDHIVRRFELMNNVQCEFMKRCESVILSIITDYRFVRYLPSVVAAATMIYVIKELYPCDALEYQNEFVTVLRTSKEKTDDCHMLITEVINNQSYILCHKRKYGSIPSSPNGVIDAYFSSDGSNDSWSAVSSVSSSPEPVFKRIRAIGGANPPH

SEQ ID NO: 93958 - protein, 339 aa, Gibberella zeae PH-1
MADAAECNGEAVDLGRRGLRIGAIFIIMASSLIGAILPIFLARQKTIPVPKFTFFICKFVGTGVIIATAFMHLLVPAVENLGDECLADRLGGYDWAEAIALMTVIVMFFVEMLAARLSNADMEHNHSDEFDPAMEVIAKKQPSTDIETGDRRASGYAPGGDEHLAHGREHKEGDAQGGLAGQLLAIFILEFGVVFHSIFIGLTLGTIASDELTVLLIVLVFHQMFEGLGLGSRLAVAPWPSNRQWMPYLLGLIFALSTPIGIAAGIGAKPNNASDQKLINGIFDAISAGILMYTGLVELLAHEFMFNPYMRKAPIKILLLAFACVSFGVAVMAILAKWA

SEQ ID NO: 93959 - protein, 402 aa, Neorickettsia sennetsu str. Miyayama
MPVFLDNQSTTKPDPEVIEAMVSLFDRPCNPHSRTHSYGWHAEAAVENAREKIAHLIGASSKDIVFTSGATESNNLAIKGVANFYRSNEKNHIITLSTEHKCVLDSCRNLETSGIEVTYLPVEKNGIVNLDVLKKAIKPSTMMVSIMAANNEIGVLQPLKEIGQICREAEIIFHTDAAQAFGKIQLDVEEMQISLMSISGHKIYGPMGIGALYIRRKNPRIRVTPLFSGGGQERGIRSGTLPTPLIVGFGKAAEIAARVMEEENKRVKFLANKLYEIIKAGIPDIVLNGDLSRRLPGNLNISFPYVEGESIIMAIPEISVSSGSACTSASLEPSYVLKALGVAEDLAHSSIRFSVGRYNTEEEIIMAGELLVKQVIRLREMSPLWEMAQEGIDLNSIKWDTS

SEQ ID NO: 93960 - protein, 405 aa, Vibrio sp. Ex25
MAGVLGMILAGGEGSRLRPLTESRSKPSVPFGGSYRLIDFALNNFVNADLMRIYVLTQFKSQSLFHHLKKGWNINGITDRFIDPIPAQMRTGKRWYEGTADAIYQNLRFMELEEPEQVCIFGSDHIYKMDIKQMLNFHSEKQASLTVSALRMPLKEASQFGVIEVDSEGRMIGFEEKPANPKSIPGDPDYALVSMGNYVFEAQVLFSELVEDADNEASSHDFGKDIIPKMFPRGDVFVYDFSTNKISGEREEVYWRDVGTIDAYWEAHMDLLEKDAPFSLYNRKWPLHTYYPPLPPATFTDSDNGRVQIIDSLVCNGSYVRGSRIEKSVLGFRSNIASACDISECILLGDVKIGEGCVLRRVIVDKDADIAPGTQIGVNLQEDKKHFHVSEEGIVVIPKGARVGY

SEQ ID NO: 93961 - protein, 896 aa, Oryza sativa Japonica Group
MASALFLWLSWLVLSLLSIYLLDLLAHSRRRLPPGPRPLPLIGSLHLLGDQPHRSLAGLAKTYGPLMSLRLGAVTTVVVSSPDVAREFLQKHDAVFATRSAPDAAGDHTRNSVPWLPPGPRWRELRKIMATELLATHRLDALHELRQEKVSELVDHVARLARDGAAVDVGRVAFTTSLNLLSRTIFSRDLTSLDDRGASKEFQQVVTDIMGAAGSPNLSDFFPALAAADLQGWRRRLAGLFERLHRVFDAEIEHRRRVAGEEHGKVKDDFLRVLLRLAARDDDTAGLDDDTLRSTSVIDNGIAQLKKPNVTWMAHGWWARLRTLISGIIAQFLPQYCNGGFVSLAFMACALSLLSVYLLDLLAQSRRRLPPGPHPLPLIGSLHLLGDQPHRSLAGLAKTYGPLMSLRLGAVTTVVVSSPDVAREFLQKHDAVFATRSAPDASGDHARNSVALLPNSPRWRELRKIMATELFSTSRLDALHELRQEKVVELVDHVARLAREGAAVDVGRVAFTTSLNLLSHTIFSRDLTSLDDHGASKEFQQVVTDIMGAAGSPNLSDFFPALAAADLQGWRRRLAGLFERLRRVFDAEIEHRRRVVGKEHGKVKDDFLRVLLRLAARDDDTAGLHDDALQSIFTDLFAAGSDTSSSTVEWAMAELLRNPLPMAKACDELQRVIGSTRRIEESDIGRLPYLQAVIKETFRLHPPVPFLLPRQATTTIQILGYTIPKGAKVFINVWAMGRDKDIWPEAEKFMPERFLERATDFKGADFELIPFGAGRRICPGLPLAVRMVHVVLASLLINFKWRLPVKLLQSKEKDRSDLAYVINAVKDLMGAAAATTATNLTILPSPRVRKSKCEEAHVMPTTAKLHTPATTKHGLTDYVASCDNEAHIQDNKWPPS

SEQ ID NO: 93962 - protein, 443 aa, Glycine max
  misc_feature (207)..(207): Xaa can be any naturally occurring amino acid
MIVPLMMIQVQYNLMSLIAFSAIIFLGSTLYIMTRPTSIFLLDYSCYLPPQHLRVRFNQFMDHSTLTGDFLPSSLHFQRKILLRSGLGEETYVPQAMHSIPPRPSISAARLEAEQVMFGSLDTLFSDTNVNPKDIGILVVNCNLFNPTPSLSSMIVNKYKLCGNAKSFNLGGMGCSVGVIAIDLAKDMLQVHPNTYAVVVSTKNIAXNWYFGNNKAMLIPNCLFRVGGVAILLSNKSSDRARAKYKLVHVVRTHKGADDKAFRCVYQEQDEVGKTGVSLSKDLMAIAGGALMTNITTLGPLVLPISEQFLFFLTLVVKKLFNAKMKPYIPDFKLAFDHFCIHAGGRAVIDELEKNLQLRPEHVEASRMTLHRFGNTSSSSIWYELAYTEAKGRIRKGHRVWQIAFGSGFKCNSAVWEALRHVNPSPNTPWENCIHRYPVHIHT

SEQ ID NO: 93963 - protein, 132 aa, Helicobacter pylori
SNIKYELDKESGALMVDRVLYGAQNYPANYGFVPNTLGSDGDPVDALVLSDVAFQAGSVVKARLVGVLNMEDESGMDEKLLALPINKIDPTHSYVKDIDDLSKHTLDKIKHFFETYKDLEPNKWVKVKGFEN

SEQ ID NO: 93964 - protein, 144 aa, Escherichia coli
MIFLPLTVAEDDWAGWKILHGALGEQIELVGDDLFVTNVKYIQRGIDENLANSALIKLNQIGSLSETFDAVQLCHDNNWGTFISHRSGETVDSFIADMTVAMRAGHLKTGAPCRGERIEKYNQLMRIEDELGSSAQFAGKSAFK

SEQ ID NO: 93965 - protein, 653 aa, Acinetobacter sp. ADP1
MQKKYFLILGGFLSLGLLQGCNDSNDQEQTSTIVDTNPNSCNQLTSDGSTVVVGSGQVGDPSAPEPASAYRLGLKAKTSNQYMVVANTPLATKAGCDILKAGGSAVDAAIAVQAVLGLVEPQSSTIAGSAFMMYYDAQTQKVTAYDGRETAPAAANEYYLVRQNLEDPNSLAPVPSARRSGRSIGVPGVMRMLEMAHNEHGKLRWNQLFDNSVQLAEGGFKVPGRLAAAIQSNAASLALDANAVKTYFHADGSPYQVGETMTNQDYARTIRTIAANGAQAMYSGTIAQAIIAKAQQDKGDDAANTPITPSLMTLNDLANYQAKKRDAICFTYRSQYHVCTMPPPSSGGIAVAQTLGILENFDLASYGPTQPETEGGVPTVMGVHLVSEAERLAYADRDKYVADTDFVPLPAQGVSSMLNKNYLKQRAGLINPDQSMKVATAGDFSVNAGIDNTVEHGTTQFTIADAYGNVVSMTSTVESSMGSFHMVDGFLLTNQLTDFSAQPVDSTGNLVANRVQANKRPRSTMAPTLVFKGTAPGDFYMATGSPGGGTIIQYVVKTLVGALDWNLDAQQATSLVNFGATNSANTNVDSSNTSLDLTALIDGLKAKGHGINSSAQSSGVATIMRIAIQNQQIKYVGGVDPRREGIVLGNGAL

SEQ ID NO: 93966 - protein, 364 aa, Buchnera aphidicola (Thelaxes suberi)
MTKKLYKIAVLPGDGIGPEIIQEAYKIIDVLQKKFSFNVKMHEYDIGGISIDKHGTALTQETIEGCENSDAILFGSVGGSKWDHLPEIEKPEKAGLLKLRKHFNLFANIRPCKLSQHLLDISPLKNSIIKKGIDLICIRELTGGIYFGKSNKITNIDDPYAFDTEIYFRSEIKRIAKIAFQIAQSRKKKIVSIDKANVLKSSILWRDTVNKMAYKFPNVKLEHMYIDNATMELIKNPSSFDVILCSNLFGDIISDECAAIIGSIGLLPSASLNKSGFGLYEPAGGSAPNIAGKTIANPIAQILSLSMLLKYSLHLPFLSSCIDEAVHEALVKKYMTMDISKNPQNFLKTNEIGDKISDLLAKKA

SEQ ID NO: 93967 - protein, 389 aa, Anabaena variabilis ATCC 29413
MLKIPNVQKLFSTAASLVSITAIFCSQPVLAASFKPTPLIIDDDGSQDGMTALAYMLANPKFDVQAITIAQGIARPESFVNNLERMLGRLNASGIPVGIGRSTPLAGNNTFPEFIRTGADTFWSPFVQLPDTAPPIVTRPAAELIVEKVKQSLAPVAILATGSLTNIAEALRLDPTIINNIAIIEIMGGAVFVPGNLPVLPDPPFSTNTTAEFNIWVDPLAAQEVFAAGGQGLKIQLTPLDATNQIAFSRADQQAWLATATPESKLAAEFLDFALTIIQSNNDPNPAWDLVAAINLSEPDFSVETPLYLEVDTTSDPGGTQGQTRAISNLPPNVLVSLNPSFNNLPFRPGQVFSYLQTQSVPEPTSIAGILLLATVSAGMMARRSQKKV

SEQ ID NO: 93968 - protein, 199 aa, Dichelobacter nodosus
MLLIIDNYDSFTYNLAQYFMELGEQILVEKNDAITPVDIENLAPTAIVISPGPCSPKEAGISNAVIAHFAGVIPIFGVCLGHQCIAEVFGGKVVGAHQVCHGKVSPVCHHHGGVFRHLPNPLTVARYHSLVVDKDSLPKAFEITAWIEDDRENVIMGIRHKTLPIEGVQFHPESFLSEAGHDLLKNFLMDVQVFNRENV

SEQ ID NO: 93969 - protein, 132 aa, Helicobacter pylori
SNIKYELDKESGALMVDRVLYGAQNYPANYGFVPNTLGSDGDPVDVLVLSDVAFQAGSVVKARLIGVLNMEDESGMDEKLLALPIDKVDPTHSYVKDIDDLSKHTLDKIKHFFETYKDLEPNKWVKVKGFEN

SEQ ID NO: 93970 - protein, 484 aa, Alkalilimnicola ehrlichei MLHE-1
MPLPRRTKIIATLGPASDGPQMATRLVKAGIDLVRINFSHGTVDDHRRRVEAVRQAAREAGREVGVLADLQGPKIRIEGFRNGAVDLEEDAPFTLDTALDKDAGDTERVGVAYPQLVRDVEPGDVLLLDDGRVLLKVESVSDTAIHCRVATGGRLSNRKGLNRLGGGLSAEALTDKDEADIRTAVELGADYLAVSFVREAADVERARELLQAAGGNAGIIAKIERAEALDCQTEIIQAADAIMVARGDLGVEIGDAALPQVQKQLIHQARDLNRVVITATQMMESMIESPLPTRAEVFDVANAVLDGTDAVMLSAETAAGEYPDAAVAAMDRVCREAEKSRAATESGHRLECRFGSSEEAVAMAAMYTANHLPVKAIIALTESGTTALWMSRIRSGIPIYALTRHPETQGRVTLYRGVYPIAFDPTQGDADSVRQRLVQTLREKRLVTEEDHLVLTFGSRMGVAGGTNTMKVVKVGDLLNGTGH

SEQ ID NO: 93971 - protein, 542 aa, Escherichia coli O157:H7 EDL933
MIAVEKLLPTGEDFASHVYPCYTSHRKETIMTNNPPSAQIKPGEYGFPLKLKNRYDNFIGGEWVAPADGEYYQNLTPVTGQLLCEVASSGKRDIDLALDAAHKVKDKWAHTSVQDRAAILFKIADRMEQNLELLATAEAWDNGKPIRETSAADVPLAIDHFRYFASCIRAQEGGISEVDSETVAYHFHEPLGVVGQIIPWNFPLLMASWKMAPALAAGNCVVLKPARLTPLSVLLLMEIVGDLLPPGVVNVVNGAGGEIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVESIRSGNPLDSVTQMGAQVSHGQLETILNYIDIGKKEGADVLTGGRRKLLEGELKDGYYLEPTILFGQNNMRVFQEEIFGPVLAVTTFKTMEEALELANDTQYGLGAGVWSRNGNLAYKMGRGIQAGRVWTNCYHAYPAHAAFGGYKQSGIGRETHKMMLEHYQQTKCLLVSYSDKPLGLF

SEQ ID NO: 93972 - protein, 122 aa, Brassica napus
MAAAPSLTLFITLSLLFISLQRSESLPQNPSMILLGDGFDWPISHGDAFDIDGGESFEDVADRRSLYWKRRRYYISYGALSANRVPCPPRSGRSYYTHNCFRARGPVHPYSRGCSSITRCRR

SEQ ID NO: 93973 - protein, 755 aa, Ehrlichia ruminantium str. Gardel
MGDLENNGFDAKKREALEFHCKGLKPGKVSLMPTKPLLTQRDLSLAYSPGVAVPCLEIAENPDLVYKYTARGNYVAVISNGTAVLGLGNIGPLASKPVMEGKAVLFKRFADIDAIDLEVDTSDVDEFVNAIKYLGLSWGGINLEDIRAPECFIIEEKLSKIMDIPVFHDDQHGTAIIVSAGLIYALDITGKNIKDIKIVVNGAGAAGIAGLEMIKLIGVPAENITLCDQNGVIYKGRQLGMNEWKAKHAIDTKNRSLKDALVMADVFLGLSVKDVLSENMLLSMNKDPIIFALANPDPEINPDIARKIRPDAIIATGRSDYNNQINNVMGFPYIFRGALDVQARCVNSAMKVAAANAIAMLAREYVSDEVSDAYGGRKMNYGKDYIIPTPFDPRLITVVAPAVAKSAIESGVARRNIENWDEYIKQLESRLSSTSNVLNMMYSSVKRDPKKVIFSEGEEEKIIQAAVQWRNQGYGVPVLVGRIDKVHEGFERLGIKDMKGIEIANAAISENNNKYTDYLYKQLQREGYLYRSCVRDVKTDRNVFAACMLACGDGDILITGLTRGYTVSIHDVQKVIKPKGVMFGLSIIVMKERTIFIADTAIHESPTPEQVAEIAIQASMQARKMGHEPRVAFISSSNFGSHSQKDARRMRKAIEILDNCNVNFEYDGEMSIDVALNPELLTLYPFCRLTSSANVLIMPTLHSASISSKLLREATGVPVIGPILVGMEKPVQIVQMSSSVSEILNLTVLAPSINK

SEQ ID NO: 93974 - protein, 362 aa, Ashbya gossypii ATCC 10895
MFRNTLSHITKRGYAAGREQLLPKKYGGRYTVTLIPGDGIGKEVTDSVVQIFEAENVPVDWESVELSALEENHEGVQKAVESLKRNKVGLKGIWHTPADQTGHGSLNVAFRKQLDIFANVALFKSFPGVKTKLQDVDLVIIRENTEGEYSGLEHESVPGVVESLKIMTKAKSERIARFAFDFALKNNRKAVCAVHKANIMKLGDGLFRNTVSEIGAKEYPEVNVSSIIVDNASMQAVAKPHQFDVLVTPNLYGSILGNIGAALIGGPGLVPGANFGREYAVFEPGCRHVGLDIKGQDVANPTAMILSSTLMLRHLGLNEYADRISRATYETIAEGKRTTKDIGGTATTTEFTNAVIDKLATL

SEQ ID NO: 93975 - protein, 356 aa, Zea mays
  misc_feature (6)..(6): Xaa can be any naturally occurring amino acid
  misc_feature (184)..(184): Xaa can be any naturally occurring amino acid
  misc_feature (215)..(215): Xaa can be any naturally occurring amino acid
MTSGSXAAAAVGGLGRTPTWKERENNKRRERRRRAIAAKIFTGLRALGNYKLPKHCDNNEVLKALCREAGWVVEDDGTTYRKGCKPPPGMMSPCSSSQLLSAPSSSFPSPVPSYHASPASSSFPSPTRLDHGSGSNSHTPGPAAAAAAAAAAASSLLPFLRGLPPLRVSSSAPVTPPLSSPTAXSRPPAKVRKPDWDAAAAADPFRHPFFAVSGXATTAPASPAYNLVNPAGGGGGASASDSMELDGVAGAEFEFDKGRVTPWEGERIHEVAAEELELTLGVGANIFVLETRPGRPDYLGSFYASRLQTPRLQGERRAAEGDSAALGSTGRPLDNPARAPCRDATGGWSTVVQALD

SEQ ID NO: 93976 - protein, 363 aa, Buchnera aphidicola (Pemphigus spyrothecae)
MTKIYNLAILPGDGIGPELLQKDLNFKVLKEQYKLKINTTEYDIGGIAIDKYGKALPKETLDGCKESDSILFGSVGGPKWQHLPPDQQPERAALLPIRKYFNLFSNLRPAKLYSTLNHLSPLRRDISEKGFDILCVRELTGGIYFGKPKGYIKNIIDKKAFDTEIYYASEIKRIAHIGFKLAQNRKYKITSVDKANVLESSVLWRETVNTISKEYPDVKLSHLYIDHAAMQIIKNPDKFDVILTSNLFGDILSDECAMITGSIGMLPSASLNDSNFGLYEPAGGSAPDIAGKNIANPIAQILSIAMLVRYTMKLPMISDHIESAVIDTLKKGYRTLDIANDKEKYVSTNDIGDIISDILKKRI

SEQ ID NO: 93977 - protein, 578 aa, Neorickettsia sennetsu str. Miyayama
MFDDGITLFQVIALLSTAVLVVALFLKLNISPILGYFVAGAVLGTHGFKIVTFSSPMETFAEFGIVFLLFLIGLELTLDRIMSMRLHVFGLGTLQVIITALLIILICRIFGNSSSASIIIGCAFALSSTAIVLQVLQETGMESNQVGRLSIAVLLMQDFTVVPLLVLVALLGNNAPQNLLLPIAMSLIRAGLVLLLIFVAGRLLLRPFFKIIASTKSSELFIATTLLIVLGAAYITEKLELSMAMGAFVAGLLLAETEYRHEVEQVIFPFKSLLLGLFFMTVGMSIDLRMLVENIGLITGIALALMTLKASIVIGLAKLFGFKTGPAINAGLLLAQGSEFALILFKLDSSTTILDASMVNILVSSVTMSMAFTPLFSSIGTMVANKLEAPDRIVEEDELIQLMRASVADIDNHVVIAGFGRVGRMVARMLAEERINYIAIDVDSKIVEKAQDEGFPIFKGNINKRATLDAIAADRASTIVLSMQNGVTSKKAVALIGQSFPHATIVARVADFSDIKTYRKLGAHKLVPETYETGLQIGAEVLQSVGLGSFAIASLKERFRACDYAIPKSIAKEEEPPS

SEQ ID NO: 93978 - protein, 367 aa, Ashbya gossypii ATCC 10895
MHRSSATSLIHKATYATSKTLTIGLIPGDGIGKEVIPAGQRVLEAIGKKHDIRFSYEHLDAGWQTFLETGNALPGATVEALRERCQGALFGAVQSPTTKVEGYSSPIVALRRQLGLYANIRPVKSVSGTGQPVDLVIVRENTEDLYVQQERTYVDAATGKRVAEAIKRISEPATERIAEISLRLALQRQRMGGRGALTVTHKSNVLSQTDGLFKEVCREVYEANKKSYGSIEYNEQIVDSMVYRLFKEPHCFDVVVAPNLYGDLLSDGAAALVGSLGLVPSVNVGNNIIIGEPCHGSAPDIAGRGIANPIATIRSVSLMLQFLGLEEAASDIDQAVTGNLKDRQVVSPDLGGKNTTQEVLDDILARI

SEQ ID NO: 93979 - protein, 262 aa, Moritella sp. PE36
MMNNTVSIKTTTEIELMRNSGKLLAQVFHMLDSYIKPGISTMDINNKVEDFIVNDLNARPASKGQYDYQYVLNSSINEVVCHGVPKVTQILKSKDIINLDVTLEKDGFIADSSKMFVMPDASPLAKKLVEVTYDAMWAGIKQVKPGARLGDVGYAIQRYAESYGYSIVREYCGHGIGREMHEEPQVLHYGSPNQGFLLKEGMVFTIEPMVNQGTAKIKNKKDGWTVVTRDKKLSAQSEHTILVTSSGYDVLTLRKEEKYPAN

SEQ ID NO: 93980 - protein, 504 aa, Xanthomonas oryzae pv. oryzae KACC10331
MTQTNGFDALHAHAQRLRGAAIPALLAAEPERPTQYAWQVGPLYFNFARQKYDRAALDALFAIARERDLAGAFQRLFRGEQVNVTEQRAALHTALRGDLTDAPVASEAYATAAEVRQRMGALIQQLEATDVTDIVSVGIGGSDLGPRLVADALRPVSGARLRVHFVSNVDGAAMQRTLATLDPARTAGILISKTFGTQETLLNGSILHAWLGGSERLYAVSANPERAAKAFDIAPGRVLPMWDWVGGRYSLWSAVGFPIALAIGFERFEQLLEGAAQFDAHALNTPLEENVAVLHGLTAVWNRNLLGSATHAVMTYDQRLALLPAYLQQLVMESLGKRVKLDGSAVDSDTVSVWWGGAGTDVQHSFFQALHQGTSVVPADFIGTVHNDDPYAENHVALMANVLAQTEALANGQDSSDPHRSYPGGRPSTVILLDALTPQALGALISMYEHSVYVQSVMWGINAFDQFGVELGKQLASQLLPALKGESADVADPVTRELLSKLRG

SEQ ID NO: 93981 - protein, 132 aa, Helicobacter pylori
SNIKYELDKESGALMVDRVLYGAQNYPANYGFVPNTLGSDGDPVDVLVLSDVAFQAGSVVKAHLVGVLNMEDESGMDEKLLALPIDKIDPTHSYVKDIDDLSKHTLDKIKHFFETYKDLEPNKWVKVKGFKN

SEQ ID NO: 93982 - protein, 418 aa, Arabidopsis thaliana
MVEKMVDPSVVGTGVSGTVGGSSISGLVPKDESVKVLAENFQTSGAYIAREEALKREEQAGRLKFVCYSNDSIDERMMCLIGLKNIFAGQLPKMPKEYIVRLLMDRKHKSVMVLRGNLVVGGITYRPYHSQKFGEIAFCAITADEQVKGYGTRLMNHLKQHARDVDGLTHFLTYADNNAVGYFVKQGFTKEIYLEKDVWHGFIKDYDGALPMECKIDPKLPYTDLSSMIRQQRKAIDERIRELSNCQNVYPKIEFLKNEAGIPRKIIKVEEIRGLREAGWTPDQWGHTRFKLFNGSADMVTNQKQLNALMRALLKTMQDRADAWPFKEPVDSRDVPDYYDIIKDPIDLKVIAKRVESEQYYVTLDMFVADARRMFNNCRTYNSPDTIYYKCATGWKHTSIAKYKQVSNLVLNLNRRRW

SEQ ID NO: 93983 - protein, 447 aa, Erwinia carotovora subsp. atroseptica SCRI1043
MAQIVSLASFLDSVQQRDPHQPEFLQAVNEVLSTLWPFLEQNPHYADYSLLERLVEPERVIQFRVAWTDDKGQVQVNRAWRVQFSSAIGPYKGGMRFHPSVNLSILKFLGFEQTFKNALTTLPMGGGKGGSDFNPKGKSQGEVMRFCQALMTELYRHLGADTDVPAGDIGVGGREVGFMTGMMKKLTNNTACVFTGKGLSFGGSLIRPEATGYGLIYFTEAMLKRHGLGFEGMRVAVSGSGNVAQYAIEKAMELGARVVTVSDSNGTVVDENGFTPEKLALLEEIKNKRYGRVEDYAREAKLTYLAGKTPWEVPVDIALPCATQNELDLPAAQTLIANGVKAVAEGANMPTTIPATDAFLDAGVLFAPGKAANAGGVATSGLEMAQNAARLGWKAEKVDARLHHIMLDIHTACVQYGGEDSQTNYVRGANVAGFVKVADAMLAQGVV

SEQ ID NO: 93984 - protein, 310 aa, Oryza sativa
ASKPTFHIHAILLRLLLLLLLLGSLAMAAPPQPVPAPAAASPEVFRLGFIGPGNLAESIARGVAASGVLPATAIRTAPHRRPERAEAFSSIGAHILETNAQVVDDSDVIVISVKPQIVRQVLVELKPLLSEEKLLVSIAAGIKMEDLQGWSGHRRFIRVMPNTPSAVGQAASVMCLGEMATENDENRVRSLFSAIGKVWTAEEKYFDAVTGLSGSGPAYIFLAIEAMADGGVAAGLPRDLALGLASQTVLGAATMVNKTGKHPGQLKDMVTSPAGTTITGIQELEKGAFRGTLINAVVAATKRCRELSQS

SEQ ID NO: 93985 - protein, 517 aa, Funalia trogii
MARFQSLLTFITLSLVASVYAAIGPVADLTISNGAVSPDGFSRQAILVNDVFPSPLITGNKGDRFQLNVIDNMTNHTMLKSTSIHWHGFFQHGTNWADGPAFVNQCPISTGHAFLYDFQVPDQAGTFWYHSHLSTQYCDGLRGPIVVYDPQDPHKSLYDVDDDSTVITLADWYHLAAKVGSPVPTADATLINGLGRSIDTLNADLAVITVTKGKRYRFRLVSLSCDPNHVFSIDGHSLTVIEADSVNLKPQTVDSIQIFAAQRYSFVLNADQDVGNYWIRALPNSGTRNFDGGVNSAILRYDGAAPVEPTTSQTPSTNPLVESALTTLEGTAAPGSPAPGGVDLALNMAFGFAGGKFTINGASFTPPTVPVLLQILSGAQSAQDLLPSGSVYSLPANADIEISLPATAAAPGFPHPFHLHGHTFAVVRSAGSSTYNYENPVYRDVVSTGSPGDNVTIRFRTDNPGPWFLHCHIDFHLEAGFAVVMAEDIPEVAATNPVPQAWSDLCPTYDALSPDDQ

SEQ ID NO: 93986 - protein, 405 aa, Bacillus licheniformis ATCC 14580
MKGGCASMFHTIEEAIRDLKQGKVIIVVDDENRENEGDFVALAEYATPDVINFMASHGRGLICAPLNEEIASRLELQPMVDENTDSHHTAFTVSVDHRDTKTGISAQERSLTVMSLIADHAHPGDFKRPGHIFPLIAKKGGVLKRAGHTEAAVDLAEACGSAPAGVICEIMNEDGTMARVPELKKIADQHGLKMITIKDLIEYRYSKGTLINREVKITLPSEFGTFKVYGYTNEIDDKEHIALVKGDIPFGDEPVLVRVHSECLTGDVFGSYRCDCGPQLAAALAQIEQAGRGVLLYLRQEGRGIGLINKLKAYKLQEEGYDTVQANEKLGFLPDLRNYGIGAQILRDLGVKQMKLLTNNPRKIAGLEGYGLTIADRVPLQMETKKDNEKYLKTKKSKLGHMLHF

SEQ ID NO: 93987 - protein, 211 aa, Neorickettsia sennetsu str. Miyayama
MEMDTLVREKMNLVPMVVDQTPRGERAYDIFSRLLKERVVFLTGPIEDGMASLIVAQLLFLEAENPDKDIFMYINSPGGVVTAGLSIYDTMQYIKPSVSTVCVGQAASAASLILASGAEGKRFALPHSRVMVHQPSGGVRGQATDMEIHVKEILQLKRMINEIYQKHTGETIKKIETLLERDTFLSPEEAKKVGIIDDIITQRKENSGKQE

SEQ ID NO: 93988 - protein, 358 aa, Campylobacter jejuni RM1221
MKAYKVAVLAGDGIGPLVMKEALKILTFISQKYNFSFEFNEAKIGGASIDAYGVALSDETLKLCEQSDAILFGSVGGPKWDNLPIDQRPERASLLPLRKHFNLFANLRPCKIYESLTHASPLKNEIIQKGVDILCVRELTGGIYFGKQDLGKESAYDTEIYTKKEIERIAHIAFESARIRKKKVHLIDKANVLASSILWREVVANVVKDYQDINLEYMYVDNAAMQIVKNPSIFDVMLCSNLFGDILSDELAAINGSLGLLSSASLNDKGFGLYEPAGGSAPDIAHLNIANPIAQILSAALMLKYSFKEEQAAQDIENAISLALAQGKMTKDLNAKSYLNTDEMGDCILEILKENNNG

SEQ ID NO: 93989 - protein, 425 aa, Vibrio sp. Ex25
MSEDNRQAATPEEEHRQKALDYHAYPTPGKIAVELTKPAETAGDLALAYSPGVAEPVREIAQNPDNVYKYTAKGNMVAVISNGTAILGLGNLGPLASKPVMEGKALLFKRFAGLDSIDIEVKHRTIDEFVDTVASIADTFGGINLEDIKAPDCFEIEKRLIERCDVPVFHDDQHGTAIVTAAGMLNAIELQGKKLEDSTIVCLGAGAAAVACMELLIKCGAMREKIYMLDRKGVIHTRRDDLNEYKQLFANNTDKRTLEDVIEGADLFLGVSGPNLLPAEALKLMADKPIVFACSNPDPEIKPELAHAVRDDLIMGTGRSDYPNQVNNVLCFPFIFRGALDVRASEINDEMKLAAVEAIRELAKEPVPETVLKAAGVDKLEFGADYIIPKPMDSRLLPRVAKAVAQAAVDSGVARIEMPENYMAE

SEQ ID NO: 93990 - protein, 367 aa, Gibberella zeae PH-1
MTDKKNEDYVVRMGDDNYDKNEKPSFQPRSPPPMAYGSSQLHSLEQLEKSPPLSIAAYCLSSISMTVVNKYGHWRKLSIGCCLYWHNHLVQAAGHDQGSRSFRRRSSKEITKSLQFLSVPVYTIFKNLTIIVIAYGEVLWFGGSVTPLALLSFGLMVLSSIVAAWADIQSAINGDFGTGDSAAAVSTLNAGYAWMGMNVFCSAAYVLGMRKVIKKMNFKDWDTMYYNNLLTIPVLVICSLLTEDWSAYNFSRNFPDDTRNKIIIGMIYSGLAAIFISYCSAWCIRVTSSTTYSMVGALNKLPIAISGLIFFSAPVTFGSVSAIFIGFISGLVYAWSRVRQSMSSGGSLPTVAPPMSASAKSNRDANS

SEQ ID NO: 93991 - protein, 265 aa, Aspergillus oryzae
MKFMNHGARADRAEHSGSTPVYSSTQKQLPMLHLKDTARNNVIAVIGEFVGTFLFLFFSFAGTQVSNTPKPVDGAPPNTANLLYSALSFGFSLMVNVWAFYRVTGGLFNPAVLWHVTLALCLVGGLSPIRGVLVFAAQIVAGIASAGVVSALFPGDLNVGTRLGGGASISQGLFIEMFLTAQLVFVIIMLAVVKHKSTFLAPVGIGLVFFVTEMIGKFILFRCHRTICLTRINVGDYYTGGSLNPARSLGPDVINRSFPGYHWIY

SEQ ID NO: 93992 - protein, 213 aa, Prochlorococcus marinus str. MIT 9211
MSSPSRLSQFAGLSQLGIHLLAVSKGQPASEIRSLFIEGQIDFGESRLQEALTKFDVLNDLQEIRWHFIGRLQANKVRGVVKSFDVIHSVDSIKLAKRISRIAGEENKMPLIMFQVKFRKDDKKTGFEVDELLEAWTKLITLPNVRICGLMTIPPAGLDRHGTKNLFKECRNLADQLSLQDCSMGMSRDWEDAIEAGATWIRLGSILFGERHK

SEQ ID NO: 93993 - protein, 360 aa, Ashbya gossypii ATCC 10895
MPPIVDRVAAMPMICDTRPGVGETASRNMSASYWDSSQRNKWQYSRESLARTRQKLWMLECQLYPQGTNILMEGGGKDAQPVTKNIPITHRDLHYDRDYNLRIYCYFLIMKLGRRLNVRQYALATAHVYLARFCLKASIREVNLYLLVTTCIYLACKVEECPQHIRTLVNEARSLWPEFVPPDPTKVTEFEFYLIEELQSYMIVHYPYRAMEQIAAALRRPPYNLVLSPDDLQNSWSLINDSYITDVHLLYPPHVIAMACLFITVCLRSAAGARDLQETFNRFMADSQVDLHEVMDTIQDFITLYDHWDKYNEPWIKFLLHNLYLRPHAGGTTVSGAAAGSAGPAGSVLTPNGTITGSTS

SEQ ID NO: 93994 - protein, 276 aa, Prochlorococcus marinus str. MIT 9211
MPFSIGIIGLGRMAQAILTPLLERGDFKPDEVLGVVGQRSSVKKVLGEFSQDLSIVSSDNPVSLEVWNSPIQLLAVKPQQLNDIKEQVSQLEIVPDRPKPVLISILAGVNLKRLQSIFPAHNCVRAVPNIPVIVRSGLTGLSWGAGVTTDQRLSVEAIFKPISEVLELPEKQLDAFLALTSSGPAYVAVIAEALADGAVAAGLPRSLANDLSNMTLAGSAKLLKESNLHPGELKDMVASPAGTTITALRHLEMAGIRSALIEAVVLAAERSRELGC

SEQ ID NO: 93995 - protein, 372 aa, Ashbya gossypii ATCC 10895
MSGQVRQRFAKDQHAGSQIEVEYGSKDAAFEADKSVELEEREELLPIRGQLAVSKVDLYTVYASGALLVALAVGFLRQAAWCDKFLRLQYASVESPGKYDIGIDDAYIVGTFVVVLCLVRSSLLEFVLKPLAHYKFRISSGKIQQRYGEQSWSMLYYTASWVTGFYLYYHSPYFLNCDHIYLNWPHDKMAGVFKVYYLVQIASWLQQIIVLNVEEKRKDYWQMFAHHIITVALTTGSYYYYFNRIGHVILIIMDVVDILLSSAKILKYCGFSVACDYMFVVFLGFWVVLRHGVYNYILHHAWAKSRGLMQNQRCGVHAPGTRCWTPLVIDIFVLLLAGLQLITVIWSFLIVKVFMKVIRGSGAEDVRSDDEE

SEQ ID NO: 93996 - protein, 136 aa, Mycobacterium sp. MCS
MTERTLVLIKPDGVQRRLVGEILGRIERKGLTLAALELKTVDDELARRHYAEHEGKPFFGSLLEFITSGPVVAAIVEGPRAIAAFRQIAGGTDPVEKATPGTIRADLALVTQDNLVHGSDSPESAAREIDLWFPGR

SEQ ID NO: 93997 - protein, 407 aa, Magnaporthe grisea 70-15
MSSKLHSDLAHHPKSPKTMRAVIFVGLGEVETRDVPFPEIEEPEDVILRITTSAVCGSDLHNYRGYFGPPKFPYPIGHEAVGVVYKVGPAVDSFKVGDRVITAIPDDRPITTKNAFTSPGLDLLLGGEFGTQAEYMRIPFADSSLIPIPNRISDKEWIMVSDAFATAWQGLDWAGFQPGDSVAVFGAGPVGLMAAYSASLRGASRIYIVDHNQQRLDKALEIGSAVIPINFLTEKASDQILKTSPGGVNRAIDCVGQEGVNQKLKIEWDYVLRECIRVTTTGGGIGLVGAYVKFAKSEGVPNADEVPAELSVPVAELFAKQLSVKAGTMDPTRTARQMVSLVENGRAKPSFVIDEGPFDLDQAPQLYRRFNEGKIIKVLFRGAPRPEEWEQCGEKGAPEGHVNGHNV

SEQ ID NO: 93998 - protein, 335 aa, Moritella sp. PE36
MTIKIGINGFGRMGRLAMRAAFNWDDIEIVQINDPAGNAETLAHLLNFDSIHGRWEHQAEFLGDQMIIADRFIPCTRNTAISDTDWSQCDVVLEASGKMKTSALLQGYLDQGVKRVVVTAPVKEEGVLNIVMGVNDDLYNKDLHPIVTAASCTTNCLAPVVKVLNEKIGIKHGSMTTIHNITNTQTILDAPHADLRRARACGTSLIPTTTGSATAITNIFPELTGKLNGHAIRVPLANASLTDCVFEVERETTAEEVNSYFKQAAENELKDILGYEERPLVSVDYKTDPRSSIIDALSTMVVNGTQVKIYAWYDNEWGYANRAAELARMVGRSDK

SEQ ID NO: 93999 - protein, 512 aa, Bacillus cereus G9241
MSILTVENVSHSYGEKAILYNACFRLLKGEHVGLVGKNGIGKSTLLMILTGELIHDDGNIEWFPHVKVGFLQQHMVLQEGMTIEGYLQSAFADLYTIECEMLKIAEQMNGAGEVEKLLVKYGELQTILESSNFYHIHTEVEEVAVGLGLFEIGLKKDVSKLSGGQRTKLLLGKLLLEKADVLLLDEPTNYLDTAHIEWLQSYLRLYEKAYVIISHDEVFLNSITNVIFHLEGGKVKRYVGNYEKFVQSYQVQKKQLQSAYTKQQKEISQLETFIQKNKIRKAKQAKSREKVLEKMQRVEKINHVTRSRFDFNVYEEPVSRILQAEKLRIGYSDPLCPELNLQVKKGEKIAIIGHNGIGKTTMLKTLLGQIKPLSGSISVGERVNPAYFAQEEFASETTPLEKIWAERPDMTKKEVRQALAKCGLKEEHVLKPIRLLSGGEQTKVRLCELIVTKSNVLILDEPTNHLDIETKKSLQEALQQYKGTVLLVSHEPSFYEAWITKVWNIEEWNAEK

SEQ ID NO: 94000 - protein, 132 aa, Helicobacter pylori
SNIKYELDKESGALMVDRVLYGAQNYPANYGFVPNTLGSDGDPVDALVLSDVAFQAGSVVKARLIGVLNMEDESGMDEKGLALPIDKIDPTHSYVKDIDDLSKHTLDKIKHFFETYKDLEPNKWVKVKGFEN

SEQ ID NO: 94001 - protein, 593 aa, Anabaena variabilis ATCC 29413
MPILAKSKLVVFTVFSLGVLCYNQIASATITLPLRSKKGMVVSAHPLASETGVAMLRKGGNAVDAAVATTFAISVVEPFSAGIGGGGFLLMRSQKTGEIKALDFRERAPLKATRKMYLDDAGKVRPNASINGYLAVATPGTIAGMYEVHRRYGKLPWYEVVKPAIALAKDGFVLAQKPTWRSIQVYGTRKQAILSNQAAREIFTRNGEFYQPGERLVQRDLARTLAEIAQNPQSFYTGDIARAIAADMAKNGGLVTLADLKAYKPIWRNPVCGNFRQAKICSMPPPSSGGVLLLQMLNIIGDTDLKSWGWHHPKALHLFTEAMKIAYSDRSQYLGDPDFVKIPLQALLSPAYGKKRRAEIDLHRAIPSTQVKPIAPQILQRFGKAEIPQRIYANRYESPETSHISVVDKERNAVSLTFTVNYGFGSGVVASGTGILLNDEMDDFAAAPGVPNVFGLVGSEANAIAPRKTPLSSMTPTIITENERLRMVVGAPGGSTIITQVLQIILNVLEYDMDVGAAVSVPRIHHQWLPDELRVETWGLDALTLQDLRRRGHNIKETNPWGNINAIVVTKEGDLEGAADPRGEGSPIANDRL

SEQ ID NO: 94002 - protein, 132 aa, Helicobacter pylori
SNIKYELDKESGALMVDRVLYGAQNYPANYGFVPNTLGSDGDPVDALVLSDVAFQAGSVVKARLVGVLNMEDESGMDEKLLALPIDKVDPTHSYIKDIDDLSKHTLDKIKHFFETYKDLEPNKWVKVKGFEN

SEQ ID NO: 94003 - protein, 132 aa, Helicobacter pylori
SNIKYELDKESGALMVDRVLYGAQNYPANYGFVPNTLGSDDDPVDVLVLSDVAFQAGSVVKARLVGVLNMEDESGMDEKLIALPIDKIDPTHSYVKDIDDLSKHTLDKIKHFFETYKDLEPNKWVKVKGFEN

SEQ ID NO: 94004 - protein, 450 aa, Erwinia carotovora subsp. atroseptica SCRI1043
MTKHYDYLAIGGGSGGIASINRAAMYGQKCALIEAKYLGGTCVNVGCVPKKVMWHAAQIAEAIHQYGPDYGFDTTVNQFNWGTLVKNRSAYIDRIHQSYDNVLGKNKVDVIHGFARFVDAHTVEVNGEKITADHILIATGGRPVHPNIPGAEYGIDSDGFFELDALPKRTAIVGAGYIAVEIAGVLNGLGSETHLFVRKHAPLRSFDPLIVDTLVEVMNTEGPTLHTESIPKAIVKNADGSLTLELENGQSQTVDCLIWAIGREPATDNLNLSVTGVGLNDKGYINVDKFQNTTVSGIYAVGDNTGAVELTPVAVAAGRRLSERLFNNKPDEHLDYSNIPTVVFSHPPIGTVGLTEPQAREQYGDDQVKVYKSAFTAMYTAVTQHRQPCRMKLVCVGKEEKIVGIHGIGFGMDEMLQGFAVAVKMGATKKDFDNTVAIHPTASEEFVTMR

SEQ ID NO: 94005 - protein, 576 aa, Vibrio vulnificus YJ016
MSQANKLKTRFQAPSLSVGAFFVFKSHKRAQTKIIADLIRNLSYAHLSFKMLVRTKNNIRSAQMKNNSSTPTSTLDILVVGGGINGAGIAADAAGRGLSVALFEAKDFASATSSASSKLIHGGLRYLEHYEFRLVSEALAEREVLIKKAPHIAFPMRFRLPHRSYLRPAWMIRCGLFLYDHLGKRTTLPSSHKVNLAETGLLKEEMKIGFEYSDCWVDDARLTLLNAISAKRNGAEVRNYCKVSKAERVDGLWKVTIEDQQNGEQFVRYAKALVNAAGPWVKQFYDDSLDGPSPRNIRLIKGSHIVVPRVHPDPQAYILQNNDGRIVFVIPYLDKFSIVGTTDVEYTGDPRHVAISEQEVDYLIDIVNQHFVHQLSKQDVVWTYSGVRPLCDDESDSPQAITRDYTIELEQELDQAPLLSIFGGKLTTYRKLAESAMRKLAPYFDHMGTPWTAQQTLPGGDFSCTREQLAHALRQQYPWLSATLAYRYVCQYGSDARQLLAGAEEVSAMGIELAPEVYQRELDYLMAHEFAQCSEDILWRRTKLGLYLTPEQVQSVENYIAKKHTTAQSPQLQQAS

SEQ ID NO: 94006 - protein, 248 aa, Triticum aestivum
PRVRILPSARPWCAAARYKIPDHPHAWAQKYYAPYASDPRAIRRVILVDMPYAIVQNYSDHYRPDWAHMSFLIDILRPSAGEGPSWYHLVNKAGGGCNDLIYSGHMFVAVLTAMAWTEAYGGWISVGIWFLVLHSAQREIRERYHYSADCVVAIYVGILLWRVTGFIWSPRDSDQARRLAQLDEVQNRLFHAAKDSDIDEIRGLLNEVEMAGQPKKTFSQGVILSFAAFMITFTLLFALLAFSLTSNG

SEQ ID NO: 94007 - protein, 600 aa, Glycine max
NYIYNFSFVTNENESYFTYSMYNSSIISRFVMDVSGQVKQFTWLENAQQWNLFWSQPRQQCEVYAFCGAFGSCTENSMPYCNCLPGFEPKSPSDWNLVDYSGGCERKTMLQCENLNPSNGDKDGFVAIPNIALPKHEQSVGSGNAGECESICLNNCSCKAYAFDSNGCSIWFDNLLNLQQLSQDDSSGQTLYVKLAASEFHDDKSKIGMIIGVVVGVVVGIGILLAILLFFVIRRRKRMVGARKPVEGSLVAFGYRDLQNATKNFSEKLGGGGFGSVFKGTLGDSSGVAVKKLESISQGEKQFRTEVSTIGTVQHVNLVRLRGFCSEGAKRLLVYDYMPNGSLDFHLFHNKNSKVLDWKMRYQIALGTARGLTYLHEKCRDCIIHCDVKPENILLDAEFCPKVADFGLAKLVGRDFSRVLTTMRGTRGYLAPEWISGVAITAKADVYSYGMMLFEFVSGRRNSEPSEDGKVTFFPSFAANVVVQGDSVAGLLDPSLEGNAEIEEVTRIIKVASWCIQDNEAQRPSMGQVVQILEGILEVNLPPIPRSLQVFVDNQESLVFYTESDSTQSSQVKSNVSKTSSSHAISNISSASSKSLGGEN

SEQ ID NO: 94008 - protein, 295 aa, Methanosarcina acetivorans C2A
MPVKVYGVILMNIEEWEEYRYVEAGIEDSIARIEDSSLKKMVEHVCHFGGKRIRPIILLLASEICSGSYSRSLDAALAVEMMHSASLIHDDLLDQGLIRRNLPSAPEKFGPSRALLCGDYLIAKSIAFISPYGEKVIRDFGKAGMDMAEGEVLDLRLDDDKFGEDDYFKCIYKKTASLFAISASIGAYTGGADEALAERFSFFGNSLGTAYQIVDDILEFLEVVEGKESKFTSETLPHIYMRKMSKEEALEKSIGSVKQHVSAAKETLGTFRACSARNKLFQITDYITVDMLENI

SEQ ID NO: 94009 - protein, 323 aa, Aspergillus oryzae
MGIFDYDFLYSQLFIRPAYPTTSFTNQTIIITGSNVGLGLEAARHFTRLGAAKVILAVRNRSAGEEARQSIERSTGTTGICEVWDLDLASHESVLAFAKKVAELPRLDVFIANASIATGTFQLAEGHERTITVNVINTILLELLVLPTLRKSARLHPGTKPRLTTVVSEVHAWAKFAERSAENVFKALDDKEQANMPERYELSKLLQVLLLREMVAQGAGDSVIINMVNPGFCHSRLGREMGLAFALLQMVLARSTEVGSRTLVAGAASGEESHGAYMTNGKVDNGALSTFVRSEEGKKTQMKLWAELVEILEALEPGCTRVV

SEQ ID NO: 94010 - protein, 268 aa, Ehrlichia ruminantium str. Gardel
MLEYTLNYLTNNLNITPVIGIELEFYFDHISLDNLKLVIDNIKNKLSCFNCNIIQEKSELQYEIQTSYTTNISRLISEINTIKEILHNTVQNHKGTINFSAKPYLDKPGSAFHVHINLLDKNANNLFFQQNNEVSTYLLYSIGGLCTLMKKHMIFFAPYSDSYLRYIHADIDTPTTISWGGNNRSTAIRIPNTTNNPNRCRIEHRVAGSDCNHKQVITSILQGLIHGIQNKIQPIPRTYGIASDLQYNLEKLPLSLDESIKHFITDQQ

SEQ ID NO: 94011 - protein, 315 aa, Corynebacterium diphtheriae NCTC 13129
MRAIYVQDDATLAVHDAPTPTLQPGEVLVQVKAAGVNRADLLQAAGHYPPPPGESEIIGLECAGVIVDAGTTSRNVGDKVACLLAGGGYAEYVAVPEGQLMPIPEGYSFAEAAAVVEVAATVWSNIGMLTGLKPEHMFLIHGGAGGIGTFAIQLAKHVGATVAVTAGSKEKLETCRELGADILINYREEDFAEVLKNKCDRILDIMGAKYLDQNVRALAMDGHQVTIGMQGGVKGELNIGRLLSKRGTISATALRARDREDKARIVASTVENVWPLLADGTIRHHIHATLPLEQAQRAHEMLKNGEVTGKLVLEV

SEQ ID NO: 94012 - protein, 750 aa, Neorickettsia sennetsu str. Miyayama
MEGERDDLGVQALRYHSKGRAGKLGVHATKPLLTQEDLSLAYSPGVAHPCLEIEKNPLDVYKYTSKGNLVAVISNGTAVLGLGNLGAMASKPVMEGKAVLFKKFADIDSIDIEVDAQSIEEFILTVKNIASTFGGINLEDIKSPECFEIEERLAAMLDIPVFHDDQHGTAIIVCAGLINAADITMRKVEELKVVVNGCGAAGIACIELMKEIGVSDIVVCDQSGVIKKDRDFHEGDRKALYAVDVTANTLEEALVDADVFIGLSAADVLKPEWLSGMKKDPIIFALANPDPEIKPELAKKARPDAIIATGRSDYDNQINNVMCFPYLFRGALDVGASKFNTEMKLAAVHAIAAIAKRPISMEVMDAYGDSHMQYSREYILPKPFDQRLIAEIAPAVARAAVETGVAKKPIYNFDAYKDDLVRRLASGATTLFGMVSSVLRGNGKRIIFAEGEELKSIRAALQWRDIGYGTPILVGRNSVIEAKMDEMNLRNREGFEVANAAVSQRSGEYIEYMYSTLQRKGFPYERCVRDVETDNDVFAACMLALNDGDAVITGLTWSNTEDRLKSIMPIVGAAGVVFEMSIIVAGIGTFFICNTGINDTLDAGDIAEVAIKAAEVAKSMGCVPRVAVIANSNFGSVNSPSALMAREAIEILDDFGAPFEYEGEMDLGMALNEKSKKLYPFSRLTDRANVLIVQNVEVVDAVCKFSSEIMETTVIGPLLFGLKRSVQIVRPSYGATDILNLALIAAKTSL

SEQ ID NO: 94013 - protein, 524 aa, Corynebacterium diphtheriae NCTC 13129
MSTPITHESSSHALAEDAEVHGKNENRRQFTGLFAGLILAVLIYLVFPESSVDMVQGVDPDGEYSYNALRITAAIAVLMGAWWMTEAIPLAATALVPLVAFPVLQVIPFAKISAPYASPTIFLFMGGFILALGMQRWNLHRRLALSVVLLVGTKPKQLIAGFMLATGFLSMWVSNTATAVVMLPIGVSVLQLTAESVGGMKAQKKFATALMLAIAYSASIGSLGTIIGTPPNALMVAYMAENHDIHIGFGTWMLVGVPLAIVYMAIAWLVLVSVFKPEVDSIPGGREMIKSELAKMGSMKFGEAATAVIFTGAALSWVFVPLLIDVFQWKVEIADAAIGLIASMLLFMIPADRKTGVRLTDWKTANELPWDVLLLFGGGLALSKMFSDSGLSLWIGEIAKGLVSLPLILLIAAIAALVLLLTEFTSNTATAATFLPIMAGVAVGIGLNANGDQNILLLTIPVALSATCAFMLPVATPPNAIAYGSGHVRIGDMVKGGVWLNLIGVVLVTLATYFLAIPVFNIVL

SEQ ID NO: 94014 - protein, 397 aa, Neorickettsia sennetsu str. Miyayama
MLSKKIESIKPSATAAATRRVCELRARGKDVISLCIGEPDFSTPFLGQEMAIQAIKDCDDNYSPVAGTMVLREEIAAKFVRDNALHYSPHEIVVGNGAKQVLYNVLGAILNPEDEVVLIAPYWVSYCEIVRIFSGKPVVVPSTKKFRIDITAIREALNTKTKAILINSPNNPSGVCYEESELRDLASALRAHPQVHIISDDIYEHITYAESSFLNIANVAPELGERIILVNGVSKCYAMTGWRVGYAAIPNKAVISLVCRLQEHSTFGVCTIAQAAALGALRSGADVLSERLAVFARKRNKAVEVLSMLPELCCYKPDGGFYLFLSCSAFFGKKSPSGFEVKTDSDVADYLLEEHAVAVVPGEEFGVPGYFRISYALSMDLLEQACMRIVKAFKALR

SEQ ID NO: 94015 - protein, 456 aa, Prochlorococcus marinus str. MIT 9211
MATHDIFMPALSSTMTEGKIVEWLKNPGEKVARGEAVLVVESDKADMEVESFQDGYLAAVLMPAGSTAPVGEIIGLIVETEDQIAEVKAKNPTKDQASKEVSSSDSESSKQTLEVASQDQGSVLEVQASKKAESLPPRAVVNDGRIIATPRARKLASQLGVDLATVLGTGPHGRIQAEDVQTAQGQPITVPWVAESDAPARLEVFNSQAANTGAPQEETKVNEAPKGNSFGAPGETVSFNTLQQAVNRNMEASLSIPCFRVGYSINTDKLDIFYKQVKPNGVTMTALLAKAVGKTLARHPQLNAACSNEGMSYPEQVNVAVAVAMEEGGLITPVLQNADTTDLFELSRQWADLVKRSRSKQLQPNEYSSGTFTISNLGMFGVDRFDAILPPGTGAILAIAASIPQVVAAKDGSMAVKRQMQVNLTADHRVIYGADGAAFLKDLSRLIENNPEQLAT

SEQ ID NO: 94016 - protein, 291 aa, Bacillus clausii KSM-K16
MIAIVGSINIDLVVYTSNMPVPGETVLGDKFRTNPGGKGANQAVAAARLGAAVTMVGRVGNDPYGKLATENLRNEQVETGYIDVDNAAHTGVAMITVTNNDNSIVVAPGANFSWKREEAGLYRELLRQSKVLLLQLEVPLPFIEEIAKLGKEEQCTTILNPAPAQQLSPSMLDLVDFITPNETECQTIFKQPVEQAVRNYPNKLIVTEGKKGATYHDGNRLVRVNGFLAKAVDTTGAGDTFNGAFAAALASEHPLAEAVSFANAAASLSVEKAGAQSGMPTKKQVVHRLGT

SEQ ID NO: 94017 - protein, 328 aa, Prochlorococcus marinus str. MIT 9211
MSRIYKDNSFAIGNTPLVKLNSVTKNTKATVLAKIEGRNPAYSVKCRIGANMIWDAEQKGLLKQGQTIIEPTSGNTGIALAFTAAARGYKLVLTMPESMSLERRRVMAVLGAELILTEASKGMPGAIAKAKEIAQSDPQKYFMPGQFDNPANPEIHFKTTGPEIWNDCDGNIDVLVAGVGTGGTITGISRYIKGEKGKSMLSVAVEPSHSPVISQTLNGQEVKPGPHKIQGIGAGFIPKNLDLSVVDRVEQVTNEESIAMALRLAKEEGLLVGISCGAAAVAAVRLAEQEEFAGKTIVVVLPDLAERYLSSVLFADVPTGIIEGPEAT

SEQ ID NO: 94018 - protein, 380 aa, Prochlorococcus marinus subsp. pastoris str. CCMP1986
MNHLFKKNAKLVLSNGITFTGYSFGAMGSTVGEIVFNTGMTGYQEVISDPSYFGQIITFTYPEIGNTGINFEDSESDNSVRGIIVRNFSNNNSNWRSKLNFNQWLIEKNIIGLYGIDTRALVKILRSNGSMNGVITSEKNDLDSCLEIISNTPNMQGLNLAKDVSTKKNYIFKATTMTDFDVREKIHKNINKFRVVAIDFGIKKSILNRLASHGCEILVLPSNSSFEDVLSHDPDGIFFSNGPGDPSSVLDGINLAKLLINYGKIPMFGICLGHQIFGLALGGKTYKLPFGHRGLNHPCGMNNNNIEITSQNHGFAIDPNSLSTELVEITHLNLNDKTVAGLKLINKPIFSVQYHPEASPGPHDSDYLFEKFVSLMLERC

SEQ ID NO: 94019 - protein, 176 aa, Zea mays
MQDMKPAAAAVAKVVAGDSPPSAASPAPAPAVANSNGTPQKPPPIPAAAFDMPKPNLRGLNKPKCILCGNIARSRCPFQCCKSCCYKAQNPCHIRVLKQTNTLPDKPSPATAPATTEQQSNNLPATSSASRLAALQKLPQHFLKFLQTKKSVYKKVHCLFPCALFVPDRFFFFFLF

SEQ ID NO: 94020 - protein, 132 aa, Helicobacter pylori
SNIKYELDKESGALMVDRVLYGAQNYPANYGFVPNTLGSDGDPVDVLVLSDVAFQAGSVVKARLVGVLNMEDESGVDEKLLALPIDKIDPTHSYVKDINDLSKHTLDKIKHFFETYKDLEPNKWVKVKGFEN

SEQ ID NO: 94021 - protein, 273 aa, Escherichia coli O157:H7 EDL933
MSCEELEIVWNNIKAEARTLADCEPMLASFYHATLLKHENLGSALSYMLANKLSSPIMPAIAIREVVEEAYAADPEMIASAACDIQAVRTRDPAVDKYSTPLLYLKGFHALQAYRIGHWLWNQGRRALAIFLQNQVSVTFQVDIHPAAKIGRGIMLDHATGIVVGETAVIENDVSILQSVTLGGTGKSGGDRHPKIREGVMIGAGAKILGNIEVGRGAKIGAGSVVLQPVPPHTTAAGVPARIVGKPDSDKPSMDMDQHFNGINHTFEYGDGI

SEQ ID NO: 94022 - protein, 339 aa, Escherichia coli O157:H7 EDL933
MNQRNASMTVIGAGSYGTALAITLARNGHEVVLWGHDPEHIATLERDRCNAAFLPDVPFPDTLHLESDLATALAASRNILVVVPSHVFGEVLRQIKPLMRPDARLVWATKGLEAETGRLLQDVAREALGDQIPLAVISGPTFAKELAAGLPTAISLASTDQTFADDLQQLLHCGKSFRVYSNPDFIGVQLGGAVKNVIAIGAGMSDGIGFGANARTALITRGLAEMSRLGAALGADPATFMGMAGLGDLVLTCTDNQSRNRRFGMMLGQGMDVQSAQEKIGQVVEGYRNTKEVRELAHRFGVEMPITEEIYQVLYCGKNAREAALTLLGRARKDERSSH

SEQ ID NO: 94023 - protein, 319 aa, Oryza sativa Indica Group
  misc_feature (311)..(311): Xaa can be any naturally occurring amino acid
  misc_feature (318)..(318): Xaa can be any naturally occurring amino acid
MAETRRWELAAHRRLEKGKVVGVVVLDGWGEAAPDTFNCIHVADTPTLDALKKGGPERWRVIKAHGTAVGLPTDDDMGNSEFGHNALGAGQIYAQGAKLVDMALASGKIYEGEGFKYIQQSFENGTLHLIGLLSDGGVHSRIDQLQLLLKGASEHGAKRIRVHILTDGRDVLDGSSVKFVELIENDLAKLRDKGVDARIASGGGRMYVTMDRYETKVTAASDLDNDGGALAWVQDTRCRALRRRLPNNPATAPSSPAAAAQRSWSRSSAAPSWRCRRRTEAGASGGARRCIGGGVESCRLRHPAKGGGWEXSDFLAGXN

SEQ ID NO: 94024 - protein, 514 aa, Escherichia coli O157:H7 EDL933
MSVSKKPMVLVILDGYGYREEQQDNAIFSAKTPVMDALWANRPHTLIDASGLEVGLPDRQMGNSEVGHVNLGAGRIVYQDLTRLDVEIKDRAFFANPVLTGAVDKAKNAGKAVHIMGLLSAGGVHSHEDHIMAMVELAAERGAEKIYLHAFLDGRDTPPRSAESSLKKFEEKFAALGKGRVASIIGRYYAMDRDNRWDRVEKAYDLLTLAQGEFQADTAVAGLQAAYARDENDEFVKATVIRAEGQPDAAMEDGDALIFMNFRADRAREITRAFVNADFDGFARKKVVNVDFVMLTEYAADIKTAVAYPPASLVNTFGEWMAKNDKTQLRISETEKYAHVTFFFNGGVEESFKGEDRILINSPKVATYDLQPEMSSAELTEKLVAAIKSGKYDTIICNYPNGDMVGHTGVMEAAVKAVEALDHCVEEVAKAVESVGGQLLITADHGNAEQMRDPATGQAHTAHTNLPVPLIYVGDKNVKAVAGGKLSDIAPTMLSLMGMEIPQEMTGKPLFIVE

SEQ ID NO: 94025 - protein, 316 aa, Thermoanaerobacter tengcongensis MB4
MARYTNSLKIFTGNSNPKLASEIAEHLGLKLADSEVGTFSDGEISVRIGESVRGASVFVIQSTCAPVNNNLMELLIMIDAFKRASAAEINAVIPYYGYARQDRKAKARDPITAKLVADLITAAGAHRVVTMDLHAPQIQGYFNIPVDHLLGGPILAKYFMDKELGDDVVVVSPDHGSVTRARYFAEKLNAPLAIIDKRRPKANVAEVMNIIGDVKGKKAILVDDLIDTAGTLVQAAEALLDHGAVEIYACATHGVLSGPAIERLKESPIKEVVITDTIPLPEEKKIDKIKVRSVAPLFAEAILRIHEGMSVSKLFT

SEQ ID NO: 94026 - protein, 175 aa, Triticum aestivum
MAPTGMASSATSVAPFQGLKSTAGLPVSRRSNGASLGSVSNGGRIRCMQVWPIEGIKRFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 94027 - protein, 250 aa, Triticum aestivum
  misc_feature (36)..(36): Xaa can be any naturally occurring amino acid
MPGVEPLRLYGSAHSTQGSRYGLFGSSCYGTEDLAXDHLSNPMVWFLQKTNIIGDILEDINEIPRCRMFCLGEIWSKYVDKLEDLKYEENSEKPVQCLNDMVTNALIHAQDCLQYMSALKDNSNFRFCAIPQIMAMGTCAICYNNVKVFRGVVKMRRGLTARIIDETKSISDVYSAFYEFSSLLESKIDDNDPNAALTRRRVDAIKKTCKSSGLLKRRGYDLEKSMYRMPMLIMIALLLVAIILGVLYGK

SEQ ID NO: 94028 - protein, 218 aa, Brassica napus
GHTIDKLSDSEDIERSRIGSPAKKVISCSIEDVRDENDEKIVLKLRQELLNKHSLPPRHDDYHMLLRFLKTMDFNIDKTVTAWEEMLKWRNDFGADQIIQDFNFNELDQVTMYYPQGYHGVDKNGRPIYIERLGKAHPGKLMDVTTIDRYLKYHVQEFEKALQQKLPACSIAAKRRVTTTTTILGADGLGMKNFSPAAANLLSSIAKVDCSYYPEHVQ

SEQ ID NO: 94029 - protein, 386 aa, Ehrlichia ruminantium str. Gardel
MNIHEYQAKQILKRFGISVPEGVIVHSLNEVNDAINKINSKVIVVKAQIHAGGRGKAGGVIVSRTLDEAKTAIKNMLGSTLVTHQTSKDGQKVRKVYLEEGCDIKKEYYISAIVNRKHGQISIIFSTEGGVDIEEVAANSPEKVVTCNIDPIFGFQGFHGRNLCFDSNLSVDQTRKITSIAKKIYKTMLETDASQIEINPLIETSSGDFIALDAKMNFDDNAIYRHPEILELRDYDEEIPEEIEASKHGLSYIKMDGNIGCMVNGAGLAMATMDIIKYYGAEPANFLDVGGGASQQTVTEAFKIILSDNVDGILVNIFGGIMRCDIIANGIIAAIQEIGINVPLVVRLSGTNFELGKKLLDNSKLNIITAHDLSEAAYDIVNIVKK

SEQ ID NO: 94030 - protein, 430 aa, Synechococcus elongatus PCC 6301
MTQTTLSTSTVKALKCKECGHEYDLGAKHVCEDVCFGPLEVVYDYDAIRQRVSRATIEAGPNSIWRYRHFLPVTGEDVIDVGTGMTPLVEAKRLARRLGLKKLFIKNDAVNMPTLSFKDRVVSVALTRARELGFSTVSCASTGNLANSTAAIAAHAGLDCCVFIPADLEAGKVLGTLIYNPTLMAVKGNYDQVNRLCSEVANTHGWGFVNINLRPYYSEGSKTLGYEVAEQLGWQLPDHIVAPLASGSLFTKIYKGFREFVDVGLVDDKAVRFSGAQAEGCSPIAKAFHEGRDFIAPEKPNTIAKSIAIGNPADGIYAVEIARKTGGNIEAVNDTEIIEGIKLLAETEGIFTETAGGTTVAVLKKLVEAGKINPDETTVVYITGNGLKTQEAVQGYIAEPFTIEPKLESFEHALERSRTLDRLEWQQVLI

SEQ ID NO: 94031 - protein, 481 aa, Rhizobium leguminosarum bv. viciae 3841
MNISLLINGADRAASGGRTYDRIDPFTEKLASRAAAASLDDAAAAVDAAAAAFGAWSKTGPGQRRAILMKAADIMDSKVGEFTQLMIEETGATAPWAGFNVMFAANILREAGAMTTQISGEIIPSDKPGTLAMGVRQAAGVCLAIAPWNAPVILATRAIAMPIACGNTVVLKASEQCPGTHRLIATALTEAGLPAGVVNVITNAPEDAPEIVAALIAHPAVKRVNFTGSTKVGKIIAETCGRHLKPALLELGGKAPLVILDDADIDGAVNAAIFGAFMNQGQICMSTERIIVDETIADQFVAKLAARASQLPAGDPRGHVVLGSLISLDAAKKMDELIADATAKGAKLVAGGKRSGTVVEATLLDHVTPEMRVYAEESFGPVKPIIRVTSEEEAIRIANDSEYGLSSAVFSRNVQRAMAVAARIESGICHINGPTVHDEAQMPFGGVKGSGYGRFGGKAAIAEFTDLRWITVEDSAQHYPF

SEQ ID NO: 94032 - protein, 356 aa, Oryza sativa Japonica Group
MAEAAAAPPAAAATNYEVDLGNLMAYDPSHHLPAASSSRSAPIAATAIVPCCFDSVTKFPGVARREELREECLRKGTELAQAVADALFALPATEDRDGPMVRLPPPTTRFPREKHLPRPKPPTKWEQFAKMKGITKHKKNKREWDEQTQTWKRTYGYDRVNDDKDIPIIEAKATDEPGVDPFAQRREDKKKHVEKQEKNRLENLKKAAKVGALPSHIQLAATALPITGTKADIPKKSRKKDLEDVAGMASSATASGGKFDEKLPGEKPPKNPGKHRKFLPVVEGKGMGNQEKQQNDKILNALLAKSSEDQMDVGRAITMYKVKKEKQRRKDKEKSSSSNKLKPQKKTLKKSSKKKA

SEQ ID NO: 94033 - protein, 481 aa, Campylobacter jejuni RM1221
MGNARGFLDFKRMDFKKIAPKERVLNFKEFTIPLDKKEQEIQGGRCMDCGVAFCHTGVMSEGKDVGCPLNNLIPEWNDLVYRSLWKEAYERLDLTNPFPEFTGRVCPAPCEDSCVCAINGVSVSIKNNELSIIENAFKENLVRVNKPKQYNGKKIAVIGSGPAGLACANTLNSLGYKVSVFERSDKIGGLLMYGIPDMKLDKSIVQRRVDLLKKSGIEFKVNENIDSRDKVSKLLKEFDALVLCTGASKPIDLDIEGRKLKGVEFALDFLTQNTKTLLKTGKGADTAKGKNVLVIGSGDTSVDCIAVATRQGAKSIVRFERSPKRPLQRSQNNPWPLKADIFTTDYGLEEAIAVYGKDPREYQKMTKKFLGKTHVEGVEANDLKREFKEGKAINVEISNSKKTYKADLVLLAMGFSGCEEAISKNFGVKLDEKNNISTENFQTTHKKIFACGDARKGQSLVVWAIKDGIECALSLHQNLAK

SEQ ID NO: 94034 - protein, 709 aa, Narcissus pseudonarcissus
MAVNGSLFSSQAANFTLLRTPFSSSACRGQFHVGASGSEGERKLSVKKEKNTSKIVYSGEKPAVPLLDTINDPAHMKNLSTQDLEQLASELRLDIVHSVSKTGGHLSASLGVVDLTVVLHHVFDTPDDKIIWDVGHQAYAHKILTGRRSRMHTLRQTSGLAGFPKRDESVHDAFGAGHSSTSISAGLGMAVARDLLGKSNHVISVIGDGVMTAGQAYEAMNNVGYLDSNLIVVLNDNKQVSLPTATLNGPATPVGALSGALAKLQASAKFRQLREAAKCITKQIGGQAHEVAAKVDEYARGMISASGASLFEELGLYYIGPVDGHNVEDLVAIFKKVKAMPSPGPVLVHIVTEKGKGYPPAEAAADKMHGVVKFDPKTGKQFKTKFPTLSYTQYFAESLVKEAEVDEKIVAIHAAMGGGTGLNFFQKKFPDRCFDVGIAEQHAVTFAAGLATEGLKPFCAIYSSFLQRGYDQVVHDVDLQKLPVRFALDRAGLVGADGPTHCGAFDVTYMACLPNMIVMAPSDEAELMHMVATAAAIDDRPSCFRFPRGNGVGVALPSDYKGTPLEIGKGRILMEGDKVAILGYGSIVQSCLKAAGSLRERGISATVADGRFCKPLDSELIRRLVNEHEILITVEEGSIGGFASHVSHFLSLNGLLDGHLKLRSMVLPDRYIDHGAPKDQIEEAGLSSKHIAGTVLSLLGRPMEAFQLQ

SEQ ID NO: 94035 - protein, 423 aa, Ashbya gossypii ATCC 10895
MVNQRVVHLCAKRSFSLTASMQKYFVDVYAKPDLVLTRGRGSRLFDDVNKREYIDFVAGIAVTSLGHSDPAIAEVIAAQSATLVHTSNLFHNSEALKFAEKLVESTKRFGGQQDAEKVYFCNSGTEANEAALKFSRRRALRTDPQKQGFIAFENSFHGRTMGSLSVTSKAKYRLPFGDMVPHVTFLNIHDPVEKLVSFIVENAPKTAAMILEPIQGEGGVHRVPEDKLVALGRLCKKHDIVLIYDEIQCGLGRTGKLWAHSNLPADAHPDIFTTAKALGNGFPMGATVVNSKVNEVLSVGDHGTTYGGNPLACAVGNHVLDRIAQQPFLDDVKAKANVFTAGLLALQKKYPFIREIRGDGLLIGVEFTVDVSDIISKSRERGLLITAAGPNTLRIIPALTIEEDTIRQGLEILESVVGEISSS

SEQ ID NO: 94036 - protein, 831 aa, Vibrio vulnificus CMCP6
MHFDSGLLALLFVIIALFIGALVRHLLKGSQVPYTVALLILGIAIGLAHRGNAFTDNYTLIGETLSLASEIDPHLFLFLFLPTLIFESAFAMEVHLFRRMFTQIVILAVPGLMLAIWLTAELVAWVLPEHWQWSWALCLMFGALISATDPVAVVALLKEVSSRKRLETLIEGESLLNDGTAIVFFSLFYGWVLMEFSNPGEAITAPPWQAVAQFFVVVFVGLAVGLILGGLCILWIDRVFNDPMIEISLTIAAAYSAFFISENFHVSGVVAVVTLAIMFASVGRTRISPEVAGFLHHFWEMMAHMANTLIFLLVGILVAIRVPLDDKEAWLALFVLYLGIMAIRACSITVFMPILKRIGIGITYEKAVVLCWGGLRGAVSLALAMTVASSDIIPKQIGDHVLFLCAGIVVLTILFNGSTMGHVLKWLNLSSLPPGKQATVDKAQHEVNRVLHDMLPTMMTSDFLKGADWETVKQGAKLQVLKECNSPTEITQDELHTAYLRRLLETERKHYWTQFSQGLIGKQATNKLVEAVEHALDGDPIIGPRNELFTTWRLPDWVEPLRQYNSWNKLLLKVYFRRLALGYDVARGFIQAQEALESHIDTLAPDAEIAVMVRQQVELNKRLTFERIESLRMSFPEIIQALQSQAATRLLLNRERAVINDQLKQAVLDKPEAQKLLNMVEERMAALQKESIFDKSQEQKLINDIPWARELKSKTREELTSWIEHTVYDAGQLICENQRPLNRIGIVSRGSITELYETRSDDNLEKVRTTIGPGETFALISLLTGKTNAQYVSDTPTDIMWLPVDKLKLLMNQDPNLTAVVCQLFKQLKSV

SEQ ID NO: 94037 - protein, 276 aa, Oryza sativa Japonica Group
MLTLHGTALFIRPSAYQEVKSSPKHAIVPHNNLLGCSAFYNPVEGHHVQKPHIVPSCKVNFTRASHYLYRSLSERTTRHWLHRFHVNASSDEDFRSSRNIAISLFKRYKNVIDRGGGDNLKEFVSAGVNAYALGCTEEGLRKELMDIEDSGLEIEALRSNGGGTSLTFKVHSFEVRECILWLSIVFITILCTPQPTIIRWSTTPPVSADVLHQWKGFCALIANAYYTKGMAWLPVKTLQLEQMAVTGSSEEPSVVASRMQLVFSTLEVVSPQWPRV

SEQ ID NO: 94038 - protein, 497 aa, Kluyveromyces lactis NRRL Y-1140
MATQFDENTVITIFGASGDLSKKKTFPALFGLYREGYLNPTTKIIGYARSKLSNEDLREKVKPFLKKPNGAKDDAKVNEFLSMVSYHAGPYDSDEGYLELKKIIEEFEAEKKVDEPHRLFYLALPPSIFIDVCSKLKENLYTESGIQRVIVEKPFGHDLQSATELQEKLAPLFSEDELFRIDHYLGKEMVKNLLLMRFGNTFLNAAWNKENIQSVQVVFKEPFGTEGRGGYFDSIGIIRDVMQNHLLQVLTLLTMERPVSFDPESVRDEKVKVLKAFSPIDHDDILIGQYGRSVDGSKPSYLDDETVKEDSKCVTFAAIGFKIANERWDGVPIVMRAGKALNEGKVEIRIQFRRVASGMFTDIPNNELVIRIQPNEAIYLKCNAKTPGLANENQTTELDLTYSERYKNYWIPEAYESLIRDALLGDHSNFVRDDELDVSWKLFTPLLNYLEGPDGPQPKIYPYGCRSPDGLVEFLADHGYTFSKPGSYQWPVTTPKM

SEQ ID NO: 94039 - protein, 487 aa, Rhizobium leguminosarum bv. viciae 3841
MGGPVFSAKLMINNEAMNASEGATFERIDPLTGDVATIASAGSVADMTRAANAAAAAFPDWSQTGPGERRRLLNAAADILEARTSELIAAMTGETGATAQWAAINCGLGADILREAAAMTTQISGEIIPSGIPGSLAMAVRQPAGVCVGIAPWNAPVILGTRAVAMPLACGNTVVLKASELCPKTHGLIGDVLRDAGFPRGVINVVSNAPSDAAAVVDALIAHPAVRRINFTGSTRVGRIIAESAARHLKRCLLELGGKAPFIVLADADIDEAVSAAAFGAFMNQGQICMSTERIILMDEIADGFVGKFRTKAATLVAGNPKDGNTPLGTLINTEAVRRVRSLVDDALQKGAVLVCGGQANGTLMDATVIDHVTPAMRIYREESFGPVAAIIRVGSVDEAVTVANDNEYGLSAAVFSADVNAALAVAMRLESGICHINEATVSDEPQMPFGGVKSSGYGRFGGKAAIDEFTELRWITMASGKRHYPI

SEQ ID NO: 94040 - protein, 412 aa, Escherichia coli CFT073
MPQQNYLDELTPAFTPLLAIKEASRCLLCHDAPCSQACPAQTDPGKFIRSIYFRNFKGAAETIRENNALGAVCARVCPTEKLCQSGCTRAGVDAPIDIGRLQRFVTDFEQQTGMEIYQPGTKTLGKVAIIGAGPAGLQASVTLTNQGYDVTIHEKEAQPGGWLRNGIPQFRLPQSVLDAEIARIEKMGVTIKCNNEIGKTLTLEQLKAENRAVLVTVGLSSGSGLSLFEHSDVEIAVDFLQRARQAQGDISIPQSALIIGGGDVAMDVASTLKVLGCQAVTCVAREELDEFPASEKEFTSARELGVSIIDGFTPVAVEGNKVTFKHVRLPGELTIAADKIILAVGQHAELAVFSALEPQRNTIETQHYQTRDPQVFAAGDIVEGDKTVVYAVKTGKEAAGAIHHYLEGACSC

SEQ ID NO: 94041 - protein, 339 aa, Bacillus cereus G9241
MTKIFILASTLSLSFFSGLNIGNAATENFSPVTNAIVQNNDYFAEGNSKDNNKPPGNGGSQDDSGSGGNGSGGNGSGGSGSGGSGSGGNDSGGNGSGGNDSGGNGSGGNGSGGNGSDGSGSGGNGSGGNGSGGNGSGGNGSDGSGSGGNGSGGNGSGGNGSSGNGSGGNGSSGNGSDGSGSGGNGSGGNGSGGNGSGGNGSGGNGSDGNGSGGNSSDGNGSGGNSSDGSGSGGNGSGGNGSGGNGSGGNSSGGNGSGGNRRKGDSSSQGGNDSHGGNRVKGNSSSQGGNGSQGGNVKDNAKKQGDKLPNTATHYPASILMGLSTFLIGMLLFIRRKNAK

SEQ ID NO: 94042 - protein, 605 aa, Gibberella zeae PH-1
MTSHPGGLKVMSSPPEGPMDSVQGTPDTRLTMFSPGEGSVSYHRGGAYSTGPAAAYDAFESSAAANQDPFVDVSNTGQLSPTASVFKPVSHYKGKAAAVLLPEGGLVVASALSHEMDISHRLEMCDTPTPAPEEVQAFMESLQRGGMTFFGARHVETDGSHVYVCFEDLRDSLNVNNAVRKSDKTWLPAYVKVKKERLDIGTVRLAELRQLDVAIEIQNYVAANPSHVDEIAQRVLTTFGSLFALVRTLSLPSGGFRGVVQYCKAARATNAFQHVRRMDTEGLFITLMHPEDIEMNGFIGGMGGLSLANGHRGHAASNASLLAPRAPEGNPWAPVAYQLSSGPLPRSFVPAAPSSMINHRAPSYNGGPSMMSSYGRRVPRYLQRAPSQRGNNVVDLYELMAGRDVRTTVLQIMLRNIPNKVDQPLLKKIVDASSFGKYDFMYLRIDFANDCNVGYAFINFVKAEYIVDFVQARANKRWNCFRSDKVAEVSYATIQGKDCLVQKFRNSSVMLEAPHYRPKLFWTIHSDDPTLAGYEEPFPGPDNQSKMKRSVENAEHVGLFTPTVGQHFRETQRHRHSQFDRGTRLAAIEEANYEQSLVLSRYSHN

SEQ ID NO: 94043 - protein, 341 aa, Escherichia coli O157:H7 EDL933
MKALSKLKAEEGIWMTDVPVPELGHNDLLIKIRKTAICGTDVHIYNWDEWSQKTIPVPMVVGHEYVGEVVGIGQEVKGFKIGDRVSGEGHITCGHCRNCRGGRTHLCRNTIGVGVNRPGCFAEYLVIPAFNAFKIPDNISDDLASIFDPFGNAVHTALSFDLVGEDVLVSGAGPIGIMAAAVAKHVGARNVVITDVNEYRLELARKMGITRAVNVAKENLNDVMAELGMTEGFDVGLEMSGAPPAFRTMLDTMNHGGRIAMLGIPPSDMSIDWTKVIFKGLFIKGIYGREMFETWYKMAALIQSGLDLSPIITHRFSIDDFQKGFDAMCSGQSGKVILSWD

SEQ ID NO: 94044 - protein, 340 aa, Prochlorococcus marinus str. MIT 9303
MSRCVVVSGAAGFIGAALVQRLLAQGDRVIGIDNLNDYYDPSLKRARLAQIEAASLKASWTFYPIALEDGAGIEELFKAEKPQVVVNLAAQAGVRYSLENPAAYIQANLVGFGHILEGCRHHGVQHLVYASSSSVYGGNRNLPFHEQQPVNHPVSLYAATKKANELMAHTYSHLYGLPATGLRFFTVYGPWGRPDMAPMLFAKAILAGEPIKVFNYGKMQRDFTYIDDIVEGLLRCCDKPATANLGFDPLNPDPATAAVPHRLFNIGNSQPIELMHFIELLEKSLGREAVKDFQPMQPGDVMATAADTSALEAWVNFRPSTPIAEGVECFSQWYRSFYEV

SEQ ID NO: 94045 - protein, 482 aa, Prochlorococcus marinus str. MIT 9303
MTAFPIRNICCIGAGYVGGPTMAVIADRCPQIQVNVVDLNEARIAAWNDLDLSKLPVYEPGLDAVVDRARGRNLTFSTQVDAAIAAADMVFISVNTPTKTKGLGAGQASDLRWVEACARQVAQSAQGHTIVVEKSTLPVRTAEVVRSILEAAQRQAVDGELPISFSVLSNPEFLAEGTAIRDLESPDRVLIGGENPVAIQSLAEIYGHWVPVEKILLTNLWSSELSKLTANAFLAQRISSINSVAALCEHTGADVREVARAIGSDSRIGSKFLEAGPGFGGSCFQKDILNLVYLCRHFGLPDVADYWENVVALNTWQQHRISRLVVQKLFGTVTGKRLALLGFAFKADTNDTREAPAIRIAHDLLEEGAQLAIYDPKVDPQQIAFDLQLAASSPPDVQAGPTRAALSGEGTWWSGTSVADTVAGADAALILTEWHEFRQLDWVALAPLMRQPAWVFDARAVVDPEAVKSSGLMLWRVGDGAV

SEQ ID NO: 94046 - protein, 481 aa, Oryza sativa Japonica Group
MVGSGAAGGGGGGGGGGDHARSKEAAGMMALHEALRNVCLNSDWTYSVFWTIRPRPRCRGGNGCKVGDDNGSLMLMWEDGFCRPRVAECLEDIDGEDPVRKAFSKMSIQLYNYGEGLMGKVASDKCHKWVFKEPSECEPNIANYWQSSFDASPLAPLLLGGRDLITATTTHLINHLQKQAQHTATATVTIAVIQAGHGLLQLGSCKIIPEDLHFVLRMRHMFESLGYQSGFFLSQLFSSSRGTSPSPSSFPLKQQQPPPPQLFNWPGHAPPQLPPGASPLFPPGPAAFHPSSRPMPPFPGGGKDESHLFHLPPAAAAKQPQHMDEHHHHQQQPMAAPQQHGGEAPEGDLKWPNGLSFFTALTGRTEDAKFLFGGGGGGGADDGSKTAAAAQDAGHGGAENVEEYLSLESHSNKARRMESAQSTKFKRSFTLPARMSSSTTSTSPSVSASTAPAPPQQQQGMEYRGPHEGGVYSDLMETFLE

SEQ ID NO: 94047 - protein, 401 aa, Haloarcula vallismortis
MMTFQTLDDLDDGQRVLVRLDLNSPVEDGTVQDNRRFDRHAETVKELADRGFEVAVLAHQGRPGRDDFVSLDQHADILADHIDRDVDFVDETYGPQAIHDIADLDSGDVLVLENTRMCDDELPEEDPEVKAQTEFVKTLAGEFDAYINDAYSAAHRSHASLVGFPLVMDAYAGRVMETEYEANTAIAEKEFDGQVTMVVGGTKATDVIDVMTHLDEKVDDFLLGGIAGTVPAAAGHPVGYDIDDANLYDEQWEANSEKIESMLEDHRDQITLAVDLAYEDENDDRAEQAVDDIDEKRLSYLDVGSETLMEYSPIIRESEAVFGEGRAGMFEDERFSVGTAGVLEAIADTDCFSVVGGGDTSRAIEMYGMEEDEFGHVSIAGGAYIRALTRAQLVGVEVLQR

SEQ ID NO: 94048 - protein, 262 aa, Pseudomonas putida KT2440
MQLEIFQVDAFSTEPFGGNPAAVIPLDSWLPDDVLQRIAEENNLSETAYFVRKGETFDLRWFTPTVEVDLCGHATLASAYVLFEQLGEQAQVLRFNTRSGELRVSRGADGLLAMDFPAKQPVAVDMPAGLLQALGLSQAKAVYLSDDYVVVIDDAMLLETLKPDFVALSAFDVRGIAVTAAGRGFDFVTRWFGPRVGVNEDPVTGSAHTSLAPLWAQRLGKNVLSCEQGGARKGQLQCEVPGNGRVIISGRAALYLRGNVYI

SEQ ID NO: 94049 - protein, 44 aa, Triticum aestivum
GLSLGLSNNLLGWILLGVFGLIWSLYTIYTSDLDEDEESGGLSL

SEQ ID NO: 94050 - protein, 538 aa, Triticum aestivum
MAADTSKPLFPAAPHTSLLPSHGNSNRLSPEAAYWRNFRSSTLDTGATAFSVTHLAFSPARARPMLAAAWSSAVHLFAGDPLAPRPRVTVCKDAAAFSPSFRCDGALLAAGDGKGVVRVFRVDKPTAGPLRTLSAHAAQTRVVRYPEAGGDKVHLLTAGDDALLAYWDVPSETPVFTVPAAHRDYIRAGAPSPVDHNLFATGSYDQSVKLWDARTGKAPALSFSHGASVESVLFLPSGGLLATAGGTTVKIWDVIGGGRLVHSVESHVKTIFALALGKMGATGETRLLSAGSDGYVKCFDYGELKMTHSMRYPKELLSVACSPCGTVLAAGSSKGDIFVRRRKKNATEEEEEEVVGSEFAWTMPKPEKQALKPSYYRYFLRGQNEKAKEGDFVISRPKKAKFAEHDKLLRKFRHKDALVSALAKNNPRSVVAVMEELVARRKLVRCIGNLDVAELGLLLDFLHRNATLPRYARLLLGVANKVLEMRAEDIISEDGGKLRGCIRNLKRMVVEEIKIQHTLQEIQGMISPMLALSASRLE

SEQ ID NO: 94051 - protein, 408 aa, Sulfolobus solfataricus
MGDLTIPTMDDIDIQSKKVLLRIDINSPVDENGKIIDDSRIKAHIGTIKELINKGNSVVLISHQGRPGDKDFTSLEEHAKLISKYLDREVIFVDDVIGPYAREMIKKLENNGILLLDNIRLISEELIEAPPQQHVKSFLVKKLAPLFDIYINDAFATAHRSQPSIVGFPLALPSAAGRVMEREVSALAKIFNAEDTPKIFTLGGGKVHDTIRIIENLVRKRIADRILTGGLVAELFSVAKGMNLNPKNMEILEKLGILSLIPRARKLLLSGAPIEIPVDYKVEINGNVIEEPASKVTGIIKDIGSTTAEIYSSFIKDAKVVVLRGPMGVIEDERFKSGSKSVLKASLEGQGYVIIGGGHMISALDEDMKIDSSKVHISTGGGALLLFLSGERLPALEALSMSVVNSGD

SEQ ID NO: 94052 - protein, 397 aa, Xanthobacter flavus
MIAFRTLDDAVDLADKRVLVRVDLNVPMESGRVTDATRLKAILPTIRDITGKGGKAVLLAHLGRPKGRDESQSLAPVAKALEGELGRKVAFASDCIGDEAKSAVSRLASGEVIVLENTRFHAGEEKNAPDFIEALASLGDIYVNDAFSTAHRAHASTEGLARKLPAYAGRSMESEIEALTKALEAPQRPVLAVVGGSKVSSKLELLGNLVKKVDILVIGGGMANTFLAALGKKVGKSLCEHDLANTARDILKKAEAAGCEIVLPVDAVVATEFKANAAHRVTSVDDVKDDEMMLDAGPETVGIVKQKLDGAKTVVWNGPFGAFEMTPFDAATVAVARYVGDLTHKGRLLSVAGGGDTVAALNHAGTAERFSYVSTAGGAFLEWLEGKALPGVEALRR

SEQ ID NO: 94053 - protein, 142 aa, Arabidopsis thaliana
  misc_feature (28)..(28): Xaa can be any naturally occurring amino acid
  misc_feature (53)..(53): Xaa can be any naturally occurring amino acid
  misc_feature (67)..(67): Xaa can be any naturally occurring amino acid
  misc_feature (75)..(75): Xaa can be any naturally occurring amino acid
SFAPEANRKIVAASGIEDVFMGMDTGPXSLTTFDGAVDTTQTVIWDGPMVVFXMEMCAAGTEAIVNXLAVLSQKXAPAIIGGGDSVDTVEKVGVAAVMSHISTDAEASLDLLKEKVLPGVVALDKAIAVAVKELLPFIRQTL

SEQ ID NO: 94054 - protein, 495 aa, Oryza sativa Japonica Group
MGGGQSRSPRDGSGHGRYGHSPSFQQQWGGGGGGGGGGGGGYPYGQDAHGGGYYGAPAPQGGYAAPYPAYQQPPPPMPSPAATQPPARAGGASKPRLDRRYSRIADDYHSVDQVTDALAQAGLESSNLIVGIDFTKSNEWLGKFSFHGRSLHHISNAPNPYEQAISIIGQTLSKFDEDNLIPCFGFGDATTHDQDVFCFYPDLRPCNGFSEALSRYRELVPHLRLAGPTSFAPIIEMAMTIVEQSGGQYHVLLIIADGQVTRSVDTASGQLSSQEQKTVDAIVRASELPLSIVLVGVGDGPWDMMKEFDDNIPSRAFDNFQFVNFSEIMNKNMPQSRKEAAFALSALMEIPQQYKATVELGILGRRSFKSPERVPLPPPGGSHDAYSYGSKSFSKPSTYPQSSTSSSSYPHYETAQSSSPAVPSSTYDNQVCPICLVNPKDMAFGCGHQCNPCKAFERLADKPVKYWVCIDKDRKASNPLLQDCGAGDVSSIETH

SEQ ID NO: 94055 - protein, 461 aa, Desulfitobacterium hafniense DCB-2
MKKKWLGLGLGILIMVIAYFLPETAGLTQAGKMAIAILLTGIVLWVTEVMPLAITALLLMVCLPYFDILNWSTTWSKFISSVIFFVIATFAITVALIKTSLATRIAGVLVRWSKGDPKGLVLGFMVGSALLSSVCNNVPTCSLFMSLALSILITDNAIPGKSNLGKCLMIGIPFGTMIGGAMTPAGTSINIMAIGLLEEATGMTISFLDWMLMGIPFAVIMVPISWLSLVMIFKPEAISQKSEDTINNMVISAGRLTSQEKKIITIIGVMLVAWIASTWVPWLDATGIAVMGLIAFFFPGIEVLTWDEFVKGVSWEVILMIGGVQAVAAGIMATGAANWLVDGIMAGAANWSTPMLAGAAASVMTILHAICPVGPAICGMATVPISGLALLAGASPAVLTMIVALGAAITFILPLDCVPLITYSKGYYKMGDMVKAGIVPTIAMILVCAFVLPVLGPLIGI

SEQ ID NO: 94056 - protein, 320 aa, Ashbya gossypii ATCC 10895
MTRIAYLGPSGTYTHQATIQQFGVEDNEMIPMVSIQKCFSALLKDESISYAVLPAENSTNGQVVFTYDLLRDYMLETPNAARGCMLPGFAIVAEQYVAVEHCLASPLPMTADELKNANIERIYSHPQVWGQVGKYLEELARVTGKALSRCDAGSTSQAVDRCLRDYREDKTVTLAIASALACRISGAHIVQSHISDVADNTTRFLIIQRRKQEPLQILPGRQPTPSGERIHLVAFTTDRQGAGSLTDVLLVLKRYGIDMRSITSRPFRRCSTSSKWQYVFFVEYSDELDVPWDSFHAEVGAHCREWCHWGTFYRNNRYYS

SEQ ID NO: 94057 - protein, 509 aa, Zea mays
MIANGLRKSSAASSQVSKLVKYIASAGSLQGGHSLSEPSARHYSSEPSLQATEENGFKGHSMLAPFTAGWQSTDVHPLVIERSEGSYVYDSNGKKYIDALAGLWCTALGGNEPRLVKAATEQLNKLPFYHSFWNRTTKPSLDLANDILSMFTAREMGKVFFTNSGSEANDSQVKLVWYYNNALGRPDKKKFIARSKSYHGSTLIAASLSGLPALHQKFDLPAPFVLHTDCPHYWRFRLPDETEEEFSTRLANNLENLVLKEGPETIAAFIAEPVMGAGGVILPPKTYFEKIQAVLKKYDILLIADEVITAFGRLGTMFGCDMYNIKPDLVSIAKALSSAYMPIGAILVSPEITDVIYSQSNKLGSFAHGFTYSGHPVSCAVAVETLKIYKERNIVEHVNKIAPRFQERIKAFSGSPIVGEIRGLGLILGTEFVDNKSPNDPFPAEWGVGSIFGAECEKRGMLIRVAGDSIMLSPPLIMTPNEVEEIISKFGDALKATEERIGELKSRKN

SEQ ID NO: 94058 - protein, 132 aa, Helicobacter pylori
SNIKYELDKESGALMVDRVLYGAQNYPANYGFVPNTLGSDGDPVDALVLSDVAFQAGSVVKARLVGVLNMEDESGVDEKLIALPIDKIDPTHSYVKDIDDLSKHTLDKIKHFFETYKDLEPNKWVKVKGFEN

SEQ ID NO: 94059 - protein, 348 aa, Prochlorococcus marinus str. MIT 9303
MAELLITGGAGFIGSHTCLVLLEAGHRLVILDNFSNSSAIASKRVAELAGVAAQERMLVLEGDIRSSNDLDRAFNSMENGIAAVVHFAGLKAVHESVQLPLKYWDVNVAGSRCLLEAMQRHNCRTIVFSSSATLYGYPEQIPIPETTRVQPINPYGQSKAAVEQLLDDLACSEPGWRIARLRYFNPVGAHPSGCIGEDPKGTPNNLFPFVSQVAVGRRAELQVFGADWPTPDGSAVRDYIHVMDLAEGHRAALEVLQREEPQLLTLNLGSGKGHSVLEVVQAFEKASGQPVPYSINQRRAGDAACSVADPSLAAERLGWSTQRSLSDMCRDSWNWQKANPQGYSQKQQ

SEQ ID NO: 94060 - protein, 792 aa, Arabidopsis thaliana
MESLIEEEEESRFFDAHEEIASCSSPCKIESPSSISGEFRYDVWIKSPGNTEERREKFLKWMGLSSTVNESKSGNVYRLSSSVNESAVLMSLKSDDDEFSSSRCDSFSPSESVDRVVNESLCKEEGEVDSGMVLRNLGFVDDGDISSSLCSLSSSPVSDKIVKEHGEPKLLPDPMVAEEEREVSGIMKRVKEKWLSRLYKVRNKRSAGGDDNGGEVAVCGSRIERVKVKEYKKEAKELSALFKGQEIQAHEGAILAMKFSPDGRYLASAGEDGVLRVWSVVEDERCEEHDVPKIDPSCIYFEVSKLSELRPVAVEKDGITGSLMSPRKTTESACVIIPPKIFRVLDKPLHEFLGHSGDILDISWSKNNKTRPTSVDNSVRLWQIGCEDCLGIFSHNNYVTSVQFNPVDDDHFISGSIDGKVRIWSASQCQVVDWADARGIVTAVCYQPDGQAVIIGTLTSDCRFYNVSGHCLQLDGHICLHNKKKSSNKRIIGFQFLLQFDSTDPSRVMVASADSQVRIISGRNVVHKYKGSRNAGNQISASFTADGKHIVSACDDSSVYVWNCVGHDPEQSSPGFFSHTKRLKIRSFEKFSADVSVAIPWCGFTPVLSGGSELSPSLFSLGREYVLDSPKGSATWPEEKLASSFSPVKAIRRSHYKFLRSSCRRTSESSHLWGLVIVTGGWDGRIKLFHNYGLPVPVHPAFLYKVGPIRKHCLSICCSNRSLSVKINHLGFLRASVWASSGGPVGRGVSPSLAAGSLLRGLGPKGARVPLFAFFCRGCWCFSCPPLGAVFL

SEQ ID NO: 94061 - protein, 226 aa, Triticum aestivum
MASFNAAGAGAANPNPNKSLEVNPAPGDSVSSLSFSPKANHLIATSWDNQVRCWEVQPGGQCQAKASISHDQPVLCSAWKDDGTTVFSGGCDKVVKMWPLLSGGQATAFSGHEAPVKELAWIPQMSLLVSGSWDKTLRYWDIRQPNPAHVQQLPERCYALSLSYPLMAVGTADRNVVIFNLQNPQAEFKRIVSPLKFQTRCIAAFPDQQGFLCLNTIKLEREGGKE

SEQ ID NO: 94062 - protein, 141 aa, Ralstonia solanacearum GMI1000
MAIERTLSIIKPDAVAKNVIGQIYARFEGAGLKVVAAKMIHLSRAEAEQFYAVHKERPFFKDLVDFMISGPVMVQALEGESAIVKNRDLMGATDPKKAEKGTIRADFADSIDANAVHGSDAAETAAVEVAFFFPGLNIYSR

SEQ ID NO: 94063 - protein, 313 aa, Streptococcus pyogenes MGAS315
MTKIYKTITELVGQTPIIKLNRLIPNEAADVYVKLEAFNPGSSVKDRIALSMIEAAEAEGLISPGDVIIEPTSGNTGIGLAWVGAAKGYRVIIVMPETMSLERRQIIQAYGAELVLTPGAEGMKGAIAKAETLAIELGAWMPMQFNNPANPSIHEKTTAQEILEAFKEISLDAFVSGVGTGGTLSGVSHVLKKANPETVIYAVEAEESAVLSGQEPGPHKIQGISAGFIPNTLDTKAYDQIIRVKSKDALETARLTGAKEGFLAGISSGAALYAAIEVAKQLGKGKHVLTILPDNGERYLSTELYDVPVIKTK

SEQ ID NO: 94064 - protein, 511 aa, Erwinia carotovora subsp. atroseptica SCRI1043
MAHDNLEGRSAFGEVGSLDLKKRYDNFIGGTWVPPDAGQYFVNLTPVTGQPMCEVASSSTRDIDHALDAAHKAKAEWGGLSVQERALVLNRIADRMEQNLERLAQVETWDNGKPIRETSGADVPLAIDHFRYFAACIRAQEGAISEIDGDTVAYHFHEPLGVVAQIIPWNFPLLMACWKMAPALAAGNCIVLKPAKLTPMSVLILMELIQDLLPAGVINVVNGSGSEIGEYLATSKRVAKVAFTGSTEVGQQIMSYAAQNVTPVTLELGGKSPNIFFADVMDKEDSFFDKALEGFTLFAFNQGEVCTCPSRALVQESIYDRFMERAIKRVEAIRIGNPLDSKTMMGAQVSAGQLETILNYIDIGKKEGARVLTGGQRKAMPGGLAEGYYLEPTILFGKNSMRVFQEEIFGPVLAVTTFKTMEDALEIANDTEYGLGAGVWSRNGNVAYRMGRGIQAGRVWTNCYHAYPAHAAFGGYKQSGIGRENHKMMLDHYQQTKCLLVSYSDKPMGLF

SEQ ID NO: 94065 - protein, 520 aa, Aspergillus nidulans FGSC A4
MAKVDQKVVLIVIDGWGVAGPNSPKEGDAIAAAETPFMSGFAEENSKTAQGYTELDASSLAVGLPEGLMGNSEVGHLNIGAGRVVWQDSVRIDQTLKKGELNKVENIAASFKRAKDGNGRLHLLGLVSDGGVHSNITHLIGLLKVAKEMEIPQVFIHFFGDGRDTDPKSAAKYMQQLLDATKEIGVGEIATVVGRYYAMDRDKRWDRVEIAIKGILSGEGEESSDPVKAIEKRYTEDETDEFLKPIIFGGKDRRVQDDDTLFFFNYRSDRVREITQLLGDYDRSPKPDLPYPKNIHITTMTQYKTDYTFPVAFPPQHMGNVLAEWLGKKDVQQCHVAETEKYAHVTFFFNGGIEKQFPGEVRDMIPSPKVATYDLEPEMSAEGVGKKVEERIAEGKFEFVMNNFAPPDMVGHTGVYEAAIKGVAATDKAIGIIYEACKKHGYTLFITADHGNAEEMLNEKGTPKTSHTTNRVPFIMANAPEGWSLRKQPGVLGDVAPTVLAAMGIEQPKEMSGESLLVKA

SEQ ID NO: 94066 - protein, 213 aa, Salmonella enterica subsp. enterica serovar Paratyphi A str.
MTDQSHQCVIIGIAGASASGKSLIASTLYRELREQVGDEHIGVIPEDSYYKDQSHLSMEERVKTNYDHPNAMDHSLLFQHLQALKRGSAIELPVYSYVEHTRMQETVRVEPKKVIILEGILLLTDARLREEMNFSIFVDTPLDICLMRRIKRDVNERGRSMDSVMAQYQKTVRPMFLQFIEPSKQYADIIVPCGGKNRIAIDILKAKISQFFE

SEQ ID NO: 94067 - protein, 413 aa, Medicago truncatula
MGSIKAILKNPDDFFPLLKLKIAARNAEKQIPPEPHWGFCYSMLHKVSRSFGLVIQQLGPELRDAVCIFYLVLRALDTVEDDTSIETDVKVPILIDFHRHIYDNDWHFGCGTKEYKVLMDQFHHVSKAFLELGKNYQDAIEDITKRMGAGMAKFICKEVETVDDYDEYCHYVAGLVGLGLSKLFYASGKEDLATDKLSNSMGLFLQKTNIIRDYLEDINEIPKSRMFWPRQIWSKYVSKLEDLKYEENSVKAVQCLNDMVTNALLHADDCLQYMSALRDSSNFRFCAIPQVMAIGTLAMCYNNIGVFRGVVKMRRGLTAKVIDRTKTMADVYGAFFDFASVLESKVDKNDPNATKTSSRLEAIQKTCRESGLLTKRKSYVLRNESGYGSTMILLLVILFSIIFAYLSANRHNN

SEQ ID NO: 94068 - protein, 53 aa, Arabidopsis thaliana
QHSKVSPTKLSSATMVSSPAQATRVAPFMRLKSAAAFRATRKANNDIASSTIN

SEQ ID NO: 94069 - protein, 214 aa, Glycine max
  misc_feature (23)..(23): Xaa can be any naturally occurring amino acid
  misc_feature (128)..(128): Xaa can be any naturally occurring amino acid
  misc_feature (174)..(174): Xaa can be any naturally occurring amino acid
  misc_feature (186)..(186): Xaa can be any naturally occurring amino acid
  misc_feature (196)..(196): Xaa can be any naturally occurring amino acid
MRDDGRETPEPPAEPQRAGNMLXGCRSVDEFERVNKRDEGAYGGWYRGRGKKSGERVALKKGKMEKEKEGFPLTSLRGINILLSFHHPSIGDVKEVVVGRSLDRIFMGGGYMGHGLKGVMEAMKQPFXQSEVKWLVIQLLEGGKDLHDNWVRYRGLKTSNLVLNNRGELKICDXGLAPQDGSPLKXYTHLGGTLWXRGPELFWGETGLTGIGLG

SEQ ID NO: 94070 - protein, 229 aa, Brassica napus
MAQVVATRSIQGSMLAPNGGSLSTRSDKFLKPASFAVKVLGNEAKRSGRVSLKSRRVVDTSVRSSARVETEVVPVSPEDVPNREEQFERLMEMQKFSDTSVGIWSKPTARRKTKIVCTVGPSTNTREMIWKLAEAGMNVARMNMSHGDHASHKKVIDLVKEYNAQSKDNTIAIMLDTKGPEVRSGDLPQPIMLDPGQEFTFTIERGVSTPTCVSVNYDDFVNDVEAGDM

SEQ ID NO: 94071 - protein, 368 aa, Rhizobium leguminosarum bv. viciae 3841
MKIHAAVARAPHTPFSLERLDLEEPREGEILVRVVATGVCHTDIVMRDQHLPVPQPVVLGHEGAGIVERVGPGVAKVKPGDHVVMTFNSCGHCPSCNDHQETYCHEFFPRNFFGARADGSSGLSCEGVRVHGNIFGQSSFASHALCHERNIVKVPEDADLALLGPLACGIQTGAGAVMNALKVEPGKVLAVFGMGSVGLAAVMAARIVGASRIIAVDVNETRLALAAELGATDIVNGKASDAVAAIMALTGAGVDYSIDASGVPAVIDQCVRVLAPRGTCGIVGASPHGATLTLDLTHILSGGRRVRGIVEGDSNPDVLIPLLIDLHRQGRFPFDRLITFYDFADINQAVEDSEKGIVLKPVVRQPAV

SEQ ID NO: 94072 - protein, 479 aa, Rhizobium leguminosarum bv. viciae 3841
MNTITAIATDTSPDVMKALLDRQRASFLKEGPPSIDTRIDRIDRVIALLVDHKDAIAAALSEDFGSRSVEASLLLDVFTCVGSLKYAKAHLAEWLKPEQHEALFPDAVAEVVYQPKGVVGILSPWNFPYQLALAPLAGILAAGNRAMIKPSEVTPASAALMAELIAGAFDETEIAVVQGGPSAGTAFTSLAFDHLIFTGGTAVAHHVMRAAADNLTPLTLELGGKSPVIVGRSADLADAARRVMTVKTLNAGQICLAPDHVYVPEESVEAFAGHAVAAVGAMYPALQENPDYTSIVNARHLARIEGLIDDARAKGARIVEINPAAENFSQQSAHRMPPTLILDPTEEMRVLQEEIFGPVLPVVPYRDIADVIDRINARPRPLALYYFSQDQQEEARVLDNTTSGGVTVNDCMSHVTAEGLPFGGVGHSGMGAYHGKFGFLAFSHPRAVYHQSRMVEAEYMMRPPYGDAMRGFLAAAICK

SEQ ID NO: 94073 - protein, 538 aa, Phanerochaete chrysosporium
MLVSVDALALRTLVYELTYLLYPAVPTAAALILLQRFGNVWLPTWTIVLLSLCNVPVAHRILVWLKDGRRWPGSIDLLRQLTQTFETGFLSEMLWGYMHVLGQTFEVYILWDSNYVTSDANVIKTILATDFDNFVKGEKLDVCVRPVLGTGVFNSDGEMWKFHRSMTRPFFTRERISHFDLFDRHADATMAKMKARLAEGFAVDFQDLISRFTLDSATEFLFGQCTTGASRTEDFARAFAEAQDAVSFRLRMGWLWPDAVARADKIKRENGGRVPEVKGEIEEDETLLDHLVNVVQTKILHDEVLNIMIAGRDTTGGTLTSAVYFLSQYPEVLRRLREEILEKVGPTRRPTYDDIREMKYLRAFINETLRLYPAVPWNVRYPVKDTTIPGPHPDKPYFIPANTPVSYSVHCMHRRTDYWGPDAEAFDPDRFLDARVQRYLTPNPFIFLPFNAGPRICLGQQFAYNEMSFFVIRLLQHFDEVQLCEDALAPDCRVPDAWRGAPGRKGVERFWPKAHLTLYAKGGLWVKMREASTSEAVV

SEQ ID NO: 94074 - protein, 331 aa, Campylobacter jejuni RM1221
MKKAKSRIAILGTGGTIAGFIDSTIATTGYTAGAIDIDVLIKAVPQIRDLADISWEQIANIDSSNMCDEIWLRLAKKIAKLFAEGIDGVVITHGTDTMEETAYFLNLTIKSDKPVVLVGAMRPSTAISADGPKNLYNAVALVANKEAKNKGVMVAINDKILSARGVVKTHSLNVDAFSSPDFGDLGYIVDGKVFFYNNVTKAHTKNAPFDVSKLTSLPKVDILYSYSNDGSGVAAKALFEHGTKGIVVAGSGAGSIHKNQKDVLKELLKKGLKVVVSSRVVAGCVAVSDSDEKLGFISAEDLNPQKARVLLILALTKTSDPKKIQEYFLKY

SEQ ID NO: 94075 - protein, 184 aa, Oryza sativa Indica Group
MAPPLQAATTASSSTREGKAPALNERILSSMSKRSVAAHPWHDLEIGPEAPTIFNCVIEIPRGSKVKYELDKKTGLVKVDRVLYSSVVYPHNYGFIPRTLCDDSDPLDVLVIMQEPVIPGCFLRAKAIGVMPMIDQGEADDKIIAVCADDPEYKHYNDIKDLPPHRLAEIRRFFEDCILLIYCS

SEQ ID NO: 94076 - protein, 251 aa, Myxococcus xanthus DK 1622
MTTDSAHRLLDLLWERYAAEVPYARTFVQLSGGRFRNDHVALRSLARPGGGIALFSQSFIRLGWKAAGAYTFPDAHLSAIYLSHPAGLPRIFISELKQEELSPRARELLARLPEDPAPPEDVDALAAWFGSPPPPDEAALLELEKESQYGAWLLAFGRKVNHFTGSVDDVEAWQKRMREAGVPMKADIEGAPGTSLRQTATQAAPLPVLLEGGGSRSWPYAYFEIAQRTPDFDGFLGPQARALFDMTKRGG

SEQ ID NO: 94077 - protein, 313 aa, Escherichia coli CFT073
MEKRKIILDCDPGHDDAIAIMMAAKHPAIDLLGITIVAGNQTLDKTLINGLNVCQKLEINVPVYAGMPQPIMRQQIVADNIHGETGLDGPVFEPLTRQAENTHAVKYIIDTLMASDGDITLVPVGPLSNIAVAMRMQPAILPKIREIVLMGGAYGTGNFTPSAEFNIFADPEAARVVFTSGVPLVMMGLDLTNQTVCTPDVIARMERAGGPAGELFSDIMNFTLKTQFENYGLAGGPVHDATCIGYLINPDGIKTQEMYVEVDVNSGPCYGRTVCDELGVLGKPANTKVGITIDTDWFWGLVEECVRGYIKTH

SEQ ID NO: 94078 - protein, 214 aa, Oryza sativa Indica Group
  misc_feature (61)..(61): Xaa can be any naturally occurring amino acid
MPVSRIAVSAPGELSHPDTAKAAVAEFISMLIFVFAGSGSGMAFSKLTDGGGTTPSGLIAXSLAHALGLFVALLGSVVACLLLKIATGGAAVGAFSLSAGVGAWNAVVFEIVMTFGLVYTVYATAVDPKKGDLGVIAPIAIGFIVGANILAGGAFDGASMNPAVSFGPAVVTGVWDNHWVYWLGPFVGAAIAALIYDIIFIGQRPHDQLPTADY

SEQ ID NO: 94079 - protein, 172 aa, Oryza sativa Indica Group
MRPASSPVPAVLTAPATAATAAIAVKPTPPQRALQASRRELVVAAGGVAAAAVALWPCGGAARAASDDEYVSETKDVIGKVRSTINMDRADPGVADAVAELRELSNSWVAKYRRGEVAAGPPVLQGDVLRAQRRVGPLHQLRPHGPHPQQAPRPHPRGDGHRREGPAPRPVS

SEQ ID NO: 94080 - protein, 222 aa, Picea sitchensis
MGAGEEASPLLPKQEETAQGEAVPEQREAVGWTVDGLPIGHGNVMGSPVSRSQWNSSLLACLGRNDEFCTSDLEVCLLGTLFPCFLYGSNVERLTSTPGTFANHCLPYSSLYLLGRFLFGSNCLAPWFSYPSRTAIRRNFNLEGSCEALSRSCGCCRGYMEDDEQREQCESICDFATHFFCHQCALCQEGRELRRRLPHPGFNGRTVLVMLPPTEQMMEHKV

SEQ ID NO: 94081 - protein, 247 aa, Thiobacillus denitrificans ATCC 25259
MSSPKPVLVLVHGWGMNARVFDALADRLDDRFDVRGFDLPGHGGRDAQAVNTLEAWADALADALPDDANLLGWSLGGQVALRAALDHPRKVARLILVATTPRFVQRADWASAMDAADLAAFGEALLADPATTLQRFLSLQTRGTPGQKALLQHLRQALREAPEPDRVALAAGLAILRDTDLRGDVLRLTHPTLVLHGALDTLTPAAAGAWLAANLRAARHVELERAAHAPHLSHPDDVAREIERFCL

SEQ ID NO: 94082 - protein, 231 aa, Oryza sativa Indica Group
MRPASSPVPAVLTAPATAATAAIAVKPTPPQRALQASRRELVVAAAAVALWPCGGAARAASDDEYVSETKDVIGKVRSTINMDRADPGVADAVAELRELSNSWVAKYRREKSLLGRPSFREMYSALNAVSGHYISFGPTAPIPNKRRARILEEMDTAEKALLRGRFPPRSGADEDAGAGATLQMSNLGSPLPVGRAVLDEVPWDAAPVWHTYPADGSSVGCMPKLWGRLTQ

SEQ ID NO: 94083 - protein, 132 aa, Helicobacter pylori
SNIKYELDKESGALMVDRVLYGAQNYPANYGFVPNTLGSDGDPVDVLVLSDVAFQAGSVVKARLVGVLNMEDESGMDEKLLALPIDKIDPTHSYVKNIDDLSKHTLDKIKHFFETYKDLEPNKWVKVKGFEN

SEQ ID NO: 94084 - protein, 333 aa, Schizosaccharomyces pombe
GMNSNFSYPALGVDGISSQISPIRDVWSTNLQQEMNLIMSLIERYPVVSMDTEFPGVVARPLGVFKSSDDYHYQTLRANVDSLKIIQIGLALSDEEGNAPVEACTWQFNFTFNLQDDMYAPESIELLTKSGIDFKKHQEVGIEPADFAELLIGSGLVLQEEVTWITFHSGYDFAYLLKAMTQIPLPAEYEEFYKILCIYFPKNYDIKYIMKSVLNNSKGLQDIADDLQIHRIGPQHQAGSDALLTARIFFEIRSRYFDGSIDSRMLNQLYGLGSTGSVLWHNNSSTPQIQFRDLPGAHPSPTPSNAGIPTTLTNTSSAPNFANSTFRFPPRVV

SEQ ID NO: 94085 - protein, 354 aa, Bacillus cereus G9241
MKSMFNKIFLIVALIGVPLSVLGKTLHWPQTIMFAVYCITIIALAGFMGRATESLAIVSGPRIGGLLNATFGNAVELIISIFALQAGLIEVVLASLTGSVLGNLLLVGGLSFFVGGLKYKRQSFNVYDARHNSALLIFAVVVAFVIPEIFSMKMDAGKTYQLSIGVSIIMIIMYLAALLFKLVTHRGVYQHKSDEVAHEEEPEWSKGKALLILAIATIAVAYVSEALVHTFETVAKSFGWSELFIGVIIVAIVGNAAEHASAIIMAYKNKVNIAVEIAVGSTLQIAMFVAPVLVLLSMFFAQRMPLVFTIPELVSMITAVFLTIAISNDGDTNWFEGGTLLAAYVIMGIGFYLL

SEQ ID NO: 94086 - protein, 303 aa, Oryza sativa
  misc_feature (43)..(43): Xaa can be any naturally occurring amino acid
  misc_feature (292)..(292): Xaa can be any naturally occurring amino acid
MWSALQHVFCESVKRCAKRCVTPPPGKKSTCHLAVICSRFWVXEKSPKAEPPKMPLPPKTSPTEPQLPPKERERRVPMPRLRKRIANRLKDSQNTFAMLTTFNEVDMTNLMKLRSDYKDEFVTKHGVKLGLMSCFVKAAVTALQNQPIVNAVIDGDDIIYRDYVDISVAVGTSKGLVVPVIRDADNMNFADIEKGINALAKKATEGALSIDEMAGGTFTISNGGVYGSLISTPIINPPQSAILGMHSIVQRPVVVDGNILARPMMYLALTYDHRLIDGREAVYFLRRIKDVXVEDPRRLLLDI

SEQ ID NO: 94087 - protein, 391 aa, Oryza sativa Indica Group
MCSCARFPHPALQPAPAPAPPPPNLKPKPAPTTRGPCPSPRTLVARAAPRWDDSTAPPPPPPSTFDFLALKRELEEEEEEEVVAVEPRDGGGGDGLASEDDGDGEAKRSGGGGESSGGRKRRQMARRSGLLAKQVISVSSARSLGFVSQLWVDAASTNPVVGVVFMDGAKQPSGWSVMQALTEVERRTHARKMKCGSVKMWIVALVEVRPSLLSGEAEKFLFEDIYQVGDVVLVEDETVVENEFKLVGLHSLVGYSVVTSRRRNVGKVRGFTFDINTGAMESLELDSFGISIVPSSLVSTYCLFVEDVLDIVSDTIVVHEDAISRVQRLTQGIWGTQNIQGPGGQMDDNGRYRRRKARRVQRQNGLRNSSGRKLHRKMRDRDGDWELPMDY

SEQ ID NO: 94088 - protein, 137 aa, Arabidopsis thaliana
  misc_feature (53)..(53): Xaa can be any naturally occurring amino acid
ARNPGGAHRGPNRAKEEGNHQEVVWVSFMLSSAVGVTSPVKATMVVQLTGWKXSVEFPATRRTNRAIISIEGNGGGVSCLKGWPPIGKKKLGTLFNLPDLRDVKLVKEVDYLFRTRGIPGVEFKLKHGFGYRGHGTT

SEQ ID NO: 94089 - protein, 464 aa, Burkholderia vietnamiensis G4
MKQSIDALLRADRAHFMHPSTHAYDHESGALPGRIVRGAHGIHIEDHEGRRYIDAFAGLYCVNIGYGRTEVADAMHEQAKQLAYYHTYVGHASDAIIELSSRIIECAPVGMKKVYYGMSGSDANETQVKLVWYYNNVLGRPNKKKIISRERGYHGSGIVTGSLTGLPSFHQHFDLPIDRVKHTVCPHWYRNAPVGMSEAQFVAYCVDELEKLIAREGADTIAAFIAEPVMGTGGIIAPPAGYWPAIQAVLRQHDILLISDEVVCGFGRLGSKMGAQHFGIEPDLITVAKGLTSAYAPLSGVIVGDKVWDVIARGSQAHGPMGHGWTYSGHPVCAAAALANLAILERENLVGNAAEVGAYFGAKLRDAFGAHPLVGEVRSVGMLAALEFMADRDARTPFDPALKIGAQVSAAALRRGVIARAMPHGDILGFAPPLVMTRAEADEIVGIVKEAVDEVAERNLAAVS

SEQ ID NO: 94090 - protein, 491 aa, Ralstonia eutropha JMP134
MSLTLANAALLRSQNFINQQWRDAGLGRRLAVANPATGEVFAHVPDSDDDDAGRAADAAAEAFPAWSARPARERAQLIKRWHALILANQEDLARIISTEQGKPLKEARGEVLYGASYVEWFAEEATRICGDIVAEAVPGRKLLVLKEPVGVVAAITPWNFPLAMIARKIAPALAAGCTVVAKPAEDTPLTALALVWLAEQAGLPAGVLNIVTASRESTPNVVDAWLADSRVRKITFTGSTPVGKHLARESAGTLKKLSLELGGNAPFIVFEDADLDAAVDGLMASKFRNGGQTCVCPNRVYVHESVHDDFVERLARRVGALHVAPATDENAQIGPMINARAVDKIARHVEDAVAKGARVVTGGRRVRTADGPHYYAPTVLIDATPAMELACEETFGPVAPVFRFRDESEVIRDANDTPFGLAAYFYSNDVRRIWRVAQALETGMVGINEGAIAAEAAPFGGVKESGYGREGSRHGLDDYMHTKYLCQGQLG

SEQ ID NO: 94091 - protein, 492 aa, Burkholderia vietnamiensis G4
MLPGHPVLFKSMCYVDGRWIHSDSAATRAVVNPADQSVIGHVPMLERAQIVGAVDAAQRAFGTWRWTPQAARSAALLRWHALILRHLDDLAALLSLEQGKPLAEARGEIRYAASFVEWFANEAKRAVGRTIPTHIDGAHLGTVMEPVGVAALITPWNFPAAMITRKAAAALAVGCTVIVKPAHETPFSALALAQLADEAGFPAGVFNVVLGEPQMAMEALVGDARVRAVSFTGSTRVGRLVTETAAKAGIRKIALELGGNAPFIVTDDADLDDAVRIAVGAKFQTSGQDCCAANRIFVARALYDAFVGRYASAVRALKTGPAFEPGVDVGPLMHQAAFDATVARVDDARARGARIVAGGRPHALGGWFYEPTVIADAAPGMRVYDEENFAPISAVCAFDTLDEVVARANDTEYGLAAYVCATRIDTIFRLVRRLDFAMVSVNGVKFTGAPIPFGGMKASGLGREGGVEGFEPFTETKYFCFGNLGLPVAATA

SEQ ID NO: 94092 - protein, 162 aa, Salmonella enterica subsp. enterica serovar Paratyphi A str.
MLEDLRANSWSLRPCCMVLAYRIAHFCSVWRKKNVLNNLWAAPVLVLYRVITECLFGYEIQAAATIGRRFTIHHGYAAVINKHVVAGDDFTIRHGVTIGNRGADSLACPVIGHGVELGANVILLGDITIGNHVTIGAGSVVLDSIPDHALVVGEKARVKVST

SEQ ID NO: 94093 - protein, 193 aa, Arabidopsis thaliana
  misc_feature (60)..(60): Xaa can be any naturally occurring amino acid
  misc_feature (156)..(156): Xaa can be any naturally occurring amino acid
PRVREVVEASNGIQAWKVLEDLNNHIDIVLTEVIMPYLSGIGLLCKILNHKSRRNIPVIXSGSGSESGTHQTQKSVKSKSIKKSDQDSGSSDENENGSIGLNASDGSSDGSGAQSSWTKKAVDVDDSPRAVSLWDRVDSTCAQVVHSNPEFPSNQXLVAPPAEKETQEHDDKFEDVTMGRDLEISIRRNWICP

SEQ ID NO: 94094 - protein, 404 aa, Aspergillus nidulans FGSC A4
MASQVQPGQKPKVQPCRYKTGKTLGAGSYSVVKECVHIDTGQYYAAKVINKRLMVGREHMVRNEIAILKQVSTGHQNILTLVDYFETMNNLYLVTDLALGGELFDRICRKGSYYESDAADLVRAILSAVAYLHDHGIVHRDLKPENLLFRTPEDNADLLIADFGLSRIMDEEQLHVLTTTCGTPGYMAPEIFDKSGHGKPVDIWAIGVITYFMLCGYTPFDRETNLEEVQAIATANFSFTPVEYWRGVSQEARDFIKRCLTVNPKKRMTAHQALQHPWINPPYDTTDDLGSGEDLLPNIKKNFNARRTLHKAIDTVRAINKLRENGGLMMDGIMSVDPKPEHVNGSEVVEDRTTPRERENEDAMEIDSRSNARGQTEQQIREQERKVKETVAGLWSRTAPRSER

SEQ ID NO: 94095 - protein, 379 aa, Aubrieta deltoidea
MSTTGQIIRCKAAVAWEAGKPLVMEEVEVAPPQKHEVRIKILFTSLCHTDVYFWEAKGQTPLFPRIFGHEAGGIVESIGEGVTDLAPGDHVLPIFTGECGDCRHCHSEESNMCDLLRINTERGGMIHDGESRFSIDGKPIYHFVGTSTFSEYTVVHSGQVAKINPEAPLDKVCIVSCGLSTGLGATLNVAKPKKGQSVAIFGLGAVGLAAAEGARIAGAGRIIGVDLNPKRFEEAKKFGVTEFVNPKDHEKPVQQVIAEMTDGGVDRSVECTGSVQAMIQAFECVHDGWGVAVLVGVPSKDDAFKSHPMNFLNERTLKGTFFGNYKPKTDIPGVVEKYMNKELDIEKFITHTVPFSEINKAFDYMLKGEGIRCIITMGA

SEQ ID NO: 94096 - protein, 379 aa, Arabis alpina
MITTGQIIRCKAAVAWEAGKPLVMEEVEVAPPQKHEVRIKILFTSLCHTDVYFWEAKGQTPLFPRIFGHEAGGIVESVGEGMTDLAPGDHVLPIFTGECGDCRHCHSEESNMCDLLRINTERGGMIHDGESRFSIDGKPIYHFVGTSTFSEYTVVHSGQVAKINPEAPLDKVCIVSCGLSTGLGATLNVAKPKKGQSVAIFGLGAVGLAAAEGARMAGAGRIIGVDLNPKRFEEAKKFGVTEFVNPKDHDKPVQQVIAEMTDGGVDRSVECTGSVQAMIQAFECVHDGWGVAVLVGVPSKDDAFKTHPMNLLNERTLKGTFFGNYKPKTDIPGVVEQYMNKELEVEKFITHTVPFSEINKAFDYMLKGEGIRCIITMGA

SEQ ID NO: 94097 - protein, 777 aa, Arabidopsis thaliana
  misc_feature (33)..(33): Xaa can be any naturally occurring amino acid
  misc_feature (114)..(114): Xaa can be any naturally occurring amino acid
  misc_feature (160)..(160): Xaa can be any naturally occurring amino acid
  misc_feature (167)..(167): Xaa can be any naturally occurring amino acid
MTITSNISVQNDNLVVQGKTILTKIPDNIILTXPVTGNGFVSGSFIGATFEQSKSLHVFPIGVLEGLRFMCCFRFKLWWMTQRMGSCGKDIPLETQFMLLESKDEVEGNGDDAXPTVYTVFLPLLEGQFRAVLQGNEKNEIEICFESGDKAVETSQGTHXLVYVHAXGTNPFEVIRQSVKAVERHMQTFHHREKKKLPSFLDWFGWCTWDAFYTDVTAEGVDEGLKSLSEGGTPPKFLIIDDGWQQIENKEKDENCVVQEGAQFATRLVGIKENAKFQKSDQKDTQVSGLKSVVDNAKQRHNVKQVYAWHALAGYWGGVKPAASGMEHYDSALAYPVQSPGVLGNQPDIVMDSLAVHGLGLVNPKKVFNFYNELHSYLASCGIDGVKVDVQNIIETLGAGLGGRVSLTRSYQQALEASIARNFTDNGCISCMCHNTDGLYSAKQTAIVRASDDFYPRDPASHTIHIASVAYNSLFLGEFMQPDWDMFHSLHPTAEYHAAARAVGGCAIYVSDKPGNHNFDLLRKLVLPDGSVLRAKLPGRPTRDCLFADPARDGISLLKIWNMNKFTGIVGVFNCQGAGWCKETKKNQIHDTSPGTLTGSIRADDADLISQVAGEDWSGDSIVYAYRSGEVVRLPKGASIPLTLKVLEYELFHISPLKEITENISFAPIGLVDMFNSSGAIESIDINHVTDKNPEFFDGEISSASPALSDNRSPTALVSVSVRGCGRFGAYSSQRPLKCAVESTETDFTYDAEVGLVTLNLPVTREEMFRWHVEILV

SEQ ID NO: 94098 - protein, 379 aa, Arabis alpina
MITTGQIIRCKAAVAWEAGKPLVMEEVEVAPPQKHEVRIKILFTSLCHTDVYFWEAKGQTPLFPRIFGHEAGGIVESVGEGMTDLAPGDHVLPIFTGECGDCRHCHSEESNMCDLLRINTERGGMIHDGESRFSIDGKPIYHFVGTSTFSEYTVVHSGQVAKINPEAPLDKVCIVSCGLSTGLGATLNVAKPKKGQSVAIFGLGAVGLAAAEGARMAGAGRIIGVDLNRKRFEEAKKFGVTEFVNPKDHDKPVQQVIAEMTDGGVDRSVECTGSVQAMIQAFECVHDGWGVAVLVGVPSKDDAFKTHPMNLLNERTLKGTFFGNYKPKTDIPGVVEQYMNKELEVEKFITHTVPFSEINKAFDYMLKGEGIRCIIAMGA

SEQ ID NO: 94099 - protein, 334 aa, Salmonella typhimurium LT2
MVISLKNRNFLKLLDYTPAEIQHLIDLAIELKAAKKAGCEKQTLIGKNIALIFEKTSTRTRCAFEVAAFDQGAQVTYLGPSGSQIGHKESMKDTARVLGRMYDGIEYRGFGQHIVEELGEYAGVPVWNGLTDEFHPTQILADLMTMLEHAPGKTLPELSFAYLGDARNNMGNSLMVGAAKMGMDIRLIAPKSFWPDAALVAQCREIASVTGARITLTESVEDGVHGVDFLYTDVWVSMGEPKEAWAERVSLMTPYQVNQQVVNATGNPDVKFMHCLPAFHNEHTKVGREIEMAYGLKGLEVTEEVFESAGSIVFDEAENRMHTIKAVMVATLGD

SEQ ID NO: 94100 - protein, 781 aa, Oryza sativa Japonica Group
MASSPPAPPPPPPPPPPPDPPSAQPPAETAWARALRKLLPAGAPVPDEEQLDYSFVSVDVAGPAAERRPPPRSSADGPPLPPLARHRRRISRLLRPSPPRRRHSPPPPPPLQCEPSPPSSSPDATSPASSPPRCSSSSPPAPPPPPPPPEAPLNPGSKRRGACARCGKGGIGVGILGKREECLACGARYCAGCVAPGDGVHAGGPASASAASGRPVADARRRARLGKGSRLLARLLAPAEVRQVMRAERGCAANQVRPGEILVNGRGLSQGELDLLLGCAVPPERLAAGRYWYDKDSGLWGKEGERPDRIVSSKLSIGGKLQTDASNGTTQVFINGREITKTELRMLKLANVQCPRNTHFWLYDDGSYEEEGQNIIKGNIWQKAKFLYGTEFSPEEILNLKLMIQSNVYKYLSTLLEWRECFEDEALEEEKELGMSNHKGDENVTECELPTGEPKAVQSTSSLYSLNQRLMHFANWLLEIVALGNLDAFFPAATREYAPIVEEVWKDPAIQATYKRKNELHFLPDVASYFLDRVVEISSNEYEPTETDILYAEGVNQWNGLSTLEFSLDDRGPLSDSYADKAGNPAIQTKYQLIRMNSKGLTGGFKCLGMLEDIRAIIFCISLADYDQTWVQSSGEPCNKMIASRDLFEDVIRHPSFEDTPCVLLLNKYDAFEEKISRVPLTVCEWFADFSPVRPHHTSQTSLASHAYYYVAVKFKDLYSSVADGRKLFVFQTKALERRTVDDAFRYIREVLRWDDVKNSDAGYCSADESSYSVDMTTSPS

SEQ ID NO: 94101 - protein, 379 aa, Arabis alpina
MITTGQIIRCKAAVAWEAGKPLVMEEVEVAPPQKHEVRIKILFTSLCHTDVYFWEAKGQTPLFPRIFGHEAGGIVESVGEGMTDLAPGDHVLPIFTGECGDCRYCHSEESNMCDLLRINTDRGGMIHDGESRFSIDGKPIYHFVGTFTFSEYTVVHSGQVAKINPEAPLDKVCIVSCGLSTGLGATLNVAKPKKGQSVAIFGLGAVGLAAAEGARMAGAGRIIGVDLNRKRFEEAKKFGVTEFVNPKDHDKPVQQVIAEMTDGGVDRSVECTGSVQAMIQAFECVHDGWGVAVLVGVPSKDDAFKTHPMNLLNERTLKGTFFGNYKPKTDIPGVVEQYMNKELEVEKFITHTVPFSEINKAFDYMLKGEGIRCIITMGA

SEQ ID NO: 94102 - protein, 361 aa, Thermoanaerobacter tengcongensis MB4
MEDMLLMTPGPTMVPEEVKKVAGMQPFHHRTEEFYQLFSKLNENLKKIFQTKNEVITLTSSGTGGMEAAVANLFSAGDKVLVASIGYFGERFYDIARAYGLDAEIYDFGWGNAVDLDILEDKLKKGNYKALLVTHNETSTGVTNNIENIAKIANRYNVPVIVDAVSSLGGIPLKMDEWGIDAVITCSQKCLMSPPGLSFIALSDRAWEMTKTSNLPKYYFDLRKAREGVLKPKPDTPATPAVSTIMAVAKATDMLLEKGLDNVYKKQSEYGKKVRKYVKELGLDLLPSEEVASNLITAIKVPERYKASDIINYMKEKHRVLITGGQGPLKGKIIRIGHMGYLTDEMLDKALYALKDAISSL

SEQ ID NO: 94103 - protein, 379 aa, Arabis alpina
MITTGQIIRCKAAVAWEAGKPLVMEEVEVAPPQKHEVRIKILFTSLCHTDVYFWEAKGQTPLFPRIFGHEAGGIVESIGEGVTDLAPGDHVLPIFTGECGDCRYCHSEESNMCDLLRINTDRGGMIHDGESRFSIDGKPIYHFLGTSTFSEYTVVHSGQVAKINPEAPLDKVCIVSCGVSTGLGATLNVAKPKKGQSVAIFGLGAVGLAAAEGARMAGAGRIIGVDLNPKRFEEAKKFGVTEFVNPKDHDKPVQQVIAEMTDGGVDRSVECTGSVQAMIQAFECVHDGWGVAVLVGVPSKDDAFKTHPMNLLNERTLKGTFFGNYKPKTDIPGVVEQYMNKELEVEKFITHTVPFSEINKAFDYMLKGEGIRCIITMGA

SEQ ID NO: 94104 - protein, 264 aa, Rhizobium leguminosarum bv. viciae 3841
MSVSLRIGIIGGGGWLGGAIAGSILDAGLVEPRNLSLSYRSEQPRRFPNSFLTTDNQALADRSDVILLSVRPDDWHALDVDAGGKLIISVMAGIRLDALSERHNTGRVIRALPNAAAEVAKSYTPWIGARDVTEDDRALVRAIFQACGSEDEVARESDIDYLTGLSGSGPAFPALLAAAMMRDAVANGLPAEIARRAVNTVITGAGRLLERHDECPDDVVETFVGYRGTTAAAIEGMRVAGFDASVAKGLSAAFKKSVSMGDAS

SEQ ID NO: 94105 - protein, 379 aa, Cardamine amara
MITTGQIIRCKAAVSWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRKNTDRVGMIHDGVSRFSINGKPIHHFLGTSTFSEYTMVHSGQVAKINPEAPLDKVCIVSCGLSTGLGATLNVAKPKKGQSVAVFGLGAVGLAACEGARMSGASRIIGVDLNPKRFEEAKKFGVTEFVNPREHDKPVQQVIAEMTNGGVDRSVECTGSVQAMIQAFECVHDGWGVAVLVGVPSKDDAFKTHPMNFLNERTLKGTFFGNYKPKTDIPGVVEMYMNKELEIEKFITHTVPFSEINKAFDYMLKGESIRCIITMGA

SEQ ID NO: 94106 - protein, 334 aa, Salmonella typhimurium LT2
MSTFYQKPFLKLLDFTASELTALLQLAAKLKADKKNGKEEQKLVGKNIALIFEKDSTRTRCSFEVAAYDQGARVTYLGSSGSQIGHKESIKDTARVLGRMFDGIQYRGYGQEIVETLAEYSGVPVWNGLTDEYHPTQLLADLLTMQEHLPGKAFNEMTLVYAGDARNNMGNSMLEAAALTGLDLRLVAPKACWPQAALVAECSAMAKKNGGAITLTEDIASGVKGADFIYTDVWVSMGEPKEKWAERIALLRDYQVNSQMMALTGNPQVKFLHCLPAFHDDETTLGKKMAEEYGLHGGMEVTDEVFESAASIVFDEAENRMHTIKAVMVATLSK

SEQ ID NO: 94107 - protein, 379 aa, Arabis blepharophylla
MITTGQIIRCKAAVAWEAGKPLVMEEVEVAPPQKHEVRIKILFTSLCHTDVYFWEAKGQTPLFPRIFGHEAGGIVESVGEGVTDLAPGDHVLPIFTGECGDCPHCHSEESNMCDLLRINTERGGMIHDGESRFSIDGKPIYHFVGTSTFSEYTVIHSGQVAKINPDAPLDKVCIVSCGLSTGLGATLNVAKPKKGQSVAIFGLGAVGLAAAEGARIAGASRIIGVDLNSKRFDEAKKFGVTEFVNPKDHDKPVQQVIAEMTDGGVDRSVECTGSVQAMIQAFECVHDGWGVAVLVGVPSKDDAFKTHPMNFLNERTLKGTFFGNYKPKTDIPGVVEQYMNKELEIEKFITHTVPFSEINKAFDYMLKGEGNRCIIRMGA

SEQ ID NO: 94108 - protein, 253 aa, Synechococcus elongatus PCC 6301
MSFSDHFSAVAASYAKARPRYPQRWFRYLARIVPDRQRVWDCATGNGQAAIALAEYFSEVIGSDASAAQVRQARSHPRVQYLVFPAEATPLAPASLDLITVAQAAHWFDLPQFYIEAQRLLRPGGVIALWGYGLGSLNPAIDHVFNHFYRDWLDPYWPPERQWVEQAYEGLSFPFEPLPTPTFSMQCDWTLFDLLAYLRTWSGVQQFQRQRGFDPVWAIAPELQRVWGDPQRYRRITWPLFAKVGRWQPDRVR

SEQ ID NO: 94109 - protein, 377 aa, Oryza sativa Indica Group
MVQRTSSDSAASAEAMVMDLSPKRPAKSYGGEGGSYFDWCPSELPMLRAASIGAAKLSLAAGGLALPFYSDSAKVAYVLQGKGTCAVLLPETPSEKILPIKEGDALALPFGVVTWWHNLHAATTELVVLFLGDTSKGHTAGRFTNMQLTGSTGIFTGFSTEFVARAWDLPQDAAASLVSTQPGAGIVKLKDGFRMPEGCDKDREGMVLNCLEAPLDVDIKNGGRVVVLNTQNLPLVKEVGLGADLVRIDGHSMCSPGFSCDSAYQVTYIVRGSGRVQVVGIDGTRVLETRAEGGCLFIVPRFFVVSKIADDTGMEWFSIITTPNPIFSHLAGRTSVWKAISPAVLQASFSTTPEMENLFRSKRLDSEIFFAPNSNSI

SEQ ID NO: 94110 - protein, 172 aa, Campylobacter jejuni RM1221
MNLNKIKIGDIPNKINAVIEIPYGSNIKYEIDKDSGAIMVDRVMASAMFYPANYGFIANTLADDGDPVDILVLNEYPIQAGAVIPCRLIGVLIMEDESGMDEKLLAVPNSKIDARYDNIKTYTDLPQATLNKIKNFFETYKILEPNKWVKVQDFKDEKAAIEILEKAIKNYK

SEQ ID NO: 94111 - protein, 379 aa, Arabis blepharophylla
MSTTGQIIRCKAAVAWEAGKPLVMEEVEVAPPQKHEVRIKILFTSLCHTDVYFWEAKGQTPLFPRIFGHEAGGIVESVGEGVTDLAPGDHVLPIFTGECGDCPHCHSVESNMCDLLRINTERGGMIHDGESRFSIDGKPIYHFVGTSTFSEYTVIHSGQVAKINPDAPLDKVCIVSCGLSTGLGATLNVAKPKKGQSVAIFGLGAVGLAAAEGARIAGASRIIGVDLSSKRFDEAKKFGVTEFVNPKDHDKPVQEVIAEMTDGGVDRSVECTGSVQAMIQAFECVHDGWGVAVLVGVPSKDDAFKTHPMNFLNERTLKGTFFGNYKPKTDIPGVVEMYMNKELEIEKFITHTVPFSEINKAFDYMLKGEGIRCIITMGA

SEQ ID NO: 94112 - protein, 96 aa, Oryza sativa Indica Group
AYAATPTNLKIIDLYVVFAVATALIQVVYMEIVGSFPFNSFLSGVLSCIGTAVLAVCLRIQVNKDNKEFKDLPPERAFADFVLCNLVPHLVIMNFL

SEQ ID NO: 94113 - protein, 339 aa, Synechococcus elongatus PCC 6301
MTIRVAINGFGRIGRNFLRCWFGRQNTDLEVVAINNTSDARTAAHLLEYDSVLGRFNADISYDENSITVNGKTMKIVCDRNPLNLPWKEWDIDLVIESTGVFVTAEGASKHIQAGAKKVPITAPGKGEGVGTYVIGVNDSEYRHEDFAVISNASCTTNCLAPVAKVLHDNFGIIKGTMTTTHSYTLDQRILDASHRDLRRARAAAVNIVPTTTGAAKAVALVIPELKGKLNGIALRVPTPNVSVVDLVVQVEKPTITEQVNEVLQKASQTTMKGIIKYSDLPLVSSDFRGTDESSIVDSSLTLVMDGDLVKVIAWYDNEWGYSQRVVDLAELAARKWAA

SEQ ID NO: 94114 - protein, 375 aa, Rhizobium leguminosarum bv. viciae 3841
MDVRAAVAVQAGKPLEVMTVQLEGPKAGEVLVEVKATGICHTDDFTLSGADPEGLFPAILGHEGAGIVVDVGPGVTSVKKGDHVIPLYTPECRECYSCTSRKTNLCTSIRSTQGQGVMPDGTSRFSIGKDKIHHYMGCSTFSNFTVLPEIALAKVNPDAPFDKICYIGCGVTTGIGAVINTAKVEIGATAIVFGLGGIGLNVLQGLRLAGADMIIGVDINPDRKAWGEKFGMTHFVNPKEVGDDIVPYLVNLTKRHGDLIGGADYTFDCTGNTKVMRQALEASHRGWGKSIIIGVAGAGQEISTRPFQLVTGRNWMGTAFGGARGRTDVPKIVDWYMQGKIQIDPMITHTMPLEDINKGFELMHKGESIRGVVVY

SEQ ID NO: 94115 - protein, 211 aa, Gibberella zeae PH-1
MFARGIRAVSRRAAIAAPLARPTILPATRQIAPAVAVNSSRSYHEKVLDHYSRPRNVGSMNKKDADVGTGLVGAPACGDVMKLQIRVDPETQKISEVKFKTFGCGSAIASSSYLTELVRGMSLDDAGKVKNTEIAKELCLPPVKRTLSHHAAYYIDTQTDFNIVHCSMLAEDAIKSAISDYYTKNPNAKVSNLSGTGMKLPEADAPAAATA

SEQ ID NO: 94116 - protein, 132 aa, Helicobacter pylori
SNIKYELDKESGALMVDRVLYGAQNYPANYGFVPNTLGSDGDPVDVLVLSDMAFQAGSVVKARLVGVLNMEDESGMDEKLLALPIDKIDPTHSYVKDIDDLSKHTLDKIKHFFETYKDLEPNKWVKVKGFEN

SEQ ID NO: 94117 - protein, 473 aa, Bacillus cereus G9241
MMDQNQGLKRELKSRHIFMIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAALLFAINALSSRSFAEVEFWFASIKVITIIAFIILGGAAMFGFLDMKGNEPAPMFSSFTDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFGKLSKNGVPIYALIVSTIVGCLSLLSGIYAEDTVYLWLLSIAGFGAILVWASIALSNLLARRSYIKQGGDVKDLKFKTPLYPFVPLLALVLNVTVIVGMAFIPEQRMALYCGIPFMIVCLLFYRATRNKGSNLEHIEKTKTTEIESL

SEQ ID NO: 94118 - protein, 684 aa, Oryza sativa Indica Group
MRGPVRWAVVVVVMAMVEAAAGRFVVEKNSLRVTSPEGIKGKYECAIGNFGVPQYGGTLHGWVEYPKSNQKACKSFEDFDISFKSTRSGGRPKFVLIDRGPWEFAIYRTDLLLKVLHCETEEVVNTQVLCSKKVQNVKVVKLIPLSGTECYFTTKAWNAQNAGAAAVLVVDDKSEPLITMDNPDDAGTEHLENITIPSVLITKKLGDDLKKSAENGDMVSVLLDWRESLPHPDERVEYEFWTNSNDECGPKCDMQMDFVKSFRGTAQILEKKGYTQFTPHYITWYCPEAFVVSKQCKSQCINHGRYCAPDPEQDFSQGYDGKDVVVQNLHQICVFKAANESGKPWLWWDYVHDFSIRCPMKEKKYTPECAVHVIKSLGLDVEKIKKCVGDPEADEENPVLKAEQDAQIGHDKRGDVTILPTLVINNRQYRGKLDKSAVLKAVCAGFEETTEPAICLSEGCLLISYMITHLLIFFLLFVSSDVQTNECLENNGGCWQDRDNNVTACKDTFRGRVCECPVVKGVKFVGDGYTNCEASGIGRCEIKNGGCWKETRNGKTISACSNEVSEGCKCPPGFKGDGIKSCEDIDECKEKLYCQCKGCSCENTWGSYECSCGGKEATSAVGWSFLWVIFFGLVLAGVGAYAVYKYRLRSYMDSEIRAIMAQYMPLDNQEAANQHHVAHAGDDI

SEQ ID NO: 94119 - protein, 261 aa, Zea mays
  misc_feature (72)..(72): Xaa can be any naturally occurring amino acid
YHFLCLLQVITLTEEILATAKQTESAQNVAGLSPPSYSAGVQSEGLDDLSHSHKFAVGTRVQAVWSEDGECXIARYNATVEALTPNGYYVAYDGWGNSEEVDPDNVRLLEEEAADALGQAEKEAEATKMAIKRKIEQAATSDFQARSLPAKLRIEPSDPEDVKAAKRKKIHAFKSKSRFEQLEFAQNKRQNAWQQFQTKGKAKKVGFFSGRKKESIFKSPDDHRGKVGVTGSGKGLTDFQRREKHLHLKGGSGDAADDDEE

SEQ ID NO: 94120 - protein, 303 aa, Blastopirellula marina DSM 3645
MTVSSFQKGIILAGGSGTRLYPLTRAVSKQLLPVYDKPMIFYPLTTLMLAGIRKILVISTPEDIGGFQRLLKDGAEWGLRIEYAVQPKPEGLAQAFVIGRDFIGDDNVAMVLGDNLFYGQGFQQILARAASRKTGATVFGYPVRDPERYGVVEFDNEGRVVSLEEKPQKPKSNYAVPGLYFYDNRIVEIAANLKPSARGEFEITDVNIEYLRREQLHVECFSRGFAWLDTGTHASLMEAGNFVQTVENRQGLKIACVEEVAFNKGFISADQLRELARQLNNDYAGYLLHLLEPTIGMRNVKHA

SEQ ID NO: 94121 - protein, 132 aa, Helicobacter pylori
SNIKYELDKESGALMVDRVLYGAQNYPANYGFVPNTLGSDGDPVDALVLSDVAFQAGSVVKTRLVGVLNMEDESGMDEKLLALPIDKIDPTHSYVKDINDLSKHTLDKIKHFFETYKDLEPNKWVKVKGFEN

SEQ ID NO: 94122 - protein, 228 aa, Ralstonia solanacearum GMI1000
MTQDELKALVAQAAADYVLANVPEGAVLGVGTGSTANLFIDAMAPHKARFAGAVSSSEASTRRLQGHGFAVLDLNEVDTIPVYVDGADEIDDTGAMIKGGGGALTREKIVASVAGRFVCIADGSKLVDVLGAFPLPVEVVPMARAAVARQLAALGGQPRLRMTKEGQIYQTDNGNVILDVSGLRIGEPKTLEAQINDIPGVVTVGLFAKRGADVLLLGTEAGVQRRDF

SEQ ID NO: 94123 - protein, 480 aa, Salmonella enterica subsp. enterica serovar Paratyphi A str.
MIMRQTKLYPVVMAGGSGSRLWPLSRVLYPKQFLCLKGDLTMLQTTICRLNGVECESPVVICNEQHRFIVAEQLRQLNKLTENIILEPAGRNTAPAIALAALAATRQHTDCDPLMLVLAADHSIANEEAFRDAVRGAMPYADAGKLVTFGIVPDLPETGYGYIRRGDVVPGATDAVAFEVAQFVEKPGLETAQAYVASGDYYWNSGMFLFRAGRYLEELKKFRPDILAACEQAMRGVDPDLDFIRVDEEAFLACPEESIDYAVMERTADAVVMPMDAGWSDVGSWSSLWEISAHTPEGNVHHGDVISHKTENSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLLGENESIYIPLGATHCLENPGKIPLDLIEVRSGSYLEEDDVVRFEDRYGRV

SEQ ID NO: 94124 - protein, 351 aa, Thermoanaerobacter tengcongensis MB4
MAYEGIIKAYREFLPPIRDENIVTLKEGNTPLIEAFNLQRKYLPGIRVYLKYEGLNPTGSFKDRGMTVAVSQAKQEGSNAVVCASTGNTSASAAAYAAKAGLKSVVLIPGGKIALGKLAQAIAYGAEVIAVDGNFDDALRLVREISQKFPITLVNSINPYRLEGQKTAAFEICDALGEVPDYVSLPVGNAGNITAYWMGFKEYYRKGKIKKLPKMLGFQAAGAAPIVEGRVIENPETIATAIRIGNPASWQKAVAARDESGGIIDKVTDEEILEAYSILAKTEGIFAEPASAASIAGVIKKYKEGFFKEGDSVVCILTGNGLKDPDTAVKLGGEVKRIQPNLKELEEVLYG

SEQ ID NO: 94125 - protein, 379 aa, Brassica oleracea
  misc_feature (86)..(86): Xaa can be any naturally occurring amino acid
MSTTGQIIRCKAAVCWEAGKPLVMEEVEVAPPQKHEVRIKILFTSLCHTDVYFWEAKGQTPLFPRIFGHEAGGIVESVGEGVTDLXPGDHVLPIFTGECGDCPHCHSEESNMCDLLRINTERGGMIHDGESRFSINGKPIHHFLGTSTFSEYTVVHSGQVAKINPEAPLDKVCIVSCGLSTGLGATLNVAKPKKGQSVAIFGLGAVGLAAAEGARIAGAGRIIGVDLNPKRFEEAKKFGVTEFVNPKEHDKPVQEVIAEMTNGGVDRSVECTGSIQAMIQAFECVHDGWGVAVLVGVPSKDDAFKTHPMNLLNERTLKGTFFGNYKPKTDIPGVVEKYMNKELELEKFITHTVPFSEINKAFDYMLKGESIRCIITMGA

SEQ ID NO: 94126 - protein, 379 aa, Capsella rubella
  misc_feature (376)..(376): Xaa can be any naturally occurring amino acid
MITTGLFIRCKAAVSWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNPSRFDQAKKFGVTEFVNPKDHDKPVQQVIAEMTNGGVDRSVECTGSVQAMIQAFECVHDGWGVAVLVGVPSKDDAFKSHPMNFLNERTLKGTFFGNYKPKTDIPGVVEKYMNKELELEKFITHTVPFSEINKAFDYMLKGESIRCIIXMGA

SEQ ID NO: 94127 - protein, 399 aa, Candidatus Pelagibacter ubique HTCC1002
MSIISDSLKKIKPSPTIAVTQKARELKAAGKDVIGLGAGEPDFDTPDNIKQAAIKAINDGDTKYTAVDGTAALKDAIVKKFKRENNLDYTTDQITVGAGGKHVIYNAMMATLNEGDEVIVPAPYWVSYPDMVLLAGGTPIILECNEKQGFKINPAKLEKSITPKTKWIILNSPSNPTGACYTESDIKEIAYVLANHPHVHILSDDIYEHVTYEGFKFFTIAQIDGLKERVLTMNGVSKAYSMTGWRIGYAAGPKDIIKAIAKIQSQSTTNPSSISQAAAVEALNGTQDFIKERATSFQERRNFVVKALNGIDGIECLNPDGAFYVFPSCKGLMGKKDTSGKELKTDTDFVQSLLENSGVAVVQGSAFGLEGFFRISYATSMDNLKKALEKISTFCKSLN

SEQ ID NO: 94128 - protein, 379 aa, Boechera stricta
MSTTGQIIRCKAAVAWEAGKPLVMAEVEVAPPQKHEVRIKILFTSLCHTDIYFWEAKGQTPLFPRIFGHEAGGIVESVGEGVTDLQPGDHVLPVFTGECGDCRHCHSEESNMCDLLRINTERGVMIHDGESRFSINGKPIYHFVGTSTFSEYTVVHSGQVAKINPDAPLDKVCIVSCGLSTGLGATLNVAKPKKGQSVAIFGLGAVGLAAAEGARIAGAFRVIGVDLNPKRFDEAKKFGVTEFVNPKDHDKPVQQVIAEMTDGGVDRSVECTGSVQAMIQAFECVHDGWGVAVLVGVPSKDDAFKSHPMNFLNERTLKGTFFGNYKPKTDIPGIVEMYMNKELELEKFITHTVPFSGINKAFDYMLKGESIRCIIPMGA

SEQ ID NO: 94129 - protein, 309 aa, Glycine max
MAATSTSLASQLYIGLRRPCLKLDSFNSQSFSLFDPNLRLSLSPPKPSRAVIAMAGTGKFFVGGNWKCNGTKDSISKLVADLNNAKLEPDVDVVVAPPFLYIDQVKNSLTERIEISAQNSWVGKGGAFTGEISAEQLKDLGCKWVVLGHSERRHVIGENDEFIGKKAAYALSQGLGVIACIGELLEEREAGKTFDVCFQQLKAYADAVPSWDNIVIAYEPVWAIGTGKVATPQQAQEVHVAVRDWLKKNVSDEVASKTRIIYGGSVNGGNSAELAKQEDIDGFLVGGASLKGPEFATIVNSVTSKKVAA

SEQ ID NO: 94130 - protein, 479 aa, Erwinia carotovora subsp. atroseptica SCRI1043
MSTTQKRMYINGEFVENRSGKWIDVVNPATEQVISQVPEGSADDAKRAIDAAEAAQPSWEALPAVERGVWLHKIAAGIREREAELTDTIIAEGGKTHGLAQTEVLFTADYLDYMAEWARRYEGEIIQSDRPNENIFVFRKAIGVTTGILPWNFPFFLIARKAAPALITGNTIVIKPSEITPNNAVIFAEIIHKIGLPKGVINFVTGYGPTVGQELAGNPKVGMVSLTGSVAAGIATMTAAAQNVTKVSLELGGKAPAIVMDDADLDLAVKAIVSSRVINSGQVCNCAERVYVQKGIYDEFIIRIKAAMEQVTFGNTAEKKTLDMGPLISAAALQRVEDKVAKAVSQGAKVLLGGKSESGTGYFYPPTLLVNVTQEMPIMHEEVFGPVLPVATFDTLEDAIAMANDSEYGLTSSIYTQNINTAMKALKGLKFGETYINRENFEAMQGFHAGWRKSGVGGADGKHGLQEYLQTHVAYLQFH

SEQ ID NO: 94131 - protein, 379 aa, Boechera stricta
  misc_feature (366)..(366): Xaa can be any naturally occurring amino acid
MITTGQIIRCKAAVAWEAGKPLVMEEVEVAPPQKHEVRIKILFTSLCHTDVYFWEAKGQTPLFPRIFGHEAGGIVESAGEGVTDLQPGDHVLPVFTGECGDCRHCHSEESNMCDLLRINTERGVTIHDGESRFSINGKPIHHFVGTSTFSEYTVVHSGQVAKINPDAPLDKVCIVSCGLSTGLGATLNVAKPKKGQSVAIFGLGAVGLAAAEGARIAGASRVIGVDLNPKRFDEAKKFGVTEFVNPKDHDKPVQQVIAEMTDGGVDRSVECTGSVQAMIQAFECAHDGWGVAVLVGVPSKDDAFKSHPMNFLNERTLKGTFFGNYKPKTDIPGIVEMYMNKELELEKFITHTVPFSEINKAFDNMXKGESIRCIITMGA

SEQ ID NO: 94132 - protein, 147 aa, Burkholderia xenovorans LB400
MTSVAQLLKTKPNNTTVFTVGADDSVYDAIKLMAEKGIGALVVTDGDSIAGIVTERDYARKVVLLDRSSKATPVRDIMSKAVRFVRPDQTTDDCMALMTERRMRHLPVIENDRLVGMVSIGDLVKNIIAEQQFTIQQLEFYIHGERP

SEQ ID NO: 94133 - protein, 379 aa, Boechera fendleri
MITTGQIIRCKAAVAWEAGKPLVMEEVEVAPPQKHEVRIKILFTSLCHTDVYFWEAKGQTPRFPRIFGHEAGGIVESVGEGVTDLQPGDHVLPVFTGECGDCRHCHSEESNMCDLLRINTERGVMIHDGESRFSINGKPIHHFVGTSTFSEYTVVHSGQVAKINPDAPLDKVCIVSCGLSTGLGATLNVAKPKKGQSVAIFGLGAVGLAAAEGARIAGASRVIGVDLNPKRFDEAKKFGVTEFVNPKDHDKPVQQVIAEMTDGGVDRSVECTGSVQAMIQAFECVHDGWGVAVLVGVPSKDDAFKSHPMNFLNERTLKGTFFGNYKPKTDIPGIVEMYMNKELELEKFITHTVPFSEINKAFDYMLKGESIRCIITMGA

SEQ ID NO: 94134 - protein, 224 aa, Burkholderia xenovorans LB400
MSAPLSNAMLTSHDPSPAADGALNGECVVLDATATLPTRYGTFTSYVFRVCESGAEHLALVMGDVANKSSVLTRLHSECLTGDVLGSYRCDCGEQLDLALRYIAAEGCGVLLYLRGHEGRGIGLSNKIRAYALQEQGRDTVEANLDLGLPDDSREYDSAAGILRTLKVTSVRLMSNNPEKFDTLSKHGIPVCERVALAIPMREENERYIRTKQVKFGHYFDENE

SEQ ID NO: 94135 - protein, 379 aa, Turritis glabra
  misc_feature (6)..(6): Xaa can be any naturally occurring amino acid
MITTGXIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCRHCHSEESNMCDLLRINTERGGMIHDGESRFSINGKPIYHFLGTSTFSEYTVVHSGQVAKINPDAPLDKVCIVSCGLSTGLGATLNVGKPKRGQSVAIFGLGAVGLAAAEGARIAGASRIIGVDLNSKRFDQAKEFGVTEFVNPKDHDKPVQQVLAEMTDGGVDRSVECTGSVQAMIQAFECVHDGWGVAVLVGVPSKDDAFKSHPMNFLNERTLKGTFFGNYKPKTDIPGVVEKYMNKELELEKFITHTVPFSEINKAFDYMMKGESIRCIITMGA

SEQ ID NO: 94136 - protein, 379 aa, Olimarabidopsis pumila
MITTGQIIRCKAAVAWEAGKPLVMEEVEVAPPQKHEVRIKILFTSLCHTDVYFWEVKGQTPLFPRIFGHEAGGIVESVGEGVTDLQPGDHVLPIFTGECGDCRHCHSEESNMCDLLRINTERGGMIHDGESRFSINGKPIHHFLGTSTFSEYTVVHSGQVAKINPDAPLDKVCIVSCGLSTGLEATLNVAKGKKGQSVEIFGLGAVGLAAAEGARIAGASRIIGVDLNSKRFDQAKEFGVTEFVNPRDHDKPVQQGIAEMTDGGVDRSVECTGSVQAMIQAFECVHDGWGVAVLVGVPSKDDAFKTHPMNLLNERTLKGTFFGNYKPKTDIPGVVEKYMNKELELEKFITHTVPFSEINKAFDHMLKEESIRCIITMGA

SEQ ID NO: 94137 - protein, 379 aa, Halimolobos perplexus var. lemhiensis
MSTTGQIIRCKAAVAWEAGKPLVMEEVEVAPPQKHEVRIKILFTSLCHTDVYFWEAKGQTPLFPRIFGHEAGGIVESVGEGVTDLQPGDHVLPVFTGECGDCRHCHSEESNMCDLLRINTERGGMIHDGESRFSINGKPIHHFVGTSTFSEYTVVHSGQVAKINPDAPLDKVCIVSCGLSTGLGATLNVAKPKKGQSVAVFGLGAVGLAAAEGARIAGASRIIGIDLNPKRFDEAKKFGVTEFVNPKDHDKPVQQVIAEMTDGGVDRSLECTGNVQAMIQAFECVHDGWGVAVLVGVPSKDDAFKSHPMNFLNERTLKGTFFGNYKPKTDIPGIVEMYMNKELELEKFITHTVPFSEINKAFDYMLKGESIRCIITMGA

SEQ ID NO: 94138 - protein, 419 aa, Synechococcus elongatus PCC 6301
MTAIALTNLATEVRADFPILQQQVNGQPLVYLDNAATSQKPRAVIQSLVDYYEGYNSNVHRGVHTLSGKATDAYEGARQKVARFINAKTEQEIVYTRNASEAINLVAYSFGMNFLQAGDEIILSAMEHHSNLIPWQFVAAKTGAALKFVGVTETGQFDLEQFRSLLSDRTKLVSVVHVSNTLGCCNPVTEICQLAHAKGARVLIDACQSLPHQAIDVQAIDCDWLVGSGHKMCAPTGIGFLYGKLDLLRQMPPFLGGGEMIADVFLDHATYADLPHKFEAGTPAIGEAIALGAAIDYLTAIGMDRIHAYEQQLTQHLFQRLAEIPELTVYGPTPEQDRDRAALAAFTAGAVHPHDLSTILDQSGIAIRAGHHCTQPLHRELQVQSTARASCYFYNTTDEIDRLIESLKEAVEFFGAIFS

SEQ ID NO: 94139 - protein, 379 aa, Arabidopsis halleri
MITTGQSIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 94140 - protein, 505 aa, Rhizobium leguminosarum bv. viciae 3841
MHEPLTASEYKAIAAGLQFPTNAFIDGAFRPANSGQTFTSTNPATGEVLAEIAACDATDVDAAVSKAKQAFDDGRWRLRSPGERKAVLLKLARLLEDNRHELAVMESLDSGKPVGECQTVDVPDTIHTIRWHAELIDKLYDNTAPVGANALTMIVREPVGVVGCVLPWNFPLLMLAWKIGPALAAGCSVIVKPAQETTLTTLRVAELAHEAGIPAGVFNVVTGGGKEVGEPIGMHMDVDMVAFTGSTPTGRRFLRYAADSNLKRVVLECGGKNPAVVLDDAEDLDLVAEQVVNGAFWNMGENCSATSRLIVHSKVKDELLKRIGAYMREWKTGDPLDPANRIGALVSKAHFEKVKSFLDDARKEKLTVTHGGETHGGIFIEPTVVEGVTPASRLFQEEIFGPVLSVTTFNSLAEAIALANDTNYGLTASVYTGSLRNAIKLSREIRAGVVTVNCFGEGDASTPFGGYKESGFGGRDKSVFAHDNYCELKTIWIDVSERSVDETIR

SEQ ID NO: 94141 - protein, 379 aa, Arabis hirsuta
MITTGQIIRCKAAVAWEAGKPLVMEEVEVAPPQKHEVRIKILFTSLCHTDVYFWEAKGQTPLFPRIFGHEAGGIVESVGEGVTDLAPGDHVLPVFTGECGDCPHCHSEESNMCDLLRINTERGGMIHDGESRFSIDGKPIYHFVGTSTFSEYTVVHSGQVAKINPDAPLDKVCIVSCGLSTGLGATLNVAKPKKGQSVAIFGLGAVGLAAAEGARIAGASRIIGVDLNSKRFDEAKKFGVTEFVNPKDHDKPVQQVIAEMTNGGVDRSVECTGSVQAMIQALECVHDGWGVAVLVGVPSKDDAFKTHPMNLLNERTLKGTFFGNYKPKTDIPGVVEKYMNKELELEKFITHTVPFSEINKAFDYILKGESIRCIITMGA

SEQ ID NO: 94142 - protein, 198 aa, Campylobacter jejuni RM1221
MIISAKFITSLVKFDENLSSNFSEVAFLGRSNVGKSSLINSLCKQKNLAKSSATPGKTQLINFFEVICKRNEEKFNINFIDLPGFGYAKVSKNLKEIWNQNLDEFLKLRTSIKLFIHLIDSRHTHLEIDVNLNDYLKRFLRPDQKILKVFTKCDKLNQSEKAKLKNEFKDSILVSNLNKFGLDSLEDIIINQTLGLDK

SEQ ID NO: 94143 - protein, 511 aa, Populus tremuloides
MAMASIARRKALFLTRNLSNSSSADAFKFSYSLTKFSRGFATSGSEENDVVIIGGGPGGYVAAIKAAQLGLKTTCIEKRGTLGGTCLNVGCIPSKALLHSSHMFHEAQHSFASHGVKFSSVEVDLPAMMAQKDKAVSTLTRGIEGLLKKNKVNYVKGYGKFISPSEVSVDTVDGANTVVKGKNIIIATGSDVKSLPGITIDEEKIVSSTGALALKKIPKKLVVIGAGYIGLEMGSVWRRLGSEVTVVEFAPDIVPSMDGEVRKQFQRMLEKQKMKFMLKTKVVGVDTSGDGVKLTLEPASGGDQTTLEADVVLVSAGRTPFTAGLGLDKIGVETDKVGRISVNERFATNVSGVYAIGDVIPGPMLAHKAEEDGVACVEFIAGKHGHVDYDKVPGVVYTHPEVASVGKTEEQVKALGVEYCVGKFPLLANSRAKAIDDAEGLVKIIAEKETDKILGVHIMAPNAGELIHEAALALTYDASSEDIARVCHAHPTMSEALKEAAMATHDKPIHI

SEQ ID NO: 94144 - protein, 571 aa, Aspergillus oryzae
MSETIHLTEYLFRRLREAGLQAVHGVPGDYNLLMMDYIVPAGLEWVGNCNELNAGYAADGYARVKGIGALVTTFGVGELSAINAIAGSYAEMAPVIHIVGTPKRAMQTRGAKLHHSVCSGKPSDFTMFAEMYSKITVAQENLWDASTAPAQIDRLIRECIIQSRPVYLQVPADMVTEPVPAAALSRPLDLTPPSNDPESEQEVCDIIVERISNGKQPFILIDAGTSRYGLVSEADELVRITGFPTATTPFGKGIPDETLPNFHGIYASVGEGAYLPYVESSDLIINIGPVHSNVNTSCFTTIPNPRVSIVFDQTSITIDGEVYNVFPKGVLKRVLDHLRDAMLSFWPYPNLPDPRSTLKHISRATSAGALTQDIFFKRMSYFFRPGDIILTETGTASNGGRDFVFPQNVSLINSGVWLSIGYMLGAAQGVALAQRNMGSQGRTILFIGDGSFQVTAQELSTIIRKKLSAIIFVINNDGYTIERLIHGMDADYNDIAMWRYLDSPSYFGAPSDDSYPVFTARVSTWGELDGVLSRESFQRGPGLRMVELMMGVSDCMETLRHFLKMYAARKE

SEQ ID NO: 94145 - protein, 316 aa, Leptospira interrogans serovar Copenhageni str. Fiocruz L1-130
METKLQKIGEVGTLLFPAWVLIGSILSFFFPQWFTWFTGPAITYGLGFTMLGMGITLLPRDFRNIFKTPIPVFIGVALQYTVMPVSGWGIGVLLDLPIPLATGLVVVSCCPGGVASNVITYLAKGDLALSVSMTASSTILSVFMTPLLTLFLIGKGIDVSTSGLFLDTFQVVIFPIVLGVLLNVYFPEVSKKIQAVSPLVAVFLITMIVSSILGAGKEKILQSAGILIFAVLSLHISGFFFGYVISWLFIRKQKISRTISIEVGMQNSGLGVVLSRNNFPDPLVAIPAAISSLVHSLIGSLLAVFWRKLEKETTIK

SEQ ID NO: 94146 - protein, 334 aa, Arabidopsis thaliana
MATAMEEPRKLRGHKSTATCCIASRDRPGIVLTSGEDGCICWFDLRCKDVQFIIDVGTEPVSSLCFKTGNENILYASCGNEIKSFDVHTLSATSWKPLESYNYNKDEVNQVVCNGRSSFLASADDSGDVKIIDLGQKCLYKTLRAGHTSICSSVQFIPWRPWEGSDTNNNSGQCLNPAFVHSIAIPEMDMVDKLDKICAVARGDGIVNLINIESELSRKGTSSKGSSSSSSNNVVKRVCLDYSVGGHNSAVSCVAFSLFQEKGRFLISGGNDKTVKIWDCFKCLDPNNNNNNSDLLHLNINLSKKVNWLCTNQSDSENLVVCDTTRVVKVYSIS

SEQ ID NO: 94147 - protein, 383 aa, Leptospira interrogans serovar Copenhageni str. Fiocruz L1-130
MQSIIDWKEIQDLYPVNQEMIWLNNCGTTPCNVHTIQAIGEYLEGYSKKGVLTEVRKYASVKHSIRKIVAGLINCDVEELCIIHNTNEGMNFLSLGFQLKSGDEILLLENEYPSNIYPWEHWKEKGVVIGFIPMASTPDQFLENLKSSISSKTKIVALSAVHWCTGMPFPLEEIGVFLDSKGIEFVLDGAQGIGLIPVDVRKMKLKYIAFPAWKWLLGPLGLGMLYIQQDCIDTLSFPFKGTGSVINDEVYLPYRAELKSGADRYEISTGNFIDWVYFQSTLEMLQKIGFHSVMERIYELADYLSEGMKGIGFQIELDHFPDNRTGIVVGYKEGIPMDELVSYLKKNEVMCALRLGKVRFSPHIYNKKDQLDRVVELLGSFSS

SEQ ID NO: 94148 - protein, 309 aa, Bacillus cereus G9241
MQCIETNNLQQLLEQVKPYTKKGKLATYIPELGNANPDDLGIAIFHKETEYIHAGNSQTLFTLQSISKVITLALALLDRGEEYVFSKVGMEPTGDPFNSIIKLETTSPSKPLNPMINAGALAITSMLAGKDNEEKMDRILHFVREITDNPTINYSSKVANSELETAYLNRSLCYYMKQNGIIDCDIEELMDLYTRQCAVEVNCIDLARIGLIFAMDGYDPYKEKQIIPKHITKICKTFMVTCGMYNESGEFAIRVGIPAKSGVAGGIFGCVKGEMGIGIFGPALDANGNSIAGFKILELLSAQEGWSIF

SEQ ID NO: 94149 - protein, 618 aa, Blastopirellula marina DSM 3645
MTEEGIEHVEPSHANDQYVVVARRYRPQSFEELVGQSQVAQALKNAIERGRVGHAYLFTGARGVGKTSSARILAKALNCQRGPSATPCNECDICRSVTVGEDVDVLEIDGASNRGIEEIRQLRSNVNIRPSRARFKIYIIDEVHMFTKEAFNALLKTLEEPPEHVKFIFCTTDPEKIPITVLSRCQRFDFGGIRMDEIVTRLAYIVENEGVTAEPEALRLLARKANGSMRDSQSLLEQLLAFGGREITVADVNQMLGAAGSEQIAVIMTALAARDAAAVLAYFDQALTRGIDPGQLIEQLLGFFRDMMTLAVGAGPTLLQTVLPTDAEKIEAVAKSYGLANVMAAVQILDDALVRMQRSAHARILAEMALVRVCQLEDLQSVADLVETIRSGKPLPARPAIQIAAAPQPSAAPQLPPQAAPQAMSTVQTDVAAERTESRVNSSDPASSGPVRQASPSEVTSYVEEPDPELGLSEPPRTNGIKLTDSTAKNIWEGILTDMSDLVGEYARPYKTVATSGPNRLVVSFSAAYNSQVEFLRRPAAKTRLEGMLTEAVGNPVTLEFKVLNDVPAAKTQEPPKRSAPSSGQMIRKVQQNQLVQQAIEMFGAEVTSVRAPESGGS

SEQ ID NO: 94150 - protein, 309 aa, Rhodospirillum rubrum ATCC 11170
MGLLIDGQWHDHWYDTAASGGRFERQPSAFRDKVGDRGFPAEAGRYRLYVSYACPWAHRTLIARALKGLEDALPVTVVEPLMLENGWELAEGADPLEGARFLHQLYTRAKADYSGRVSVPVLWDSQTATIVNNESAEILRMIDSAFGALASGPSLYPEDKREEIDAINAWVYDAINNGVYKAGFATTQAAYEEAVTALFAALARVEAILSERRFLVGDQPTEADWRLFTTLIRFDCVYVGHFKCALRRISDSPVLFAYLRDLYQVPGIAQTVRFDHIKTHYYASHRTINPTGIVPLGPDIDFTAPHGRG

SEQ ID NO: 94151 - protein, 198 aa, Cucumis melo
MSSNGVSSSISKRLAGKVALITGGASGIGESTVRLFVENGAKVVVADVQDDLGAVLCKELDDGTGYNVSYFHCDVTDESDISNAVDYAVEKYGKLDIMFNNAGIRGDVGATTLTTDMNDFKKVFDVNVFGSFMGAKHAARVMAPAKTGCILFTSSMASVICSGNAPAYAASKHAIIGLMKTLAVELGPKGIRVNAISP

SEQ ID NO: 94152 - protein, 456 aa, Saccharomyces cerevisiae
MSDKPIDIQYDKQATPNLSGVITPPTNETGNDSVREKLSKLVGDAMSNNPYFAAGGGLMILGTGLAVARSGIIKASRVLYRQMIVDLEIQSKDKSYAWFLTWMAKHPQRVSRHLSVRTFYIQHDNGSVSTKFSLVPGPGNHWIRYKGAFILIKRERSAKMIDIANGSPFETVTLTTLYRDKHLFDDILNEAKDIALKTTEGKTVIYTSFGPEWRKFGQPKAKRMLPSVILDSGIKEGILDDVYDFMKNGKWYSDRGIPYRRGYLLYSPPGSGKTSFIQALAGELDYNICILNLSENNLTDDRLNHLMNNMPERSILLLEDIDAAFNKRSQTGEQGFHSSVTFSGLLNAQDSVTSSEETITFMTTNHPEKLDAAIMRPGRIDYKVFVGNATPYQVEKMFMKFYPGETDICKKFVNSVKELDITVSTAQLQGLFVMNKDAPHDALKMVSSLRNANHIF

SEQ ID NO: 94153 - protein, 321 aa, Pseudomonas putida KT2440
MKYLVVGGAGYIGSHMVKHLLAAGHEVLVADLVSPGPGIQWAKLDIADEAALDVLFGVCRFDAVFHFASFIQVGESVSAPGKYYQNNVAATLSLLQAMVNAGIRHLVFSSSAAVYGNPQYVPIDEAHTKGPINPYGLSKWMVEQILEDFDRAYGLKSVSLRYFNAAGADPEGQLGERHEPETHLIPLILQAASGRREAVTVFGRDYDTPDGTCIRDYVHVADLAAAHALAVDYLLDGGERAAFNLGNGLGFSVQQVIDTARAVTGRQITALDAQRRAGDPPRLVADASKAMQVLGWRPAFASLEQIVRHAWQWELQYPWRR

SEQ ID NO: 94154 - protein, 289 aa, Ralstonia eutropha JMP134
MLPHSDSPIPRWLAGTAGVAVLAGLARHLLFRALEREAFVTPPIPPQGGQSETTLHASTFASGGRVLHAAFAPAATAQAPALMVCHGDDECLSDWAPVQTMLSRAGISTFVFDYSGYGASSGRPTVRHLREDARAAYRMFLEATPAASRRYVLGHSLGSGVLLDVARELRPVPDGMIIASGFSSARAAAVQTGKVPARLAWLLPDPWNNLARTRRLNVPLLVLHSRDDEVLPFAHSERLAQAASRLQELVLFDGMPHDAAILPDYIEAFWAPIIAFMLAPQAPRIDGST

SEQ ID NO: 94155 - protein, 470 aa, Moritella sp. PE36
MKKTKIVCTIGPKTESVEKLTELVKAGMNVMRLNFSHGNFAEHSVRIQNIREVSENLNEKIAVLLDTKGPEIRTIKLENGEDVILTAGQLFTFTTDINVVGNKDSVAVTYPGFAKDLSAGAIILVDDGLIEMKVVETTDTEVKCTVLNTGALGENKGVNLPNISVGLPALSEKDKADLAFGCEQEVDFVAASFIRKADDVREIREILFNNGGENIQIISKIENQEGVDNFDEILAESDGIMVARGDLGVEIPVEEVIMAQKMMIKKCNKAGKVVITATQMLDSMINNPRPTRAEAGDVANAVLDGTDAVMLSGETAKGKYPVEAVSIMANICERTDNSMSSDLGANIVAKSMRITEAVCKGAVETTEKLCAPLIVVATRGGKSAKSVRKYFPKANILAITTNEKTAQQLCLTKGVSTCIVAQIDSTDEFYRKGKELALATGLAKEGDIVVMVSGALVPSGTTNTASVHQL

SEQ ID NO: 94156 - protein, 364 aa, Escherichia coli O157:H7 EDL933
MMSKNYHIAVLPGDGIGPEVMTQALKVLDAVRNRFAMRITTSHYDVGGAAIDNHGQPLPPATVEGCEQADAVLFGSVGGPKWEHLPPDQQPERGALLPLRKHFKLFSNLRPAKLYQGLEAFCPLRADIAANGFDILCVRELTGGIYFGQPKGREGSGQYEKAFDTEVYHRFEIERIARIAFESARKRRHKVTSIDKANVLQSSILWREIVNEIATEYPDIELAHMYIDNATMQLIKDPSQFDVLLCSNLFGDILSDECAMITGSMGMLPSASLNEQGFGLYEPAGGSAPDIAGKNIANPIAQILSLALLLRYSLDADDAASAIERAINRALEEGIRTGDLARGAAAVSTDEMGDIIARYVAEGV

SEQ ID NO: 94157 - protein, 132 aa, Helicobacter pylori
SNIKYELDKESGALMVDRVLYGAQNYPANYGFVPNTLGSDGDPVDALVLSDVALQAGSVVKARLVGVLNMEDESGMDEKLLALPIDKIDPTHSYVKDIDDLSKHTLDKIKHFFETYKDLEPNKWVKVKGFEN

SEQ ID NO: 94158 - protein, 210 aa, Thermoanaerobacter tengcongensis MB4
MRMIDLSHFIEEGMPQYPGQPEIKVERLVEVEKDGYQLTELKYVVHLGTHCDAPAHFIEKGDTIEKLPVDFYSGEAVIVDVPHLPDRLMRPELLEGVDLKEGDIVIFRTGMSKYWREEAYIKEFPYLTEELAHFLVDKKVKAIGLDTISPDPVETEDFPVHHVLLGNKVGIIENLTNLEAIDKKRFLFIALPLKIKGSDGSPVRAVAILE

SEQ ID NO: 94159 - protein, 121 aa, Synechococcus sp. RS9917
MLDGSGTWRCLHQCGACCRLAPEERPEALEVLDDAQRQLYLEMAGPDGWCRHYDSGGRRCRIYEERPDFCRVSNLADLFAVEASDAEAFAIACCRQQIRSVYGGRSLELRKFNRLLRTGDE

SEQ ID NO: 94160 - protein, 379 aa, Arabis hirsuta
  misc_feature (183)..(183): Xaa can be any naturally occurring amino acid
  misc_feature (372)..(372): Xaa can be any naturally occurring amino acid
MITTGQIIRCKAAVAFEAGKPLVMEEVEVAPPQKNEVRIKILFTSLCHTDVYFWEAKGQTPLFPRIFGHEAGGIVESVGEGVTDLAPGDHVLPIFTGECGDCPHCHSEESNMCDLLRINTERGVMINDGESRFSIDGKPIYHFVGTSTFSEYTVVHSGQVAKINPDAPLDKVCIVSCGLSTGXGATLNVAKPKKGQSVAIFGLGAVGLAAAEGARIAGASRIIGVDLNSKRFDEAKKFGVTEFVNPKDHDKPVQQVIAEMTDGGVDRSVECTGSVQAMIQAFECVHDGWGVAVLVGVPSKDDAYKTHPMNFLNERTLKGTFFGNYKPKTDIPGLVEKYMNKELEIEKFITHTVPFSEINRAFDYMLKGEGIXCKITMGA

SEQ ID NO: 94161 - protein, 379 aa, Arabis hirsuta
  misc_feature (317)..(317): Xaa can be any naturally occurring amino acid
MSTTGQIIRCKAAVAWEAGKPLVMEEVEVAPPQKNEVRIKILFTSLCHTDVYFWEAKGQTPLFPRIFGHEAGGIVESVGEGVTDLAPGDHVLPIFTGECGDCPHCHSEESNMCDLLRINTERGVMINDGESRFSIDGNPIYHFVGTSTFSEYTVVHSGQVAKINPDAPLDKVCIVSCGLSTGLGATLNVAKPKKGQSVAIFGLGAVGLAAAEGARIAGASRIIGVDLNSKRFDEAKKFGVTEFVNPKDHDKPVQQVIAEMTDGGVDRSVECTGSVQAMIQAFECVHDGWGVAVLVGVPSKDDAFKTHPMNFLNERTXKGTFFGNYKPKTDIPGLVEKYMNKELEIEKFITHTVPFSEINKAFDYMLKGEGIRCIITMGA

SEQ ID NO: 94162 - protein, 153 aa, Fusobacterium nucleatum subsp. vincentii ATCC 49256
MKVFEGKFNGKGTKIAIVAARFNEFITSKLIGGAEDILRRHEVQDNDINLFWVPGAFEIPLIAKKLAQSKKYDAVITLGAVIKGSTPHFDYVCAEVSKGVAHVSLESEVPVIFGVLTTNSIEEAIERAGTKAGNKGADAAMTAIEMINLIKGI

SEQ ID NO: 94163 - protein, 218 aa, Triticum aestivum
  misc_feature (16)..(16): Xaa can be any naturally occurring amino acid
  misc_feature (58)..(58): Xaa can be any naturally occurring amino acid
ERFVDVRLATHEDGHXKGFGHVEFATAEDAQKALDSLNGGDLMGRPVRLDMAAERGCXAPRTRDGGSFGKPSGGPSLSVFVKGFDSSQQEDAIRSSLQEHFSKCGEITRVSVPMDYENGASKGIAYMDFTDESSFSKALELSGSDLGGCNLYVAEAKPKGQFGGVGGRSGGRDGGRSGGGRFGRSGGRDGGRGGGRGFQSRQSAGTASAGKKTTFGDD

SEQ ID NO: 94164 - protein, 379 aa, Arabis soyeri subsp. subcoriacea
MITTGQIFRCKAAVAWEAGKPLVMEEVEVAPPQKHEVRIKILFTSLCHTDVYFWEAKGQTPLFPRIFGHEAGGIVESIGEGVTDLAPGDHVLPIFTGECGDCPHCHSEESNMCDLLRINTERGGMIHDGESRFSINGKPIHHFVGTSTFFEYTVVHSGQVAKIIPDAPLDKVCIVSCGLSTGLEATLNVAKPKKGQSVAIFGLGAVGLAAAEGARIAGASRIIGVDLNSKRFDEAKKFGVTEFVDPKDHDKPVQQVIAEMTDGGVDRSVECTGSVQAMIQAFECVHDGWGVAVLVGVPSKGDAFKTHPMNFLNERTLKGTFFGNYKPKTDIPGVVEKYMNKELELEKFITHTVPLSEINKAFDYMMKGESIRCIITMGA

SEQ ID NO: 94165 - protein, 563 aa, Coprinopsis cinerea okayama7#130
MKGLFVYLAVLVSSGVCTQQEPLQWGSSSSPRPQESYEFKWPIKKVAVIGTGVGGLQAYRELTQHGFAVDIYERDNVPGGNWHYTDETPLDAPIPNAPIAVGDYEPSLPPAGVVYPYTEEYTDEESNAPAVSGIGLPIQQIRETPWPKGTEWELPHAKLARYIRAFASWHGVNTNDGNPHAFYNTRVERVEKRYNADGSEAGWSLVAKELVKDANKTRATWYKRNYDAVVVATGRYNAPNVPAISGLEEWNKKFPGHLLHSRQYRHPQPFKGKTVLVIGAATSGGEIAREVITQAKQVYVSIRPDKFRGPHFALTDHLRRLPANITLIGEIKSFNDPSGSIQASEIQLVNGTVITGVDNVIFGTGYRYTYPFLSDYINPSLGPKDELPREEGVIQPIITDGTHVRSLYLDAFYIPDPTLLFINANFGMQSFTYAEFVSLAAAKVWSGKADLPNTAALWAAYDETVKDRLGYGRHFQFLGTERTKASLRFFVSWLNEAAVKYGGRQIDQLPKENDEISRIWAGARWGNPNRGSSHPNNLLPEDDGVAIDGSEPWVQDSVYSDWW

SEQ ID NO: 94166 - protein, 379 aa, Boechera lignifera
MSTTGQIIRCKAAVAWEAGKPLVMEEVEVAPPQKHEVRIKILFTSLCHTDVYFWEAKGQTPLFPRIFGHEAGGIVESVGEGVTDLQPGDHVLPVFTGECGDCRHCHSEESNMCDLLRINTERGVMIHDGESRFSINGKPIYHFVGTSTFSEYTVVHSGQVAKINPDAPLDKVCIVSCGLSTGLRATLNVAKPKKGQSVAIFGLGAVGLAAAEGARIAGASRVIGVDLNPKRFDEAKKFGVTEFVNPKDHDKPVQQVIAEMTDGGVDRSVECTGSVQAMIQAFECVHDGWGVAVLVGVPSKDDAFKSHPMNFLNERTLKGTFFGSYKPKTDIPGIVEMYMNKELELEKFITHTVPFSEINKAFDYMLKGESIRCIITMGA

SEQ ID NO: 94167 - protein, 528 aa, Pseudomonas putida
  misc_feature (26)..(26): Xaa can be any naturally occurring amino acid
MASVHGTTYELLRRQGIDTVFGNPGXNELPFLKDFPEDFRYILALQEACVVGIADGYAQASRKPAFINLHSAAGTGNAMGALSNAWNSHSPLIVTAGQQTRAMIGVEALLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHQYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYFCAAGGLGFALPAAIGVQLAEPERQVIAVIGDGSANYSISALWTAAQYNIPTIFVIMNNGTYGALRWFAGVLEAENVPGLDVPGIDFRALAKGYGVQALKADNLEQLKGSLQEALSAKGPVLIEVSTVSPVK

SEQ ID NO: 94168 - protein, 379 aa, Boechera lyallii
MSTTGQIIRCKAAVAWEAGKPLVMEEVEVAPPQKHEVRIKILFTSLCHTDVYFWEAKGQTPLFPRIFGHEAGGIVESVGEGVTDLQPGDHVLPVFTGECGDCRHCHSEESNMCDLLRINTERGVMIHDGESRFSINGKPIHHFVGTSTFSEYTVVHSGQVAKINPDAPLDKVCIVSCGLSTGLGATLNVAKPKKGQSVAIFGLGAVGLAAAEGARIAGASRVIGVDLNPKRFDEAKKFGVTEFVNPKDHDKPVQQVIAEMTDGGVDRSVECTGSVQAMIQAFECVHDGWGVAVLVGVPSKDDAFKSHPMNFLNERTLKGTFFGNYKPKTDIPGIVEMYMNKELELEKFITHTVPFSEINKAFDYMLKGESIRCIITMGA

SEQ ID NO: 94169 - protein, 379 aa, Arabidopsis lyrata subsp. lyrata
  misc_feature (374)..(374): Xaa can be any naturally occurring amino acid
MITTGQIIRCKAAVAWVAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGGTLNVVKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTLPFSEINKAFDYMLKGESIRCXIPMGA

SEQ ID NO: 94170 - protein, 379 aa, Boechera parishii
MSTTGQIVRCKAAVAWEAGKPLVMEEVEVAPPQKHEVRIKILFTSLCHTDVYFWEAKGQTPLFPRIFGHEAGGIVESVGEGVTDLQPGDHVLPVFTGECGDCRHCHSEESNMCDLLRINTERGVMIHDGESRFSINGKPIHHFVGTSTFSEYTVVHSGQVAKINPDAPLDKVCIVSCGLSTGLGATLNVAKPKKGQSVAIFGLGAVGLAAAEGARIAGASRVIGVDLNPKRFDEAKKFGVTEFVNPKDHDKPVQQVIAEMTDGGVDRSVECTGSVQAMIQAFECVHDGWGVAVLVGVPSKDDAFKSHPMNFLNERTLKGTFFGNYKPKTDIPGIVEMYMNKELELEKFITHTVPFSEINKAFDYMLKGESIRCIITMGA

SEQ ID NO: 94171 - protein, 379 aa, Fourraea alpina
MITTGQIIRCKAAVAWEAGKPLVMEEVEVAPPQKHEVRIKILFTSLCHTDVYFWEAKGQTPLFPRIFSHEAGGIVESVGEGVTDLQPGDHVLPIFTGECGDCRHCHSEESNMCDLLRINTERGGMIHDGESRFSINGKPIYHFLGTSTFSEYTVVHSGQVAKINPDAPLDKVCIVSCGLSTGLGATLNVAKPKKGQSVAILGLGAVGLAAAEGARIAGAARIIGVDLNPKRFEEAKKFGVTEFVNPREHDKPVQEVIAEMTDGGVDRSLECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 94172 - protein, 502 aa, Coprinopsis cinerea okayama7#130
MPKTYTHKFDTQAYKGSSTISTGLFINGEWVDPVQGDEIDIVNPATGEVITKVAIGTKADVDKAVAAARKVCAYKTTWGLKASGSERARLLNKLADLIEKNLEELAALESLDVGKVYANAKVMDIGGAVIVFRYYAGWADKIQGTTVESGDTKLNYVRREPYGVCGQIIPWNFPMVAPALATGNTVVLKPSEVTPLTALRFADLVVEAGFPPGVVNIVNGYGHTVGAAIAEHPNIDKVAFTGSTLTGRRILKAAADSNLKPVTLELGGKSPTIIFDDADFEQALKWTTAGIYSNMGQVCTAGSRIFVQEGIYDKFVESFAAVAKGFGQATGDPFAEGTKHGPQVSQTQFDRVLSYIESGKKEGATAIVGGDKHGDKGYFIQPTIFTGVTKDMKIAREEIFGPVASVFKFKTEEGELSFVIELANDTVYGLAAYVFSENISRGIRVAHALEAGSVAVNSTVPFDVGMPFGGYKQSGIGRELGQYAIDTYTQNKAVHVNIGLRI

SEQ ID NO: 94173 - protein, 379 aa, Arabidopsis lyrata subsp. petraea
MITTGQIIRCKAAVAWEAGKPLVMEEVEVAPPQKHKVRIKILFTSLCHTDVYFWEAKGQTPLFPRIFGHEAGGIVESVGEGLTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVVKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTLPFSEINKAFDYMLKGESIRCIITMGA

SEQ ID NO: 94174 - protein, 437 aa, Aspergillus oryzae
MSLPETTHSTISQRAQSALVAGSKNLMWDVMNDLWCEKTNPNGYVNVGVAENVLMHDHLLSFINRQLDLPAKLLTYNDGPTGSGRVKRAVSAFVNRHFRPFHPVEPSHLFITNGVSSAIEHVSWAITEPGEAILLGRPYYGTFIPDISLRPGATVIPVSFDDCDPFSLEAVQKYEQALLSFQETTGRKVKGLALCHPHNPLGRCYPRDVLLKLMELCQKYQMHFISDEIYALSVWKNTVDESPKPVDFESALSLDLTGIIDPQLVHVLWGVSKDFGANGLRLGVIISQANRDILAALRNVGLYSYVSGVSEYLVALLLEDVNFTDEYIRLNREKLSENYSFVVQQLKSNGIEYSTGANAAFFIWMNLGKKYHELHPEVKDDEDVSETVMDLLLQKKVFLASGSLFGSERGGWYRIVFSQPQEYLSEAVRRIMAALEA

SEQ ID NO: 94175 - protein, 379 aa, Arabidopsis lyrata subsp. petraea
MITTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVIEKYMNKELELEKFITHTLPFSEINKAFDYMLKGESIRCIITLGA

SEQ ID NO: 94176 - protein, 324 aa, Pseudomonas aeruginosa UCBPP-PA14
MGQLIDGRWHDQWYDTQKDGRFQRENAQRRHWLGEPAFPAEGGRYHLYVSLACPWAHRTLIVRKLKGLESLVDVSVVSWLMRENGWTFDPAHGSTGDRLDGLAFLHQRYTRDDPHYSGRVTVPLLWDKQAQKIVNNESADIVRIFNSAFDAIGANALDFYPEPLREEIDRLNGRIYPAVNNGVYRAGFATRQDAYEEAFVQLFEELDYLEGLLGERRYLAGEYLTEADIRLFTTLVRFDAVYHGHFKCNLRRIEDYPNLSGWLRELYQRPGIGETVDFEHIKGHYYASHRTINPTGIVPLGPRLDLARAPGRERLPGKGIWGEG

SEQ ID NO: 94177 - protein, 189 aa, Clostridium perfringens str. 13
MQMSLINKKVLDFKVQAYQNGEFKEVTSEDLKGHWSVFVFYPADFTFVCPTELGELADNYESFKEIGCEVYSISTDTHFVHKAWADASDTIGKIKYPMLADPTGKLARDFEVMIEEEGLALRGSFVINPEGEIKAYEIHDNGIGRNAEELLRKVQAAQFVAEHGDQVCPAKWKPGEETLAPSLDLIGKL

SEQ ID NO: 94178 - protein, 472 aa, Escherichia coli
MAGGTGSRLWPLSRELYPKQFLQLSGDNTLLQTTLLRLSGLSCQKPLVITNEQHRFVVAEQLREINKLNGNIILEPCGRNTAPAIAISAFHALKRNPQEDPLLLVLAADHVIAKESVFCDAIKNATPIANQGKIVTFGIIPEYAETGYGYIERGELSVPLQGHENTGFYYVNKFVEKPNRETAELYMTSGNHYWNSGIFMFKASVYLEELRKFRPDIYNVCEQVASSSYIDLDFIRLSKEQFQDCPAESIDFAVMEKTEKCVVCPVDIGWSDVGSWQSLWDISLKSKTGDVCKGDILTYDTKNNYIYSESALVAAIGIEDMVIVQTKDAVLVSKKSDVQHVKKIVEMLKLQQRTEYISHREVFRPWGKFDSIDQGERYKVKKIIVKPGEGLSLRMHHHRSEHWIVLSGTAKVTLGDKTKLVTANESIYIPLGAAYSLENPGIIPLNLIEVSSGDYLGEDDIIRQKERYKHED

SEQ ID NO: 94179 - protein, 303 aa, Bacillus licheniformis ATCC 14580
MYMLMKVVPRNLFVLCEDGKVFLFLEGGIKMKRIGFIGAGSMAEAMIKGLVKSGAMEPEAIFVTNQSNTARLRELSETYGVCGEADTAKVAARSDTLVLAMKPKDAAGGIAALRPYLRKEQLLISVLAGIPIHTIQHYAGLELPVVRAMPNTSAAIQKSATAFAASPLVTKEQMQEAADLFATVGSVTIVEESALDAVTAVAGSGPAFVYRFVEALQASAAELGLPEKTAKQLIIDMMAGAAQMLETGRDPSVMRKEITSAGGTTEAGLRMLDDHQFEQTVISCVKEAANRSAELRDMFAAKI

SEQ ID NO: 94180 - protein, 458 aa, Escherichia coli
MAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQIFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 94181 - protein, 414 aa, Bacillus cereus G9241
MNVSSTVAIIGLGYVGLPLAVHFAERGHTVLGLDKDTRKIESIIQGESYIPDVSSKSLQSLLTRKKLIVNTPDQGIADFQNSDYVIVTVPTPINEQREPDLSALISASHYIQQNLQKGQTFIFESSTYPGTLEEVIIPIISQTGKKVGEDFYIGYSPERIDPANSQYSVQTIPKVISGQTEMCKQKVQALYSTIFDVVVPVSSPKVAEMCKLFENIQRLVNISLVNELNTLCESLGIDFYEALEAASTKPFGFTPYWPGPGIGGHCIPVDPLYFQWRIKKNGAISQLIEAAHVINEEMPGKMVRKVKGVVQSPATVLIVGIAYKKDVNDLRESPALPIIELLIKEGYEIEYHDPYISSAKFGDKVYQSVSLDEQVVKQADCILILTDHSNIDWKVFKGIKQVVDTRGIIKKVSV

SEQ ID NO: 94182 - protein, 184 aa, Triticum aestivum
  misc_feature (42)..(42): Xaa can be any naturally occurring amino acid
KIAPFSTFWGGANWGEKPKFHPPCRPKIKGGQELLAASSVLXKAMVWSETEVKLNLHGFSITSAYVLMLQWVDAVKVSRTLPLEVSVVCGVGKHSDVRGEPKVRELAQEVLSRMGSPLRLSARNKGRLVAKRDRVKQWLATEWTSVVPEESTDQSPNASDQQPFLPNLLRKLRQFFSSFVRVSR

SEQ ID NO: 94183 - protein, 576 aa, Rhodospirillum rubrum ATCC 11170
MGVLKVVVTTGLAFAALTLPSMAQEKAIFDPMDRIHPVWAEHGMVAAQERLAAEIGRDILAKGGNAVDAGVAVAFALAVTLPQAGNIGGGGFMIVHDGPTGKTVAIDYREKAPAGASRDMFLDAQGNADSGKSLYSGAASGVPGTVAGMKAALDAFGSMDWAEVIAPAIRLAEGGIVVTPKLADSLKDARKQLEAFPSSARIFLKEGGADYRPGDRLVQADLAATLKTIAAEGPDGFYKGAVAEKISAAVQAAGGLITPQDMADYTVVMREPVRGGYRGYEIVSMPPPSSGGVHLVQILNALEGYPIGALGQNTGQTLHLMAETMKLAYADRAHYLGDPDFTAVPVAALTSKDYAAAMRETISADFARPSATIGPGDLTPYESDQTTHFSIIDKNGSAVANTYTLNLSYGSGLVAEGTGVLMNNEMDDFSAKPGVPNAFGLVGGDANAVQAGKRPLSSMTPTIVLKDGKVWLVTGSPGGARIITTVLQVIMNMIDHKMNVAEASTAPRAHHQWLPDELRIEEGISLDTIRILQAKGHTIALKPAMGSTQSIMRDGASGAVYGASDPRDPDAATVGY

SEQ ID NO: 94184 - protein, 241 aa, Petunia x hybrida
MSPPVSVTKMQVENYAFAPTVNPAGSTNTLFLAGAGHRGLEIEGKFVKFTAIGVYLEESAIPFLAEKWKGKTPQELTDSVEFFRDVVTGPFEKFTRVTTILPLTGKQYSEKVAENCVAHWKGIGTYTDDEGRAIEKFLDVFRSETFPPGASIMFTQSPLGLLTISFAKDDSVTGTANAVIENKQLSEAVLESIIGKHGVSPAAKCNVAERVAELLKKSYAEEASVFGKPETEKSTIPVIGV

SEQ ID NO: 94185 - protein, 184 aa, Triticum monococcum
APINLSDRLNQVLRWALGSVEILFSRHCPIWYNYGGRLKLLERVAYINTIVYPITSLPLIAYCVLPAICLLTNKFIIPEISNYAGMFFILMFASIFATGILELRWSGVGIEDWWRNEQFWVIGGTSAHLFAVFQGLLKVLAGIDTNFTVTSKANDEDGDFAELYVFKWTSLLIPPTTVLVINLV

SEQ ID NO: 94186 - protein, 213 aa, Oryza sativa Indica Group
MGYAQLVIGPAGSGKSTYCSSLYQHCETVGRTIHMVNLDPAAEHFSYPVSTENHRHLEDNLDDWLDEQLDGYLDDDYLVFDCPGQIELFTHVPVLRNFVEHLKRKNFNVCAVYFLDSQFVSDVTKYISGCMASLSAMIQLELPHINILSKMDLVSNKKDVEEYLNPEAQVLLSQLNRQMAPKFGKLNKSLAELAAHVFQMSMLSLLFPAKSMA

SEQ ID NO: 94187 - protein, 201 aa, Pseudomonas viridiflava
MSTANQNPAAAPAMKKKLTTSAMIASIASEGQATRSAPFGHALAALADQRSDIVGLSADLSRYTDLHIFAKAHPERFYQMGMAEQLLMSAAAGMAREGCVPFATTYAVFASRRAYDFICMAIAEENLNVKIVCGLPGLTTGYGPSHQATDDLAIFRAMPNLMIVDPCDALEIEQAVPAIAAHQGPVYMRLLRGNVPLVLDE

SEQ ID NO: 94188 - protein, 195 aa, Oryza sativa
  misc_feature (94)..(94): Xaa can be any naturally occurring amino acid
  misc_feature (115)..(117): Xaa can be any naturally occurring amino acid
  misc_feature (129)..(129): Xaa can be any naturally occurring amino acid
  misc_feature (136)..(136): Xaa can be any naturally occurring amino acid
  misc_feature (139)..(139): Xaa can be any naturally occurring amino acid
  misc_feature (143)..(143): Xaa can be any naturally occurring amino acid
  misc_feature (145)..(145): Xaa can be any naturally occurring amino acid
  misc_feature (147)..(148): Xaa can be any naturally occurring amino acid
  misc_feature (151)..(152): Xaa can be any naturally occurring amino acid
  misc_feature (154)..(155): Xaa can be any naturally occurring amino acid
  misc_feature (157)..(160): Xaa can be any naturally occurring amino acid
  misc_feature (162)..(163): Xaa can be any naturally occurring amino acid
  misc_feature (166)..(167): Xaa can be any naturally occurring amino acid
MKNIPVLLGLLSVWNVSFLGYPARAILPYSQALEKFAPDIQQLSMESNGKGVSIDGVQLPFESGEIDFGEPGTNGQHSFYQLIHQGRVIPCDFXSVSVKSQQPVYLKGEILSNHXXXLNVPFSFAQPDXVCLWESXLTXGLAXKXPXXLSXXGXXGXXXXVXXLLXXCDLAGDRPGFRGCLGGGIGNCGRSFWGF

SEQ ID NO: 94189 - protein, 281 aa, Oryza sativa Japonica Group
MAASTPAASRERRWSLAGKTALVTGGTKGIGRAIVEELAGFGVRVHTCSRHDADLQDCLRRWNAADGGGLGGGAAAPVTASVCDVSVRGDREALVAAARAALGGRLDILVNNVGQTLFGAAAACAAEDYARIMATNLESCFHLAQLAHPLLLGAGGAAASVVNISSVAGFIAYPALSVYSATKGAMNQLTRSLAAEWARDGIRVNCVAPGGVRTDIAGSSGVALEPGAARAMEEREAARVVMGRIGEPEEVASLVAFLCMPAAPYITGQVICVDGGRTITA

SEQ ID NO: 94190 - protein, 217 aa, Bacillus anthracis str. A2012
MEGKTMSVNTTFDTIEADYLKRSCSMSMTEICLVRHGQTDWNFQEIIQGREDIPLNEVGKKQASQSAAALQAEAWDVIISSPLIRAQETAKEIAEATGLQSILLDERFVERNFGEASGKPVATVRELIAEGKVEGMEQDEEIVARCFAAVKDVAETHSGKRIIIVAHSHAIKAILHAIAPEDITFKTPLKNACISYVNENSGKWDVLKYNIAEHIHV

SEQ ID NO: 94191 - protein, 557 aa, Staphylococcus aureus subsp. aureus MRSA252
MALSTFKREHIKKNLRNDEYDLVIIGGGITGAGIALDASERGMKVALVEMQDFAQGTSSRSTKLVHGGLRYLKQFQIGVVAETGKERAIVYENGPHVTTPEWMLLPMHKGGTFGKFSTSIGLGMYDRLAGVKKSERKKMLSKKETLAKEPLVKKEGLKGGGYYVEYRTDDARLTIEVMKRAAEKGAEIINYTKSEHFTYDKNQQVNGVNVIDKLTNENYTIKAKKVVNAAGPWVDDVRSGDYARNNKKLRLTKGVHVVIDQSKFPLGQAVYFDTEKDGRMIFAIPREGKAYVGTTDTFYDNIKSSPLTTQEDRDYLIDAINYMFPSVNVTDEDIESTWAGIRPLIYEEGKDPSEISRKDEIWEGKSGLLTIAGGKLTGYRHMAQDIVDLVSKRLKKDYGLTFSPCNTKGLAISGGDVGGSKNFDAFVEQKVDVAKGFGIDEDVARRLASKYGSNVDELFNIAQTSQYHDSKLPLEIYVELVYSIQQEMVYKPNDFLVRRSGKMYFNIKDVLDYKDSIIDIMADMLDYSPAQIEAYTEEVEQAIKEAQHGNNQPAVKE

SEQ ID NO: 94192 - protein, 200 aa, Synechococcus sp. RS9917
MTANGCLRVGQQAPDFTATAVVDQEFKEISLSQYRGKYVVLFFYPLDFTFVCPTEITAFSDRYADFSSKNTEVLGVSVDSQFSHLAWIQTPRNQGGLGDIAYPLVADLKKEIASAYNVLDEEEGVALRGLFIIDPEGVIMHATINNLPVGRNVDETLRVLQAFQYVQSHPDEVCPANWTPGEKTMKPDPVGSKEFFAAVN

SEQ ID NO: 94193 - protein, 471 aa, Ralstonia solanacearum GMI1000
MSQSIADVMKLVKENDVKFVDFRFTDTKGKEQHVSVPVSHFGEDKFESGHAFDGSSIAGWKGIEASDMLLMPDANTAHIDPFYEEPTLVMTCDVIEPSDGKGYDRDPRSIAKRAEAYLKSTGLGDTAYFGPEPEFFIFDGVTWNVDMQGSFVKIHSEEAPWSSGKEFEHGNSGHRPGKKGGYFPVAPIDTFQDIRSEMCLILESLGIPVEVHHHEVAGQGQNEIGTKFSTLVQRADWTQLQKYVIQNVAHTYGKTATFMPKPVVGDNGSGMHVHQSVWKDGQNLFAGNGYAGLSEFALYYIGGIIKHARALNAITNPGTNSYKRLVPGFEAPVKLAYSARNRSASIRIPYVANPKGRRIETRFPDPLCNPYLGFAALLMAGLDGVQNKIHPGEAADKNLYDLPPEEDAKIPTVCSSLDQALEYLDKDREFLTRGGVFTNSMIDAYIELKMEEVTRFRMTTHPVEFEMYYSL

SEQ ID NO: 94194 - protein, 379 aa, Arabis procurrens
MITTGQIIRCKAAVAWEAGKPLVMEEVEVAPPQKHEVRIKILFTSLCHTDVYFWEAKGQTPLFPRIFGHEAGGIVESIGEGVTDLAPGDHVLPIFTGECGDWPHCHSEESNMCDLLRINTERGGMIHDGESRFSINGKPIHHFVGTSTFSEYTVIHSGQVAKINPDAPLDKVCIVSCGLSTGLEAPLNVANPKKGQSVAIFGLGAVGLAAVEGARIAGASRIIGVDLNSKRFDEAKKFGVTEFVNPKDHDKLVQQVIAEMTNGGVDRSVECTGSVQAMIQAFECVHDGWGVAVLVGVPSKDDAFKTHPMNFLNERTLKGTFFGNYKPKTDIPGLVEKYMNKELEIEKFITHTVPFSEINKAFDYMMKGEGIRCIITMGA

SEQ ID NO: 94195 - protein, 379 aa, Arabis procurrens
MITTGQIIRCKAAVAWEAGKPLVMEEVEVAPPQKHEVRIKILFTSLCHTDVYFWEAKGQTPLFPRIFGHEAGGVVESVGESVTDLAPGDHVLPIFTGECGDCPHCHSEESNMCDLLRINTERGVMIHDGESRFSIDGKPIYHFVGTSTFSEYTVIHSGQVAKINPDAPLDKVCIVSCGLSTGLGATLNVAKPKKGQSVAIFGLGAAGLAAAEGARIAGASRIIGVDLNSKRFDEAKKFGVTEFVNPRDHDKPVQQVIAEMTDGGVDRSVECTGSVQAMIQAFECVHDGWGVAVLVGVPSKDDAFKTDPMNFLNERTLKGTFFGNYKPKTDIPGLVEKYMNKELEIEKFITHTVPFSEINKAFDYMLKGKGIRCIITMGA

SEQ ID NO: 94196 - protein, 207 aa, Pseudomonas cichorii
QQIVTLTYPHIGNTGTTPEDAESNRVWSAGLVIRDLPLVSSNWRNKQPLDEYLKANNVVAIAGIDTRRLTRILREKGAQNGCIIAGDNISEEAAIAAARGFPGLKGMDLAKEVSTKESYEWRSSVWSLKTDSHPEIAAAELPYHVVAYDYGVKVNILRMLVERGCRVTVVPAQTPASDVLAYSPDGVFLSNGPGDPEPCDYAIKAIK

SEQ ID NO: 94197 - protein, 379 aa, Arabidopsis thaliana
MSTTGQIIRCKAAVAWEAGKPLVIEEVEVAPPQKHEVRIKILFTSLCHTDVYFWEAKGQTPLFPRIFGHEAGGIVESVGEGVTDLQPGDHVLPIFTGECGDCRHCKSEESNMCDLLRINTERGGMIHDGESRFSINGKPIYHFLGTSTFSEYTVVHSGQVAKINPDAPLDKVCIVSCGLSTGLGATLNVAKPKKGQSVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 94198 - protein, 307 aa, Zea mays
MAFSPPLIDWEAESYPAYPDFAAIPLFVVFFLVVRFFLDRFVFEWLARKLIFKEEDEKKLGPTTYAGKRKIRKFKESAWKCMYFLSGELLALSVTYNEPWFTTTRNFWVGPGDQIWPDQKIKLKLKTVYMYVAGFYTYSIFALLFWEIRRSDFGISMTHHVATVCLIALSYIFRFARVGSVVLAIHDATDVFLELGKISKYSGHELFADVSFLVFVSSWVLLRLIYYPFWILWSTSYEVVLTLDKEKHKVDGPIYYYVFNSLLFSLLVLHIYWWVLMYRMLVKQIQSRGHVGDDIRSDSEGEEEHED

SEQ ID NO: 94199 - protein, 208 aa, Pseudomonas flavescens
QQIVTLTYPHIGNTGTTPIDADSDRVWAAGLIIRDLPLTASNWRNKQSLPDYLKENGTVAIAGIDTRRLTRILREKGSQNGCILVGTEATEEKALELARGFPGLKGMDLAKEVSCSERYEWRSSVWGLKDVGHPEIAASKLPYHVVAYDYGVKLNILRMLVARGCRLTVVPAQTPAKDVLALNPDGVFLSNGPGDPEPFDYAIQAIKY

SEQ ID NO: 94200 - protein, 379 aa, Pseudoturritis turrita
MITTGQIIRCKAAVAWEAGKPLVMEVVEVAPPQKHEVRIKILFTSLCHTDVYFWEAKGQTPLFPRIFGHEAGGIVESVGEGVTDLQPGDHVLPIFTGECGDCRHCHSEESNMCDLLRINTERGVMIHGGESRFSINGKPIYHFLGTSTFSEYTVVHSGQVAKINPEAPLDKVCIVSCGLSTGLGATLNVAKPKKGHSVAIFGLGAVGLAAAEGARISGASRIIGVDLNPKRFEEAKKFGVTEFVNPRDHDKPVQQVIAEMTDGGVDRSVECTGSVQAMIQAFECVHDGWGVAVLVGVPSKDDAFKTHPMNFLNERTLKGTFFGNYKPKTDIPGVVEKYMNKELEIEKFITHTVPFSEINKAFDYMLKGEGIRCIITMGA

SEQ ID NO: 94201 - protein, 934 aa, Myxococcus xanthus DK 1622
MGGRRLPPERAHDQRRVGMCASEVHPSGRTAAVQSPRRRGSQALASEGKHHTSPCPPSGPVTASEVSMAIRYALPNGLTVVFEEQHAAKVAAFQVWVKAGSADERPDQAGLAHLHEHMLFKGTERRGPGEVARDVESHGGEINAWTSYDQTVYHIVIASQFARMGLDILGDAVRRSAFDAGELSREIEVVCEEIKRSQDTPSRRASRDLFSTAYQVHPYRLPVIGTDESVRSFTREKVLEFYHRHYTPKNLVLSVAGDLREAELREWVDDIFGGDWGRPYEGRVARAPEPVAAGRRILLRPDEVKEAYLHLAFGIPQADHEDVPALDVLAMIAGQGDASRLVREVKRRHNLVNDIHTFAYTPTDPGLFSASMTLQPANAVRALEEAARGLATLRATPVTAEELATAKALVEAEAVYQRETVQGVARKMGFYQSGMGSLEAEARYYEAVRNLTPEHLRAAAERYLRFDRAVVTGLLPEGTPLTEAQVHEVLDAVDRAPAAAPPERKPRKVAVSDSPVRILKGTSAGPSDIITEKLPSGATIVVRVEPAVPLFAIRAAFAGGLRYETPEDNGITTLLTRSITRGTPTHDAEEVSDLIDAYAGSLGGQGGRNSVGLRGEFLSRHFEPAFRLFADCLLNPSFPEAEVARERTLLLQDILTREDKPSSVAFDLFSKTIYRTHPYRMPTTGEQASVEKLTPELLRAWHAAHMDPSQLTLSVVGDVKVDEVMALAREYFGASRGKAAPPPKVSLEAPLEGPREAKKVLARAQAHLVLGFPGIRVGDPQQHALEVLSTVLSGQGGRLFVELRDKRSMAYSVSSFAIEGVDPGYFATYMGTSPEKVDAALAGIRAELERVRDEPIPAEELARAKQHLIGTHEIGLQRNGSRAALLALDTCYGLGLENFLHYADHVAKVSADDVREVARKIINFDRSALAVVGP

SEQ ID NO: 94202 - protein, 379 aa, Barbarea vulgaris
MITTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPEAPLDKVCIVSCGLSTGLGATLTVAKPKKGQSVAVFGLGAVGLGAAEGAKMAGASRIIGVDLNPKRFEEAKKFGVTEFVNPREHDKPVQQVIADMTNGGVDRSVECTGSVQAMIQAFECVHDGWGVAVLVGVPSKDDAFKTHPMNFLNERTLKGTFFGNYKPKTDIPGVVEMYMNKELELEKFITHTVPFSEINKAFDYMLKGESIRCIITMGA

SEQ ID NO: 94203 - protein, 208 aa, Pseudomonas fluorescens
QQIVTLTYPHIGNTGTTPEDVESDRVWSAGLVIRDLPLVASNWRNTMSLSDYLKANNVVAIAGIDTRRLTRILREKGSQNGCIMVGDNISEEAAIAAAQGFPGLKGMDLAKVVSVKEKYEWRSTVWDLKTDSHATIEAADLPYHVVAYDYGVKYNILRMLVERGCRVTVVPAQTPASDVLAMQPDGVFLSNGPGDPEPCDYAIQAIKD

SEQ ID NO: 94204 - protein, 345 aa, Coprinopsis cinerea okayama7#130
MGLKSTDTPPNRLNPKGYKWAEHISTRLNTGLRPLTPILLIILFTSLFNQSPLGTHFYSWLNHHYTPFQINAYWSFGVTSIVYWVGGLVFLVGDLFQPRFLHQYKIQPAQHVSWGDYKKIMWVVARNQVGICFDYYLLVALPLSILNAYISPLPTGFPLPGTLETIWTYIFCLACEEIGFFYVHRTLHAPIFYKRFHKMHHEFVAPVAFASTYCTLTEHLFSNILPIILGISLLKAHWSLMIMFFSSLELATLSSHSGYNLPFNNNALQHDWHHFFYTENYGPTGLLDSLHGTNRVFKAWMGELRRRDGGGRVKEGEEVLREGRRELATGEVRGVTPPEMVDKED

SEQ ID NO: 94205 - protein, 326 aa, Triticum aestivum
  misc_feature (284)..(284): Xaa can be any naturally occurring amino acid
  misc_feature (298)..(298): Xaa can be any naturally occurring amino acid
MVSAGQAGADGPSTSDIRGTGNGAVENGHALKANEDKEWRGGSKEEDWPSTHSAPPGLDEHKQQQGRVIRWEKFLPVETLRVLLVENDDCTRHVVRALLRKCGYEVIAAENGLHAWHYLEDVQNRIDLVLTEVAMPCLSGIGLLSKITSHSICKGIPVIMMSKNDSMSTVFRCLSKGAVDFLVKPIRKNELKTLWQHIWRRCHSSSGSESGIHTQKCSKPKAGDEYENNSHDDDDDCGSHDDDDDDDDDADDDFSVGPNARDGSDNGSGTQSSWTKRAVEIDSXPQLVSSDHLADSPXSTCAPVTHPQIRDTHHSVPADRTLKPPP

SEQ ID NO: 94206 - protein, 208 aa, Pseudomonas fluorescens
QQIVTLTYPHIGNTGTTPQDVESNRVWSAGLVIRDLPLVASNWRSTMSLSDYLKANNVVAIAGIDTRRLTRILREKGSQNGCIMVGENISEAAAIAAAQGFPGLKGMDLAKVVSTQEQYDWRSTVWDLKTDSHATIDAADLPYHVVAYDYGIKYNILRMLVERGCRVTVVPAQTPASDVLALQPDGVFLSNGPGDPNPCDYAIKAIKD

SEQ ID NO: 94207 - protein, 60 aa, Zea mays
EPVAFMGGVFAGLLRLDLNEDPLKEWISRTVEASGIAEENSSEESSEADQNDAPQQIEIE

SEQ ID NO: 94208 - protein, 3739 aa, Streptomyces venezuelae
MSTVNEEKYLDYLRRATADLHEARGRLRELEAKAGEPVAIVGMACRLPGGVASPEDLWRLVAGGEDAISEFPQDRGWDVEGLYDPNPEATGKSYAREAGFLYEAGEFDADFFGISPREALAMDPQQRLLLEASWEAFEHAGIPAATARGTSVGVFTGVMYHDYATRLTDVPEGIEGYLGTGNSGSVASGRVAYTLGLEGPAVTVDTACSSSLVALHLAVQALRKGEVDMALAGGVTVMSTPSTFVEFSRQRGLAPDGRSKSFSSTADGTSWSEGVGVLLVERLSDARRKGHRILAVVRGTAVNQDGASSGLTAPNGPSQQRVIRRALADARLTTSDVDVVEAHGTGTRLGDPIEAQAVIATYGQGRDGEQPLRLGSLKSNIGHTQAAAGVSGVIKMVQAMRHGVLPKTLHVEKPTDQVDWSAGAVELLTEAMDWPDKGDGGLRRAAVSSFGVSGTNAHVVLEEAPAAEETPASEATPAVEPSVGAGLVPWLVSAKTPAALDAQIGRLAAFASQGRTDAADPGAVARVLAGGRAEFEHRAVVLGTGQDDFAQALTAPEGLIRGTPSDVGRVAFVFPGQGTQWAGMGAELLDVSKEFAAAMAECESALSRYVDWSLEAVVRQAPGAPTLERVDVVQPVTFAVMVSLAKVWQHHGVTPQAVVGHSQGEIAAAYVAGALTLDDAARVVTLRSKSIAAHLAGKGGMISLALSEEATRQRIENLHGLSIAAVNGPTATVVSGDPTQIQELAQACEADGVRARIIPVDYASHSAHVETIESELAEVLAGLSPRTPEVPFFSTLEGAWITEPVLDGTYWYRNLRHRVGFAPAVETLATDEGFTHFIEVSAHPVLTMTLPETVTGLGTLRREQGGQERLVTSLAEAWTNGLTIDWAPVLPTATGHHPELPTYAFQRRHYWLHDSPAVQGSVQDSWRYRIDWKRLAVADASERAGLSGRWLVVVPEDRSAEAAPVLAALSGAGADPVQLDVSPLGDRQRLAATLGEALAAAGGAVDGVLSLLAWDESAHPGHPAPFTRGTGATLTLVQALEDAGVAAPLWCVTHGAVSVGRADHVTSPAQAMVWGMGRVAALEHPERWGGLIDLPSDADRAALDRMTTVLAGGTGEDQVAVRASGLLARRLVRASLPAHGTASPWWQADGTVLVTGAEEPAAAEAARRLARDGAGHLLLHTTPSGSEGAEGTSGAAEDSGLAGLVAELADLGATATVVTCDLTDAEAAARLLAGVSDAHPLSAVLHLPPTVDSEPLAATDADALARVVTAKATAALHLDRLLREAAAAGGRPPVLVLFSSVAAIWGGAGQGAYAAGTAFLDALAGQHRADGPTVTSVAWSPWEGSRVTEGATGERLRRLGLRPLAPATALTALDTALGHGDTAVTIADVDWSSFAPGFTTARPGTLLADLPEARRALDEQQSTTAADDTVLSRELGALTGAEQQRRMQELVREHLAVVLNHPSPEAVDTGRAFRDLGFDSLTAVELRNRLKNATGLALPATLVFDYPTPRTLAEFLLAEILGEQAGAGEQLPVDGGVDDEPVAIVGMACRLPGGVASPEDLWRLVAGGEDAISGFPQDRGWDVEGLYDPDPDASGRTYCRAGGFLDEAGEFDADFFGISPREALAMDPQQRLLLETSWEAVEDAGIDPTSLQGQQVGVFAGTNGPHYEPLLRNTAEDLEGYVGTGNAASIMSGRVSYTLGLEGPAVTVDTACSSSLVALHLAVQALRKGECGLALAGGVTVMSTPTTFVEFSRQRGLAEDGRSKAFAASADGFGPAEGVGMLLVERLSDARRNGHRVLAVVRGSAVNQDGASNGLTAPNGPSQQRVIRRALADARLTTADVDVVEAHGTGTRLGDPIEAQALIATYGQGRDTEQPLRLGSLKSNIGHTQAAAGVSGIIKMVQAMRHGVLPKTLHVDRPSDQIDWSAGTVELLTEAMDWPRKQEGGLRRAAVSSFGISGTNAHIVLEEAPVDEDAPADEPSVGGVVPWLVSAKTPAALDAQIGRLAAFASQGRTDAADPGAVARVLAGGRAQFEHRAVALGTGQDDLAAALAAPEGLVRGVASGVGRVAFVFPGQGTQWAGMGAELLDVSKEFAAAMAECEAALAPYVDWSLEAVVRQAPGAPTLERVDVVQPVTFAVMVSLAKVWQHHGVTPQAVVGHSQGEIAAAYVAGALSLDDAARVVTLRSKSIGAHLAGQGGMLSLALSEAAVVERLAGFDGLSVAAVNGPTATVVSGDPTQIQELAQACEADGVRARIIPVDYASHSAHVETIESELADVLAGLSPQTPQVPFFSTLEGAWITEPALDGGYWYRNLRHRVGFAPAVETLATDEGFTHFVEVSAHPVLTMALPETVTGLGTLRRDNGGQHRLTTSLAEAWANGLTVDWASLLPTTTTHPDLPTYAFQTERYWPQPDLSAAGDITSAGLGAAEHPLLGAAVALADSDGCLLTGSLSLRTHPWLADHAVAGTVLLPGTAFVELAFRAGDQVGCDLVEELTLDAPLVLPRRGAVRVQLSVGASDESGRRTFGLYAHPEDAPGEAEWTRHATGVLAARADRTAPVADPEAWPPPGAEPVDVDGLYERFAANGYGYGPLFQGVRGVWRRGDEVFADVALPAEVAGAEGARFGLHPALLDAAVQAAGAGRGVRRGHAAAVRLERDLLYAVGATALRVRLAPAGPDTVSVSAADSSGQPVFAADSLTVLPVDPAQLAAFSDPTLDALHLLEWTAWDGAAQALPGAVVLGGDADGLAAALRAGGTEVLSFPDLTDLVEAVDRGETPAPATVLVACPAAGPDGPEHVREALHGSLALMQAWLADERFTDGRLVLVTRDAVAARSGDGLRSTGQAAVWGLGRSAQTESPGRFVLLDLAGEARTAGDATAGDGLTTGDATVGGTSGDAALGSALATALGSGEPQLALRDGALLVPRLARAAAPAAADGLAAADGLAALPLPAAPALWRLEPGTDGSLESLTAAPGDAETLAPEPLGPGQVRIAIRATGLNFRDVLIALGMYPDPALMGTEGAGVVTATGPGVTHLAPGDRVMGLLSGAYAPVVVADARTVARMPEGWTFAQGASVPVVFLTAVYALRDLADVKPGERLLVHSAAGGVGMAAVQLARHWGVEVHGTASHGKWDALRALGLDDAHIASSRTLDFESAFRAASGGAGMDVVLNSLAREFVDASLRLLGPGGRFVEMGKTDVRDAERVAADHPGVGYRAFDLGEAGPERIGEMLAEVIALFEDGVLRHLPVTTWDVRRARDAFRHVSQARHTGKVVLTMPSGLDPEGTVLLTGGTGALGGIVARHVVGEWGVRRLLLVSRRGTDAPGAGELVHELEALGADVSVAACDVADREALTAVLDSIPAEHPLTAVVHTAGVLSDGTLPSMTAEDVEHVLRPKVDAAFLLDELTSTPGYDLAAFVMFSSAAAVFGGAGQGAYAAANATLDALAWRRRTAGLPALSLGWGLWAETSGMTGGLSDTDRSRLARSGATPMDSELTLSLLDAAMRRDDPALVPIALDVAALRAQQRDGMLAPLLSGLTRGSRVGGAPVNQRRAAAGGAGEADTDLGGRLAAMTPDDRVAHLRDLVRTHVATVLGHGTPSRVDLERAFRDTGFDSLTAVELRNRLNAATGLRLPATLVFDHPTPGELAGHLLDELATAAGGSWAEGTGSGDTASATDRQTTAALAELDRLEGVLASLAPAAGGRPELAARLRALAAALGDDGDDATDLDEASDDDLFSFIDKELGDSDF

SEQ ID NO: 94209 - protein, 250 aa, Picea sitchensis
MAIGVAFGRFDEAFGLDGFKSYLAEFISTLLFVFAGVGSAMAYDKLTSSAALDPAGLVGVAICHGFALFVAVAIAANISGGHVNPAVTFGLVLGGQITILKGIFYWIAQLVGAIVACLLLKFVTGGLTTPTHNVAAGMSTIEGVVMEIVITFALVYTVYATAADPKKGSLGTIAPIAIGFIVGANILAAGPFSGGSMNPARSFGPAVVSGDFTNNWVYWFGPLVGGGLAGAVYGGVFIGSHSHAPLSQDY

SEQ ID NO: 94210 - protein, 60 aa, Brassica napus
MATNIGMMDSAYFVGRNEILGWINDRLHLNLSRIEEVASGAVQCQMLDMTFPGVVPMHKV

SEQ ID NO: 94211 - protein, 463 aa, Oryza sativa Indica Group
MQGGRIARRGLSRLAAAVETAAVAPPRMPDFNHVPLPYDGPSAAEIARKRAEFLSPSLFHFYSKPLNIVEGKMQYLFDESGRRYLDAFAGIATVCCGHCHPDVVGAIAAQAGRLQHSTVLYLNHAIADFAEALASKMPGDLKVVFFTNSGTEANELAIMMARLYTGSHDIISLRNSYHGNAAGTMGATAQKNWKFSVVQSGVHHAVNPDPYRGAFGSDAEKYARDVQEIIEFGTTGQVAGFISEAIQGVGGIVELSPGYLPLAYEAVRSAGGLCIADEVQAGFARVGSHFWGFETHGVVPDIVTMAKGIGNGIPLGAVVTTPEIAQVLTRRCYFNTFGGNPLCTAGGLAVLRVLEKEGLQANAHAVGSYLKDRLRALQDKHEIIGDVRGTGFMLGVELVTDRQLKTPAKDEICRAMEHMKEMGVLVGKGGFYGNVFRITPPLCFTKEDADFFVAVMDSALSKL

SEQ ID NO: 94212 - protein, 96 aa, Glycine max
  misc_feature (17)..(17): Xaa can be any naturally occurring amino acid
DSSMISYPADTTDNPAXAEMTAPFTDLNALHVLPTIKTNNELTSIASNPGKLLCMQVCTPLVNKKFETLSYLPDLDDATFEDEPEYLLMNGWIPCL

SEQ ID NO: 94213 - protein, 163 aa, Oryza sativa Indica Group
MIRRIQQYGHLSNTSILMDASKYIKELKQKVVRLNQEIACAQDALRQNRVTVETLRHGFLVNVFSGKSCPGLLVSILEAFDELGLSVLEATASCTDTFRLEAIGSENLMEKVDEHVVKQAVLRAIRSCSGSGGDHHDDDDDDDDDGWSREQAWSPVGEHRVAG

SEQ ID NO: 94214 - protein, 165 aa, Oryza sativa Indica Group
MIRRIQQYGHLSNTSIIMDASKYIKELKQKVVRLNQEIACAQDALRQNRVTVETLGHGFLVNVFSGKSCPGLLVSILEAFDELGLSVLEATASCTDTFRLEAIGSENLMEKVDEHVVKQAVLRAIRSCSGSGGDHHHHDDDDDDDDDGWSREQAWSPVGEHRVAG

SEQ ID NO: 94215 - protein, 121 aa, Brassica napus
MLCWSGSVKRKQKPGPFPVYLNVYDLTPMNAYGYWLGLGVFHSGVEVHGVEYAFGAHEYPSTGIFEVEPKKCPGFTFRKSILVGKTDTCARDVRVYMEKLAEEYRGNKYNLISRNCNHFRN

SEQ ID NO: 94216 - protein, 457 aa, Prochlorococcus marinus str. MIT 9303
MVLHSVLSVLSSHDVEVAETLIGVLNFLLIFVAARTLAELLVRLHLPTIVGELLAGVLIGASGLHLLVPPSAHVQLNEGLVSLISALASIPPEAVPDLYYETFPSLQAVATLGLYALLFLTGLESELEELVAVGVQAFTVAMAGVVLPFALGTFGLMALFQVELIPAIFAGASMTATSIGITASVFGELGYLKTREGQIVIGAAVLDDILGIVILAVVVALATGGSLEIAPIVKLVAAATVFVVLAIALSRTAAPAFDWVIDRLKAPGAVVVASFVILVFCCFVATAIGLEAALGAFAAGLILSSSKNNRAIQQSVLPIVTLFATIFFVLVGAGMDLSVINPLDPASRSALVVAGFLLVVAIVGKIAAGWAFWIDKPTNRLVVGLGMMPRGEVGLIFLGLGTSAGLLSPSLEAAVLLMVIGTTFLAPLLLRLVLRDKPPGGGNVIPDDVAANPVGLV

SEQ ID NO: 94217 - protein, 459 aa, Erwinia chrysanthemi
MSTLDVIDTRYPQLTQWLRRQQRQLAAYSPVTRQGQIIGISGILLESSLPNARIGDLCLVERSDSSQGAGRKSSVSAPETPSCRRWARWTASRRGPSFTPLYQPHCVQFRCTVRQRAGRLRPPLEEGGHRAFVEPGDLNANPMPVIGDAPPPTERPRIADPCPPVMRAIDGLLTIRLRPARRGVRRRRLRQNHPAGGTGAQHPMRRHCVRLNRRAWPRTARISRSRTGRTATQPHRAGLLHLRSQHMERARAAFTATAIAEAFRAAGKQVLLIIDSLTRFARAQREIGLALGEPQGRGGLPPSVYTLLPRLVERAGQTRQGAITALYSVLIEQDSMNDPVADEVRSLIDGHIVLSRRLAERNHYPAIDVLMSLSRTMSNVVEREHTRNANAVRRLMAAYKQVEMLIRLGEYQPGHDAFTDAAVSANDDINRFLQQAMREPQSFDFIQSQLAEVSQYANL

SEQ ID NO: 94218 - protein, 569 aa, Arabidopsis thaliana
MAVLIIFILLCLLSFLCYSLFFMKPKDSRDGRDLPPSPPSLPIIGHLHLILLSTLTHKSFQRLSSKYGPLLHLRIFHVPIVLASSASVAYEIFRDQDVNVSFRHSPPIEESLFLGSYSFISAPYGDYWKFMRKLMVTKILGPQALERSRRFREDELDRFYKTLLDKAMKKESVEIVEEAAKLNNNTICKMIMGRSCSEETGEAERIRGLVTESMALTKKIFLATIFHKPLKKLGISLFKKEIMSVSRKFDELLEKILVEHEEKMEEHHQGTDMMDVLLEAYRDENAEYKITRNHIKSMFVDLFIAGTDTSSTTIQWIMAEIINHPKILERLREEIDFVVGKTRLIQETDLPNLLYLQAIIKEGLRLHPPGPLLPRTVQERCEIKGFHIPEKTILVVNSYAIMRDPDFWEDPDEFKPERFLSISRSGQEDEIRDKFLKYIPFASGRRGCPGTNLAYASVGTAVGVMVQCFDWKIEGENVNMNEAAGTMVLTMAHPLKCTPVPRTLNLLPPYTFYKSIDNALEADFSKDTLIYQALESMSEGHALVDLNSTSISLKHIKKRTYIYFLKFVT

SEQ ID NO: 94219 - protein, 266 aa, Fusobacterium nucleatum subsp. vincentii ATCC 49256
MSRIFQENKIEAVMHFAGYIRVPESVDDPNKYYFNNTYTTMCLIQSMVKHNVKNIIFSSTAAVYGEIIEDQPIDEKHSTVPINPYGASKLMSERIILDCAKAYGLNYSIFRYFNVAGAHEKYPIGQKGEGVTSLITLTLQAAKDSNRVLEVFGDDFPTKDGTGIRDYIHVVDLVKAHVLSLKLLFKNESNIFNLGNGNGFSVLETVEAARKVTCKKISYKITGRRKGDPACVIASSKKAQKLLGWKTQYTNVEKIIETGWHFVENL

SEQ ID NO: 94220 - protein, 141 aa, Oryza sativa
GSGGKKSSSRGGPTPGTGRGRGFPKHVSRKDFPPSQNGVGKRSSDDIDILHPESLIKEVERVFSINNPDPLEVEKAKKVLKEQEQSLIDAIARLAEASDGESDEHNRVRRNAPYVGSQHQANYADAMAVDGGHMLGGADAV

SEQ ID NO: 94221 - protein, 208 aa, Pseudomonas fluorescens
QQIVTLTYPHIGNTGTTPEDVESDRVWSAGLVIRDLPLVASNWRNTMSLSDYLKANNVVAIAGIDTRRLTRILREKGSQNGCIMVGDNVSEAAAIAAAQGFPGLKGMDLAKVVSTKEQYEWRSTVWDLKTDSHATIEASELPYHVVAYDYGVKYNILRMLVERGCRVTVVPAQTPASDVLALQPDGVFLSNGPGDPEPCDYAIQAIKD

SEQ ID NO: 94222 - protein, 450 aa, Pseudomonas viridiflava
MVNAALDQWKAVQAARLSQYSAVRVSGRVSAVRGILLECKLPAAKVGDLCEVSKADGSLLLAEIVGFTPDCTLLSALGAPDGIQVGATIRPLGIAHRIGVDDSLLGCVLDGFGRPLLGDALGAFAGPDDRRTTLPVIADALPPTQRPRISRALPTGVRAIDSAILLGEGQRVGLFAGAGCGKTTLMAELARNMDCDVIVFGLIGERGRELREFLDHELDETLRSRSVLVCATSDRSSMERARAAFTATAIAEAFREKGQKVLLLLDSLTRFARAQREIGIASGEPLGRGGLPPSVYTLLPRLVERAGMSENGSITALYTVLIEQDSMNDPVADEVRSLLDGHIVLSRKLAERGHYPAIDVSASISRILSNVTGREHQRANNRLRQLMAAYKQVEMLLRLGEYQAGSDPVTDCAVKLNEDINAFLRQDLREPVPLEETLNALLRITSQLPE

SEQ ID NO: 94223 - protein, 495 aa, Pseudomonas sp. MT-1
MRVSTLFEWKRPEIRALHLTWIAFYICFFVWFGMAPLASSMLKSVNWLTPEDLKLFAIANVALTIPARILVGMALDHWGPRRVFSVLLVTMAAPALFFAFGDSRTQLLVSRLILGSIGASFVVGIHMTAMWFKPKDIGFAEGFYAGWGNFGSAAAAMSLPAIAIHAFGGPEGWRWAIASSAIIMAVYGVYYWFALTDGPVGTIHRKPHKASALEVSTWADMVKLIIWTIPMVGVLGILVWRIEGLGYLGATGAAICYSVIALVVIFQVVQILRVNIPILKKGVPEDDKYPFNTVAALNSTYFANFGAELAVVSMLPMFFELTWGLTPTTAGIIAASFAFVNLVARPMGGLVSDRFGNRRFVMLAYMLGIAVGFFLMGLMNASWPLIVAVAITVACSMFVQGAEGATFGIIPSIKRRVTGQISGMAGAYGNVGAVCYLTLYTFVTPSQFFMVIAAGAFVSFGLCLLWLKEPEGAFSDEYYVSSVDRELEARQKLAS

SEQ ID NO: 94224 - protein, 232 aa, Oryza sativa Japonica Group
MGAREYYDYRRAIYGDITHKAILVDAAGTLLAPTEPMAQVYRTIGEKYGVNYSEDEILMRYRRAYAQPWGRSRLRYVDDGRPFWQHIVSSSTGCSDLQYFEELYQYYTTAKAWQLCDPDAKYVFEALRKAGVKTAVVSNFDTRLRPLLQALNCDHWFDAVAVSAEVAAEKPNPTIFLKACEFLGVKPEEAVHIGDDRRNDLWGARDAGCDAWLWGSDVYSFKEVAERIGVKV

SEQ ID NO: 94225 - protein, 222 aa, Zea mays
MDVDGPAPADASARPATNGEAPSGAREVDVGEEDTLAGVLRSFVDGVWYPDEPLLRRLRAASCDAAPRLRGASRNSARDLLEWTRRGSGLRAILVISVGTITLIALTGLLTFMFFLLVATANAIIVSVLMSLAAAGGFLAIFFACLVAVYIGAVSVAIFVISATVISAVVGILVATGWVGFFWIIWFTARKSMVLTKHSFGMTSSAIQSYSASRQVKQKPVD

SEQ ID NO: 94226 - protein, 208 aa, Pseudomonas fluorescens
QQIVTLTYPHIGNTGTTPEDAESDRVWSAGLVIRDLPLVASNWRNTMSLSDYLKANNVVAIAGMDTRRLTRILREKGAQNGCIMAGDNISEEAAIAAAQSFPGLKGMDLAKVVSTKEKYEWRSTVWDLKTDSHATLEASELPYHVVAYDYGVKLNILRMLVERGCRVTVVPAQTPAAEALALKPDGVFLSNGPGDPEPCDYAIQAIKD

SEQ ID NO: 94227 - protein, 418 aa, Ralstonia solanacearum GMI1000
MAIVDVKVPQFSESVEEGTLISWKKKPGEAVTVDEVLVEIETDKVVLEVPAPSAGVLAEVLVADGATVTSEQLLAKIDTEGKAGAAAPAAAAPAPAAAAPAPVAAAPAAAAATGGVAMPSAAKLMAEANLSAGQVAGTGRDGRITKGDVLGAVAGGAKPAPAAAPQAARPALQQVAAPVDFAVLGDRPEERVPMSRLRARIAERLVQSQSTNAILTTFNEVNMKPVMDLRAKFKDQFEKTHGVKLGFMSFFVKAAVHALKKYPVINASVDGNDIVYHGYFDIGIAVGSPRGLVVPILRNADQMSLADIEKKIAEFGQKARDGKLTLDDLTGGTFSISNGGTFGSMLSTPIINPPQSAILGVHATKDRAVVENGQVVVRPMNYLAMSYDHRIIDGREAVLGLVAMKEALEDPARLLLDL

SEQ ID NO: 94228 - protein, 501 aa, Oryza sativa Japonica Group
METRELWVLAAALAVSLLYYLAALMRYAGGGCSRSSRPPLPPGPTPLPLIGNLLSLRGVLHHRLASLARVHGPVMALRLGLTTAVVVSSRDAAAEAFTKHDRRLAARVVPDSNRAHGFSDRSIIWLPSSDPRWKALRGIQATHLFSPRGLAAVRSVRESKVRDIVAYFRSRAGEEVVFGEAIYSGVLNLVSSSFFSVNMAGVGSEEAHGLRELVEDLVEAIAKPNVSDLFPFLRQLDLQGLRRRTEERMARAFGILDGIIDRRLANRTHGDRHGDFLDALLDLVSEGKMARDHVTIMLFEVFGAGSDTMSVSLEWAMAELLRNPRAMRKARAELEDAAAVVEESDAARLPYLQAVVKEAMRLHPVGPILLPHRAVEDGVEIGGYAVPRGAMVIFNAWAIMRDPAAWERPDEFVPERFMETTTAIDFRGKEYEYLPFGSGRRLCPGLPLAERVVPFVLASLLRAFEWRLPDGVSAEDLDVSERFNTANVLAVPLKVVPVIVN

SEQ ID NO: 94229 - protein, 208 aa, Pseudomonas fluorescens
QQIVTLTYPHIGNTGTTPEDVESDRVWSAGLVIRDLPLVASNWRNTMSLSDYLKANNVVAIAGIDTRRLTRILREKGSQNGCIMVGDNISEEAAIAAAQGFPGLKGMDLAKVVSVKEKYEWRSTVWDLKTDSHATIDAADLPYHVVAYDYGVKYNILRMLVERGCRVTVVPAQTPASDVLALQPDGVFLSNGPGDPEPCDYAIQAIKD

SEQ ID NO: 94230 - protein, 274 aa, Hyoscyamus niger
MAGESEVYINGNNGGIRWSLKGTTALVTGGSKGIGYAVVEELAGLGARVYTCSRNEKELQQCLDIWRNEGLQVEGSVCDLLLRSERDKLMQTVADLFNGKLNILVNNAGVVIHKEAKDFTKEDYDIVLGTNFEAAYHLCQLAYPFLKASQNGNVIFLSSIAGFSALPSVSLYSASKAAINQITKNLACEWAKDNIRVNSVAPGVILTPLIETAIKKNPHQKEEIDNFIVKTPMGRAGKPNEVSALIAFLCFPAASYITGQIIWADGGFTANGGF

SEQ ID NO: 94231 - protein, 375 aa, Zea mays
MGMWKFLPQGKNSPPTGSKRKEAAPIVGAVAVAFLCLVILTSFLACRYGLLPFKSKNKPGTRIESFLQKNESIHPKRYTYADVKRMTKSFAVKLGQGGFGAVYKGSLHDGRQVAVKMLKDTQGDGEEFMNEVASISRTSHVNVVTLLGFCLQGSKRALIYEYMPNGSLERYAFTGDMNSENLLTWERLFDIAIGTARGLEYLHRGCNTRIVHFDIKPHNILLDQDFCPKISDFGLAKLCLNKESAISIVGARGTIGYIAPEVYSKQFGTISSKSDVYSYGMMVLEMVGARDRNTSADSDHSSQYFPQWLYEHLDDYCVGASEINGETTELVRKMIVVGLWCIQVIPTDRPTMTRVVEMLEGSTSNLELPPRVLLS

SEQ ID NO: 94232 - protein, 500 aa, Oryza sativa Japonica Group
MENSQMWLLWGALSVALFFYFSTLRRRYAGGKPLPPGPTPLPLIGNLHLVGGGTFHHKLRDLARVHGPVMTLKLGLATNVVISSREAAIEAYTKYDRHLAARATPDTFRACGFADRSMVFIPSSDPQWKALRGIHASHVFTPRVLAAVRPIRERKVGDLIAYLRAHAGEEVLVGHAMYTGILNMVSFSYFSVDIVDMGSQMARELREVVDDIILVVGKPNVSDFYPFLRPLDLQGLRRWTTKRFNRVFSIMGDIIDRRLAHIRDNKPRHDDFLDSILELMAAGKIDRVNVLNMLFEAFVAGADTMALTLEWVMAELLKNPSVMAKARAELRDVLGDKEIVEEADAARLPYLQAVLKEAMRLHPVGALLLPHFAMEDGVEVGGYAVPKGSTVLFNAWAIMRDAAAWERPDEFVPERFVERTPQLDFRGKDVEFMPFGSGRRLCPGLPLAERVVPFILASMLHTFEWELPGGMTAEELDVSEKFKTANVLAVPLKAVPVLIK

SEQ ID NO: 94233 - protein, 208 aa, Pseudomonas fluorescens
QQIVTLTYPHIGNTGTTPEDVESDRVWSAGLVIRDLPLVASNWRNTMSLSDYLKANNVVAIAGIDTRRLTRILREKGSQNGCIMVGDNISEEAAIAAAQGFPGLKGMDLAKVVSVKEKYEWRSTVWDLKTDSHATIEASELPYHVVAYDYGVKYNILRMLVARGCRVTVVPAQTPASDVLAMQPDGVFLSNGPGDPEPCDYAIKAIKE

SEQ ID NO: 94234 - protein, 477 aa, Vitis pseudoreticulata
MYETDVGIITGKTFPTFDPRTGEVIANVAEGDAEDINRAVSAARKAFDEGPWPRMSPYERSRILLRFADLAEKHNDELAALETWNNGKPYEQAAKAELPLFVRLFRYYAGWADKIHGLTVQADGPHHVQILHEPIGVAGQIIPWNFPLMMFAWKVGPALACGNTIVLKTAEQTPLTALFAAKLFHEAGLPPGVLNIVSGYGPTAGAALASHMDVDKIAFTGSTDTGKIVQELAAKSNLKPVTLELGGKSPFIVCEDADIDQAVELAHFALFFNQGQCCCAGSRTFVHESVYDEFIEKAKARALSRTVGDPFKKGIEQGPQIDPEQFAKVLRYIKSGVESNATLECGGGRIGSKGYFVQPTVFSNVQDDMLIAKDEIFGPVQSILKYKDLDEVIRRANSTRYGLAAGVFTKNINTANTLTRALRVGTVWVNCFDVFDAAIPFGGYKMSGVGREKGIYNLNNYLQVKAVITPLRNPAWL

SEQ ID NO: 94235 - protein, 356 aa, Streptococcus agalactiae 2603V/R
MAKKLLILEDGTVFEGLSFGSSLDVTGELVFCTGNTGYQEIITNPSHNGKILVFTSPLIGNYGIHRSYSEAIIPTCLGVVVAEYSRCVSSDTSKMNLDEFLKMKKVPAMSGVDTRYLMQVIKEKGFVKATLAEAGDVLSHLQDQLIATVLPTNNVEQVSTKTAYPSPASGRNIVVLDFGLKHSILRELSKRQCDVTVIPYNTSLEGIKNLYPEGIILSNGPGNPEKLQEILNTIKELQKSVPMLGIGLGHQLIAMANGAEIMRLPVAKKGPNYPMRDIATGRLETVSQFNHFTVNRLNLPHDLLVTHEGLNDQEIVALRHRSFPVMSVQFYPEAAPGPHDVTYFFDEFLEMIGSRA

SEQ ID NO: 94236 - protein, 208 aa, Pseudomonas marginalis
QQIVTLTYPHIGNTGTTPEDVESDRVWSAGLVIRDLPLVASNWRNTMSLSDYLKANNVVAIAGIDTRRLTRILREKGSQNGCIMVGDNISEEAAIAAAQGFPGLKGMDLAKVVSVKEKYEWRSTVWDLKTDSHATIDAAELPYHVVAYDYGVKYNILRMLVERGCRVTVVPAQTPASDVLALQPDGVFLSNGPGDPEPCDYAIQAIKE

SEQ ID NO: 94237 - protein, 501 aa, Campylobacter jejuni RM1221
MMANLYLMRSRSDELNTIISTNLLKNYSKIYKNIAIYCPVIYIHRVPVLQGWLEEFNINQTVKSAYGFTFREAMEEFSKDPHNFFNVILEEYEELKRKYDFVLVNSFCEFGILDGFDLSIKLAKNLNTPIAAIINDEDKLIAQKYFDHALDGRNYVLINENFNFEEVQKLKEYDFITPHRFKYELIKQSIKNKKTVVLPESNDERILKAAEILLKSKVVDLILLGDEEKIKQDATRLSLDLSAMQIMNPLNSEYNQEFTSILYEARKSKGMSLEEAKMLVQDKTYFGTLLIHTGKADAMVSGASTTTAETIRPALQLIKTKEGISSVSGIFFMGLEDQVLAFADCAVNPSPTAEQLATSAYVSAMTAKSFGLEPRIALLSYSSGDSGKGESVDLVKEALKIAKEKYPELNIDGPMQFDCAYDPKTAAKKMPNSKIAGHANVYIFPDLNAANICYKAVQRTANALAIGPILQGLKKPVNDLSRGCLVDDIVDTVILSAIQAQ

SEQ ID NO: 94238 - protein, 293 aa, Triticum aestivum
  misc_feature (52)..(52): Xaa can be any naturally occurring amino acid
  misc_feature (70)..(70): Xaa can be any naturally occurring amino acid
  misc_feature (239)..(239): Xaa can be any naturally occurring amino acid
  misc_feature (280)..(280): Xaa can be any naturally occurring amino acid
MAPIKIGINGFGRIGRLVARVALQSPDVELVAVNDPFITTDYMTYMFKYDTXVHGQWKHHEVKVKDSKTXLLFGEKEVAVFGCRNPEEIPWAAAGAEYVVESTGVFTDKDKAAAHIKGGAKKVIISAPSKDAPMFVCGVNEKEYKSDIDIVSNASCTTNCLAPLAKVINDRFGIVEGLMTTVHAMTATQKTVDGPSSKDWRGGRAASFNIIPSSTGAAKAVGKVLPELNGKLTGMAFRXFPPVDVSVVDLTVRLAKPATYDQIKAAIKGGVWRKPLRGFXGYVDEDLVSLTSR

SEQ ID NO: 94239 - protein, 351 aa, Physcomitrella patens subsp. patens
MTDITWRYQFMYHTNDQSIEMYDIKNQKTFLKRVAYPAITLEQLYIGSTILVYTRQLLIEDYGDEFTRKHLRGLQETTCAMIKPDAICNAGKILECITRNGLLIKHMRMCQLSRKQAEEFYNVHQGKPFYESLIQLISNGPVIAMELVGENALCRWRLLLGPTSTEVARIKAPSSIRAQFGTDTTMNACHGSDSHENARIVLEYGHVRPLQKLHPVHHQATCRHVWYGTRIFLPFKVTQILMSMTHELASGDFIILEIVDKENPCSNPVNKFREFCGPADSCIARALRPRSLRAEFGINKVKNAVHCTDIPDDGELERTAPIVLVSFGLSKSLILKWYWRTCASPGSRRIY

SEQ ID NO: 94240 - protein, 814 aa, Kluyveromyces lactis NRRL Y-1140
MVKPRPRKNGLSQSLETKISDLIYRMLDEKSLEKQRENAKKRELLERSDVQSDDSSLEELNTELADIFLAKDLRFPEVLAFCQSKDLSLQRVKKVLLEKTIQKALLQVIDDELEEMGPLMDQEKPESNEEVLSDKNLMFTPNSNDLNKDITSQWQVSKLEKEETTEGKKLIKKRAKDEPKDKIKRQKKDDRSPPSSNLSTLGGMDDVIAQLMELIGLPILHPEIYSATGVEPPRGVLLHGPPGCGKTSIANALAGELQVPFISISAPSVVSGMSGESEKKIRELFDEAKSLAPCLVFFDEIDAITPKRDGGAQREMERRIVAQLLTSMDELSFEKMEGKPVIVIGATNRPDSLDAALRRAGRFDREICLNVPNETSRYFILKKMASSLKIDGEIDFIKLAKLTPGFVGADLKALITAAGTCAIKRIFQNYAGSNDVDMDIDIDAETQLKNTANMIDPLPLSIIQRFIDNFPDALTAEQLQGLFIKYEDFLKALPTIQPTAKREGFATVPDVTWSSVGALDKIRIELNMAIVQPIKRPELYEKVGISAPAGVLLWGPPGCGKTLLAKAVANESRANFISIKGPELLNKYVGESERAIRQVFNRARASVPCIIFFDELDALVPRRDASLSESSSRVVNTLLTELDGLNDRRGIFVVGATNRPDMIDPAMLRPGRLDKTLFIELPNFEEKVDIMRTLIRSNGTPIADDVDINRIVNDERCKNFSGADIAALVRESSVLALKRNFFKTDEIMSVGENNLDKEFEDLTTNSPTEDVIVYMKDFENALKKVKPSVSDKDRTRYDRLNKRMGWNDSSDGSE

SEQ ID NO: 94241 - protein, 239 aa, Thiobacillus denitrificans ATCC 25259
MPKGKSKSAARLPVFDLNGRDGVPDVRIVGFKAHNLIRMAAMGLPVPQGFVMGTDWCGAIRNGEGVKVHLPDALQSGIRDLERATGLGFGSARRPLLVSVRSGAPVSMPGMMETVLNVGLNDVSLAGLLRLTGDHRLVWDSYRRLIQAFAEIVAVIPAEPFEAALDATLRRAGADVARQLDFQALRDLAHIYLDLYHGHTGREFPQDPFEQLWMACRRLKALLGKVISNCIKFWKALET

SEQ ID NO: 94242 - protein, 637 aa, Halobacterium sp. NRC-1
MLARQRARRDTTGGCAMSSGIIPVVATIIALGVLSQVVADKLQVPSVLFLILAGIVVGPEVLGVVTLSSFGGIDTLAGIVGLSVAVIVFEGAFHLKLEKLREAPGAWLRLVTVGAAIALFGTAIVVRVLLGTGWDVAFLIGSLLVATGPTVITPILSVVPVRDRVGAALETEGVVNDVTAAILAIVVFRVVENPQRSVDVVLQDFVTRLGTGVLVGLVVAAVVWYILRRIDLSKGNAPQNARLVVLAGALVAYGAADTLYSEAGIAAVATAGVLLGNADLPYEKEIEAFKGDVTLVVLSFVFIGLAALLSFQTLLDLGVAGLAVAVLVALVIRPLAVFASTARSRYTSAERVFMSAVGPRGIIPASVATLFAVELQGYGMPQAANVLVGTVFLTILLTVVFEGGFARHIAQALNVIPMRVIIVGGGTVGRALAERLEDRGENVVLVEDDPEAVERARNEGYTVHSGDGSDTDELRAAGAENAKILTAATGDDDVNLLVAQLADSKFDIDTIIARANNPDNIDAFEDLGVSTVSSSLATAWGIDNIIERPALSNWMTEIGRSGDVQEVEVTSEELVGLTIADLDDDLPGGVIIALAGRDGDNQVPNPEFTIQHGDHLTFLGRKEAVRDALNWCHPDDG

SEQ ID NO: 94243 - protein, 484 aa, Prochlorococcus marinus str. MIT 9303
MATPPLIPVILCGGTGTRLWPLSRASYPKQYWALSGSSEETLLQQTQQRLKGIEGLSAPLLICNEEHRFIVAEQMRQIDVEPNAILLEPMGRNTAPAVTVAALQATERGEDPLLLVLAADHVIRDATQFRHVIEAGRIPAEAGRLVTFGIVPTAPETGYGYIEAAESFGNGEPKALPIARFVEKPDRIAAEQFLANGCFTWNSGMFMFKASAILSELERLSPEVVSCCRAALEQEVPDLDFLRLEREAFAKCPNVAIDVAVMEKTELGTVLPLDAGWSDVGSWSALWDTTDRDLNGNVLRGHVIAESSRNCYLRSEHRLVVGLGVEDLVVVETDDAVLIANRSQAQDVKTIVKQLEADGSPEGKAHRKIYRPWGHYTSVVKDSRWQVKRIELKPGASLSLQMHHHRAEHWIVVKGTALVEKDGEKQLVGENQSTYIPLGCKHRLTNPGRMPMELIEVQSGPYLCEDDIVRFEDRYGRNESVIVN

SEQ ID NO: 94244 - protein, 287 aa, Bradyrhizobium sp. BTAi1
MTSDRDILALGDLDGADILGMLTRAQELAACWHAREMPQTLAGRRIALVVDDGGWRNTTAFDLGARSMGGLCVHVPIRLNATEAAEDLAAYLDNWFDAVVCRTPELEMLYALSHWAQAPVVNARTRQNHPCETLGDLAFLWHRHGAIDGLKIAVVAPAANILGSWIEAAQVLPIEVVQVYPARWHAPGESPRFRVATDLGELQDADVIITDCWPRDDDAGDLQDYQITAALLDGLRPDLDFLPCPPVTRGMEVSGDAMLHRACRVVQAKAFLLHAQNAALEWVFGAL

SEQ ID NO: 94245 - protein, 459 aa, Glycine max
MDGKKLEYKGEEALKEIERLTMKAAEVQEGLLKQILTQNRETEYLSKYMRGEKNITDVAEFKRCVPVITYERIFPYIQRIANGEDSTLITSHPITEMLCSSGTSAGEPKMMPSIVEDLERRTFVYNLITPIINQYVSDLDEGKAMYLYFVKAEMCTPCGLPARTVLTSYYKSKHFKCRTHDPWNDYTSPDQTILCNDSNQSMHCQLLSGLVHRRHVLRLGAVFASALLRAISFLERNWRHLCEDIRTGQLSSFITDPSCRSCMSTLLSSPDPRLADEITRICSQKSWKGILCQLWPKAKFIEAVVTGSMAQYVPALKHYSDGKLPLVCTMYASSECYFGVNLKPLCDPGDVAFTLLPNMGYFEFLPLGHNGTLLMDFDEGEQVPNDKLVDLVHVKLGCFYEPVVTTFAGLYRYRVGDVLQVVGFYNNAPQVRFICRRNVVISVDTEKTNEEDLHRGVTM

SEQ ID NO: 94246 - protein, 103 aa, Prochlorococcus marinus str. MIT 9303
MLPSPLLTPLPPARRMRRPVFTAMSQEAILEKVRSIVTEQLSVEAGEVKPESSFQNDLGADSLDTVELVMALEEAFDIEIPDEAAEGITTVGDAVKYIEDKQA

SEQ ID NO: 94247 - protein, 498 aa, Bradyrhizobium sp. BTAi1
MTPTAATRTTPSATASLRERLKDGSLLREQCYIDGSWVGVPVFPVNNPATGAELAKVAQLGAAETTQAVEAAARAFPAWAKLTAKQRSNLLRKWFELIVANREDLALILTSEQGKPLNEALGEVDIGAAYIEFFAEEARRVYGETIPTQKPDARLLALKQPIGVCGAITPWNFPNSMITRKVSPALAAGCTVVLKPANETPLSALALAVLAERAGIPKGVLNIITGDAPPIGKVLCEHPAVRFVGFTGSTEVGKILYRQSAGTVKKLGLELGGNAPFVVFDDADVDAAVEGAIVSKYRNMGQTCVCANRLYAQDGIYDAFVEKLAARVAAMKIGDGTEAGVVQGPLINEEAVEKVERHIADAVKGGATIVTGGKRHALGRTFFEPTVLSNVKADALVAHEETFGPLAPVIRFQSEADVIAMCNASPFGLASYFYARDLGRVWRVAEALESGMVGVNTGLITTEVAPFGGVKESGLGREGSHHGIEEYLEIKYVMMAGV

SEQ ID NO: 94248 - protein, 478 aa, Ralstonia solanacearum GMI1000
MSKQFDVLVIGAGPGGYIAAIRAGQLGLNVACCEDNAYDDPKGEPRLGGTCLNVGCIPSKALLASSEEFENVNHHLADHGITVDGARVDVAKMLKRKDDIVGKMTKGIEFLFRKNKVTLLKGHGKFVGKTDAGYQVEIAGKAGTEVVTAKHVIIATGSKARHLPGVPVDNVTIADNEGALKFGEVPKKLGVIGAGVIGLELGSVWRRLGSDVTILEALPSFLGAADESVAKEANKLLNKQGLKINVGVKVGEIESSAKGVKVNYTDATGAAQVLECDKLIVSIGRVPNTDNLGLDAIGLATDQRGFIEVDDHCATKLPNLWAIGDVVRGPMLAHKAEDEGVAVAERIVGQKPHIDYNCIPWVIYTFPEIAWVGKTEQQLKAEGREIKAGQFPFMANGRALGMGASDGFVKVIADAKTDEILGVHVVAANASDLIAEAVVAMEFKAAAEDIGRICHPHPSMSEVMREAALAVDKRQLNM

SEQ ID NO: 94249 - protein, 216 aa, Herminiimonas arsenicoxydans
MTEILLIRHGETDWNVEKRLQGHHDIDLNREGVRQVAALGRALLDEPLDAIFSSDLKRALGTAQGIAIPRGMSVQLHKGLRERCFGALEGLLHPEIHARYPDEYAAWKRRDIDANYPPGEFQAETLREFSARAIAAITGLANTPGCRKIAIVTHGGVLDSVYRHARNMGYEHPRDFDVLNASINRVSWDGAHFQILKWADVAHLAHATLDESDNAA

SEQ ID NO: 94250 - protein, 323 aa, Xylella fastidiosa Ann-1
MTVLVTGAAGFIGAHVCRALAARNDTVVGLDNYNAYYDPQLKRDRVTALCPDVHIRTLDLTDRERCAALFNEVQPDQVVHLAAQAGVRYSIENPHAYVDSNLVGFLNVLELCRHCRVQHLVYASSSSVYGDSAIPPFSEQQRVDQPRSLYGATKVANEVMAYSYAQLYGLRATGLRFFTVYGPWGRPDMAPLIFSRAVMEGRPIEVFNHGRMERDFTFINDIVAGVIGALDAPGEQAVPHRLFNLGNHTPVLLEHFIKVIEQAAGRPADKHYKPMQLGDMMATMADIAAARAAFGFEPVTSIEIGMPQVVEWCRHYFDTRAST

SEQ ID NO: 94251 - protein, 228 aa, Zea mays
MGVTPKIAPSMLSSDFANLASEAQRMLHFGADWLHMDIMDGHFVPNLTIGAPVIESLRKHTKGYLDCHLMVTNPLDYVEPLAKAGASGFTFHVETSKDNWEELIQRIKSHGMTPGVALKPGTPIEEVYPLVEAGNPVEMVLVMTVEPGFGGQKFMPEMMDKVRILRKKYPSLDIEVDGGLGPSTIDVAASAGANCIVAGSSVFGAPEPVQVISLLRNSVEKAQQTLIQ

SEQ ID NO: 94252 - protein, 378 aa, Haemophilus influenzae R2846
MEIKQINSTIKSRAAVAFAPNQPLQIVEIDVEMPRKGEVLIRNTHTGVCHTDAFTLSGSDPEGVFPVVLGHEGAGVVVAVGEGVLSVKPGNHVIPLYTAECGECEFCLSGKTNLCVSVRDTQGKGLMPDGTTRFSCQGKPIYHYMGCSTFSEYSVVAEVSLAKINPEANHEQVCLLGCGVTTGIGAVHNTAKVQEGDSVAVFGLGAIGLAVVQGARQAKAGRIIAIDTNPAKFELAKQFGATDCLNPNDYDKLIKDVLLDINKWGIDHTFECIGNVNVMRQALESAHRGWGQSIIIGVAGAGQEISTRPFQLVTGRVWKGSAFGGVKGRSELPQMVEDSMKGDIQLEPFVTHTMPLDQINEAFELMHEGKSIRTVIHY

SEQ ID NO: 94253 - protein, 208 aa, Pseudomonas mendocina
QQIVTLTYPHIGNTGTTPEDAESNRVWAAGLIIRDLPLISSNWRDKQPLDEYLKENGTVAIAGIDTRRLTRILREKGSQNGCILVGDDATEEKALELARSFPGLKGMDLAKEVTCDKPYEWRSSVWSLENDSHPEIAAADLPYHVVAYDYGVKLNILRMLVARSCRLTVVPAQTPASEVLALNPDGVFLSNGPGDPEPCDYAIKAIKE

SEQ ID NO: 94254 - protein, 361 aa, Aspergillus nidulans FGSC A4
MGCMSSKQLEAGDDKEAIQRNARIEKSLKNDKKVMDRTIKILLLGAGESGKSTIIKQMRIIHSGGFPEDERRQTRAVIYSNIVVAFKVLLDIMRTENIDFEQEGTRVSDTEFVDNLEPDVGVEEAFSDLRVRDAMNEMWKDGGVQKAVSKGHEFALHDNLNYFFHSLDRLFESGWLPDNQDMLQARLRTTGITETLFELGQMNFRMMDVGGQRSERKKWIHCFEGVQCLLFMVALSGYDQCLVEDQNANQMHEAMMLFESLVNGEWFKRKPIILFLNKIDLFKDKLAISPISKHFPDYSDSNTDFDAAAKYFADRFRGINRIPEREIYIHYTNATDTTLLKATMDSVQDMIIQKNLHTLIL

SEQ ID NO: 94255 - protein, 208 aa, Pseudomonas putida
QQIVTLTYPHIGNTGTTPEDAESNRVWSAGLVIRDLPLLASNWRNTQSLPDYLKANNVVAIAGIDTRRLTRILREKGAQNGCILAGDNISEEAAIAAARAFPGLKGMDLAKVVSTKERYEWRSSVWELKTDSHPTLEASELPYHVVAFDYGVKLNILRMLVARGCRVTVVPAQTPASEVLALNPDGVFLSNGPGDPEPCDYAIQAIKE

SEQ ID NO: 94256 - protein, 500 aa, Coprinopsis cinerea okayama7#130
MPSTFSYQWDTPAYKGKTEFNTGLFINGQFVDGSNKTTIDVVNPTNGKVITSISEGVEKDVDLAVEAAQKAFETTWGLNVSGSQRSELLWKLATLMEQHHEELAAIEATDNGKTFAWAKGTDVAFSINVIKYFAGWADKITGQTIETDERKLIYTRHEPIGVVGQIIPWNFPLLMLAWKIGPALATGNTIVLKPSEFTPLTAIRMCSLIQEAGFPPGVVNIVTGYGNTVGAAISSHPKIEKVAFTGSTLVGRKIMEAAAKSNLKNVTLELGGKSPNVIFNDADIDQAVNWAVHGLFWNHGQACCAGSRIFVQSGIYDEFLKRFTAKAAAIRVGDPFGVEVDQGPQVSQIQYDRIMGYIDSGKADGATVHLGGKRHGQEGYFIEPTIFTDVKPDMKIVREEIFGPVGVLIKFEDEADVIRQANDTVYGLAAAVFSQNINRAIETAHKMQAGTVWVNCANQLHANVPFGGFKQSGIGRELGEYALHNYTNVKAVHVNIGHVM

SEQ ID NO: 94257 - protein, 208 aa, Pseudomonas putida
QQIVTLTYPHIGNTGTTPEDAESNRVWSAGLVIRDLPLVASNWRNTMSLSDYLKANNVVAIAGIDTRRLTRILREKGAQNGCIMAGDNISEEAAIAAARGFPGLKGMDLAKVVSTKEQYEWRSTVWDLKTDSHATIDASELPHHVVAYDYGVKVNILRMLVERGCRVTVVPAQTPAADVLALNPDGVFLSNGPGDPEPCDYAIQAIKE

SEQ ID NO: 94258 - protein, 160 aa, Triticum aestivum
  misc_feature (36)..(36): Xaa can be any naturally occurring amino acid
  misc_feature (49)..(49): Xaa can be any naturally occurring amino acid
  misc_feature (96)..(96): Xaa can be any naturally occurring amino acid
  misc_feature (117)..(117): Xaa can be any naturally occurring amino acid
LKKIPLLPVTAPRAGNPKTVGGKLVQFPGEEIPGKXSPPVFFGNSLYTXTGLTLGVEFHKGTLQTSFWSPKGCSSCSGQANFGWVENSCAIKTSNXKGNGGDGQMDSNPGKQCSVSXITAFRRQQSVSIWYEVSKLKQYSLFGLFSGLKDSLAGQFSNFF

SEQ ID NO: 94259 - protein, 171 aa, Solanum sogarandinum
MANPRVFFDLTIGGASAGRVVMELFADTTPKTAENFRALCTGEKGIGKMGKPLHYKGSTFHRVIPGFMCQGGDFTAGNGTGGESIYGAKFKDENFVKKHTGAGILSMANAGPGTNGSQFFICTAKTEWLDGKHVVFGQVVEGLDVIKKTEAVGSSSGRCSKPVVVADCGQL

SEQ ID NO: 94260 - protein, 208 aa, Pseudomonas putida
QQIVTLTYPHIGNTGTTPEDAESNRVWSAGLVIRDLPLLASNWRNTQSLPEYLKANNVVAIAGIDTRRLTRILREKGAQNGCILAGDNISEEAAIAAARGFPGLKGMDLAKVVSTKERYEWRSSVWELKTDSHPTIEAADLPYHVVAFDYGVKLNILRMLVARGCRVTVVPAQTPASEVLALNPDGVFLSNGPGDPEPCDYAIQAIKE

SEQ ID NO: 94261 - protein, 208 aa, Pseudomonas resinovorans
QQIVTLTYPHIGNTGTTPEDAEANRVWAAGLIIRDLPLLASNWRNKQSLPDYLKENGTVAIAGIDTRRLTRILREKGSQNGCILVGDDATEEKALELARSFPGLKGMDLAKVVSCEERYEWRSSVWNLETDSHPEIAASELPYHVVAYDFGVKLNILRMLVARGCRLTVVPAQTPASEVLALNPDGVFLSNGPGDPEPCDYAIQAIRE

SEQ ID NO: 94262 - protein, 449 aa, Streptococcus agalactiae 2603V/R
MSKQYDYIVIGGGSAGSGTANRAAMYGAKVLLIEGGQVGGTCVNLGCVPKKIMWYGAQVSETLHKYSSGYGFEVNNLNFDFTTLKANRDAYVQRSRQSYAANFERNGVEKIDGFARFIDNHTIEVNGQQYKAPHITIATGGHPLYPDIIGSELGETSDDFFGWETLPDSILIVGAGYIAAELAGVVNELGVETHLAFRKDHILRGFDDMVTSEVMAEMEKSGISLHANHVPKSLKRDEGGKLIFEAENGKTLVVDRVIWAIGRGPNVDMGLENTDIVLNDKGYIKADEFENTSVDGVYAIGDVNGKIALTPVAIAAGRRLSERLFNHKDNEKLDYHNVPSVIFTHPVIGTVGLSEAAAIEQFGEDNIKVYTSTFTSMYTAVTTNRQAVKMKLITLGKEEKVIGLHGVGYGIDEMIQGFSVAIKMGATKADFDDTVAIHPTGSEEFVTMR

SEQ ID NO: 94263 - protein, 385 aa, Streptococcus agalactiae 2603V/R
MNKLKVNSVVERKIKSGAQLLEKKDFDTSLVNQLVQLFSQSNQFLGMAYLSPQNKGIGWLLSRQVFDFNHDYFVSLFEKSREKRQKFEKSSQTTAYRLFNQDGDNFGGLTIDFYSDYALFSWYNEFVYTNRQMIVAAFKQVYPNIKGAYEKIRFKGLDFESAHLYGQEAPESFLILENNIKYSVFLNDGLMTGIFLDQHDVRKALATNLSEGKKVLNMFSYTAAFSVAAAVGGALETTSVDLAKRSRELSKAHFDANQIVTDNHRFIVMDVFEYYKYAKRKHLSYDVIVIDPPSFARNKKQTFSVTKDYYKLIEQALDILTPGGTIIASTNAANLTVSQFKKQLEKGFGKASHNYISLQQLPEDFTINDKDQQSNYLKVFTIKVK

SEQ ID NO: 94264 - protein, 295 aa, Bacillus anthracis
MKIRKAIIPAAGLGTRFLPATKAQPKEMLPIVDKPTIQYIVEEAVSSGIEDIIIVSGRGKHVIEDHFDKSYELEQTLFKKNKIKTLEDIECISNLANIHYIRQKEPKGLGHAIYCARRFIGEEPFAVLLGDDIVSSTYPCLKQLIDVYEEHHCSVVGVQRVLETEVSKYGIVKSANQNVNQSIIPISMLVEKPPLETAPSNLAIMGRYILKPDIFEVLKNLPVGSGGEIQLTDAINVLNKQQKVLAFEFDGKRYDVGDKFGFIKATIDFALQRESLKEDVLSYLRNITRDKLINK

SEQ ID NO: 94265 - protein, 443 aa, Bacillus anthracis
MNISIVGTGYVGLVTGVCLSEVGHNVTCIDIDEEKVKKMKLGYSPIFEPCLEELMKNNIIKGRLHFTTNYVDGADGAEIFYIAVGTPQKEDGSADLSFIKQAAINIARTIKNDVIIVVKSTVPVGTNIYIKNLILKNLNYDVKVDIISNPEFLREGSAVNDTFYGDRIVIGSENKTSANVMEEVYKPFGTPIFKTDIQSAEMIKYASNTFLATKISFINGIANLCEMVGADVEKVAQGMGQDKRIGSQFLNAGIGYGGSCFPKDTHALVKVSESLQHKFHLLESVIKLNKNQQTVLIEKIKKRFGSIVGKKIALLGLSFKPNTDDLREAPSIPIARKLVEEGAQVIAYDPVAIKNAREVLPKEVHYVYSTMEALTEADIALVLTEWDEVVDSLLLKASQLMKEPVIFDGRNCFELNEAKNYDVEYHSIGRPSVLREVKGEITA

SEQ ID NO: 94266 - protein, 150 aa, Triticum aestivum
GELGPTSHAPARHGAGISSGRPGRSYGKTPEQLRSEKVPENLISHKTFQGNRPSLSFLLSSLSAYEIGQLLSIYEHRIAVQGFIWGINSFDQWGVELGKSLASTVRKQLHASRMEGKPVEGFNPSSASLLTRFLAVKPSTPYDTTVLPKV

SEQ ID NO: 94267 - protein, 453 aa, Coccidioides immitis RS
MTSSSSNVVGVHYRVGKKIGEGSFGVIFEGTNLLNNQQVAIKFEPRKSDAPQLRDEYRTYKILVGCPGIPNVYYFGQEGLHNILVIDLLGPSLEDLFDHCNRRFTIKTVVMVAKQMLSRVQTIHEKNLIYRDIKPDNFLIGRPGSKAANVIHVVDFGMAKQYRDPKTKQHIPYRERKSLSGTARYMSINTHLGREQSRRDDLEALGHVFMYFLRGGLPWQGLKAATNKQKYEKIGEKKQTTAVKDLCDGYPDEFNKYLTYVRNLGFEDTPDYDYLRDLFTQALKNTGEVEDGEYDWMKLNGGRGWEASKSYPAQHHLHTGNAMPNSSAREIHGASAARGPHPQRPGITADRLNAAQPPPPSPAKPGAGKPARERPNASGGPQVKRQNGAAGGLDATAAASTQAQFQNSNAHLPGRISNPVNSTMNNPQAQPARRTPEPEPTFVQKVMKALCCG

SEQ ID NO: 94268 - protein, 333 aa, Bradyrhizobium sp. BTAi1
MTDAKYDVLGIGNAIFDVLVHADEAFLAKHAMTKGSMALIDEARAAAIYRDMGPATEMSGGSGANTIVGLASLGARAAYVGKVRDDQIGRMYSHDIRAAGVTFDTAPATDGPATGCCYILVTPDGERTMNTYLGAAQNLTAADIDPAQIAAARIVYLEGYLWDPKEAKEAFVKAATVAHDAGREVALTLSDSFCVDRYREEFLDLMRGGTVDIVFANEAELHSLYQTSDFDGALKQLREDATLGIVTRSDKGCVVVSNDGVIAVPAHPIETLVDTTGAGDLFAAGFLFGLVRKTGYEMAGRLGGLAAAEVIQHIGARPQVSLKELAAQNGLKA

SEQ ID NO: 94269 - protein, 421 aa, Corynebacterium diphtheriae NCTC 13129
MALVVQKYGGSSLESAERIRRVAERIVATKKQGHDVVVVCSAMGDTTDELLDLAAQVNPVPPAREMDMLLTAGERISNALVAMAIESFGAKAQSFTGSQAGVITTERHGNARIVDVTPGRVREALDEGKICLVAGFQGVNRESKDVTTLGRGGSDTTAVALAAALNADVCEIYSDVDGVYTADPRIVPNAQKLEKLCFEEMLELAASGSKILVLRSVEYARAFGVPLRVRSSYSNDPGTLVAGSMEDIPVEEAVLTGVATDNSEAKITVLGIPDSPGSASAVFRALADAEINIDTVLQNISSLEDNRTDITFTCPRADGPHAMELLRNLQAKNDWQNVLYDDQIGKVSLVGAGMKSHPGVTAEFCEALRDAGVNIELISTSEIRISVLIRESDVDVAARAIHEKFELGGETEAIVYAGTGR

SEQ ID NO: 94270 - protein, 172 aa, Prochlorococcus marinus subsp. pastoris str. CCMP1986
MNRFSFLKYFLCLTFSFLIFTSPVFAGANVATKGEGDEVPSYVRSNITGFDFHGEDLHLSSIAGAVARDADFSEVDLHGTTLTLSDLKGSNLNGIDLTDTLADRVNFQKTDLRNSILINMIASGSSFAGAQIEGADFSYAILDSEDQRNLCKIAEGVNPTTGVSTRDSLECN

SEQ ID NO: 94271 - protein, 245 aa, Rhodospirillum rubrum ATCC 11170
MFDLTGKKALVTGASGGLGASIAKALADRGASVALSGTREAALNETAVFLGKDVPILPCDLSDTAAVERLIPAAEAALSGLDILVNNAGLTRDMLSMRMKDEEWDQVIAVNLSAAFRLSRSAVKGMMKRRWGRIVNITSIVGVTGNPGQANYAASKAGLIGLSKSMAAEVAARHITVNCVAPGFIATAMTDKLNEKQKEAILPHIPAGRMGAPEDVAAAVVYLASEEAAYVTGQTLHVNGGMAMI

SEQ ID NO: 94272 - protein, 377 aa, Glycine max
MMACQDWPEPVIRVQALAESGLTTIPERFIKPKSQRPTNNNNYAPKVNFSQIGHHENTTTTNNNNTNIPVIDMKHIYGGDERRRAETLRLVSEACREWGFFQVVNHGVSHELMKGAREVWREFFQQPLEVKEVYANTPLTYEGYGSRLGVNKGAILDWSDYFFLHHMPCSLRDQAKWPALPTSLRNIISEYGEQVVMLGGRILEILSINLGLREDFLLNAFGGENDLGACLRVNFYPKCPQPDLTLGLSPHSDPGGMTILLPDENVSGLQVRRGEDWITVKPVPNAFIINMGDQIQVLSNAIYKSIEHRVIVNSNKDRVSLAFFYNPRSDIPIQPAKELVTKDRPALYPPMTFDEYRLYIRTRGPSGKAQVESLTSE

SEQ ID NO: 94273 - protein, 297 aa, Triticum aestivum
QGWKSCAVTTLRRGGSDLTATTIGKALGLREIQVWKDVDGVLTCDPNIYANAVPVPYLTFDEAAELAYFGAQVLHPQSMRPAREGGIPVRVKNSYNRHAPGTVITKTRDMRKSILTSIVLKSNITMLDIVSTRMLGQYGFLAKVFSIFEDLGISVDSVATSEVSISLTLDPSKLWSRELIQQELDHVVEELEKIAVVHLLQHRSIISLIGNVQRSSLILEKAFNVLRRNGVNVQMISQGASKVNISLVVNDSEAKQCVQALHSAFFENGLLSEVEEADLAQKRAPVLVSSNGAINGN

SEQ ID NO: 94274 - protein, 189 aa, Bradyrhizobium sp. BTAi1
MFIQTEATPNPATLKFIPGRVVLPSGTMEFSSREAAARSPLAERLFAIGGVTGVFYGADFITVTKNDGEWQHLKPAILGAIMEHYMSGAPLLADGSAANDDATDEDDEFYDEADTETVGMIKDLIESRVRPAVANDGGDITFRGFKDGIVYLNMKGACSGCPSSTATLQHGIQNLLKHFVPEVVEVRPM

SEQ ID NO: 94275 - protein, 77 aa, Rhodospirillum rubrum ATCC 11170
MSDVADRVKKIVVEHLGVEEAKVTENASFIDDLGADSLDTVELVMAFEEEFGCEIPDDAAEKILTVKDAIDFIESNG

SEQ ID NO: 94276 - protein, 183 aa, Triticum aestivum
VTILNKFVQKSRLLPVRNSRDIVDPRVREFEVEEAVAMESQTIRHMIEDDCADNGIPLPNVNSKILSKVIEYCNKHVQAKPADGAAAGAGASDASAAAPAALAEDLKNWDAEFVKVDQATLFDLILAANYLNIKGLLDLTCQTVADMIKGKTPEEIRKTFNIKNDFTPEEEEEIRRENQWAFE

SEQ ID NO: 94277 - protein, 451 aa, Brassica napus
VDPASEKLYGEFLVNAQGEDVVAGIRTPEDLDTMKRLMPQAYAELVENCDILEGHYKDMMDIEFTVQEERLWMLQCRAGKRTGKGAVKIAVDMVGEGLVDKSTAIKMVEPQHLGRLLHPQFHDVSGYREKVVAKGLPASPGAAVGQVVFTAEEAEVWHSQGKNVILVRTETSPEDVGGMHAAEGILTARGGMTSHAAVVARGWGKCCIAGCSEIRVDENHKVLLIGDLTINEGEWISMNGTTGEVILGKQALAPPALSADLETFMSWADSVRRLKVMANADTPEDATAARKNGAEGIGLCRTEHMFFGADRIKAVRKMIMAVTTEQRKASLDVLLPYQRADFEGIFRAMDGLPVTIRLLDPPLHEFLPEGDWMLIVQELAAETGMKEDVILSQVEKLSEVNPMLGFRGCRLGISYPELTEMQARAIFEAAASMQDQGVTVLPEIMVPLVGT

SEQ ID NO: 94278 - protein, 421 aa, Gibberella zeae PH-1
MLSRSIATASRMVPARVLRPRAHPLVMLPAMMQTVRTYADSVIKVPQMAESISEGTLKQFSKSIGDYVAQDEEIATIETDKIDVAVNATEAGTIKEFLVAEEDTVTVGQDLVRIELGGEPSGDKKEAPKEEPKKSESESKPEPKQESAPEPKKEPAAASSKPEAPRQPEKKESKSESSASSGSSMGNREERRVKMNRMRLRIAERLKQSQNTAASLTTFNEVDMSNIMEFRKLYKEDVLKKTGVKLGFMSAFSRACVLAMRDLPAVNASIEGPNGGDTIVYRDYVDISVAVATEKGLVTPVVRNVESMDMIGIEESIADMGKKARDNKLTIEDMAGGTFTISNGGVFGSLMGTPIINLPQSAVLGLHAIKERPVAVNGKIEIRPMMYLALTYDHRLLDGREAVQFLVKVKEYIEDPRRMLL

SEQ ID NO: 94279 - protein, 799 aa, Xylella fastidiosa Temecula1
MALNGASYLNENILWLHELRLTDLARVGGKNSSLGEMIGNLTALGVSVPGGYATTAAAFKAFIAYNNLSKRIYDKLATLDVEDVKALTAAGKEIRDWVIDAPLQPELEKDIRDAYDTLSKDNSGNDVAVAVRSSATAEDLPDASFAGQQETFLNVIGADQVVHKIKEVFASLYNDRAIAYRVHHGFKHEDVFLSAGIQLMVRSDISASGVLFTLDTESGFREVVFVTASFGLGEMVVQGAVNPDEFYVYKKTLKAGKPAILRRTLGTKLVRMVYSDAPGERVKIEDTPTELRHCFAISDADVQELARQALIIEQHYGRPMDIEWAKDGISGKLFIVQARPETVKSRSHTTQIERFALQQPGQILTEGRAIGQKIGSGTARVVNSLEDMHHMQPGDVLVADMTDPDWEPVMKRASAIVTNRGGRTCHAAIIARELGVPAVVGTGNALSIIQDGQPITVSCAEGDTGYIYAGKLPFERTTTDLGHMPPAPLKIMMNVANPERAFDFGQLPNAGIGLARLEMIIAAHIGVHPKALLEYHKQDADTKQKIDAKIAGYPDPVSFYVNRLAEGIATLTASVAPHTVIVRLSDFKSNEYAHLIGGQHYEPQEENPMLGFRGASRYVDPSFSDAFALECKAVLKVRNEMGLDNLWVMIPFVRTLEEGRKVIDVLRQNGLKQGENGLKVIMMCEVPSNALLADEFLDIFDGFSIGSNDLTQLSLGLDRDSSIVAPLFDERNPAVKKLLSMAIKAARSKGKYIGICGQGPSDHPDLAEWLMQEGIESLSLNPDTVVDTWLRLAKLKTVH

SEQ ID NO: 94280 - protein, 208 aa, Pseudomonas stutzeri
KQIVTLTYPHVGNTGTTPEDAESWKVWAAGLVIRDLPLISSSWRDKQSLPDYLKANGTVAIAGIDTRRLTRILREKGAQNGCILAGSDATEEKALELARSFPGLKGMDLAKEVSVKERYEWRSSVWCLKDDGHAEIPASELPYHVVAFDYGVKYNILRMLVARGCRVTVLPAQTPASEALALNPDGIFLANGPGDPEPCDYAIRAIQE

SEQ ID NO: 94281 - protein, 512 aa, Oryza sativa Japonica Group
MEKLKSELWMTAVATCMSLLLYLTILRRRHASGGRSLALPPGPTPLPLIGNLLCLGGIFHQTLAKLARVHGPVMTLKLGLTTAVVVSSAEAAREAYTKHDQRLAARPVPDAFRANGFSERSIVFSPSSDPQWKNLRGIHATHIFSPRALAALRGIRERKVRDIVGYIRTVAGEEMCVREVVHNGVLNLISTSFFSMDMADVRSESARGLRGLIEDIIATVAGPNVSDFFPFLRQLDLQGLRRQTGSHLGIVFGLLDDIIDRRMAETRDHPDKQRHGDFLDALISLASAGKIPRYHITYLLFDVFAAGADTMTTTVEWAMAELLRNPRVMAKVRAEVTDALGGRESFDEGDAASLTYLQCVFKEAMRLHPVGSILVPHLAVQDGVEIGGYAVPKGTTVIFNAWAIMRDPAAWESPDQFLPERFLHKEESSSPPLELRGKDYEYIPFGSGRRLCPGLPLAERAVPFILASLLHAFEWRLPDGMSPDDMDMTEKFATANVLATPLKAVPVASHTS

SEQ ID NO: 94282 - protein, 208 aa, Pseudomonas syringae
QQIVTLTYPHIGNTGTTPEDAESNRVWSAGLVIRDLPLVASNWRNKLSLGDYLKANNVVAIAGIDTRRLTRILREKGAQNGCILAGDNITEEAAIAAARSFPGLKGMDLAKEVCTKDTYEWRSSVWDLKTDSHPEIAASELPYHVVAYDYGVKVNILRMLVERGCRVTVVPAQTPASEVLAYKPDGVFLSNGPGDPEPCDYAIKAIRE

SEQ ID NO: 94283 - protein, 208 aa, Pseudomonas tolaasii
QQIVTLTYPHIGNTGTTPEDVESDRVWSAGLVIRDLPLVASNWRNTMSLSDYLKANNVVAIAGIDTRRLTRILREKGSQNGCIMVGDNISEEAAIAAAQGFPGLKGMDLAKVVSVKEKYEWRSTVWDLKTDSHATIEAGELPYHVVAYDYGVKYNILRMLVERGCRVTVVPAQTPASDVLALQPDGVFLSNGPGDPEPCDYAIQAIKD

SEQ ID NO: 94284 - protein, 305 aa, Sulfolobus shibatae
MPLDPRIKKLLESGFVVPIGKASVDEVRKIFRQLASAAPKAEVRKVEDIKIPGSETSINARVYFPKAKGPYGVLVYLHGGGFVIGDVESYDPLCRAITNACNCVVVSVDYRLAPEYKFPSAVIDSFDATNWIYNNLDKFDGEMGIAIAGDSAGGNLAAVVALLSKGKLDLKYQILIYPAVGFDSVSRSMIEYSDGFFLTREHIEWFGSQYLRSPADLLDFRFSPIIAQDLSGLPPALIITAEYDPLRDQGEAYANRLLQAGVPVTSVRFNNVIHGFLSFFPLIDQGKDAIGLIGSVLRRTFYDKS

SEQ ID NO: 94285 - protein, 410 aa, Coprinopsis cinerea okayama7#130
MSSSLNINQGADLTAPTPQNTPLNQAPISLGLSRPTVPDISEDNEQEDIGEVNDIDGDMIKAHMLGLVQGRLAELVGRSSGYIESLPVEIKLNVEALKGVQEQQNELVQQYKLECLELEKKYLNLTKPLYERRKAIINGTATATKEEIEAGEKVSAEDIEEYEPLPKDATPSTDGIPEFWLTALRNHIGLNELITDRDADALKHLTDIQLEYTADGKPGFKLLFHFTPNDYFENDVLEKTYYYQEKVGYGGDFVYDRAIGTDIKWKEDKDLTKEFEIKKQRNKTTNRTRLVRKAKPADSFFNFFYPPVPPSPEAIEEGEIDEDELDEIEEKLEIDYQIGEDLKEKIVPRAIDYFTGKAIEYDFEDDDDYDLGDEDDDDDDDDDDEGSDSDAPRPAKKGGNKVDPEECKQQ

SEQ ID NO: 94286 - protein, 368 aa, Burkholderia xenovorans LB400
MKTYRIATIPGDGIGKEVVPAGRRVLEAIAARSDAFGFEFENFDWGGDYYREHGVMMPADGLDAIRHQDAILFGSAGDPHIPDHVTLWGLRLKICQGFDQYANVRPTRILPGIDAPLKRCGPQDLDWVIVRENSEGEYAGVGGRVHQGHPIEVATDVSMMTRAGVERILRFAFRLAQSRPRKLLTVITKSNAQRHAMVMWDEIAVQVSKEFPDVRWDKELVDAATARMVNRPATLDTIVATNLHADILSDLAAALAGSLGIAPTANLDPERRYPSMFEPIHGSAFDIMGKGLANPVGTFWSVVMMLDHLGEHAAARQLMAAIERVTADPSLHTGDLGGTATTAQVTDAVCAILAAGSPAVPAASVKAA

SEQ ID NO: 94287 - protein, 284 aa, Candida glabrata CBS 138
MSSFSKSNFNSEGYKQSRPQYPLEFYKHLQQYHNGKCDLIVDVGCGPGTATLQLSEVFNDTNEIIGTDYSERMIEAANNGNPAKNVNFHVAGGEDFTFLGERQNKRQCDMVVSAEAIQYFNLDKFQDEVHKNLRADGTLAYWGYLEPVVLELPAVDDALYDFCFGEEKLAPYWEKPAVDIIASYYRNIKLNDSLFKEVDLKVYNPREANYESAPFKMICEMTVQNLREYLQTWGIYYKWKHDPKNANKKDIIDEVIDKILENNYDLDTKIHVSWKTFYTFARAI

SEQ ID NO: 94288 - protein, 445 aa, Escherichia coli
MSDFSAFDNALRSLESIPLARVAGRLVRLNGILLECVGCSLMTGQLCRIESANHTLIDAQAVGFNRDITYLMPFKQPVGLMAGARVFPEEKAHDILIGESWLGRVVNGLGEPLDGKGRLNGNDLLPPLPPSVNPLTRRSVDEPLDVGVKAINGLLTIGKGQRVGLMAGSGVGKSVLLGMITRQTKADIVVVGLIGERGREVKEFIDHSLGADGLAKSIVVVAPADESPLMRLKATELCHSIAAWFRDRGHHVLLLVDSLTRYAMAQREIALSLGEPPATKGYPPSAFGMIPKLVESAGNSESSGSMTAIYTVLAEGDDQQDPIVDCARAVLDGHIVLTRKLAEAGHYPAIDIGQSISRCMNQVTSLEHQQSARALKQNYAAYMEIKPLIPLGGYVAGADASVDKAVKMFPAIERFLRQEMREPASLELVQSRLQILFPGVKKAEQ

SEQ ID NO: 94289 - protein, 553 aa, Oryza sativa Japonica Group
MASISPTSSSVAALRGHPVQFVKGGAVSKEAKGSISFSPVANSNNANVKFTGLRVAASLKRDGAFPGDGYSGNDNTVLPKSTSVRGQDYPTADSVLPTESIIVPEISNAGLKCVADMFSDEDKDTEQDLDSPTEGFSSISEAIKDIQQGKLVIVVDDESRENEGDLIMAASLVTPEAMAFVVRYGTGIVCVSMKEEDLERLNLPLMVATKENEEKLCTAFTVTVDAKEGTTTGVSAKDRAKTVMTLASPDSKPEDFNRPGHIFPLKYREGGVLKRAGHTEASVDLAMLAGLPPAAVLCEIVDEDGSMARLPKLRVFAERENLKIVSIADLIRYRRKRDRLVERSSVARLPLRWGNVRAYCYRSVIDGIEHIAMVKGEIGDGQGVLVRVHSECLTGDIFGSARCDCGDQLAMAMEMIEKAGRGVLVYLRGHEGRGIGLGHKLRAYNLQDDGRDTVEANEDLGLPVDSREYGIGAQILRDLGVRSMKLMTNNPAKYGGLKGYGLSIVGRVPLVTPITSENRRYLETKRTKMGHVYGLANGQASHQTGSNGAKGEH

SEQ ID NO: 94290 - protein, 232 aa, Candida albicans SC5314
MSVSAPEDIRPSTSNGDQSNRDTNTPTTSTSASTTAPPPPPPPPQQQQQQQPSSSITTTDNNNNNQTSQQSQEKKEKIIPRDVRLLHLIFATHAVHNYQDHVPLQLMDFAHRYTKSVLKDALVYNDHSKPINANTNLNSNTNATVNTDDIRLAIAARSNYQFKPVPPKELLLELAQERNSRPLPPVIPRWGLNLPPEKYCLTAKDWDSIYDEPDEDNNNQSSQQKNKKLKTK

SEQ ID NO: 94291 - protein, 423 aa, Pseudomonas putida KT2440
MGTHVIKMPDIGEGIAQVELVEWFVKVGDIIAEDQVVADVMTDKATVEIPSPVSGKVLALGGQPGEVMAVGSELIRIEVEGSGNHVDVPQPKPVEAPAAPIAAKPEPQKDVKPAVYQAPANHEAAPIVPRQPGDKPLASPAVRKRALDAGIELRYVHGSGPAGRILHEDLDAFMSKPQSNAGQAPDGYAKRTDSEQVPVIGLRRKIAQRMQDAKRRVAHFSYVEEIDVTALEALRQQLNSKHGDSRGKLTLLPFLVRALVVALRDFPQINATYDDEAQIITRHGAVHVGIATQGDNGLMVPVLRHAEAGSLWANAGEISRLANAARNNKASREELSGSTITLTSLGALGGIVSTPVVNTPEVAIVGVNRMVERPVVIDGQIVVRKMMNLSSSFDHRVVDGMDAALFIQAVRGLLEQPACLFVE

SEQ ID NO: 94292 - protein, 459 aa, Pseudomonas putida KT2440
MQQIIQTTLLIIGGGPGGYVAAIRAGQLGIPTVLVEGQALGGTCLNIGCIPSKALIHVAEQFHQASRFTEPSPLGISVASPRLDIGQSVTWKDGIVDRLTTGVAALLKKHGVKVVHGWAKVLDGKQVEVDGQRIQCEHLLLATGSSSVELPMLPLGGPVISSTEALAPKTLPQHLVVVGGGYIGLELGIAYRKLGAQVSVVEARERILPTYDSELTAPVAESLKKLGIALHLGHSVEGYENGCLLASDGKGGQLRLEADQVLVAVGRRPRTKGFNLECLDLKMNGAAIAIDERCHTSMHNVWAIGDVAGEPMLAHRAMAQGEMVAEIIAGKARRFEPTAIAAVCFTDPEVVVVGKTPEQASQQGLDCIVAQFPFAANGRAMSLESKSGFVRVVARRDNHLIVGWQAVGVAVSELSTAFAQSLEMGACLEDVAGTIHAHPTLGEAVQEAALRALGHALHI

SEQ ID NO: 94293 - protein, 294 aa, Herminiimonas arsenicoxydans
MQSFDGWMKATQGEMELALVQHLPPVALTPARLHEAMHYAVLDGGKRVRPLLVYAAGALFDADAAELARAAAAVEMIHAYSLVHDDMPCMDDDALRRGKPTVHVKYDEACALLVGDALQSQAFDVLADGGIDPVRQLAMVRLLAKASGSLGMCGGQAIDLASVGLNLSLEELEQMHRLKTGALLRVSVLLGALAGKSLSAEETQALDSYAAAIGLAFQVVDDVLDATADSATLGKTAGKDAADNKPTYVSILGLEQSRTLAEKLRNDAHRALEQFGEKARRLRELADLIVQRKA

SEQ ID NO: 94294 - protein, 456 aa, Haemophilus influenzae R2846
MTKHYDYIAIGGGSGGIASLNRAASYGKKCAIIEAKHLGGTCVNVGCVPKKVMFYGAHIAEAINNYAPDYGFDVEVKKFDFSKLIESRQAYISRIHTSYNNVLAKNNIDVINGFGKFVDAHTIEVTLADGAKEQVTADHILIATGGRPYRPNIKGQEYGIDSDGFFALTELPKRAVVIGAGYIAVELSGVLNSLGVETHLLVRRHAPMRNQDPLIVETLVEVLAQDGIQLHTNSTPSEIVKNADGSLTVKCDGQSDVTVDCAIWAAGRVPATDKIGLENAGVETNEHGYVKVDKYQNTNVKGIYAVGDIIENGIELTPVAVAAGRRLSERLFNNKPTEYLDYSLVPTVVFSHPPIGTVGLTEPQAIEQYGAENVKVYKSSFTAMYTAVTQHRQPCKMKLVCVGKDEKVVGLHGIGFGVDEMIQGFAVAIKMGATKADFDNTVAIHPTGSEEFVTMR

SEQ ID NO: 94295 - protein, 345 aa, Triticum aestivum
MAVRVPSMELNRSPPLLSGGRGKTCLQKPFIVQAKRSGGLEKANTSRSRGPQASEKLKKREPLTRGTVSAPLPVPGHIPRPPYVGSNKMPEISSERQMQDKDTIVHMKAACELAARVLQNAGKLVKPSVTTDEIDKAVHKMIIDAGAYPSPLGYGGFPKSVCTSVNECMCHGIPDSRELKDGDIINIDVTVYLNGFHGDTSKTFFCGEVDEAAKRLVKVTEECMLRGISSCKHGVSFKKIGRRISEHAERNGFGVVEQFVGHGVGRVFHSQPIIYHQRNNMPGQMVEGQTFTIEPILTMGSNSNSIECDMWEDGWTAVTTDGSLAAQFEHTILITRTGAEILTKC

SEQ ID NO: 94296 - protein, 460 aa, Pseudomonas putida KT2440
MQSHGLKQSLKQRHITMIALGGVIGAGLFMGSGSLIASAGPAAILSYFIGGLVVTLVMFMLGEMACRNPDAGSFSTYANTYLGDWAGFAVGWLYWFKSMMTITLEAVLLGAILHDFLPWLPIWAGAFLMLVTLMASNAYSVRSFAEVEYWLAAMKVATILIFMLLGVSILLGLHSDIPAPGLINLTAHDGFMPNGLSPVMAGVIVVIFSLGGSEIAAVAAGESENPRQNVIRAIKSVILRVMLFYVGSVSILILCLPWTDKANLASPYVSLFSLAGFGGAAVAMKLVLFVSFMSVMNSFMFSNSRMLFSLSQRGHAPKLFSRTSAKGVPINALLLSLSICTMILTVHFVSGGDLFMTLAKSTGSLVMVVWIFIIIAHVAMRIKTRHEAVAPNAFRAWLFPYTNIIALFALLAVIGTQAFDPASRFQFWFTVLTVLLVVAGYFLMRQRLASSAVLAHERDA

SEQ ID NO: 94297 - protein, 360 aa, Hordeum vulgare subsp. vulgare
MVQPVFDAAVLSGRTDIPSQFIWPEGESPTPDATEEMHVPLIDIGGMLSGDPRAAAEVTRLVGEACERHGFFQVVNHGIDAQLLADAHRCVDAFFTMPLPEKQRALRRPGESCGYASSFTGRFASKLPWKETLSFRSCPSDPALVVDYIVATLGEDHRRLGEVYARYCSEMSRLSLEIMEVLGESLGVGRAHYRRFFEGNESIMRLNYYPPCQRPLETLGTGPHCDPTSLTILHQDDVGGLQVHTDGRWRSIRPRADAFVVNIGDTFMALSNGRYKSCLHRAVVNSRVPRKSLAFFLCPEMDKVVAPPGTLVDAANPRAYPDFTWRSLLDFTQKHYRADMKTLEVFSSWVVQQQPASART

SEQ ID NO: 94298 - protein, 400 aa, Roseovarius nubinhibens ISM
MRYSKTITGLTGGGSDGWDIYRKARRMQRDGTEVTMLTIGEHDIRTDAQILDALHRFAHAGHTGYTTFDGEPELKDRIATRLSERTGVPTTPANVLIVPGGQGGLFAAHHAICDPGDTALYIDPYYTTYPGTIRTVGAIPLAIEARPRHGFQPQPEDIARAADAAGNARSLLVNTPNNPTGVVYTRKTLEGIAEICTDKGLWLLSDEVYDTQVWNGDHLSPRALPGMAERTLVIGSMSKSHAMTGSRVGWVVGPEEAIAHMANLATHTTYGISGYIQHAAAFALDLGPAFEEQIAEPFRRRRDLVMAQMEGQNAARPIPADGAMYVMVDIRSTGLSGEAFADGLLDRHHVAVMPGESFGQAAAGHVRVALTVADDLLVAAVARLVELAAELAAQHAEPAQ

SEQ ID NO: 94299 - protein, 582 aa, Streptomyces verticillus
MSSLAVRVGARVRSVLPTRADLAGMGRSPRRDLLAGLTVAIVALPLALGFGVSSGLGAEAGLATAVVAGALAAVFGGSNLQVSGPTGAMTVVLVPIVARYGPGGVLTVGLLAGLMLIALALARAGRYMQYVPAPVVEGFTLGIACVIGLQQVPNALGVAKPEGDKVLVVTWRAVETFAGAPNWTAAGLAAAVAAVMLTGARWRPVVPFSLLAVTGATVVAQLCHLDAARPIGDLPAGLPAPSLAFLDLGALGSLLAPAVAVAALAALESLLSASVADGMTVGQKHDPDKELFGQGLANLAAPLFGGVPATGAIARTAVNVRTGASSRLAALTHAAILAVIVFAAAPLVSRIPLAALAGVLIATAIRMVEVGSLRAMARATRSDGLVLILTAVATVALDLVYAVIIGLLVAGALALRAVAKQVRLDQVSLKEDLTGDHSAEEHALLAEHIVAYRIDGPLFFAAAHRFLLELSDVADVRVVILRMSRVTTMDATGALVLKDAVTKLNRRGITVLASGVRPGQRRVLDSVGALGLLRAATGDDYTGTPEAIAAARSHLHGAGVLAPACPGPPPPVPPPCAPSARR

SEQ ID NO: 94300 - protein, 580 aa, Coprinopsis cinerea okayama7#130
MMKNMTLKEALLPQPPSFMKKRNYELKDTLGEGTFGKVIRATWHVPVDQVDIAEHGAAAQLDSQPTTPRGSRPATPVTTSHVDSGIRKEVALKVIPKKKVKGNEDSVWGEMEVLKGLDHPNIVKFYEWFESRSKYYLSFELAVGGELFQRILQRGKFTEKDAVAVVRSILSGVNYLHEHDIVHRDLKPENILYRTKKLDSDIVIADFGIAKHLHSPDEQLHSLAGSLGYVAPEVLSKDGHGKAVDIWATGIITYVLLCGYSPFRSNDAKTLLKETTEGKVEFHERYWKNVSEEAKAFIKSLLNPNPAERPTAARALADPWLTTHAPSTAHDLSNGLRDNFNPRARWKSAIASARALNRFGSFAAAAAAAAKERELSSSDSHISAETSSEGWRTPTREESEDENEGWRNSDTLPSSSSMKSAPSENRLGDSLRRAGGELSKAPPAADDGHSSINVRVFAPEPEGQPPASTSNATATPPPPVGSSEPLKIPKSNSRSSSRSNSPSRGSSWRDIFAPKLKEYIYTEEPEGNPENRRSVDMRIPGSFDMYGPHASNSANGTTSNGQQPQQQSWIDMLRRLHLQQ

SEQ ID NO: 94301 - protein, 507 aa, Candida glabrata CBS 138
MVLPRLYAAPSSRAALQAARMASKFNSPVRFASTAALASGKVSAVIGAIVDVQFEESNLPAILNALEIKTPQGKLVLEVAQHLGENTVRTIAMDGTEGLVRGEKVVDTGAPISVPVGRETLGRIINVIGEPIDERGPINSKLRKPIHADPPSFAEQSTAAEVLETGIKVVDLLAPYARGGKIGLFGGAGVGKTVFIQELINNIAKAHGGFSVFTGVGERTREGNDLYREMKETGVINLEGDSKVALVFGQMNEPPGARARVALTGLTIAEYFRDEEGQDVLLFVDNIFRFTQAGSEVSALLGRIPSAVGYQPTLATDMGLLQERITTTKKGSVTSVQAVYVPADDLTDPAPATTFAHLDATTVLSRSISELGIYPAVDPLDSKSRLLDAAVVGEEHYNVATKVQETLQTYKSLQDIIAILGMDELSEQDKLTVERARKIQRFLSQPFAVAEVFTGIEGKLVRLKDTISSFKAVLEGKYDDLPENAFYMVGGIEDVVAKAEKLAAEAS

SEQ ID NO: 94302 - protein, 166 aa, Phillyrea latifolia
MELKIFRSIYVLLAFLCLGFIYYITVFVFIEDWLGLRSSAGSLNALIFTFLASFCAFSFCVCAFTDPGGVPSSYVPDVEEYQISDQETKKTGVHRMQCDKCSTHRPPRAHHCRVCRRCVLKMDHHCIWINNCVGHRNYKPFLVLIFYATVASTYSATIFISCVLQK

SEQ ID NO: 94303 - protein, 804 aa, Physcomitrella patens subsp. patens
MFLRYSKPKKDFSTAILERKKAPNRLVVDEAVNDDNSVVALSMETMEKLQLFRGDTVLIKGKKRKDTVCIVLSDDTCDEHKIRMNKVVRANLRVRLGDVVSVHQCPDVKYGKRIHVLPFDDSIEGVTGNLFDAYLKPYFLEAYRPVRKGDLFLVRGGMRSVEFKVVETDPAEYCIVAPDTEIFCEGEPLRREDEERLDEVGYDDVGGVRKQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTQGEVERRIVSQLLTLMDGLKSRAHVIVMGATNRPNSIDPALRRFGRFDREIDIGVPDEVGRLEVIRIHTKNMKLAEDVDLERIAHDTHGFVGADLAALCTEAALQCIREKMDVIDLEDDTIDAEVLNSMAVTNEHFQTALGISNPSALRETVVEVPNTTWEDIGGLENVKRELQETVQYPVEHPEKFEKFGMSPSKGVLFYGPPGCGKTLLAKAIANECQANFISVKGPELLTMWFGESEANVRDVFDKARQSAPCVLFFDELDSIANQRGSSQGDAGGAADRVLNQLLTEMDGMNAKKTVFIIGATNRPDIIDSALLRPGRLDQLIYIPLPDEASRLRIFQAALRKSPLAKEVDLEALARYTQGFSGADITEICQRACKYAIRENIEKDIEREKRRAENPEAMEEDEVEEVAQIKASHFEEAMKYARRSVSDADIRKYQAFAQTLQQSRGFGSEFRFPDRPAAAGAPSAAEAPSAFGTDAADEDDLYS

SEQ ID NO: 94304 - protein, 155 aa, Physcomitrella patens
MAGSLRLFVSIPATARHFGINGVEKAQRVHNRVNGRYKINAASGPSQGGGVLDRPTIDKPTPGRESEFDLKKKKKISPPYRVMLHNDNFNKREYVVQVLMKAIPGMTVDIAVNVMNEAHINGLAVVIVCPQEDAEDYCMQLRTNGLLSSIEPASC

SEQ ID NO: 94305 - protein, 105 aa, Zea mays
  misc_feature (60)..(60): Xaa can be any naturally occurring amino acid
  misc_feature (66)..(66): Xaa can be any naturally occurring amino acid
  misc_feature (74)..(74): Xaa can be any naturally occurring amino acid
PRHRALPHRLRARAQLVRWARRVGTTPHCMNDLTVKHCCMCHTESFNDLPNDRLLTQTNXLRHAPXSLPIAGVXYSSTGYTSAALSPYCDAEDIHDIDFLPDNRI

SEQ ID NO: 94306 - protein, 495 aa, Halobacterium sp. NRC-1
MLSRCPVLRRPIPHGTIDHLIRSRDCGTGTRVPRLTKPPLAVSLSLRFDRFYVRGRPTDSCHTLRSRVLRRSPPTVKPGPRIPASMLSLSDIRDARERVSETARHTPLEYSHTFSDLTGADVRPKLECFQRTGSFKIRGATNRIRTLSADQQDAGVVTASAGNHAQGVALAASRSGVDSKVVMPESAPISKIKATKSYGAEVVLHGADYDDAQAHAHELEAAEGRTYVHAFDDEYIMAGQGTLGLEIAADCPTVDTVVVPIGGGGLISGVATALKGELDDVRVIGVQAEGASTVARSLDKGQPQAVDHVDTIADGIAVRQVGAQTFPVIQEHVDEVVTVSDDEIATALVLLLERGKTLVEGAGATALAAVLEDKFEYADGETIVPALCGGNIDLNLLTTVIVRGLVDQGRYVKIRTVLKDSPGSLNDLLATAAEERANIYAIQHDRTNRDIAMNATEVELDLETRGPEHVDRLLTRIQDEGFDVTVLNGPQIVSE

SEQ ID NO: 94307 - protein, 364 aa, Candida albicans SC5314
MNSSRSANNSHSVSKSSSSNSVYISGTTLAALQPAKSFNYHQGASITSLDFDDAGQFSVSSGIDKSIQLYDCHKGTHSKDIQSQKYGAHSARFTHEELNCLYASTPEPSDNNENAIRYLSLSNNRYLRYFKGHKAQVSSIEVNPVDKTFLSSSYDGTVKLWDLKSSSAVGNLEVGQNSVIGFDPHGVVFAIGKYSQGETGTVSLYDLKTFDKAPFLHVEIPILPGQIWNKLEFSNNGKLILISTDSAEHYVLDSYSGELLAVVRLAIGSVASNNWMSFKYPYTGCCTFSPCGKYLLVGTPKSTINIYDVSNLHNSNNKPVILSRTNHILQSTNGIPKIVSFSPKMFTLATADTTVTLWSPPEKV

SEQ ID NO: 94308 - protein, 288 aa, Staphylococcus aureus subsp. aureus MRSA252
MKKIKKAIIPAAGLGTRFLPATKAMPKEMLPILDKPTIQYIIEEAARAGIEDIIIVTGRHKRAIEDHFDSQKELEMVLKEKGKSELLEKVQYSTELANIFYVRQKEQKGLGHAISSARQFIGNEPFAVLLGDDIVESEVPAVKQLIDVYEETGHSVIGVQEVPEADTHRYGIIDPLTKNGRQYEVKKFVEKPAQGTAPSNLAIMGRYVLTPEIFDYLKTQKEGAGNEIQLTDAIERMNNDNQVYAYDFEGERYDVGEKLGFVKTTIEYALKDDSMREELTRFIKELGL

SEQ ID NO: 94309 - protein, 363 aa, Halobacterium sp. NRC-1
MLVCRSCGATYETGPEEPWRCRACEHAVDFAERPRATGDPTAVDPTAGLWAFSEFLPVAADDAVSLGEGWTPLVSASEWDAEFKLDYVCPSGSYKDRGAAVLMTRAAALGVDRVVEDSSGNAGAAVAQYAARAGIDAEIYVPADAPAAKLDAMEAAGATTVPVAGGRRAVTEACVSEAVGSDAWYASHAWSPSFYAGTATVAYEIAAQRGWRAPDAVVVPVGHGTLLLGAYRGFRALAAGGWIESMPRLLGVQAAGVEPVAAAVNGSASDEDAVNEAADGIQIRSPARLDQVAAAVAATDGDVVACDESATTDALASLHEAGLYVEPTSAVAVAGLAAYRARGVVGDSDDVVVALTGSGLKKP

SEQ ID NO: 94310 - protein, 572 aa, Physcomitrella patens subsp. patens
LQSFKQGLIDPAGVLSNWNNSDTTPCNWKGVLCSNSTIAVIFINLPFANLTGNVSSKLAGLKYLERLSLHHNRFFGEIPDSFSNLTSLRVLNLRNNSISGNIPQSLSALKNLRILELANNEFHGSIPESFSALTSLRYFNISNNHLIGNIPGGALRRFNASSFAGNAGLCGVLGGLPSCAPSPSPAVAPAFEPPQAVWSHKSSLSGGQIVLLCVSLFLFVKFVILAIFIMRWMRKDNDLEISLGSGGKIVMFQGAAKALPSSKEVLQATRLIRKKHIIGEGGYGVVYKLQVNDYPPLAIKKLKTCLESERSFENELDTLGTVKHRNLVKLRGFCSSPSVKILVYDFLPGGNVDQLLHHATEENLPVDWPIRYRIALGVARGLAYLHHSCEPRIIHGDVSSSNILLDNEFEPYLSDFGLAKLVSTNDTHVTMTVGGTFGYVAPEFAKSGHATDKVDVYSYGVVLLELLSGRRAVDESMSDEYANLAGWVRELHNCGRALEIVDPNLRDTVKDVALDLLLEVACHCVSLSSYDRPQMNKVVELLELLSDTASSPIRSSLTTSLESLQRSASADP

SEQ ID NO: 94311 - protein, 609 aa, Herminiimonas arsenicoxydans
MRHFTRPQLKQLADELRAFVLESVSATGGHLSSNLGTVELTIALHNVFNTPEDRIIWDVGHQTYPHKILTGRRDQMHSLRQRDGISGFPRRDESVYDTFGTAHSSTSISAALGMALAARTKGENRHAIAVIGDGAMTAGMAFEALNNAGIHDDINLLVILNDNDMSISPPVGALNRYLARLMSGQFYAAAKNVGKTVLPAPVRELAKRFEEHAKGMIVPATMFEEFGFNYIGPIDGHDLDSLIPTLQNLKHLKGPQFLHVVTKKGQGYKLAEADPVLYHGPGKFDPAEGIKPAAASKVTYTSVFGDWLCDMAAADDKLIGITPAMREGSGMVEFERRFPGRYYDVGIAEQHAVTFAAGMACEGLKPVVAIYSTFLQRAYDQLIHDVALQNLDVTFALDRAGLVGADGATHAGNYDIAYLRCIPNMVVMAASDENECRQMLSTGFHYNGPAAVRYPRGGGIGAKVEKNLATIPLGTGEIRREGKRIAILAFGTMVAPSLRAGEELDATVANMRFVKPLDVELLKRLAATHEAIVTVEEGCIMGGAGAAVAEALAAAGIVKPLLNLGLPDQFIDHGDAQQLLAMCGLDAAGIAATIRQRFGKGEPRLVVNN

SEQ ID NO: 94312 - protein, 256 aa, Pseudomonas viridiflava
MSTANQNPAAAPAMKKKLTTSAMIASIASEGQATRSAPFGHALAALADQRSDIVGLSADLSKYTDLHIFAKAHPERFYQMGMAEQLLMSAAAGMAREGCVPFATTYAVFASRRAYDFICMAIAEENLNVKIVCGLPGLTTGYGPSHQATDDLAIFRAMPNLMIVDPCDALEIEQAVPAIAAHQGPVYMRLLRGNVPLVLDEYGYQFEIGKAKTLRTGNDVLIISTGLMTMRSLEAAQELQADGVDVAVLHVPTIKP

SEQ ID NO: 94313 - protein, 250 aa, Methylococcus capsulatus str. Bath
MRRPLVVGNWKMNGRSASVARLLNDILAGIGDCKAEVGVCVPFVYIPQASEILKGTKVMLGAQNVADHNSGAFTGEISAGMLREFGCELAIVGHSERRLLYGESNELVASRYEQAIQGHLKPILCVGETLEQREQGRTLAVIGAQIDTVFEFAGVQSLEHAVIAYEPVWAVGTGRSATTGQAQEVHYHIRSLIARWNPEVAQAVQIIYGGSVKPENSAELFAMPDIDGGLIGGASLDARAFLSICHSVSV

SEQ ID NO: 94314 - protein, 647 aa, 'Chlorella' ellipsoidea
  misc_feature (613)..(613): Xaa can be any naturally occurring amino acid
MAAFLNSHLLAGWRPVLPVPARPHVHASASNGNGVATAPLPTITDIYGTTAALGPDMNAAGAYSMPAKEAEPVSPEVQALIDEQGIDFELSGLKYLSNEGRLKALAKKATKVEKMKNKKSGDRIWSDISELAALVRSGEKTWEELNLDDVDVRTKWAGLFHRKKRAPGTFMMRLKVPNGEITSKQLRVLGEQLKPFGDELGVGDITSRANFQLRGIPMAETDNVIKAVQGCGLSNVMTGMDNVRNMTGSPIAGIDPHELLDIRPLNYEINNMITNYGKGNHELSNLPRKINLALSPSRDDFPHVFINDVGLQAIRHPETGEVGFNVELGGYFSIKRNTQSINGNTYLRQDQVVAYCKALLEFFRDAGNREDRQKAGLMWLVEACGVDNFRKNVAQRMGLDDLPGHVHVEYPDVWKRRDVIGFHPQKQDGYYWACACVPSGRITADDYLAFAEIADRYGNGTARATVECNILFPFIPESKLEDLKKEPLFQKFSLEPKPLTRGLVSCTGAQFCGVAIIETKQRAMAIAAKLENELDIPQTVRMHWTGCPNSCGQVQVADIGLMGGPARHEGKAVEGVRIFTGGKVGEGASLGAEIEKGVACNDEVLLPKLREIXINQYGRHREEDGSLQDGDWRAGRPRLGPSRMTVL

SEQ ID NO: 94315 - protein, 382 aa, Thermus thermophilus
  misc_feature (234)..(234): Xaa can be any naturally occurring amino acid
MRGLSRRVQAMKPSATVAVNAKALELRRQGVDLVALTAGEPDFDTPEHVKEAARRALAQGKTKYAPPAGIPELREALAEKFRRENGLSVTPEETIVTVGGKQALFNLFQAILDPGDEVIVLSPYWVSYPEMVRFAGGVVVEVETLPEEGFVPDPERVRRAITPRTKALVVNSPNNPTGAVYPKEVLEALARLAVEHDFYLVSDEIYEHLLYEGEHFSPGRVAPEHTLTVNGAAXAFAMTGWRIGYACGPKEVIKAMASVSSQSTTSPDTIAQWATLEALTNQEASRAFVEMAREAYRRRRDLLLEGLTALGLKAVRPSGAFYVLMDTSPIAPDEVRAAERLLEAGVAVVPGTDFAAFGHVRLSYATSEENLRKALERFARVL

SEQ ID NO: 94316 - protein, 186 aa, Clostridium perfringens SM101
MKNNDSKISKYISLILRHKPEEIGLKLDEHGYLVVLDLIEGINKSYEGFSMDDLERIVREDSKGRYSFNEDKSKIRANQGHSIKVDLGLEEIKPPKVLYHGTGRKYLESILKNGLIKKERQYIHLSKDRETASIVGKRHGDLVILEVDSESMFNDGIKFYLSKNNVWLCNYVPKKYIKELNLEEVF

SEQ ID NO: 94317 - protein, 116 aa, Zea mays
MPSTVNSASLDQNLELAKQCSREAALAGFKAAAVATAVIRHEELVSVRMLPWAKANINPAGQALIVSTVAGMAYFIAADKKILSLARQHSYENAPEHLKDTSFQGTGRPHPGFFRP

SEQ ID NO: 94318 - protein, 394 aa, Roseovarius nubinhibens ISM
MAWKTLDDMDLAGKRVLTRVDINVPVENGKVTDATRIERIAPTVEHILSQGGIPVLIAHFGRPKGKVVLDMSLRIVLPALEAALGHKVGFVETLEGAENLTGEARAAEVLLLENIRFYPGEEANDPEFAARLAGLGDIYCNDAFSAAHRAHASTAGVAEHLPSCAGRLMQAELQALEAALGAPERPVVAVVGGAKVSTKLDLLGNLVDKVDHLVIGGGMANTFLAAQGLNVGASLCEHDMADTARQIMVKAGAAGCEILLPADVVVAREFAAGAENEVVPAHACPEDAMILDAGPQSVARVAAVLAKAKTLIWNGPLGAFEIAPFDTATNAAAQEAARLSREAGLISVAGGGDTVAALNQAGAAEDFTYISTAGGAFLEWMEGKTLPGVAALGG

SEQ ID NO: 94319 - protein, 457 aa, Clostridium perfringens SM101
MNKYEYIIIGFGKGGKTLAGYLGKLGKKVAIIEKSDKMYGGTCINVGCIPTKTLVNKSKVSLYKGLNTFEEKAREYRKSIEEKNALIEALRDKNYNMLNNNENVDVFNGTASFISNTEILINSEKEDIILEGEKIFINTGATTIIPNIQGIKSSSKIYNSTTIMELKELPKHLVIVGGGYIGLEFASIYASFGSKVTVIEAFDRIAGREDEDISKSIKEILEKKGIEFLLGSKVKSFEEIHGEVEVSYENSLGELNKITGDAVLIAIGRKPNTEELNLEAAGVKVTERGAIEVNNKLKTNIPNIWAIGDVNGGPQFTYISLDDFRIIKDNLFGEGKRSTDDRKFIPYSVFIEPNLSRVGLSEKEALEKGFEIKTAKLDVNTIPRAKVIGETEGIMKAIVDVKTNKILGCTLLCAESAEIINIVTLAMKADEDYTFLRDNIFTHPTMSEALNDLFSLI

SEQ ID NO: 94320 - protein, 589 aa, Brassica napus
MSLPETKTQTLLDAWDFQGRPADRSKTGGWASAAMILCIEAVERLTTLGIGVNLVTYLTGTMHLGNATAANTVTNFLGTSFMLCLLGGFIADTFLGRYLTIAIFAAIQATGVSILTLSTIIPGLRPPRCDPTTSSHCVQANGIQLTVLYLALYLTALGTGGVKASVSGFGSDQFDDTEPKERSQMTYFFNRFFFCINVGSLMAVTVLVYIQDDVGRKWGYGICALAIVLSLSIFLAGTNRYRFKKLIGSPMTQVGTVLVAAWRNRRLELPSDPSFLYDLDDVIAAEGSMKSKQKLPHTNQFRSLDKAAIKDQEMAMTQNVYNKWTLSTVTDIEEVKQIVRMLPIWATCILFWTVHAQLTTLSVAQSETMDRHIGSFEIPPAAMAVFYIGGLLLTTAVYDRLAIPLCKKLFNYPHGLRPLQRIGLGLLLAAMGMAVAALVEIKRLRTAHAHGPTVKTLPLGFSLLIPQYLIVGIGEALIYTGQLDFFLRECPKGMKTMSTGLLLSTLALGFFFSSVLVTIVEKVTDKAHPWIADDLNKGRLYNFYWLVAVIVALNFLVFLVFSKWYVYKEKRLADLGIELEDEPDIPMGH

SEQ ID NO: 94321 - protein, 398 aa, Roseovarius nubinhibens ISM
MGFAQGRSYLAIPGPSVVPDAVQRAMHRAAPNIYQGELVDMMDGLTTDLRHVAQTDGYVAIYIANGHGAWEASLANTIAPGDRVLVLATGHFGLGWGRHAEAMGAKVDLLDFGNRATIDPDRIEAALRADTTHEIKAVLVTHVDTSSTVRNDIASVRAAMNAASHPALLMVDCIASLGCERFEMDRWGVDVMVSASQKGLMLPPGLGFVWFNDRADAVQTRLDRVSPYWSWTPRAKPEAFYQYFGGTAPTHHLYGLRVALDMIRQEGLDAIWQRHARLAGAIWAATDCWARDGAMRLNISDSALRSHAVTALSLTAPDASRLRGWTEEMAGVTLGIGLGMAEQGTPAADGFFRIGHMGHVNAHMVLGALGAIEAGLAALDIPHGSGGVSAAARALAAD

SEQ ID NO: 94322 - protein, 481 aa, Hordeum vulgare subsp. vulgare
ALAAKAGVVGAGRTTAPPAVPGLPLIGNLHQLKEKKPHKTFAKWSDIYGPIYTIKTGASSVAVLNSSEVAKEAMVAKYSSISTRKLPKALSVLTRDKTMVATSDYGDFHKMVKRLVMSGMLGSSAQRQFRDTRDMMMDNMLSTFHTLVTDDPHSPLNFREVFKDELFRLSLIQSLGEDVDSVYVKEFGREISKDEIYQITVVDMMMCAIDVDWRDFFPYLSWIPNKSFETRVHTAESRRTAVMQALIRQQKKRIANGEARASYLDFLLAEKALTDEQLMMLVWEAVIEAADTTLVTTEWAMYELAKNPEKQDRLYQEIREVCGDETVTEDHVPRLPYLSAVFHETLRLHSPVPLVPPRFVHETTKLAGYDVPAGTEIVINLYGCNMNKKDWEEPEEWRPERFMDGRFEAADMYKTMAFGAGRRSCAGSLQATSISCAAIARFVQDFAWRLKEGDEDNVDTVQLTSYKLHPLYVYLLPRGRK

SEQ ID NO: 94323 - protein, 594 aa, Treponema denticola ATCC 35405
MKKLNGLIASDGLAAGPLYCIMEQPETVIPSYSISENEIDLQKSRLAGAVEKAKNELSELISSSSDVEKNENDKTGEDIISTHILMLSDTAFLDSVFAAIEKARMNAEFVLKRKLDETIAMLQTAGDKYLSARAVDIQDAFESVFVHLLKQGARDSRFTKVPKGAIIAAKLIKPSEALLVKNAGVSGIIMEEGGVTSHISIMARAWDIPMLVGVKNCMDFARTNMPAALDADGGFVLFNPSKTLIKEYEERIEKRNAEIKELLEAQKNYTERLSITTKDGVKVSVNANIAFPEEIENKFVTISNGIGLFRSEFLFLEDGKIPDEDTQFEAYKKVVEAMGKKPVVIRTFDVGADKMIDEQETLREKNPLLGWRAVRYCIERKEVFKTQIKAILRAGVFGNVFLLIPMISNIEEIIEVKKIIEECKLECNADGKKIIEKVNVGIMVEVPSTAVAADLYAPYLDFFSIGTNDLIQYTMAADRENTKVAYLANYFEPAVLRLIKNVIDAQRFIKEQVGHLVSMCGEMASHEDAAFLLLGMGLRHFSMPAGKILKMQKFMQSVNVKDAEVLYEKIKKLNSASQIKTEVQKALEIYYAEN

SEQ ID NO: 94324 - protein, 571 aa, Magnaporthe grisea 70-15
MAPHLLLNTGITVNTDLESANTNAPTMTNTPQDVEANSLDCLVQSNGAVPVETNSLMGQSVGPFTVVMLNIGNIIGIGVFSTSSSILKGTGSVGMSMIYWTIGIFIAASHLAVFLEFACYFPKRSGSLVVFLEQSYPKPRYLFPIMIALVGLILGFGSSMALVLAKYLFQAVGHTYTTWELKGLAVAGYTAVIVLLTLSNRVSYWVINVMGVIKIATLAFISVAGLLVLGGRVPKIPDPLANFRDPFSGTATAYGLTNALVKIIFSYAGSGNGINVQGELKKPGKSLRNMEFLALGATGILFVLTNLAFFAAIPKNELENSTEIAAGMFFRRVFGDSGWVRGLNVLIALCALGSIVSTTLGLSRMTRESGRQGVIPWTRFWASTRPFGTPLGPYAWRWALTTIMILAVPSGDAFNFMVDLQMYPGVFFELALNVGLVVVRARRSRQHAPRPEFRAWNVALMVNTLASLAVIVMPWYPPDGGPYAGDVSFWYATYAAAGVGVLVVCALYYLFKIHLMPRWGGYVIRDTTVMLQDNVQTNMLVKVPLGKLASLGEACKGTPSNISSEPNNGKD

SEQ ID NO: 94325 - protein, 198 aa, Brassica napus
LRMQKGLVPTKFFADMLRIAKILKASPSCVANLEKRIGMQLDQAALEDLVMPSFSHTMETLYDVDSVQRILDHFLSTDQIMPADVGSPCSSVDDGNVIGSPRLITPMTAVAKLIDGYLAEVAPDVNLKLPKFQALAASVPEYARLLDDGLYRAIDIYLKHHPWLAETERENLCRLLDCQKLSLEACTHAAQNERLPLR

SEQ ID NO: 94326 - protein, 445 aa, Physcomitrella patens subsp. patens
MGTPRDYEFYIAARVMLGTLLRLEVDADLVVIASTSVPQHWQETLTDEGFKVVVVKDIQNPYHSNHNFNKRFEFTLNKIYVWSLTEYTRVVMLDVDNLFLRKPDELFQCGQFCAAFINPCIFHTGLFVLQAIFVPDLQPSSEVFSTMMHDINAKKENRDGVDQGFLVSHFTDLLDRPMFHPPVDGSRLNGLFRLSIGYQMDAAFYYLKLKWRIPCGPNSVITFPSVPMLKPWYWWSWPTLPLGLSWHEKRMETIGYESETSTLIAESLFYVVTMFLAIIIRQRYAAVEKSFTKSCFGRGLYCEKKMCHPLALKILIALLVAVSFLFPALIIPTTVHPFAGWGVFLLGSLWHLTVVINSFQLPVLPVLTPWIGGIGALSVLAWPFYSNGILRAAAIAVYTALVTPILWNAAMKVSAVVDVRTHWEPQLTWTRLNSGSGSETLMKLC

SEQ ID NO: 94327 - protein, 429 aa, Arabidopsis thaliana
MVNPEENNRNLVVKPITEILQDDDKRSRKFGVEMKRQNRRALGVINHNLVGAKAYPCVVNKRRGLSQRKQESCDKKKLDSLHPSISRSQEETKKLKPSGNEFGDCIFIDEEEEKNEEVTLDQPMPMSLEEPYIEFDPMEEEVEMEDMEEEQEEPVLDIDEYDANNSLAAVEYVQDLYDFYRKTERFSCVPLDYMAQQFDISDKMRAILIDWLIEVHDKFELMNETLFLTVNLIDRFLSKQAVARKKLQLVGLVALLLACKYEEVSVPIVEDLVVISDKAYTRTDVLEMEKIMLSTLQFNMSLPTQYPFLKRFLKAAQSDKKLEILASFLIELALVDYEMVRYPPSLLAATAVYTAQCTIHGFSEWNSTCEFHCHYSENQLLECCRRMVRLHQKAGTDKLTGVHRKYSSSKFGYIATKYEAAHFLVSDSH

SEQ ID NO: 94328 - protein, 277 aa, Candida albicans SC5314
MRTILTRSIFKFRYPNIIQRTMSSTSTSTSTPSFPEPTEARKQELITNYNNTLQQVQSLNPKVNLVAVSKLKPSSDIMALYSIGVRHFGENYVQELIAKSQELPNDIKWHFIGGLQSGKAKDLSKHVANLYAVETIDSLKKCKQLDNTRVKVEGDDINVFLQINTSGEEQKSGFQNLQDIESTVEFLLSSDCKKLKFLGLMTIGSFNESISNENDKENQDFKKLVEMKQILDSKYNLNLELSMGMSNDFQQAIKQGSTSVRVGTTIFGSRPPSQQQK

SEQ ID NO: 94329 - protein, 256 aa, Bacillus anthracis str. A2012
  misc_feature (104)..(104): Xaa can be any naturally occurring amino acid
  misc_feature (191)..(191): Xaa can be any naturally occurring amino acid
  misc_feature (233)..(233): Xaa can be any naturally occurring amino acid
MYVKEKVVIITGGSSGMGKGMATRFAKEGARVVITGRTKEKLEEAKLEIEQFPGQILTVQMDVRNTDDIQKMIEQIDEKFGRIDILINNAAGNFICPAEDLSVXGWNSVINIVLNGTFYCSQAIGKYWIEKGIKGNIINMVATYAWDAGPGVIHSAAAKAGVLAMTKTLAVEWGRKYGIRVNAIAPGPIEXTGGADKLWISEEMAKRTIQSVPLGRLGTPEEIAGLAYYLCSXEAAYINGTCMTMDGGQHLHQYPF

SEQ ID NO: 94330 - protein, 324 aa, Candida albicans SC5314
MTDFVYQGEDFDEKVRKQVEFYFSDSNLQTDKFLWKIYESNDGWVELKTILTFGRMRQYRPEDKVISALKESKKLVLSANNDMIRRKDPIKDFNEVKNTRKRNTIHIEGFPKDLSQDDVENWVNEKVIVQLPKEKEVCSIRRIKSRAKKEFFGVVDIEFKTQEDAEFILNNVELSYPEGIISKEDAQSLEKKDLLKKMTLLTFQEMRESSKRFGVNEVTKRRNSFNENHKGGNKKFKKGNNNGKGKNNKNENDNGNGTEDKETKLEKVEEIDSTKENTEEVAAKETAPESTEKTETKEAPAPTTETETETKTEVTEATEAAKEE

SEQ ID NO: 94331 - protein, 191 aa, Acetabularia peniculus
MTGDVDMSLHPSGIIPELQNVVSTVNLGCTLELKEIAMQARNAEYNPKRFAAVIMRIRDPKTTALIFGSGKMVCTGAKSEQDSRTAARKYAKIVQKLGFPAKFTEFKIQNIVGSCDVKFPIRMEPLAYQHQQFCSYEPELFPGLIYRMLQPKIVLLIFVSGKVVLTGAKERTEIYRAFEQIYPVLTQFRKR

SEQ ID NO: 94332 - protein, 379 aa, Aspergillus fumigatus
MSRSTHRDDFFQTSAALEEQKRKDAKSRNTHGSPIKLQSKILAIAADPVNQGAVFVALSTGTVRKIILETGETAAVFKGPTAPVTSVCFSPDGRLLFAGCWDKTIWSWDVASGQPQHRYEGHTDFVRSVISSSLRGQDLLVSGGADAQILVFDIASGKRLYTLKGHAKGVQDLIMDPTSLDLESKSLVLFSAGSDREIRWFDITCGSQDLTAMDPLLAHDTSVYKLFFDSDGDLWTASADKTAKCLVREDGWKANLTLPHPDFVRDVVVYEQGGWVITACRDEEVRVWHRSNSQTGQLYHTFSGHFEEVTRLVLIGSTIVSVSIDATIRQWSLRPDDLRTAVEKAKRVKAEEEEQSEQNPESMLTEEEERELAELMNED

SEQ ID NO: 94333 - protein, 234 aa, Herminiimonas arsenicoxydans
MSVIRQNLQAVRQRITDAANSAQRDVHEVELLAVSKTFGADAVLAAAEAGQRAFGENYLQEALDKMDAVRAIRPDLPLEWHFIGPVQSNKTRPIAEHFDWVHAVDREKIAHRLSEQRPATLPPLNICLQVNISGEASKSGALPADAPGLAKAIAKLPHLRLRGLMAIPEPEDDEVRQRRSFHQLRVLYEQLRAEGLPLDTLSMGMSADMPAAIAEGATIVRIGSAIFGTRNYAK

SEQ ID NO: 94334 - protein, 274 aa, Herminiimonas arsenicoxydans
MQNNLKISFIGGGNMAAALIGGLAGKLTAAQNIHVIDISADALAKLHAQFGVTTSIEIDARIAGSDVIVLAVKPQQMKGVATQILPHIGTQLVLSIAAGIRAADLSRWLNGYQAIVRTMPNTPALIGKGITGMVATAGVSDVQRAAADAILRAVGETVWLDDEKLIDPVTAVSGSGPAYVFYFIEAMQQAAQEMGLTAEQGNALAVSTFVGAAQLAAQASDPVSVLRERVTSKGGTTYAALTSMEESGVKQAIINAMKAAAARGQALGEEFGRD

SEQ ID NO: 94335 - protein, 398 aa, Oryza sativa
  misc_feature (261)..(261): Xaa can be any naturally occurring amino acid
MPLTREAADAFGVATITLFAIFAVLGLFCIFQSIYFRFRIRRGAFIPLGYFNGPWVTRIVLILITIWWGVGEIVRLSFLKRKLFSSILLQKGVCDAYILSNLGFAEPSIFFAFAFLLHGSLQKRELGTLNQRWNWKTIGYMLVFCVPVFFVQALLVFVGPTFVKDENNTHGRKKIAKYFIRTSMPVGDTNICTYPLFGTIFLGLIDAILMSYVSYVGSRVLSLVHHKELRRRVSLLMLSVLYFLSIRVLLLGFSVLPQPGXDVAFEVIIFLSFLMMISCTTVGVLLLVYYPVADSLALREIGQREITEMVPYDDYYYEGASLVANQSFREIERNSDTSTKRGSISFRTMIREDQLQQDGVDEIGFSSRSGAHIGSPSPSGSSPSAAMPMLPLKEVPRY

SEQ ID NO: 94336 - protein, 339 aa, Haemophilus influenzae R2846
MAIKIGINGFGRIGRIVFRAAQHRDDIEVVGINDLIDVEYMAYMLKYDSTHGRFDGTVEVKDGNLVVNGKTIRVTAERDPANLNWGAIGVDIAVEATGLFLTDETARKHITAGAKKVVLTGPSKDATPMFVRGVNFNAYAGQDIVSNASCTTNCLAPLARVVHETFGIKDGLMTTVHATTATQKTVDGPSAKDWRGGRGASQNIIPSSTGAAKAVGKVLPALNGKLTGMAFRVPTPNVSVVDLTVNLEKPASYDAIKQAIKDAAEGKTFNGELKGVLGYTEDAVVSTDFNGCALTSVFDAEAGIALTDSFVKLVSWYDNETGYSNKVLDLVAHIYNYKG

SEQ ID NO: 94337 - protein, 417 aa, Nocardia farcinica IFM 10152
MGHVSPHLPHRPPRVLEQSTKLQNVVYEIRGPVHAHAARLEAEGHRILKLNIGNPAPFGFEAPDVIMRDIIAALPYAQGYSESKGILSARRAIVTRYELVPGFPEFDVDDVYLGNGVSELITLTMQALLDNGDEVLIPAPDYPLWTAMTSLAGGTPVHYLCDESNGWQPDIADIEAKITDKTKALLVINPNNPTGAVYSAEVLQQIVDLARKHQLLLLADEIYDKILYDDAKHISLATLAPDLLCLTFNGLSKAYRVAGYRSGWMVITGPKEHATGFLEGIDLLATSRLCPNVPAQHAIQVALGGHQSIEDLILPGGRLLEQRDVAWERLNMIPGVSCVKPKGALYAFPRLDPEVYEIHDDSKLILDLLLQEKILMVQGTGFNWPAHDHLRIVTLPWARDLAVAIERFGNFLASYRQ

SEQ ID NO: 94338 - protein, 339 aa, Synechococcus sp. RS9917
MGINGFGRIGRLVFRALWGRPGIEIVQINDPAGDAAIAAHLLEFDSVHGRWDRSLNAEASGFSVDGQAVGWSQERAITAVPWREQGVEMVLECSGKIKTPETLAPYFESVGLKRVVVACPVKGVVAGAEALNIVFGINQQLYDPARHRLVTAASCTTNCLAPMVKVVQEQFGIVHGMITTIHDITNTQVPIDAFKSDWRRARSGLTSLIPTTTGSAKAIAMIFPELQGKLNGHAVRVPLLNGSLTDAVFELQRDVTVAEVNGALQAAAEGPLKGILGYEERPLVSCDYTNDSRSSIIDAPSTMVVDGNQLKLFAWYDNEWGYSCRMADLACHVAALEAR

SEQ ID NO: 94339 - protein, 460 aa, Oryza sativa Japonica Group
MGSVVSSANINARSMDRHEKSGFGSNKRVKISTYECDSFQRIIPTLPDELSFQILARLPRLYYLKLKLVSQAWKAAITSSELSQLRRELGLTEEWLYVLTKLEPNKLDCYALDPLFRKWQRLPPMPSFVSEEESTGRTQSSWFQTWNVVGSSIRIADFIKGWFRRRYGLDQMPFCGCSVGVADGCLYVFGGFSRAVALNCVFRYNPCLNVWQEVSPMISGRAFSKAALLQSKLYVVGGVSRGRNGLLPLRSGEVFDPKTGIWSELPEMPFMKAQVLPTAFLADVLKPIATGMASYKGKLYVPQSLYSWPFFFDIGGEIYDPELNSWETMADGLGDGWPARQAGTKLGIVVNEELYTLEPSSSLDSGQIKRYDSEQDTWKTIVPQVPVHDFTDAEAPFLLAGLHGKVHVITKEANNNLQVMQAVLQNNIENSPSEENIIWNILASKNFGSAELVSCQVLDV

SEQ ID NO: 94340 - protein, 514 aa, Zea mays
  misc_feature (36)..(36): Xaa can be any naturally occurring amino acid
TKQGRCVAFPCGWLGRLSRELHWTFVLAVAAVYGLXACQGVGNAIGGVAAGYYWKDVQRVQPSVAQFYQGVTDAPWIVKPIWGLLTDVVPVAGFRRRPYFVLAGVIGVSSMLMFSLNHELGIMPALLMLTAQSAGAAVGDVTVDALVAQNSITHPPLAADMQSLCGFSSSIGALLGFSLSGLLVHSMGSQGALGLLSIPSALVLLAGILLKENRGTEFDYMQVHKKFYKAIQSMGRTLKCPQVWRPCAYIFVSLNLSLDIQGGMFYWYTDPVVGPGFSEGYIGLIYSIGSVGSLIGVLLYQSTLKDYTFRSMLLWGQVLSSLAGMLDLVLVTRLNLKIGMPDYFFAVADNTVSQMVGRLQWLPLLVLCSKLCPPGTEGTLYALLMSLQNAGLLMSAWWGGLLLHMLNVTRLEFSNLWIAVLIRNISRFVPLMLLFLVPDCDQNSALLPAEMLHGSESTETMEKGSNEFSVLVGDDCGCISPDVTVDNEQIKMFDAEIDDVELIPLVNKSGLTIS

SEQ ID NO: 94341 - protein, 274 aa, Oryza sativa Japonica Group
MAAGSSHVSADARKLVGKVAVITGGASGIGACTARLFVKHGARVVVADIQDELGASLVAELGPDASSYVHCDVTNEGDVAAAVDHAVARFGKLDVMFNNAGVSGPPCFRMSECTKEDFERVLAVYLVGPFLGTKHAARVMAPARRGSIISTASLSSSVSGAASNAYTTSKHALVGFTENAAGELGRHGIRVNCVSPAGVATPLARAAMGMDDEAIEAIMANSANLKGAGALKADDIAAAALFLASDDGRYVSGQNLRVDGGLSVVNSSFGFFRD

SEQ ID NO: 94342 - protein, 239 aa, Oryza sativa Japonica Group
YLLYKIFPPEIKDTPEAPAIAAQKLKNMGPVTRNEWIMVATMILAVSLWIFGDTIGVSSVVAAMIGLSILLLLGVLNWEDCLNEKSAWDTLAWFAILVGMAGQLTNLGIVSWMSNCVAKVLQSFSLSWPAAFGVLQASYFFIHYLFASQTAHVGALYSAFLAMHLAAGVPAILSALALTYNSNLFGALTHYSSGQSAVYYGAGYVDLPDVFKLGFTTAAINAVIWGVVGTFWWKFLGLY

SEQ ID NO: 94343 - protein, 257 aa, Arabidopsis thaliana
MAVRSVKVGNLSSGATEHDIKEFFSFSGEVESIDIQSNEHSAYVTFKETQGAETAVLLSGASIADQSVIIELAPNYSPPAAPHAETQSSGAESVVQKAEDVVSSMLAKGFILGKDAVGKAKAFDEKHGFTSTATAGVASLDQKIGLSQKLTAGTSLVNEKIKAVDQNFQVTERTKSVYAAAEQTVSSAGSAVMKNRYVLTGVSWAAGAFNRVAQAAGEVGQKTKEKVEAEQPSQPAQSQQQLPEGYSPIHSSEYSKN

SEQ ID NO: 94344 - protein, 504 aa, Methylococcus capsulatus str. Bath
MSTAMPGAFSPPRGLADLPLCPVYSRLGRPFHQPVAATSLPEPRMVHFNAALAGELGFGPEAGPQLLEILAGNRPWPGYASSASVYAGHQFGAWVPQLGDGRALLIAEVRTPARERVELQLKGAGPTPYSRGLDGRAVLRSSIREYLASEAMHALGVPTTRCLSLVASPQPVARETVESAAVVCRAAASFVRFGQFEYFAGRGQTEPMARLADHVIAEHFPHLQGHPERHAAWLGEVIERTARLIAQWQLLGFCHGVMNTDNFSVLGLTLDYGPFGFMDRFRWYHVCNHSDYEGRYAYRAQPEVGRWNCERLLQAVSPLLADAPGRAAEIGQDLLRRYASVYHRAVMRGWADKLGLREVRETDAGLIDEFLGLLQRGRGDFTRSFRLLGRIRTDSDAPARGVREAFADINAFDAWVADYRTRLRSEQNVDDEARAGRMNRVNPKYVLRNHLAQIAIDKAMLGDYSEVARLAELLRRPYDEQPDMEAYAAEPPDYMRNIEVSCSS

SEQ ID NO: 94345 - protein, 262 aa, Candida albicans SC5314
MFTFTRNIPRSLLHYTPITKRTPLITTTIRNLFIQTSETPNEQALKFLPSIKILQDNQTKEFLSGREAASSPLALKLFSIDGIRSVMFGSDFITIEKSNNFDWSLLKPEIFSILTEYLTNGTPILLEDNVDEYGNSLLTNDMAINEDDDEVVSMIKELIFTRIRPAIQDDGGDIEFVNFNEEDGTVYLRLKGACRSCDSSSVTLKNGIESMLKHYIEEVNSVEPIEEEQQQEEINVESSTIKPINRDEPSSSVSSSSSPPSL

SEQ ID NO: 94346 - protein, 414 aa, Clostridium perfringens SM101
MKRWTFDENTIILPNGLKVITIKKNTRLASINIGVNIGSLYEDEKELGMSHFVEHMLFKGTKNRSNEQLNRELEFLGGDYNAYTDYISTVYSITCLDEEFEKGIELLSDMILNSSFDEKEMKKEKGVVLSEIKSDKDDIEDLSISRIHEYAFDKSALRNSIAGTEEHVKGFKRKQVYDFYKKYYTPDNCVIVTVSAFSHEQMQKIITDLFGKWEGKSHKKAKIIKEENKNIVKTTYKSQIEQGTVTYLYAFKEVCEKDKLPLKILSYKLAESSNSILFRELREERGLAYDVYSQMDLDENVNTMNIFTSVREESIDEVIEVIDKAILDIKNRDINFDEDMLCMMKKTHKTGVVSTLEDCSSLCSYVLVQSLAGKDITEFINSMEELETLTGEDIYRVCNKYLNKPTIHILKPME

SEQ ID NO: 94347 - protein, 210 aa, Brassica napus
  misc_feature (44)..(44): Xaa can be any naturally occurring amino acid
  misc_feature (153)..(154): Xaa can be any naturally occurring amino acid
  misc_feature (156)..(156): Xaa can be any naturally occurring amino acid
  misc_feature (158)..(158): Xaa can be any naturally occurring amino acid
  misc_feature (160)..(160): Xaa can be any naturally occurring amino acid
  misc_feature (172)..(172): Xaa can be any naturally occurring amino acid
  misc_feature (176)..(176): Xaa can be any naturally occurring amino acid
  misc_feature (182)..(183): Xaa can be any naturally occurring amino acid
  misc_feature (185)..(185): Xaa can be any naturally occurring amino acid
  misc_feature (190)..(190): Xaa can be any naturally occurring amino acid
MERRRVTGEAPTQKRIVLASLSAMVAESVTFPIDLTKTRMQLHXYAPGSASAAHRVGAIGVVSEIMRQEGMMGFYKGLSPAIIRHLFYTPIRIIGYENLKGFVVRSDAINGESLPLATKALLGGLSGVMAQVVASPADLVKVRMQADGRLVSXXLXKXRXSGPIEAFTRILXSERXGRVFGXXGXVPKIXKSVSGWEGQLLVNNKNYHSG

SEQ ID NO: 94348 - protein, 149 aa, Zea mays
MAMRMAAAAVALVAVMGVLAPRAAAQTPNCAEKLIPCSPYMNTTGTPPDTCCGPLKDAVQNDLKCLCDLYASPEIFKAFNISLDQALGLSKRCGLSDTTAACKGLSPTQSPPGSPPSGGSSNAARRALPASFAGLVTSLFLALWSVLLA

SEQ ID NO: 94349 - protein, 235 aa, Oryza sativa Japonica Group
MPNGSLEKFIYAENSKTTLGWDKLYDIAVGIARGLEYLHRGCNTRIIHFDIKPHNILLDHDFVPKIADFGLAKLCNPKESYLSMAGMRGTIGFIAPEVFSRRFGVVSTKSDVYSYGMMLLEMVGGRKNLKASVDNPSEMYFPDWIYRCLADVGSLHSFDMEHETEEIARKMASIGLWCIQVSPSSRPTMSKVLEMFERSADELEIPPKHCFYSAIQEDSFEQESYLQIVTISPPV

SEQ ID NO: 94350 - protein, 407 aa, Oryza sativa Japonica Group
MASYTPATDVAAGDEEEAACLQAFELMCAFTVPMTLKAAIELGLLDALVTAADDDDGRALTADELAARLPDALDKAEAASSVDRMLRLLASCNVVKCSTEAGPAGEPLRRRYSPAPVCRVVHRRRQQSPWISGPLGLVRHRRGLPEHLVRTKNSIEHLTNFIFHRNYIFFSICPAIDANLPRHQLAAAVGGGGAVAFERAHGAPMFEYMGTNRRLNTLFNQAMAQQSMIVINKLLDRFHGFDGVGVLVDVGGGTGGTLEMIMSRHKHITGVNFDLPHVISQAPSLPGVKHVAGNMFESIPNGDAIFLKSILHLQNDEDCIKILKNCHQALSDNGKLIAVEIVLPAIPEPVPTAQYPFQMDMIMLNNFRGGKERTELEFTKLAMDSSFSGTLRTTYIFANYWALEFNK

SEQ ID NO: 94351 - protein, 340 aa, Oryza sativa Japonica Group
MTLKAAIELGLLDALAAAGDGRALTADELAAARLPDAAPDKAEAASSVDRMLRLLASFDVVKCSTEAGPGGEPPRRRYSPAPVCRLFTAGGNSHRGSLAPSVLFGVDEDYLCTWRQLAAAVGGGGPSAFERAHGMRMFEYMGTNRRLNTLFNQAMAQQSMIVIDKLLDRFHGFDGVGVLVDVGGGTGATLEMITSRYKHITGVNFDLPHVISQAPSIPGVKHIAGNMFESISNIGDAIFLKMILHMQNDEDCIKILKNCHQALPDNGKVIAVEIVLPTIPDLAQTARYPFQMDMIMLSNSRGGKERTELEFAKLATDSGFSGALRTTYILANYWVLEFSK

SEQ ID NO: 94352 - protein, 522 aa, Burkholderia sp. 383
MSFSRSAADAADTLPDLAATLGEPAVGAFVTLGDAFHTRLPAAPLAAPYVVGFSGEVAQLLDLPPSIAAQPGFAELFAGNPTRDWPANAMPYASVYSGHQFGVWAGQLGDGRALTIGERTGTDGRRYELQLKGSGRTPYSRMGDGRAVLRSSIREFLCSEAMHHLGIPTTRALTVIGSDQPVVREEIETSAVVTRVSESFVRFGHFEHFFSNDRPDLLRQLADHVIDRFYPECRRADDPYLALLEAATLRTADLVAQWQAVGFCHGVMNTDNMSILGVTIDYGPFGFVDAFDANHICNHSDTSGRYAYRMQPRIAHWNCYCLAQALLPLIGLQHGIDDDDARAERAVEDAQAVLAKFPERFGPALERAMRAKLGLELERESDAELANKLLETMHASHADFTLTFRRLAQISKHDASRDAPVRDLFIDRDAFDAWANLYRARLSEETRDDAARAAAMNRVNPKYVLRNHLAEVAIRRAKEKDFSEVERLAQILRRPFDEQPEHEAYAALPPDWAGSLEVSCSS

SEQ ID NO: 94353 - protein, 647 aa, Arabidopsis thaliana
MRLFFTPSMSNLSIFFSILLLSLPLPSIGDLAADKSALLSFRSAVGGRTLLWDVKQTSPCNWTGVLCDGGRVTALRLPGETLSGHIPEGIFGNLTQLRTLSLRLNGLTGSLPLDLGRCSDLRRLYLQGNRFSGEIPEVLFSLSNLVRLNLAENEFSGEISSGFKNLTRLKTLYLENNKLSGSLLDLDLSLDQFNVSNNLLNGSIPKSLQKFDSDSFVGTSLCGKPLVVCSNEGTVPSQPISVGNIPGTVEGREEKKKRKKLSGGAIAGIVIGCVVGLSLIVMILMVLFRKKGNERTRAIDLATIKHHEVEIPGEKAAVEAPENRSYVNEYSPSAVKAVEVNSSGMKKLVFFGNATKVFDLEDLLRASAEVLGKGTFGTAYKAVLDAVTLVAVKRLKDVTMADREFKEKIEVVGAMDHENLVPLRAYYYSGDEKLLVYDFMPMGSLSALLHGNKGAGRPPLNWEVRSGIALGAARGLDYLHSQDPLSSHGNVKSSNILLTNSHDARVSDFGLAQLVSASSTTPNRATGYRAPEVTDPRRVSQKADVYSFGVVLLELLTGKAPSNSVMNEEGMDLARWVHSVAREEWRNEVFDSELMSIETVVSVEEEMAEMLQLGIDCTEQHPDKRPVMVEVVRRIQELRQSGADRVG

SEQ ID NO: 94354 - protein, 506 aa, Rhodococcus erythropolis
MTKYARPGTADAIMSFQSRYDNWIGNEWVAPVKGQYFENPTPVTGQNFCDVARSTAEDIELALDAAHAAAPAWGKTSVAERAIILNKIADRMEENLESIALAESWDNGKPIRETLNADIPLAIDHFRYFAGAIRAQEGSLSEINSDTVAYHFHEPLGVVGQIIPWNFPILMAVWKLAPALAAGNAIVLKPAEQTPVSILHLIGIIGDLLPAGVLNIVNGFGVEAGKPLASSPRIKKIAFTGETTTGRLIMQYASQNLIPVTLELGGKSPNVFFSDVLASNDDYQDKALEGFTMFALNQGEVCTAPSRALIQEDIFDEFLAMAAIRTKAVRQGDPLDTDTMIGAQASNDQLEKILSYIEIGKAEGAKVITGGERAELGGDLSGGYYVQPTVFTGNNKMRIFQEIFGPVVSVTSFKDYDEAIEIANDTLYGLGAGVWSRDGGVAYRAGRDIQAGRVWTNTYHQYPAHAAFGGYKQSGIGRENHLMMLSHYQQTKNLLVSYAQKAQGFF

SEQ ID NO: 94355 - protein, 150 aa, Methylococcus capsulatus str. Bath
MSIGQFCIRDTVIVDKDDTIVEAAKVMRAHHVGSVVVVEEAEGGCKPLGILTDRDLVVEILAEEVAPDAVTVGDVMSFELVTAQEQDGLWETLQRMRAHGVRRIPVVDERGLLVGIISADDYLEILAGELGELARLLAREKGREEQARSA

SEQ ID NO: 94356 - protein, 159 aa, Triticum aestivum
PLAAATASSSKPSSPPSKLTAPNPPPPPSHGGGRRGPRQEEEKWVPVTKLGRLVKEGRFTKMEEIYLHSLPVKEHQIVETLCPGLKDEVMKITPVQKQTRAGQRTRFKAFVVVGDSNGHVGLGVKCAKEVATAIRGAIILAKLSIVPVRRGYWGNKIGQ

SEQ ID NO: 94357 - protein, 564 aa, Kluyveromyces marxianus
MSEITLGRYLFERLKQVEVQTIFGLPGDFNLSLLDKIYEVPGMRWAGNANELNAAYAADGYARLKGMACVITTFGVGELSALNGIAGSYAEHVGVLHVVGVPSISSQAKQLLLHHTLGNGDFTVFHRMSSNISETTAMITDINSAPSEIDRCIRTTYISQRPVYLGLPANLVDLKVPASLLETPIDLSLKPNDPEAENEVLETVLELIKDAKNPVILADACCSRHNVKAETKKLIDITQFPAFVTPMGKGSIDEQHPRFGGVYVGTLSSPEVKEAVESADLVLSVGALLSDFNTGSFSYSYKTKNIVEFHSDYIKVRNATFPGVQMKFVLQKLLTKVKDAAKGYKPVPVPHAPRDNKPVADSTPLKQEWVWTQVGKFLQEGDVVLTETGTSAFGINQTHFPNDTYGISQVLWGSIGFTGGATLGAAFAAEEIDPKKRVILFIGDGSLQLTVQEISTMIRWGLKPYLFVLNNDGYTIERLIHGETAQYNCIQSWKHLDLLPTFGAKDYEAVRVATTGEWNKLTTDKKFQENSKIRLIEVMLPVMDAPSNLVKQAQLTASINAKQE

SEQ ID NO: 94358 - protein, 416 aa, Candida albicans SC5314
MAPFAGIKELPPDPLFGLKARYNADSRTNKVDLGIGAYRDNNGKPWILPAVRQAEQKLINSPDYNHEYLSISGFAPFTESAAKVILGENSLAIKDKKIVSQQSLSGTGALHLAGVFIKEFYQGNHTIYLSQPTWANHKQIFEYIGFKVASYPYWNNDTKSLDLSGFLKAISSAPDGSVFLLHACAHNPTGLDPNQSQWDEILAALEKKKHFIIFDSAYQGFASGDLEKDAYPIRKAIDSKVITSPIIICQSFAKNVGMYGERVGAIHVIPSTVESNDSLNRAIKSQLNRIIRSELSNPPAYGSKIVATILNDPELYSQWRKDLVTMSSRIGEMRNTLRSKLESLGTPGTWNHITEQTGMFSFTGLTPQMVERLEKHHGIYLVSSGRASVAGLNEHNVDQVAKAIDEVVRHFGKSKL

SEQ ID NO: 94359 - protein, 236 aa, Brassica napus
  misc_feature (179)..(179): Xaa can be any naturally occurring amino acid
GLVANTITYTTLIHGFCQLGNLNAALDLLQEMISSGVCPNVVTCNTLLDGLCNNGKLKDALEMFKVMQKSKMDLDASHPFNDVEPDVQTYNILICGLINEGKFSEAEELYEEMPHRGLVPDTITYNSVIDGLCKQSRLDEATQMFDSMGSKGFSPDVVTFTTLINGYCKVGRVGDGLEXFCEMGRRGIVANAITYRTLIHGFCQVGNINGALDIFQEMISSGVYPDTITIRNMLTG

SEQ ID NO: 94360 - protein, 214 aa, Mannheimia succiniciproducens MBEL55E
MKKDLRLYLIRHGRTVWNEQGLMQGWGNSALTEQGVKGAQLTGQALAEVPFIAAYSSCLQRTIDTANYILGERSVPLFQHIGLNEQFFGSWEGTNVETIRQTAEFQQMVNDPKNYQASSNGGETWQQVAERAMKAMQDIIDVHHRGDILIVSHGHTLRLLLALFAGATWQNHREQGKSVAMLNTAINMVRYVQHDEDQAGKFIIERLNDAAHLG

SEQ ID NO: 94361 - protein, 491 aa, Bacillus anthracis str. Ames
MTFVLFGATGDLAKRKIYPALYNLYRDQKLPKQISVIGLGRREVSHVDFQKRIKESIETFSRHREEGTPELEGFLDNFRYCPLDVSKPEDYERLLQVVREREEELHIKGNRMFYLSGAPEFFETIALNIKESGLDKTDGWKRLMIEKPFGHDLTSARELNDKLSRTFEEDEIYRIDHYLGKPMIQNLEALEFANPVLQSIWNKEHIANVQITASETVGVEERAGYYDQAGAIRDMVQNHMLQILMMTAMNLPEKVNACEIREEKRKVMEALRKVKKEDVQNHIIRGQYGAGEINGGQVVAYKEEPGVNPSSNIDTFIAARLWIDNPFWTGVPFYIRTGKRMKEKSTRIVIEFKNTLKQQYQDSNPNAAPNLLIIEISPGENVSLQLNSKNPLKNGEIEPIRINFTCEQADVGVPEAYERLIHDAVSGDATFFAHWREVELSWEWVQPILEAFEENLLPLHEYESGSYGPEASNELLQESGFKWWLDQETKK

SEQ ID NO: 94362 - protein, 173 aa, Prunus armeniaca
MEHEETGCQPHPEGPILCVNNCGFFGSVATRNMCSKCHKDMMLKEEQAKLAASSFGNIVNGTSNSNGNEPVVAAGVDVQAHLVEPKTISLQPSFSFGSGSGGSGEAKPEGPKRCGTCNKRVGLTGFNCRCGHLFCAVHRYSDKHDCPYDYHTAARDVIAKANPVVKADKLEKI

SEQ ID NO: 94363 - protein, 182 aa, Bacillus anthracis str. Ames
MDSMTFLLFGATGDLAKRKIYPALYKLFSNGNIPQSISIIGIGRRVMSDVEFQTKVEQSLATFSRRSTDDESGVEEFLSTFRYCQLNTANIEDYQDLLSLVKRRETELNIPENRMFYLSVIPKVFDVIALNIKESGLWATKGLNRLIIEKPFGHHVTSAHEFNEKLIEDFDETDIFYIDHYL

SEQ ID NO: 94364 - protein, 356 aa, Roseovarius nubinhibens ISM
MNRRNLLAAGGAAGLAAMAGRGFAAGAEGYAVPPEEAPHARSFMQWPVNRKVHPDPVFLDMAQQTIADIANSIAEFEPVILLADKADHARARKKLSARVELWDIPTEDLWCRDAGPIFVVNGAGDLAVSHIQFNGWGEKQVHAHDAQIAARVAERLGLRLLPSGLRGEAGGVEQDGHGLLLAHESSWVNDNRNPGLSRDEIEARLLAAYGAERMIWSDGVWGEDITDYHIDSLARFTGPGRVLINLPDDPDMGDPFHLAALGTYDRLLAEGLTVEVIPEPHRRRIKSLDFVASYANYYVCNGAVIAAEFGDREADEIARAALARHYPGREIVTLNVDPLGEMGGGIHCATQQMPAV

SEQ ID NO: 94365 - protein, 277 aa, Zea mays
MLLMLHETLPFVRPTSSCRDPKLSEKSASAFHGKLGCSAVCSSAEGHRVQKPHIVHSYKVSFTRTSQHLCKSLNERTTRHCLHRFHVNASPDDDDFRSSRNIAISLFKRYKNVIDRGGGQNLNEFVSAGVTAYALGCTDEGLRKELMDIEDSGLEIEGLGSLGGTSLKFKVHSFEIRECILWLSIVFVTILCTPQLTVIRWSPNPPVSADVLHQWKGFCALIANAYYVKGMAWLPVKTLQLEQMAVTGSSEKPSVVASRMQLVFSTLEVVSPQWPRV

SEQ ID NO: 94366 - protein, 210 aa, Corynebacterium diphtheriae
MGKNYDITNTVLSFGRDKKWREKTRERLQLKAGERVLDLAAGTAVSTVELTRSGAWVVACDFSQGMLAAGKDRNVPKVVGDGMKLPFADNSFDAVTISYGLRNVHDFRMALREMARVTKPGGRITIAEFSTPNLPGFKTIYKEYLTKLLPLIAKVVGTNPEAYEYLAESIRAWPEREELAAAINENGWHDAGWQNLSLGIVALHSAVKPS

SEQ ID NO: 94367 - protein, 502 aa, Zea mays
  misc_feature (323)..(323): Xaa can be any naturally occurring amino acid
MGALLPWLAWLLVSLVGVYLLGHLVQARRRRGLPPGPHPLPIIGSLHLLGNQPHRSLARLAKTHGPLVSLRLGSVTTVVASSPAAAREILQRHDAAFSNRSVPDAPGAHARNSTVWLPNAPRWRALRKIMGTQLFAPHRLDALQHLRRDKARELVDHVRRLARRGEPVNVGRVAFTTSLNLVSRTIFSRDLASLEDDGASRKFQEVVTDIMEAVGSPNVSDFFPALAVADLQGCRRRLARLFARLHRIFDEEIDARLRGRDAGEPKKNDFLDLLLDAAEDDDNTAGLDRDTLRSLFTDLFSAGSDTSSSSVEWAMVELLRSPXSMAKACDELATVIGPRKDIEESDIGRLPYLQAVVKETFRLHPAAPLLLPRRAQADVKMMGYVIPEGSRVFVNVWAMGRDEETWPEPEKFLPERFLGKKTQQAVDLRGGDFDLIPFGGGRRICPGMPLAIRMVHLLLASLLNQFAWRLPAELERNGVDMAENFGITLTKAVPLCAIATEI

SEQ ID NO: 94368 - protein, 447 aa, Oryza sativa Japonica Group
GNGGGGNKKGRRDSPSPPLETPPRGELPSTSSSSSSRATKRHRVAGMADRYFPNDLPDFVAEAPDGGRGLLSLPYSSLSERLLRAALRIKDKVMEETWTRARRQVTDYTLYTGALGTALLLFKSFQVTGNRADLALAGDIVKECDAASRGLPRRFLTFICGRAGVCALGAVIAKHCNDQLLLTHYLSSFDEIIVTEKVPNELLYGRAGYLWACLFLNTHLGEKTIPHEHITSVAKDIIDEGRKLAKKGNCPLMYEWHGKKYWGAAHGLAGIMHVLMHTELKLDEKDDVKNTLLYMIRNRYPTGNYPSSEGSESDRLVHWCHGAPGVALTLAKAYQVFHDEHFKQTAAEAAEVVWNRGLLKRVGICHGVSGNAYVFLSLYRLTGNVEYLYRAKAFACFLLEKADQLIADGAMHGGDHPFSLFEGRAGMAYLLLDMVSPSESKFPAYEL

SEQ ID NO: 94369 - protein, 94 aa, Brassica napus
MITATDFYHVMTAMVPLYVAMILAYGSVKWWKIFTPDQCSGINRFVALFAVPLLSFHFIDANNPYAMNLRFLAADSLHKIIVLCLLVLWCKISR

SEQ ID NO: 94370 - protein, 350 aa, Oryza sativa
  misc_feature (155)..(155): Xaa can be any naturally occurring amino acid
MSSGQEAGSSSGGSGDGGAAAPRRNTRKPKYSKFTQQELPACKPILTPKWVISVFVLVGVIFVPIGLVSLKASRKVVEIVDRYDDACVPANTTDKLAYIQNPTISKNCRRTLKVPKDMDAPIFVYYQLDNFYQNHRRYVKSRSDAQLRDPKKANXTSTCDPEGTANGMAIVPCGLIAWSIFNDTYGFVRNSKNLPVDKKNISWKSDREHKFGRDVFPKNFQNGSLIGGKTLDPNKSLSKQEDLIVWMRTAALPTFRKLYGRIHTDLKKGDTITVTLENNYNTYSFSGKKKLVLSTSTWLGGKNDFLGLAYLSVGGLCFFLAFAFTLLYLIKPRKMGDNNYLSWNRNPAGR

SEQ ID NO: 94371 - protein, 352 aa, Magnaporthe grisea 70-15
MPEIPTEQWAQVIEKTGGPSVYKKIPVAKPGPDEVLVNIKYSGVCHTDLHAMNGDWPIPTRLPFVGGHEGAGVVVARGELVQDVEIGDHVGVKWINSSCQNCDFCRSANEMLCPKVTLSGYTVDGSFQQYAIAKAALVARLPKEVSLEAVAPVLCAGITVYKGLKETGARPGQWVAIVGAGGGLGAMALQYARAMGLRVIAIDSGEEKRRACLEDLGAAAFVDFATSADVVADVRKVTADGLGPHAAVLLAVTSRPFQQAAEYIRPRGTVVCIGLPSGAQIKADVLDMVVRLITIKGSYVGNRQDTAEAVDFFARGLIKAPFKTVGLSELGKVFEALEQGKVVGRYVLDTSK

SEQ ID NO: 94372 - protein, 332 aa, Physcomitrella patens subsp. patens
MVGSGAFCKVYQGSDLTNHEVVGIKLEDTRTEHAQLMHESRLYNILRGGKGVPNMRWFGKEQDYNVMVLDLLGPNLLHLFKVCGLRFSLKTVIMLGYQMIDRVEYVHSRGLVHRDLKPDNFLMGCGRQGNQVFIIDFGLAKEYMDPATRRHIPYRDRKSFTGTARYASRNQHRGIEHSRRDDIESLGYILMYFLRGNLPWQGKGGQRLTDQKQHEYMHNKIKMNTTVEELCDGYPSQFADFLHHARSLGFYEQPDYCYLRSLFRDLFIQKKFQLDHVYDWTVYTQLPQNGSLQSVRSQNSAASSHLQNRPSNVSYCPPLTKSEFRREVVAAN

SEQ ID NO: 94373 - protein, 202 aa, Shewanella sp. MR-4
MKLYLLDNFDSFTYNLVDQFRSLGCEVVIYRNDVAADYIADKLLAETEPSALVLSPGPGAPHEAGSMMALIDKVAGKVPMLGICLGHQAMVEYYGGKVERAPFVVHGKASPTFHNGTGVFANLSSPLPVARYHSLVATKVPDCLEVIATTEEMPMAILHAEHRAVGFQFHPESILTTLGSTLLTQTLRFLTQDITHNTAGAQ

SEQ ID NO: 94374 - protein, 350 aa, Bacillus halodurans C-125
MLTEEKVLAALNRVKDRDLNKSIVETGGIRELKISGANVSVKVALAQTGTREQMEIQQEIVNVLKGEGAESVGLRFDQLDETEIEKLGGLPKQEFHGPPLLHPNTSTTFIAVTSGKGGVGKSTVSVNLATTLARLGKKVGIIDADIYGFSVPDMMGIEERPKVVGEQIFPVERFGVKVISMGFFVEDNAPVIWRGPMLGKMLNNFFAEVEWGDLDYLILDLPPGTGDVALDIHTMLPHSKEILVTTPHATAAFVAARAGAMALKTHHEIIGVVENMAYFESKITGEKEYVFGQGGGERLAEELKTEVLGRIPLGQPEIDEDDFAPSVYGATHPIGEIYTAIAKRVIDKTT

SEQ ID NO: 94375 - protein, 781 aa, Glycine max
MANRHHPSVFLVLVTVLLSIHCSEQLQSSHSQTLLRIQQLLNFPAALSNWNSSTDFCNTDSNSSLTVVCYEDTITQLHIIGERRDTPLPRNFSIDSFVTTLVRLPSLKVLTLVSLGIWGPLPSKIARLSSLEIVNMSSNFLYGSIPQELSSLSSLQTLIFDNNMLADTFPHWLDSLQALTVLSLKNNKFNGSLPKSLGNVENLRTLSLSHNHFYGAVPDLSRLTNLQVLELDDNAFGPQFPQLGNKLVILVLRKNSFRSGIPAELSSYYQLERLDISSNSFVGPFQPGLLSLPSITYLNISGNKLTGMLFENLSCNSELDVVDLSSNLLTGSLPRCLVSNSSDSTVLYARNCLDTTNQNQQPQPFCHTEALAVGILPETKKHKQVSKVVLSLGIVGGTLGGVALVLLVFFIVRRGNDRSKTKNPPTRLISENAASGYTSKLFSDARYISQTKKLGAVGLPTYRSFSLEEIESATNYFDTASLMGEDSYGKMYRGQLKNGSLVAIRCVEMKKRHSTQNFVQHIELISKLRHRHLVSAIGHCFECSLDDSSVSKVFLVFEYVPNGTLRNWISDEHARKSFSWTQRIGAAIGVAKGIQFLHTGIVPGVYSNDLKIEDVLLDQNLVAKISSYHLPLLSNMGKVRRGNSSSGLKNSSNSKSVKQEDKSDIYNFGVILLELILGRQIKTVNDADAFRDLLQASLGGDEEGRRGVVDPAFRKACLDQSLKTMMEICVRCLVKEPADRPSIEDVLWNLQFASQVQDAWRGDSQSSEGSPGSESRGLPFH

SEQ ID NO: 94376 - protein, 490 aa, Convolvulus arvensis
MRSNPTTSGSEVSAVEKKNLGRIVKIIGPVLDVAFPPGKMPNIYNALVVQGRDNEQTNVTCEVQQLLGNNRVRAVAMSDTDGLMRGMAVINTGAPISVPVGGSTLGRIFNVLGQPVDNLGPVDTNTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDVLPEQAFYLVGNIDEATAKAMNLKT

SEQ ID NO: 94377 - protein, 490 aa, Calystegia sepium
MRSNPTTSGSEVSAVEKKNLGRIVKIIGPVLDVAFPPGKMPNIYNALVVQGRDNEQTNVTCEVQQLLGNNRVRAVAMSDTNGLMRGMEVINTGAPISVPVGGSTLGRIFNVLGQPVDNLGPVDTNTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLKT

SEQ ID NO: 94378 - protein, 511 aa, Saccharomyces cerevisiae
MSKSKTKTDKRNQSSLSRIKLSALHYCMSDAEPSIAYLQDNSAFINNEWHNLVLEKIFPVYNPSTEEDITQVSEKSQHDSTEEDITQVSEKSQHDDDKAVVDISERGRLLNILADLIERDRDILAAIEHLDNGKPFDEAYLLDLASVLKELRYTAGWADKLHGTLRFAITIPTFQDLRFLRYTRHEPVGVCGEIIPWNIPLLMYIWKIGPALAAGNTVVLKPEELTPLTALTVATLIKEAGFPPGVVNVVSGYGPTAGAACLSHKDNDKLAFTGSTLVGKVVMKAAAKSNLKKVTLELGGKSPMIVFIDADLDWAVENAHFGVFFNQGQCCIAQSRITVHESIYDEIVERDLEKAKKQVLGNPFESDTRYGPQILKIEFDSIPRLINSAKAEGAKVLCGGGRDDSCVGYYIQPTVFADVTDEMRIAKEEIFGPVITISRFKSVDEAIKRVDNTKYGLAAYVFTKDKAIRISAALKAGTVWVNCVHVASYQIPFGGNKNSGMGRELGEYGLE

SEQ ID NO: 94379 - protein, 549 aa, Mannheimia succiniciproducens MBEL55E
MQNINPTSTAAWKALEAHKGTLENTTINDLFQQEKNRFADYSLTFNNEILVDFSKNKITRETLNLLRRLAKECALDEAKEAMFSGEKINRTENRAVLHTALRNRSNTAVLVDGKDVMPEVNEVLAKMKAFSERVISGEWKGYTGKAITDVVNIGIGGSDLGPYMVTEALRPYKNHLNMHFVSNVDGTHIAEVFKKTNPETTLFLVASKTFTTQETMTNAKSARDWFLATAKDEKHVAKHFAALSTNAAEVEKFGIDTDNMFGFWDWVGGRYSLWSAIGLSIILSVGFENFEALLSGAHEMDKHFRNTPIEQNIPATLALVGLWNTNFQGAQTEAILPYDQYMHRFAAYFQQGNMESNGKYVGRDGKVISNYQTGPIIWGEPGTNGQHAFYQLIHQGTTLIPCDFIAPAKTHNPLADHHNKLLSNFFAQTEALAFGKTKETVEAEFLKAGKSLDEVKDVVPFKVFAGNKPTNSILLQEITPFSLGALIAMYEHKIFVQGVIFNIFSFDQWGVELGKQLANRILPELSGDEQVTGHDSSTNGLINQFKAWR

SEQ ID NO: 94380 - protein, 279 aa, Bacillus anthracis str. Ames
MKNLQSTTKLHNGVEMPWFGLGVFKVEEGPELVEAIKSAIKTGYRSIDTAAIYGNEAAVGEGIRAGIEATGISREELFITSKVWNADQGYKETIAAYEESLKKLQLDYLDLYLVHWPVEGKYKDTWRALETLYKEKRVRAIGVSNFQIHHLQDVIQDAEIKPMINQVEYHPRLTQKELQAFCKEQGIQMEAWSPLMQGQLLDNETLQAIAEKHGKTTAQVILRWDLQNGVITIPKSTKEHRIIANADVFNFELTKEDMEKIDALNENHRVGPDPDNFDF

SEQ ID NO: 94381 - protein, 467 aa, Synechococcus sp.
MALQQFGLIGLAVMGENLALNIERNGFSLTVYNRTAEKTEAFMADRAQGKNIVPAYSLEDFVASLERPRRILVMVKAGGPVDAVVEQLKPLLDPGDLIIDGGNSLFTDTERRVKDLEALGLGFMGMGVSGGEEGALNGPSLMPGGTQAAYEAVSRSVPTIAAQVDDGPCVTYIGPGGSGHYVKMVHNGIEYGDMQLIAEAYDLLKSVAGLNASELHDVFAAWNKTPELDSFLIEITADIFTKVDDLGTGQPLVELILDAAGQKGTGRWTVETALEIGVAIPTIIAAVNARILSSIKAERQAASEILSGPITEPFSGDRQAFIDSVRDALYCSKICSYAQGMALLAKASQVYNYGLNLGELARIWKGGCIIRAGFLNKIKQAYDADPTLANLLLAPEFRQTILDRQLAWRRVIAIAAERGIPVPAFSASLDYFDSYRASPAQNLTQAQRTTCAHTYKAPIALLFHAMF

SEQ ID NO: 94382 - protein, 843 aa, Arabidopsis thaliana
MVSSIIAVAEGKKMELEPNKSLSADMPSLLSRSSEAFNGGTGYRSSSDLSMFSSSLPTLFHEKLNMTDSDSWLSFDESSPNLNKLVIGNSEKDSLEDVEPDALEILLPEDENELLPGLIDELNFTGLPDELDDLEECDVFCTGGGMELDVESQDNHAVDASGMQISDRGAANAFVPRKRPNTAGRVSVEHPNGEHPSRTLFVRNINSSVEDSELSALFEPFGEIRSLYTACKSRGFVMISYYDIRAAHAAMRALQNTLLRKRTLDIHFSIPKENPSEKDMNQGTLVIFNVDTTVSNDELLQLFGAYGEIREIRETPNRRFHRFIEYYDVRDAETALKALNRSEIGGKCIKLELSRPGGARRLSVPSQSQDLERTEVTNFYNQVGSHVANSPPGNWPIGSPVKGSPSHAFTRPHGLGMVRPVNSDNMPGLASILPAHPSSFHGFSPVSNDQGLLNHSNQTILNKGLMHNISYGQPHSLPEHITGGISNSMRFIAPHSSGFGTSSDHRYRWGSPPQHMNYPGYTGVSSSSSSTERPFTVRHGFPFAERQASLLGKYQHHVGSAPSSIHFNTQMNCYTGSPEIPLGFSDMGINRNYNSAHGKANLGVSLPGNSSEQDFTGFGMSSMPTVPFGGSRGLQSVRPEPFAEQGRIHNHESHNQNQFIDGGRYHIDLDRIASGDEIRTTLIIKNIPNKYTYKMLVAEIDEKHKGDYDFLCLPTDFKNKCNMGHAFINMVSPLHIVPFQQTFNGKIWEKFNSGKVASLAYAEIQGKSALASYMQTPSSMKEQKQLFPEVSYHDDGQDANDHEQLFSSIWNITAPDSDWSYTMDLIENPRENGNSKNAAEESS

SEQ ID NO: 94383 - protein, 476 aa, Zea mays
MPGGVVDAAAKGVRLERHAALLRRAAGAKQLVSASSQLLFRATVLATLALVVLFAVHYPSMLSRSFSLSAAPASGASSSRSRHSHRSLLGSRPASRWSAAWEREVRRSAAPRRDGALSVLVTGAAGFVGAHCSLALRARGDGVVGLDNFNAYYDPSLKRARQRLLASRGVAVVDGDVNDAALLERLLASVRFTHVLHLAAQAGVRHAMRAPQAYVASNVAGLVALFEAAARHADPQPAVVWASSSSVYGLNTQAPFSEEHRTDRPASLYAATKKAGEAIAHAYNHIYGLSITGLRFFTVYGPWGRPDMAYFSFARSIVAGEPVTLFRAADGSDARRDFTYIDDVVRGCLGALDTAGRSTGSRSGRKRGPAPLRVYNLGNTSPVPVTRMVAILEKLLGKKAIKRVVTMPANGDVPFTHANVSHAARDFGYRPATSLEAGLRHFVDWFVRYYKVDVRGGNVLAGKTAKRKSMAMSSAS

SEQ ID NO: 94384 - protein, 1835 aa, Ostreococcus tauri
MTADLRCRELGIARWPFRKMRKLDNMISILETQKSRTVAAASEDEKASKLETIKKTRELVLAQPNSNAHAKLGKINSKLRRKVLESSSARENSAEVSGKSGEYGSVGSGSQRSARTNDERLTNKKRSRGEMEQTSAPTRDDHGSLDQLLSAASVVVQNDVHRESSASPAESTFTLAAPIIRDSTVQPFLGDLLKRTPVRRELPSNVSRPTPRRFDMNANLLLAAVGGTALNVVVDRTDPSSVRRARPAIRKSNVDRSRLSIESHDDDTPKPRRRASPPQSSTTRRERGLAPLRDPANARTRTPAQENRLRAKKQGMSHEDVKKEQAADAKKIKQLEQKNESFGMTKGAAMNKKHEVAMQRLRDMNDPTTELGKQHMRAERKKAKEQLEFLLRTQGIDVKQPPLPDGVDPKTVLCEFFKHGCCPKSADRCKYSHQLDISTRQQKRSAYEIPDEDSIEMWDQKKLEAVIAKKHGQEVNSNNETTIVCKHFLQAVEKKLYGWFWHCPGGADCKYRHKLPPGFVFKSELRERMLAELAARKTDQDILREKLIALKKSNKTLTPMTLDVYLKWKTERVEKMKASIEEAREERLKKNLLTGREIIEQQLGGSEAQVDGGASAADDEITRLLKERKAADEEAERKAAEEAAENLARAKNLGDLYNVEMLPDETDDYADLLEEEEEDYSPPEGWTPDAVAPPGFEDGESQEEGQNGGVDMTENEKKAKREAERKALEAEGIVLADKTIKKDKEEELFKPAVEIPDEAFEEAAVDGELDPKKLGEMLAAKRAAEESQRQSELEALAEEKIRKEAAKAAKKAEREAARAQKKKKKKGDDDGEDDKITSIEQAMGKVDIEATGAALKRISTGVLASRPTARDIKIINFSMGMGGRELIKDCDIEVTIGRRYGLIGQNGCGKTNFLECLAAREVPIPDHIDLYHLREEALPSDRTAIQAVIDEVQAEMERLNRFEAHILETTGPDDERLELIYDRLEEIDPTTFEARGSELLHSLGFSQEMIHRPTKDMSGGWRMRVALAKALFASPTLLLLDEPTNHLDLEACVWLEKYLAEYKKCLIIVSHSQDFLNGVCTHIIWLTQQKLTYYTGNYDTFCNTVEENNIVQQKKYEKEQADIKHLKEFIASCGTYSNMRKQAESKQKIIDKMMAAGLTPPVAKEADFKFDFPDCQKVPPPVLPFANVSFAYNGKPENFLYENLELGVDCDTRVALVGPNGAGKSTLLKLMTGELTPTIGTVDRHPALSIGKYHQHSVDVLNKDMNPLEFFMEQYPNTLTWKREYEEWRAYLGRYGITGRMQTQKIGELSEGQQSRLVFAMICMQRPNLLLLDEPTNHLDLEAIDALAEAIKRYNGGLVLVSHDFRLIDQVANQIWVCEDKTVKIWNDDIRAYKKKLARKAEKEAEERRLKGNNETFHALPTNARAINKAASAAPRNNVSAHSAAITANAFPTIPLSVPHANNRSLGHRRSGVTSLKFPGCRANHRTTASSGLGRPSLGVREKSPDDDATTTSPRARALAARPTAPLSRARLPRAVDTTPARESATVIFSARARLTPSPRVDMSAGAPRVTADARVVARGLPRRARSFERAWTARRASKAPRVDDVPLTEWALSTKESVDGGDFRRARAKEASLRSPFGAEAFAWAYWRGYRQMFNALGYPGPDAEAECAATVLAPSKRLLDASCGPGLITEKLAKAPGSFTSVIAIDYSEAMVKEARERLGDDALACCADVSDLPFADEVFDAVHSSAGAHCWDDPVKGFVELHRTLRPGGKALVSTVVLLKTTGSEEDYTRKRKSNTPFWNERAVCRMMESVGFRNVEVVRKDKCFVAIKATK

SEQ ID NO: 94385 - protein, 318 aa, Ostreococcus tauri
MEWTTIESDPGVFTELARAIGVRGVAFEELYTLEADELKRLEPIYGLIFLFKYRGDDGGEVCAIDAEAESKGVFFARQMIQNACATQAVLSVLLNADDKLELGETLSAFKEFTSEFDAETKGLAISNSDVIRDAHNSFARPEPIVLQSRPAREDDDVFHFVGYVPKGKVVYELDGLRQGPINHGHFGNEDDDKTWLDVAVPAIQRRIAAYSTNEIKFNLLAVTKDQRISLRERIAELQGIGDSIGDSLAKEITQLSSELAYLESKAEDWRNENIRRRWNYLPFIFGLLREVAAKKQLMSAFEIAKKNREKGASDGQTH

SEQ ID NO: 94386 - protein, 556 aa, Ostreococcus tauri
MMRQRETKEAVARRTLAEFETQIEETARRTGDATTRARVERMLKRLPKQYAMDVNFIEDVLAHAELLGRVEQELQAMGVSSVYCSVREVEVGRAAFGSHEDMMDTDGGIEQLNVTADNGIPIRADSPAGKPRGPTFGSSLQMTSSLGGDPSRGSAGMYEVAVAAGNKPRLLSRVSAVLFDVGLNIAEAHVFCTDDGLALDIFVVTGWKRGEEAAVGHAVQTALDAADFSDIVPASRNASAATPSADEGRMSAGSHGRSTSNDSVSIDGGEWELKESQLVFNEKIASGAFEVAIKVLKSNAQEGNAGNETMREFAQELSILRRVHHKHIIQLIGALTKQKTMCLVTEFMHGGNVLQFVQEHALKLHEIIRFSLGVAMGLDYLHKINIIHRDIKTANLLLDENSVVKIADFGVARLQPTDGSTMTAETGTYRWMAPEVIAHGFYNEKADVYSYGIMVWELESGGEVPYPGYTPLQAAVGVVQRGLRPAISTSCNPKLAQVMQSCWLADATQRPGFEQIISLLKSIDTQKAETDGKHGFFDRLRSVSFKSKKNAPARSS

SEQ ID NO: 94387 - protein, 528 aa, Arabidopsis thaliana
MVIGAAARVAIGGCRKLISSHTSLLLVSSQCRQMSMDAQSVSEKLRSSGLLRTQGLIGGKWLDSYDNKTIKVNNPATGEIIADVACMGTKETNDAIASSYEAFTSWSRLTAGERSKVLRRWYDLLIAHKEELGQLITLEQGKPLKEAIGEVAYGASFIEYYAEEAKRVYGDIIPPNLSDRRLLVLKQPVGVVGAITPWNFPLAMITRKVGPALASGCTVVVKPSELTPLTALAAAELALQAGVPPGALNVVMGNAPEIGDALLTSPQVRKITFTGSTAVGKKLMAAAAPTVKKVSLELGGNAPSIVFDDADLDVAVKGTLAAKFRNSGQTCVCANRVLVQDGIYDKFAEAFSEAVQKLEVGDGFRDGTTQGPLINDAAVQKVETFVQDAVSKGAKIIIGGKRHSLGMTFYEPTVIRDVSDNMIMSKEEIFGPVAPLIRFKTEEDAIRIANDTIAGLAAYIFTNSVQRSWRVFEALEYGLVGVNEGLISTEVAPFGGVKQSGLGREGSKYGMDEYLEIKYVCLGDMNRH

SEQ ID NO: 94388 - protein, 261 aa, Methylococcus capsulatus str. Bath
MSISIKSAEDIEGMRVACRLAAEVLDMIAPYIKAGITTEEIDRICHDFIVNEQHAIPAPLNYKGFPKSICTSVNHVICHGIPGPKKLKNGDIINVDITVIKDGFHGDTSKMFLVGQVKPYARQLVDVTREAMYLGIREVRPGAALNRIGAAIERHASKYNYSVVREFCGHGIGREFHEEPQVLHYFEPKLDIRLEAGMIFTIEPMINQGKRHIQMLSDGWTAVTKDHKLSAQWEHTVLVTPTGYEVLTLRQEEDFGRTELG

SEQ ID NO: 94389 - protein, 239 aa, Zea mays
  misc_feature (225)..(225): Xaa can be any naturally occurring amino acid
PAKEPESLKRCFHFLNQTSRSFAAVILELHPDLLVPVTLFYLILRGLDTIEDDMTIPLAKKEPLLRNFQDILEQGGWTFTENGPNEKDRQLLVEFNVVIEEFKKIKPAYKDIIKDITTRMGNGMADYANNAEFNAGVKTVKEYELYCHYVAGLVGEGCTRLFVEAGLANAALLKRPELMESMGQFLQQVNITRDIREDFDDGPRFWPKEIWSKHVDHFEEPVQPXNKEKALNASFGMIL

SEQ ID NO: 94390 - protein, 522 aa, Candida albicans SC5314
MLSRRTITRKLNKGVSKSLLSFARYNHSITSTTTPASSQPHIELTTFANGLRLITDSTPGHFNAVGAYIDAGSRYEDPKAPGLSYLRDRLSWKSTEDFTGQQMLENLSKLGGNYMSSAQRESMIYQASVFNKDIDRMVGMIGQTIRYPIFSDQEFQEALQTAEYEVAELAYKSDLYLPEELHTVAYKENTLGLPLFIPQERIPLVSKSDVIDYNNKFFQPQNTVIAMVGVPHEYALKLIMENFGDWANTTTTKPNPGIKNYTGGEISLPYTPPLYANLPELYHIQIGFETTGLLNDDLYALATLQKLLGGGSSFSAGGPGKGMFSRLYTKVLNKYPFVENCMSFNHSYIDSGIFGITLSLVPEAAHVSSQIIAHELSQLLVTEESQGGMNAKEVQRAKNQLISSLLMNVESKLARLEDLGRQIQCQGKITTIDEMVDKINRLTIKDLQNVAEKVLTGKVITSNGGTSLGLPSIVMQGERETFGDVEFILRRYGLGNYKGPEITEPRDFSSNQNEKKKKSRWF

SEQ ID NO: 94391 - protein, 322 aa, Zea mays
MIDTKRSSTAGRDCAQRANEEAATAPGGRRQQQQRVAIATAAAARARRRRDSSSAGRPQLQQRACSSHAGAQKARQQQCRAAATAAEGMQQPRGRAEGATAAVPGGRNCSRGRADEATAAGAGSSTAGSRGRADEATAAGAGSSTAAGAGDSRVGEARSAAAGYVFSDGKMNIERLTKLVELVGKQRLVLDLSCRKKDGRYTIVTDRWQKFSDVFVDEPALEYLAAFADEFLVHGVDVEGKRLGIDEELVELLGHHSPIPVTYAGGVSTMDDLERIKKAGKSRVDVTVGSALDIFGGDLPYKDVVLWHKKQSMVGQVSRNMW

SEQ ID NO: 94392 - protein, 533 aa, Lentinula edodes
MLPFVYLLAAELVCLVYGAEVIRDTTTYGQTVSENLFIVNKQLAPDGFQRSTVLAGLTPSTGSFPGPLISGNKGVRFNLNVTDQLTDPSMVRSTTVHWHGLFQKTTNYADGVAFVSQCPIAANHSFLYDFQVPDQAGTFWYHSHISVQYCDGLRGPLVIYDPQDPQAYLYDVDDGTTVLTIADWFHNTSTELIAAAVAPLADATLINGKGRYLGGPAVPLAVINVQQGKRYRFRMISIACDANHNFSIDGHRLTVIEVDGENHEPATVDNIQIFPGQRYSFVLDATQPVDNYWVRALSSSGVGTSGFIGGLNSGILRYQGAPDADPTTTNSTGVVLTESMLHPLENPGAPGLPFPGGADEVLNLTLGFNLPATFFMNDTQYIPPTVPVLLQILSGAQSPQDLLPPGSVYTLPINKTIEINFFGNATPGGPHPFHLHGHSFDVVRSADNTTYNYENPVRRDVTSVAIGNQTTIRFVTDNPGPWFLHCHIDLHLEFGLAVVMAEAPSLVKATDVTTPAWDELCPIYDSLTPAQLP

SEQ ID NO: 94393 - protein, 394 aa, Oceanobacillus iheyensis HTE831
MELAQRVQTLTPSSTLAITAKAKDLKKQGFDVIGLGAGEPDFNTPEYIMDGAKQAMNNGLTKYTPAGGIAELKLAIIDKFKQDNGLSYNEKQIIVTNGAKHALYTLFQVILNKEDEVIIPSPYWVSYPEQVKLAEGNPIILPAAETNDFKITPTQLEEAITPKTKAVIINSPSNPTGLMYSKEELAALGEVCLKHNIIIVSDEIYEKLIYTSKEHVSIASISDELYNQTIIINGVSKSHAMTGWRIGYAAGNETIIKAMTNLASHSTSNPTSIAQYGALAAYTKDPGDISLEYKKIFAERLDAFYKLIQDIPGMECIKPEGAFYLFPNAKKAAEMNGFATVDEWVAALLEEEKVALVPGSGFGSPDNVRLSYALSIEELTEAANRIHRFVLNHK

SEQ ID NO: 94394 - protein, 533 aa, Lentinula edodes
MLPFVYLLAAELVCLVYGAEVIRDTTTYGQTVSENLFIVNKQLAPDGFQRSTVLAGLTPSTGSFPGPLISGNKGVRFNLNVTDQLTDPSMVRSTTVHWHGLFQKTTNYADGVAFVSQCPIAANHSFLYDFQVPDQAGTFWYHSHISVQYCDGLRGPLVIYDPQDPQAYLYDVDDETTVLTIADWFHNTSTELIAAAVAPPADATLINGKGRYLGGPAVPLAVINVQQGKRYRFRMISIACDANHNFSIDGHRLTVIEVDGENHEPATVDNIQIFPGQRYSFVLNATQPVDNYWVRALSSSGVGFSGFTGGLNSGILRYQGAPDADPTTTNSTGVVLTESMLHPLENPGAPGLPFPGGADEVLNLTLGFNLPATFFMNDTQYIPPTVPVLLQILSGAQSPQDLLPPGSVYTLPINKTIEINFFGNATPGGPHPFHLHGHSFDVVRSADNTTYNYENPVRRDVTSVAIGNQTTIRFVTDNPGPWFLHCHIDLHLEFGLAVVMAEVPSLVKATDVTTPAWDELCPIYDSLTPAQLP

SEQ ID NO: 94395 - protein, 103 aa, Triticum aestivum
  misc_feature (77)..(77): Xaa can be any naturally occurring amino acid
AAQAVYVARGSARVQVSSAVGGDTLLLDEDIAAGSLFVVPRFAVALVAAGADGVEWVSLIKSARPAVEHLIGEGSIXGGLTPQVVQASLKVAPELGEAALSGG

SEQ ID NO: 94396 - protein, 210 aa, Brassica napus
MDSDQGKLFVGGISWETDEDKLREHFSSYGDVSQAIVMRDKLTGRPRGFGFVIFSDPSLLDRVLQDKHHIDSREVDVKRAMSREEQQVSGRSGSFNATRGSGGDAYNKTKKIFVGGLPPTLTDEEFRLYFEQYGPVADVVIMHDQTTSRPRGFGFVSFDSEDAVDRVLQKNFHDLNGKQVEVKRALPKDANPGGAGRAMGGGGGGGYQGF

SEQ ID NO: 94397 - protein, 95 aa, Nicotiana tabacum
MRGVLVDWLVEVAEEYKLLSDTLYLAVSYIDRFLSTKVIPRQKLQLLGVSSMLIASKYEEINPPHVEDFCYITDNTYTKEDVVKMEADVLQSLKF

SEQ ID NO: 94398 - protein, 388 aa, Ostreococcus tauri
MWGDAGGDGVQISEIDSGEFVPGRGGRYSVMTPEDSWNVAVGDRRAPSPAIGWHDEEGSSSDALHTEFLINPDDVRLQERIAVGGFAEVFRGTWQGTVVAVKQLLERTSEVKEKLEQEVQVLAKLRHPNLLLFMGYCVDPPLICTEFMRRGSLHTILKAGKPLEPARNHAIALAVARGMSYLHSRSPPILHLDLKSPNILVDEKWRVKIADFGLARMRQTTQMSAKSQFHGTPEWMAPEMLRAEDYDEHADSYSYGVVLWELITAHKPWEDLHPMQIVAVVGYSGRSLELPSEGFPESSHPLTALLADIFTRCARRDPSARPLFPAILTDLERARDLARARAEAAGADKTAARIPPRPDTESVDRRALGVQLEYISLADAVASTDASS

SEQ ID NO: 94399 - protein, 383 aa, Pyrus pyrifolia
MSSSNAVGATSHELLGAQAQLWNHIFQFINSMSLKCAVQLGIADVIHNHGQPISLSELIAGLNVHPSKAHFVSRLMLILVHSNFFAQHHHVHHDRADVEEEEAVVLYSLTPSSRLLLKDGPFSTTPFLLATLDPVVTTPFHLMGAWLKINGGDDPGATCTPFEMENGMPFWELGAQEPRFGNLFNEAMEADSKLIGRVVVEECGGVFEGLKSLMDVGGGSGTMAKAIANAFPNINCTVFDQPHVVAGLQGTTHNLGFMGGDMFEEIPPANAILLKWIMHDWNDEESVTILKKCREAISLSKNEGGNKKIIIIDIVVGYVDNKKKMMDKKSIETQLMFDMLMMSILPGKERSKLEWEKIFFSAGFTHYNITHTLGLRSLIEVYP

SEQ ID NO: 94400 - protein, 802 aa, Arabidopsis thaliana
MMMDEDVEQASLMSFNDRPRAFPNMRSKTYSPLIFRIIRKLNVRVLSIILLFCFGAIFYMGASTSPIIVFVFTVCIISFLLSIYLTKWVLAKDEGPPEMVEISDAIRDGAEGFFRTQYSTISKMAILLAFVILCIYLFRSLTPQQEAAGLGRAMSAYITVAAFLLGALCSGIAGYVGMWVSVRANVRVSSAARRSAREALQIAVRAGGFSALVVVGMAVIGIAILYSTFYVWLGVGSPGSMNVTDLPLLLVGYGFGASFVALFAQLGGGIYTKGADVGADLVGKVEQGIPEDDPRNPAVIADLVGDNVGDCAARGADLFESIAAEIISAMILGGTMAKKCKIEDPSGFILFPLVVHSFDLIISSIGILSIKGTRDASVKSPVEDPMAVLQKGYSLTIILAVITFGASTRWLLYTEQAPSAWFNFALCGLVGIITAYIFVWISKYYTDYKHEPVRTLALASSTGHGTNIIAGVSLGLESTALPVLTISVAIISAYWLGNTSGLVDENGIPTGGLFGTAVATMGMLSTAAYVLTMDMFGPIADNAGGIVEMSQQPESVREITDLLDAVGNTTKATTKGFAIGSAALASFLLFSAYMDEVSAFANVSFKEVDIAIPEVFVGGLLGAMLIFLFSAWACAAVGRTAQEVVNEVRRQFIERPGIMEYKEKPDYSRCVAIVASAALREMIKPGALAIASPIVVGLVFRILGYYTGQPLLGAKVVASMLMFATVCGILMALFLNTAGGAWDNAKKYIETGALGGKGSEAHKAAVTGDTVGDPFKDTAGPSIHVLIKMLATITLVMAPVFL

SEQ ID NO: 94401 - protein, 399 aa, Rickettsia prowazekii
MSIISTRLNSIKPSPTLAVVKKTLELKKAGVNIIALGAGEPDFDTPDNIKEVAITSIKDGFTKYTNVDGIPLLKQAIKNKFKRENNIDYELDEIIVSTGGKQVIYNLFMASLDKGDEVIIPVPYWVSYPDMVALSTGTPVFVNCGIENNFKLSVEALEHSITDKTKWLIINSPSNPTGAGYNCKELENIAKTLRKYPNVNIMSDDIYEHITFDDFKFYTLAQIAPDLKERIFTVNGVSKAYSMTGWRIGYGAGSKALIKAMTIIQSQSTSNPCSISQMAAIEALNGTQDYIKSNALNFQKKRDLALSILEEVTYFECYKPEGAFYLFVKCDKIFGTKTKSGRIIANSNNFSEYLLEEAKVAVVPGIAFGLDGYFRISYATSMQELEEACIRIKHACNAL

SEQ ID NO: 94402 - protein, 384 aa, Staphylococcus aureus subsp. aureus MRSA252
MISNKLANIPDSYFGKTMGRKIEHGPLPLINMAVGIPDGPTPQGIIDHFQKALTIPENQKYGAFHGKEAFKQAIVDFYQRQYNVTLDKEDEVCILYGTKNGLVAVPTCVINPGDYVLLPDPGYTDYLAGVLLADGKPVPLNLEPPHYLPDWSKVDSKIIDKTKLIYLTYPNNPTGSTATKEVFDEAIAKFKDTDTKIVHDFAYGAFGFDAKNPSILASENGKDVAIEIYSLSKGYNMSGFRVGFAVGNKDMIQALKKYQTHTNAGMFGALQDAAIYALNHYDDFLEEQSNVFKARRDRFEAMLTKADLPFFHAKGGIYVWLETPPGYDSEQFEQFLVKEKSILVAPGKPFGENGNRYVRISLALDDQQLDEAAIRLTELAYLYE

SEQ ID NO: 94403 - protein, 447 aa, Triticum aestivum
  misc_feature (232)..(232): Xaa can be any naturally occurring amino acid
MAATIQSVKARQIFDSRGNPTVEVDVCCSDGTFARAAVPSGASTGVYEALELRDGGSDYLGKGVSKAVNNVNSIIAPALVGKDPTAQTELDNFMVQQLDGTKNEWGWCKQKLGANAILAVSLAVCKAGASVKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLEXLLKTAIEKAGYTGKVVIGMDVAASEFYNDKDKTYDLNFKEENNDGSQKISGDSLKNVYKSFVSEYPIVSIEDPFDQDDWVHYAKMTEECGVEVQIVGDDLLVTNPTRVAKAIKEKSCNALLLKVNQIGSVTESIEAVKMSKHAGWGVMTSHRSGETEDTFIADLAVGLSTGQIKTGAPCRSERLAKYNQLLRIEEELGAAAVYAGLKFRAPVEPY

SEQ ID NO: 94404 - protein, 376 aa, Neisseria meningitidis FAM18
MMLECTINYCSGEIMSQTIDELLLPHRNAIDTIDAEILRLLNERAQHAHAIGELKGTGAVYRPEREVAVLRRIQDLNKGPLPDESVARLFREVMSECLAVERPLTIAYLGPQGTFTQQAAIKHFGHAAHTMACPTIDNCFKQVETRQADYLVAPVENSTEGSVGRTLDLLAVTALQACGEVVLRIHHNLLRKNNGSTEGIAKVFSHAQALAQCNDWLGRHLPNAERIAVSSNAEAARLVAESDDGTVAAIAGRTAAEIYGLDMVAECIEDEPNNTTRFLVMGHHETGASGSDKTSLAVSAPNRAGAVASLLQPLTESGISMTKFESRPSKSVLWEYLFFIDIEGHRRDAQIQTALERLGERASFVKVIGSYPTAVL

SEQ ID NO: 94405 - protein, 324 aa, Candida albicans SC5314
MTDFVYQGEDFDEKVRKQVEFYFSDSNLQTDKFLWKIYESNDGWVELKTILTFGRMRQYRPEDKVISALKESKKLVLSANNDMIRRKDPIKDFNEVKNTRKRNTIHIEGFPKDLSQDDVENWVNEKVIVQLPKEKEVCSIRRIKSRAKKEFFGVVDIEFKTQEDAEFILNNVELSYPEGIISKEDAQSLEKKDLLKKMTLLTFQEMRESSKRFGVNEVTKRRNSFNENHKGGNKKFKKGNNNGKGKNNKNENDNGNGTEDKETKLEKVEEIDSTKENTEEVAAKETAPESTEKTETKEAPAPATGIETETKTEVTEATEAAKEE

SEQ ID NO: 94406 - protein, 660 aa, Saccharomyces cerevisiae
MLLCNRKVPKTLNTCFILHIFTLLTLGVLVSGMPSKMVSFASQETLQRINNLLRGSANRDVDIIAEYLKKDDDDDGGDKDHHNIDIDPLPRRPSLTPDRQLLKVGLHGAISSDLEVCSNLTINEVLLKFPGSNAADAAVTQALCKGMVNFFNSGIGGGGYVVFSGKDDEDHLSIDFREKAPMDSHKFMFENCSLCSKIGGLAVGVPGELMGLYRLFKERGSGQVDWRDLIEPVAKLGSVGWQIGEALGATLELYEDVFLTLKEDWSFVLNSTHDGVLKEGDWIKRPALSNMLMELAKNGSVAPFYDPDHWIAKSMIDTVAKYNGIMNLQDVSSYDVHVTKPLSMKIRKGANFIPDNDMTVLTSSGSSSGAALLAALRIMDNFQNQEGGDYEKETTYHLLESMKWMASARSRLGDFEGEALPKHIEEVLDPEWALKAVKSIKRNSQDGNFKTLENWTLYDPAYDINNPHGTAHFSIVDSHGNAVSLTTTINLLFGSLVHDPKTGVIFNNEMDDFAQFNKSNSFELAPSIYNFPEPGKRPLSSTAPTIVLSELGIPDLVVGASGGSRITTSVLQTIVRTYWYNMPILETIAYPRIHHQLLPDRIELESFPMIGKAVLSTLKEMGYTMKEVFPKSVVNAIRNVRGEWHAVSDYWRKRGISSVY

SEQ ID NO: 94407 - protein, 486 aa, Zea mays
MAGGSSAEQLLSRIASGDGHGENSSYFDGWKAYDMDPFDLRHNRDGVIQMGLAENQLSLDLIEQWSTEHPEASICTAQGASQFRRIANFQDYHGLPEFREAMAKFMGQVRAGKVTFDPDRVVMCGGATGAQDTLAFCLADPGDAYLVPTPYYPAFDRDCCWRSGVKLLPIECHSSNNFTLTREALVSAYDGARRQGVRVKGVLITNPSNPLGTTMDRATLAMLARFATEHRVHLICDEIYAGSVFAKPDFVSIAEVIERDVPGCNRDLIHIAYSLSKDFGLPGFRVGIVYSYNDDVVACARKMSSFGLVSSQTQHFLAKMLSDAEFMARFLAESARRLAARHDRFVAGLREVGIACLPGNAGLFSWMDLRGMLRDKTHDAELELWRVIVHKVKLNVSPGTSFHCNEPGWFRVCHANMDDETMEVALDRIRRFVRQHQHSKAKAERWAATRPMRLSLPRRGGATASHLPISSPLALLSPQSPMVHAS

SEQ ID NO: 94408 - protein, 177 aa, Geobacter metallireducens GS-15
MIRSFQGMNPRIDSSAFIAETAVVIGDVTVGAESSIWYNVVVRGDVNFIRIGARSNIQDLTMLHVTHKKHADDPGAPLVIGDDVTVGHSVTLHGCTIENGAFIGMQAMVMDKAVVGEGALVGARALVTEGTVIPPHTLWVGAPARYKRDLTPDEIAWLKRSAGNYVRYSREYLDDTP

SEQ ID NO: 94409 - protein, 322 aa, Marinobacter sp. ELB17
MGLLQKGQWVDQWYDTGNSGGEFRRQDSRFRSWLTPDGKAGPNGEPGFKAEKGRYHLYVSLACPWAHRALIFRQIKQLQDYIDVTVVDPVMLKNGWEMKDPLYGLDFLYQLYLKADSSYEGRVTVPVLWDKQTQTIVSNESSEIIRMFNTAFNALTGNTTDYYPDTLHERINALNDRVYDTINNGVYRAGFATTQEAYEKAYHSLFDSLDWVEGLLTRQRYLGGGQLTEADWRLFTTLIRFDAVYFGHFKTNRQLLADYPAISGYVRELYQIPGVSDTVSFEHIKTHYYASHLMINPTGIIPVGPAQDFTAAHGREGIGENS

SEQ ID NO: 94410 - protein, 445 aa, Brassica napus
MGKKSATKVDAAPAAIKATKPLKKGKRDPEDDLDTKVNLKKQKKDVIAAVQKEKAEKKVPKKVENSDSSDIEEEESSDEEEVAAVAKNGSVKAKAESSSEEEDSSDESDDESEKPAAKKAAPATTKADSSEEDSDEESEDEKPAAKKDSSSDDSDSDESESEDERETPKKKNSDVEMVNAEQKQPKTPSTPATGGSKTLFVANLSFNVERSDVENFFKDAGEVVDVRFATSKDDGSFRGLGHVEFATAEDAQKALELHGRALLGRDIRLDLAAERGDRPAYNTPQSGGGNFRSGGGEGQKIFVKGFDSSLPEEDIRQALTQHFASCGEITRVSLPMDRETGASRGIAYIDFKEGAEKAYDLNGTELGGWNIVVDEAKPRDSSGGGGGGGRFSGGGGGRFCSGRGRDSGRGRNGGGRFGRGRDNGGGRGFSRPSFTSSVNKKTTFD

SEQ ID NO: 94411 - protein, 481 aa, Nocardia farcinica IFM 10152
MHYDSLFIGGRWTEPAGSERLQVISPATVEPVGSVPVVERADVDAAVTAARHAFDHGPWPSTPPTERAAVLTKAARLIEQRSGDLVAALTAEMGAPGMAAMTLNQLPATATLDTYAALAQTFPWTETRTGSFGTTRVSREPRGVVAAVTAWNVPLFLAVNKLAPALLAGCTVVLKPAPLTPLTANMIADIFTEAGVPEGVISVLPAEAEVAEYLIAHPGVDKVTFTGSTPVGRRIAAIAGEQLKSVSLELGGKSAAILLEDMDVAANIPVLAFSGLMNSGQGCVAQTRILAPRSRYDEILDALVEHVRTLKTGDPNDPSVTFGPLISERQRERVEGYIAKGKAEGARLVLGGGRPAGLDRGWFVEPTIFADVDNKSTIAQEEIFGPVLSVIPYETEDEAVAIANDSAYGLAGSVWTTDVEHGAAVAARVRTGTYAINWYAFDPTAPFGGYKNSGLGRENGPEGLDSFCEQKSLLMPMGWTG

SEQ ID NO: 94412 - protein, 314 aa, Streptococcus pyogenes M49 591
MDPNVITVTSYANIAIIKYWGKENQAKMIPSTSSISLTLENMFTTTSVSFLPDTATSDQFYINGVLQNDEEHTKISTIIDQFRQPGQAFVKMETQNNMPTAAGLSSSSSGLSALVKACDQLFDTQLDQKALAQKAKFASGSSSRSFFGPVAAWDKDSGAIYKVETDLKMAMIMLVLNAAKKPISSREGMKLCRDTSTTFDQWVEQSAIDYQHMLTYLKTNNFEKVGQLTEANALAMHATTKTANPPFSYLTKESYQAMEAVKELRQEGFACYFTMDAGPNVKVLCLEKDLAQLAERLGKNYRIIVSKTKDLPDV

SEQ ID NO: 94413 - protein, 356 aa, Clostridium perfringens SM101
MLYSLILAGGKGTRLYPLSRSSNPKQFLSIHNNGKSFLSNTVDRIRPIIHKDNIYVVTNQEYEDKIRDELKDIREENIFTEPANKETATCIGLSAAKLLKKDKDAVMIVLPSDHYIEGDKSYLQTLEQAVEIADKKRAIVTIGIEPTRPETGYGYIEMGDRVNGHIPTFKIARFTEKPNLEVAKDFLLKGTYLWNSGMFIFRADVILREIEKYIPKMYKCLMEIYQHIGEDDEEEIIKEQYSLIDGISIDFGVMQKTRRSFVIKCDFSWDDIGTFSALSRFLGPNGNNRTSDNVFLEECENCSVFGKEKLIIGFGIKDLVLVDAGDVILVMDKGRDQEIKHLLNSISGKKEFKEYL

SEQ ID NO: 94414 - protein, 187 aa, Zea mays
  misc_feature (171)..(171): Xaa can be any naturally occurring amino acid
  misc_feature (181)..(181): Xaa can be any naturally occurring amino acid
MALTRIGLAGLAVMGQNLALNIAEKGFPISVYNRTTSKVDETVQRAKAEGNLPVYGFHDPASFVKSIQKPRVVIMLVKAGAPVDQTIATLAAHLEQGDCIIDGGNEWYENTERREKAMEERGLLYLGMGVSGGEEGARNGPSLMPGGSFDAYKYVEDIVLKVAAQVPDSGXPCVTYIGKGXSGNFVK

SEQ ID NO: 94415 - protein, 379 aa, Streptococcus mutans
MKNEMLALILAGGQGTRLGKLTQSIAKPAVQFGGRYRIIDFALSNCANSGINNVGIITQYQPLALNSHIGNGSSWGLDGINSGATILQPYSATEGNRWFQGTSHAIYQNIDYIDSINPEYVLILSGDHIYKMDYDDMLQTHKDNMASLTVAVIDVPLKEASRFGIMNTDSNDRIVEFEEKPEQPKSTKASMGIYIFNWDRLRTMLVDAEKNNIDMSDFGKNVIPAYLESGERVYTYNFNGYWKDVGTIESLWEANMEYIGEDNDLHSRDRSWKIYSKNLIAPPNFITEEAHVKDSLVVDGCFVSGKVEHSILSTNVQVKEGAQIKDSFIMSGAVIGEGAKITRAIVGEGAKIGEDVEIDGTEEVQVIGYNEVVGVPNED

SEQ ID NO: 94416 - protein, 414 aa, Shewanella oneidensis MR-1
MSDIRQQALDYHEFPVPGKTAVCLTKPAETSHDLALAYSPGVAEPVREIAANPENAYRYTNKGNTVAVISNGTAILGLGNLGPLASKPVMEGKALLFKHFANIDSTDIEVTHNTAQEFINTVAAIAGTFGGINLEDIKAPECFVIERELIARCNVPVFHDDQHGTAIVTAAGMINALEIQGKLISDAIFVCMGAGAAAIACMTMLVKCGANRANIYMLDTKGVIHSGRTDLNEYKALFANETDKRTLQDVIKGADVFLGLSGPNVIGAEEVAMMADKPVIFACSNPDPEIKPELAHATRSDLIMGTGRSDYPNQVNNVLCFPFIFRGALDVRASCINDEMKIAAVHAIAELAKEAVPASVLKAYPKVSSLSFGSEYVLPKPMDPRLLPRVARAVAKAAIDSGVATITTLPKYAD

SEQ ID NO: 94417 - protein, 447 aa, Geobacillus kaustophilus HTA426
MSISLSQEQTTSKKYVQVGQLFENMPVTREHWKAGLALFFSFVIEAWEMMIIILCSASIGTEFKLSGTQIGSLIGSIFLGMIPGCLIWGKLIDKFGRKKAMIYSLISYGIISLISAFSTDYGMLWWMRFLSGIGLAGLMVATFPYFEELLPVKVRGKATVYLASGWPVGYLLAIGITYLLGDMGWRWVIGISSIAGLWFLVVATFVPESPYWLAGRDRQKEAKEVIRRLSANRMDHELNDVELIVEKVKKGSFIEVFRGKFLRPTVLQLIINFCFSWGYWALSSWMPALLAKKGLSAPQGLGFMALSALFMFPGYMAASYLTGKFGRKKIMFTFVFLAAIGGFGFASSNSMAEMYVWNFVLSFFSLGAWGVWDTWMAELYPTEVRGVSYSLGATAQRVANAIAPSVIGAMLASNTSFLATVSFISCFLVITFIATLFLKEMEGQILH

SEQ ID NO: 94418 - protein, 413 aa, Oryza sativa
  misc_feature (206)..(206): Xaa can be any naturally occurring amino acid
MNGASSGGGGGAGAGGDGPLVYQRWKGNNVFVLQGRFIFGPDARSLYVTMFLIIAPASIFCLFVAKELMNNFSYGLGLPVMISAVVFTAYDLSLLLLTSGRDPGIIPRNAHPPEPEGLDGNAEVGSNQTPPMRLPRVKDVVVNGITVKTKYCDTCMLYRPPRCSHCSICNNCVERFDHHCPWVGQCIGLRNYRFFYMFVFSTTLLXLYVFGFCWVYIVKIRSSEQITIWKAMAKTPASIALLVYTFIAVWFVGGLSVFHLYLMSTNQTTYENFRYRYDQRANPYNRGVMENIKDIFFSAIPASKNNFRARVPVPQEQGLRPRPTNGFMSPNMGRAVGDIEMGRKPVAWDEPRMAADIGDLGAGLGNLLEDKDGRFRSASPDLSRDALAIGGLDDQGSSVMNPGRTSWGVEAGR

SEQ ID NO: 94419 - protein, 589 aa, Thermotoga maritima MSB8
MAPGRSGYRLRFRSGARISGDSEQTQGFVQEPGSCAEDPGGIVLKRVIVIDNYDSFVYNIVQYIGEVEPDCEIEVFRNDEITIEEIERKNPTHIVISPGPGRPEEAGISVDVVRHFSGKVPILGVCLGHQVIGYAFGGKIVHAKRILHGKTSKIVHNGKGVFSGVKNPLVATRYHSLVVEEASLPEVLEITAKSDDGEIMGLQHKEHPTFGVQFHPESVLTEEGKRIIKNFLNIQDIQVKKVSEETEIDIVSALKKLVEFEDLTFEESRQVMNFIMSGNATDAQIAGFLVALRMKEETGDELGGMASVMREKSIHIKAPSPRTVDTCGTGGDGFGTFNISTTTAFVVAAAGIPVAKHGNRSVSSKVGSADVLEAGGYKLEKTPEEMERELKETGFSFLFAPLLHPAMKHVMPARRQLKIRTAFNLLGPITNPARVKYQVVGVFDLSFASKLATALQRLGTERSAVVNGGFTDELTTCGKNNLLLVTQEEIVPMVLDPEELGLKSGDPEELKGPSDPKEAYRMMESVLKGEASRTQVETVALNAGVVFWLVGECDTIKDGVGKALDLIRTGEAYKKLREVMDYQKTLGNS

SEQ ID NO: 94420 - protein, 247 aa, Oryza sativa
IAGGRSRSRTSPRVRLVPLPGSNNESWCQGLDGLASRCAEYYKQGARFAKWRTVVSIPCGPSALAVKEAAWGLARYAAIAQDNGLVPIVEPEILLDGDHAIERTLEVAEKVWSEVFFYLAQNNVLFEGILLKPSMVTPGAEHKQKATPEAIAKHTLTMLRRRVPPAVPGIMFLSGGQSEVEATLNLNAMNREPNPWHVSFSYARALQNSVLQTWQGRPDNVQAAQNALVVRAKANCWIRWMIHGEAK

SEQ ID NO: 94421 - protein, 776 aa, Magnaporthe grisea 70-15
MSADYESFDAGRPGFVIGNHESGRWDALTDNHHSHVLASGFNFVTAPVTNRHFRQRVVDLYNSHVKETQEFGLTDAEKANPSLPGPIISTLTDDDTSLFPSSFVSAIIAYSSPWIDLCSEDPLVADLSRQALNLEVAYANFCGVRSIVIPGPRRDEDAKGVAQYARAIQEAFLIATRLNFIIHMPMYREPNLEETDMLLSEAVGRQTKVAQKKEIDLFSAWDTWHTIRSVNDYNVRLFVAMRIPKRLPEKELQTRWFAEPLHYLTLGPNAFEKNRAGHPSLTKNHQEMINMYMRLKAYPWLIVYDLGPSKEELTRAEKAGSEFPTLAEAANGDSRIASNPEVAYLRHLERQQPPYGKLESPALISFQDWLQSPLQPLSDNLESSTYEMFEGDPVKYDQYEKAITEAMAEWKLLKKPTSGFNKETQEPELVVTVAGAGRGPLVTRVLRASAATGFPVQLWALEKNQNAYVYLLRQNERVWGGKVRVIKTDMREWDGIVPAGQKVTAENPAGSVDILVTELLGSFGDNELSPECLDGIQRHLAKPHGISIPHSYTAHLSPIAHPKLHAEISGRFATDPNSYNTPWVVRLFAIDFLASRGVPGKPRFQQAWEFVHPVRLPFAEKWAAEHGPHRRPIRGGGGAMNLSSGLNEHNARHCHLTFVCGRRGVMHGLAGYFESTLYASQVQGKEKELVEISILPEQIDRKSKDMISWFPIYFPLNKPLYFPEDAELEVSMWRQTDDTRVWYEWMVEAYLWVSQTQRVKIGASDLHSSRKIACLM

SEQ ID NO: 94422 - protein, 457 aa, Marinobacter sp. ELB17
MPSFKDLELSAAMQANLVRLGFTEPTDIQTRALPHCLAGQDVIALAHTGSGKTAAFGIGLIEHVKPKQFSVQSLVLCPTRELADQVAKALRELARARDNIKILTLCGGVSIGPQIGSLAHGAHIVVGTPGRIADHLQKGTLKLDRVHTVVLDEADRMLDMGFQEAVENILSHAPAQRQTLLFSATWPESIRKLSAGFQREPVDVRAQTEKMNSDIAEVFYEISGNQRTRAIVALLSQHQPTSCLVFCAMKHQCDELAAELSQQGFSALALHGDLEQRDRDSVLVRFANQSCQVLVATDVAARGLDIKSLPLVVNAEPAGDPEIHTHRIGRTGRAGEQGLAVTLCSPSQGHKINRLESERGATVIWGDSDPLMATVPKPMKPLMKTLCIAAGRKEKLRPGDVMGALTGDGGLPGSAVGKINVFEFQCFVAVESRHAGRALEQLERGKVKGRNLRARLV

SEQ ID NO: 94423 - protein, 561 aa, Oryza sativa
MELFYELLLTAAASLLVAFLLARLLASAATASDPRRRAPDHAAVIAEEEAVVVEEERIIEVDEVEVKSARARECVVSEGWVEVGRASSAEGKLECLPEEEEAPAKAARELVLDAVLEEREEEGQVGEERCDLAAAVAEVVGVKPHELGVEAAPGEVSDVTLEEGKVQDVGVEQHDLVAEAAPREALDTGLEKQGVPIIEAVEIKRQDDLGAEVAPSDVPEVEFEQQGVRIIEAIDVNQHHRVALAAPAEVVDAGLEERVQAIEAGSSGLTSETVPEEVLDELSEKQEEQVIEEKEHQLAAATAPVAIPGVALAETEELKEEQSSEKAVNVHEEVQSKDEAKCKLHLVDQQEGSASKVELVGRNTDNVEISHGSSSGDKMIAELTEEELTLQGVPADETQTDMEFGEWEGIERTEIEKRFGVAAAFASSDAGMAALSKLDSDVQLQLQGLLKVAIDGPCYDSTQPLTLRPSSRAKWAAWQKLGNMYPETAMERYMNLLSEAIPGWMGDNISGTKEHEAGDDAVGSVLTMTSNTINQHDSQGNEDNTGMYEGHLTSSLDCHVG

SEQ ID NO: 94424 - protein, 399 aa, Glycine max
  misc_feature (115)..(115): Xaa can be any naturally occurring amino acid
MEDPEVIIGSLNPNDTRGKTVTCKAAVAYGPGEPFVVERVLVHPPQKMEVRIKILFTSICHTDLSAWQGENEAQRAYPRIFGHEASGIVESVGEGVNDMKEGDLVVPIFNGECGXCKYCKCEKTNMCERFGVDPMKKVMASDGATRFSTMDGKPIFHFLNTSTFTEYTVVDSACIVKIHIDGSNGDLNRNIKRLTLLSCGVSSGVGAAWNTADVHFGSTVAVFGLGVVGLAVAEGARARGASRIIGVDINSDKFIKAREMGITDFINPKDDERPVYEIIGEMTGGGVHYSFECAGNLNVLRDAFLSAHEGWGLTVLVGIHLSPKMLPIHPMELFHGRRIVGSNFGGIKGKTQLPHFAKECMNGVVKLDDFITHELPFKEINQAFDLLTPGKSLRCLLHF

SEQ ID NO: 94425 - protein, 717 aa, Shewanella sp. MR-4
MSRNIMLIPIGTGVGLTSLSLGMVRALERHGVKVQFFKPISQLRPNDNGPERSTTILSKSPTVNPLEPFDMAHAEALIRADQTDVLMEQIIARAAECASNTETLIVEGLVPTRNHPFADDVNYAIAKAMDADVIFIATPGSDTPTGLMNRLEIAYNSWGGKNNKRLIGAVINKIGAPVDDEGRARPDLSEVFDHQGVQRSDSSIMFQLPGKSPLRILGSVPYNLDLVAPRASDLAKHLRARILNAGEMNTRRLRKVTFCARSLPNMVNHIKTDSLLVTSGDRSDVIVSACLAAMNGVKIGALLLTGSYEPEPEILKLCEQAFETGLPVFLIDTNTWQTSLNIQRFDHEVPVDDAVRIDLVQEYVAGHIDQTWVESVTKNSPREHRLSPPAFRYKLTELARAAHKTVVLPEGDEPRTIKAAAICAERGIARCVLLGKKDEILRIAAQQDVVLGDGVVIVDPDEVRDRYVEPMLDLRRNKGLTEVVAKEQLEDNMVLGTMMLAQNEVDGIVSGAVNTTANTIRPPLQLIKTAPGSSLVSSIFFMLMPDQVLVYGDCAINPDPNAEQLADIAIQSAESAKAFGIEPRVAMISYSTGNSGTGSDVDKVREATRIAKEKRPDLVIDGPLQYDAAVMPNVARSKAPNSPVAGQATVFVFPDLNTGNTTYKAVQRSADLISIGPMLQGMRKPVNDLSRGALVDDIVYTIALTAIQASQNDASKA

SEQ ID NO: 94426 - protein, 177 aa, Hordeum vulgare
LAGDSPGNVPGSWKEPGIGWMTGFLLACSFGGLLTLIPLRQVLAVDYKLVYPSGTATAILINGFHTDQGDKNSRKQIRGFLKYFGGSFMWSFFQWFYTGGDACGFVQFPTFGLKAWKQTFYFDFSMTYVGAGMICPHIVNISTLLGAIISWGIMRPLISKNKGDRYPAKVPESSMKS

SEQ ID NO: 94427 - protein, 508 aa, Oryza sativa
MEGGGRGGGPVVAALLLAALLLAAVAPASASSYPAKVVSGFLSNAASSVMKRLWSLKSTTKTGSGGKSMVKYEGGYTVETVFDGSKLGIEPYAVEVTQGGELLVMDSMNSNIYRIALPLSRYSRPKLVAGSPEGFPGHVDGRPREARMNHPKGFTVDGRGNIYVADAMNMAIRKISDTGVTTIAGGKSSRGGHVDGPSDDAKFSTDFEVRYIGSSCSLLVIDRGNQAIREIQLNFDDCVYQYEAGFPLGVAVLLAAAFFGYMLALLQRRVLGMVSTEDEPETQTPLKASIASIPPYQKPLKQSVRPPLIPNEDESEKQEVEEGFFTSIGKLIVGAKSSVAEIVGAAFSRKKRLNIHQQQARVRSWPVQESYAIPRDETPPPLDTRTPTPRKNYAFMSKEPEKIHHIRHGRSQFNGWNGDAPQQQQQQQQQQQIHHQQYLQHHRQYSSGPQTFYEPSCEATNEIVFGAVQEVDGKRRAVEIKPMNHGDPQYDQDGLRHRSSYTGYSNNW

SEQ ID NO: 94428 - protein, 300 aa, Mannheimia succiniciproducens MBEL55E
MQWLKYKHRCKYSLGGNKMQTFKLNNGVEIPVLGFGVFQIPPEETEQAVISAIHAGYRHIDTAQAYMNETETGAGIRNSGVVREEIFVTSKVWIENYGYEAAKASLDRTLARLDIGYIDLMLLHQPFNDVYGAWRALEEYLAAGKIRAIGLSNFTADRVLDVGLYNKVMPAVNQIEINPFHQQQAQVEGLLSEGIVPEAWGPFAEGKFGIFENPVLAKIGQKYGKSIAQVVTRWLVQRGVVVLAKSTRPERMAENLNVFDFELDADDFAQIAALDVGKSQIISHTDLAMVRQFKEWVFNV

SEQ ID NO: 94429 - protein, 358 aa, Clostridium perfringens SM101
MHKKLFIPGPVEVREEVLEKMATPMIGHRSKEASQLQRRISDNLRKLFFTNNEILLSTTSGSGLMEGAIRSCTLKKAAVFSVGAFGDRWYEMGISNNVPVDKFEVPWGKSINVDLIDSVLKTGQYDLITVTHNETSTGVMNDLEAISKVIRKYPEVIFCVDAVSSAGGSKIEVDKLNIDICITSSQKALGLPPGISICTFSEKARERAEKVKFRGTYLDLLALYKYIKKKDYQYPSTPSISHMYALDYQLDYILNVEGLENRFNRHIEMAKIVREWAEKYFEIYPEKGYYSNTLTTIKNNKNIDIGALNKELGKRGFQISNGYGKLKDKTFRIAHMADCQVKDIKELLSNINEILELE

SEQ ID NO: 94430 - protein, 625 aa, Streptococcus pyogenes M49 591
MSHFLVEKLTKTVGDKTVFQDISFIIHDFDRIGIIGVNGTGKTTLLDVLSGRLGFDGDHSPFSKANDYKIAYLTQDPEFNDAASVLDTVLSADVKAIQLIRQYELLMANYTEDKQESLESLMSEMDRLDAWSIESDVKTVLSKLGITDLEQKVGDLSGGMRRRVQLAQVLLGAADLLLLDEPTNHLDIDTIAWLTTYLKTAKKTVLFITHDRYFLDNVATRIFELDKGGLTEYQGNYQDYVRLKAEQDERDAANLHKKKQLYKQELAWMRTQPQARATKQQARINRFTDLKKEVHQDSSADKLEMAFETSRIGKKVIHFEDLSFAYGDRQLIKDFNLIIQNKDRIGIVGDNGVGKSTLLNIINGDLKPTSGKLDIGDTIRVGYFSQQLKDMDETKRVINYLQEVADEVKTSVGTTSISELLEQFLFPRSSHGTLIAKLSGGEKKRLYLLKLLIEKPNVLLLDEPTNDLDIATLTVLENFLANFAGPVITVSHDRYFLDKVATKILAFEEGDIRIFYGNYSDYLDEKAFEKETVEADLAKAIVTEEVSLPPKEEKKRMSYLEKQEWAQIEDKIATIEANIEEIENQMLTVVSDYDQLAQLQKELDQRNNDLLLAYERFEYLSGLDI

SEQ ID NO: 94431 - protein, 486 aa, Arabidopsis thaliana
  misc_feature (77)..(77): Xaa can be any naturally occurring amino acid
  misc_feature (146)..(146): Xaa can be any naturally occurring amino acid
  misc_feature (167)..(167): Xaa can be any naturally occurring amino acid
  misc_feature (180)..(180): Xaa can be any naturally occurring amino acid
  misc_feature (221)..(221): Xaa can be any naturally occurring amino acid
  misc_feature (245)..(245): Xaa can be any naturally occurring amino acid
  misc_feature (309)..(309): Xaa can be any naturally occurring amino acid
  misc_feature (322)..(322): Xaa can be any naturally occurring amino acid
  misc_feature (347)..(347): Xaa can be any naturally occurring amino acid
  misc_feature (388)..(388): Xaa can be any naturally occurring amino acid
  misc_feature (391)..(391): Xaa can be any naturally occurring amino acid
  misc_feature (399)..(399): Xaa can be any naturally occurring amino acid
  misc_feature (453)..(453): Xaa can be any naturally occurring amino acid
  misc_feature (472)..(472): Xaa can be any naturally occurring amino acid
ADGNNIKAPIETAVKPPHRTEDNIRDEARRNRSNAVNPFSAKYVPFNAAPGSTESYSLDEIVYRSRSGGLLDVEHDXEALKRFDGAYWRDLFDSRVGKSTWPYGSGVWSKKEWVLPEIDDDDIVSAFEGNSNLFWAERFGKQFLGXNDLWVKHCGISHTGSFKDLGXTVLVSQVNRLRKXKRPVVGVGCASTGDTSAALSAYCASAGIPSIVFLPANKISXAQLVQPIANGAFVLSIDTDFDGCXKLIREITAELPIYLANSLNSLRLEGQKTAAIEILQQFDWQVPDWVIVPGGNLGNIYAFYKGFKXCQELGLVDRIPRXVCAQAANANPLYLHYKSGWKDFKPXTASTTFASAIQIGDPVSIDRAVYALKKCNGIVEEATEEELXDAXAQADSTGXFICPHTGVALTALFKLRNQGVIAPTDRTVVVSTAHGLKFTQSKIDYHSNAIPDXACRFSNPPVDVKADFGAVXDVLKSYLGSNTLTS

SEQ ID NO: 94432 - protein, 317 aa, Mycobacterium sp. MCS
MSLHALVIGEALIDIVERDGVVQGEHVGGSPLNVAVGLSRLGRGVDFLTHIADDARGRRIVEHLEAAGVHLVAGSRNAARTPTARAMLDDKGSARYEFDIDWNLTGTPEAAPPLVAHTGSIATVLEPGCRATAALLDAYHLSATITFDPNIRPALIDDADAARARIDRLVERADVIKASDEDLRWLDPNRTPKQIARAWLQLGPSIVAVTEGGQGAFAVCAAGSARVAALPVEVVDTVGAGDAFMSGLIDALWTHGLLGAEKRRELRAIRLDALHDVLQTAALSSALTVTRAGADLPDRATRDAAAREPATLIDRRR

SEQ ID NO: 94433 - protein, 231 aa, Physcomitrella patens subsp. patens
NTVRVTNISEKATAHDIHDFFSFSGEIVNIELQRSNDSQIALVTFKEPQALDTALLLSGATVVDRAVNITPLEDELPPSNNPIPREQASQTSNQAVDVVATMLARGFILGKDALSKAKEFDAKHDLSASAKSSVVNFDKNTGISEKLNAGTAVVNQQMKAVDEKYQVSEKTRAVLAVAEEKVSTAGSVLMNNRYLLTGARWVTGAFSRVQKVAAEVSQKTKEKAGIMESEH

SEQ ID NO: 94434 - protein, 120 aa, Oryza sativa Indica Group
QRESGSTMDVVAAQTKAISERIKDWTNVVVAYEPVWAIGTGKVATPDQAQEVHDGLRKWLAANVSAEVAESTRIIYGGSVTGANCKELAAKPDVDGFLVGGASLKPEFIDIINSATVKSA

SEQ ID NO: 94435 - protein, 84 aa, Clostridium perfringens SM101
MDLNAKQMTSEEFSKLIENQGVMGKSNITFVIGGSLGLSQAVIKRENYKVCFSKMTFPHQLFRIMLLEQVYRAFRIMKNEPYHK

SEQ ID NO: 94436 - protein, 270 aa, Oryza sativa Japonica Group
MDRYQRVEKPRNETPISENEIRITAQGRMRNYISYGMSLLEENGHDEIVIKAMGRAINKTVMVVELIKRRIGGLHQITSTESIDITDTWEPLEEGLLPLETTRHVSMIAITLSKKALDTLSPGYQPPIPAEEVRPAFDYEHEESFPTNRGRGRGGGRRGRGRAMSNGPPAYDYGEEWEEEGDYYNYRGRGRGRFRGRGRGRGRGGYYGGGRRGGYGYDYGYGGRGDYYEDQGEYFEEPEDYPPPGRGRGRGRRGGGPGPFRGRGRGRGRF

SEQ ID NO: 94437 - protein, 479 aa, Gibberella zeae
MAENSTPDVPGPAGIPYFGNYLEIYPDHLGNHQRLFEKYGPLFTTTSMGNRLYQTNSAELSNIFLSEDHYFTKDIVPGHPLHPIKNQEAGVFLADTNTEQWRLAHKFLPPALGPKAVRHYAPTMQRTVESSFKVFDELDQKGEAWNVYQYMLKLGSQAVGKLVLGMDFAHFEQVDSPLHEMVLKIAENLELNKRVSSMGAWYAQMPFGDPKKVRQTMARIMEMMDESIARASKGQEDLELQDAALKADTVVDYFLRATDNKGNKLPPSQFAPALLVATAAGFTTTSSLLSWLIYSLVKYHGNQERLLQELIDNDWDENTQVTADTTSKLTFLDKFIKETQRLHNPSFQPGRTAKVDMILPGGYRLPKGAVVISALHHMHNNKDVWENPGRFDPDRWDTEQVKNRPPGSYIPFATGPRMCVGFNFALQEIKVFLPKLVYRYKFSLAQDGPIEYDPYFQLIRPNNLYVQAEKRVKWPPKSE

SEQ ID NO: 94438 - protein, 218 aa, Thermotoga sp. RQ2
MLFRKVGEFFRDFVSIFKHISEDLEMYLKLDPAAESKLQVFFFYASFQGLMWYRFAHFFYKWKLKVLAYLIYYFVRVVFSMDIHPAARIAPGVVIDHGIGVVIGSTASVGRGTLIYHGVTLGTRKPCSGKRHPDVGENVMIGTGAKILGPIRVGNNAVVGANAVVLEDVPDGAVVVGVPARIVKWRRDFCDDGKTDREHSYSEARFDRLENILETGKE

SEQ ID NO: 94439 - protein, 291 aa, Thermotoga sp. RQ2
MMERLIGSTPIVRLDSIDSRIFLKLEKNNPGGSVKDRPALFMILDAERRDLLRNGIVEPTSGNMGIAIAMIGAKRGHRVILTMPETMSVERRKVLKMLGAELVLTPGELGMKGAVEKAIEISKETGAHMLNQFENPYNVYSHQFTTGPEILKQMDYRIDAFVAGVGTGGTISGVGRVLKGFFGNEVKIVAVEPAKSPVLSGGQPGKHAIQGIGAGFVPKILDRSVIDEVITVEDEEAYEMAKYLAKKEGILVGISSGANVAAALKVAQKLGPDARVVTVAPDHAERYLSIL

SEQ ID NO: 94440 - protein, 673 aa, Vitis vinifera
MNSSSYIGITTMKPYCRVLTSCRNSSIFKFPSSKSNHFIADNSSKFQSKLTQSRRFHCCSAQILGKKCGINSNRRAFRFSDPNWGQIRVYRSCSGAHGGRRGVLVISNVASDFRKHSTSVESHVNEKGFESIYINGGLNVKPLVIERIERGHVEEESGLEFKDPDVNFDHSEGLNKEKVEREVPEIEKEAWRLLRSAVVDYCGNPVGTVAANDPGDKQPLNYDQVFIRDFVPSALAFLLKGEGEIVKNFLLHTLQLQSWEKTVDCYSPGQGLMPASFKVRTVPLDGGNGAFEEVLDPDFGESAIGRVAPVDSGLWWIILLGAYGKITGDYALQERVDVQTGIRLILNLCLTDGFDMFPSLLVTDGSCMIDRRMGIHGHPLEIQALFYSALRCSREMLTVNDGTKNLVRAINNRLSALSFHIREYYWVDMKKINEIYRYKTEEYSTDAINKFNIYPDQIPTWLVDWIPDQGGYLIGNLQPAHMDFRFFTLGNLWSIISSLGTAKQNEGILNLIEAKWDDLVAHMPLKICYPALENEEWRIITGSDPKNTPWSYHNGGSWPALLWQFTLACIKMGRPELARKAVALAEERLSVDHWPEYYDTRSGRFIGKQSRLYQTWTIAGFLTSKMLLENPEMASLLAWEEDYELLEICVCALSKTGRKKCSRSAARSQIPVQ

SEQ ID NO: 94441 - protein, 590 aa, Treponema denticola ATCC 35405
MNKIFKQIEKIGIVPVIVLDNEKDAFPLGKALSTAGLLCAEITFRTEAAEKAIKVFAKNFPDFLIGAGTILSPEQADKAIAAGAKFIVSPGLNPKVVEHCVNLGYPIIPGVSTAGEIEQAMSFGLEVVKFFPAEAAGGLKFIKALSAPYPNIKFMPTGGINAQNIAEYAAFSKVIACGGSWMVSKELISSKDFKKIEEESSIALQIVKEARNPKKSPSALTAFSYPKTSTETKSSISNESSLSGSIETNKAPKVITMGEIMLRLSPTGFNRFVQADALELVFGGAEANVAVSLANFGMQSSYITKLPSHEIGQAAVNSLRRYGVDVSGIVRGGKRVGIYFLEKGASQRASKVIYDRANSAIAEASLSDFNWKEIFKGASWFHFTGITPALSKNAAEICLEACKTARSMGITVSCDLNYRKKLWTPDEAKETMSSICEFVDICISNEEDAEQVFGITSKNTVVSSGKLNEKGYKEVAAKLCKKFGFQKVGITLRESTSASENNWSAMLYTKGKAYFSKKYTMQVVDRLGGGDSFAAALICAELKGFKPQKQIDFASAASCLKHSINGDFNQVSFDEVLTLAKGDASGRVQR

SEQ ID NO: 94442 - protein, 253 aa, Pteris vittata
MARKFFVGGNWKCNGTVAEVNKIVKLLNEADVPSEDVVEVVISPPFVFLPQVKAVLRSDFAVAAQNAWVRKGGAYTGEISAEMLINLEIPWVILGHSERRALLKESNEFVADKVAYALSQGLKVIACIGETLEQREAGETLNVVSEQTKAIAEKIKDWSNVVLAYEPVWAIGTGKVATPVQAQEVHADLRSWLATNVSSDVAESVRIIYGGSVNAGNCVELAGQPDVDGFLVGGASLKAEFVDIIRSALVSKS

SEQ ID NO: 94443 - protein, 1216 aa, Ustilago maydis
MPTTVPSTVASANAVSSIQSQKKFSTFAGLRDMSARGGSYNGTTGQPNSNRTSIRGLFDEDGNPGSLNASPRLPTTELNSTLTDPASAAALGRSADGPWSISVAEAKDKREGRKRKQLVASYTLYVTTPTHNLTLIRSANDITEVDQKIRDALPSSRLPALPTMPNFAPSSSGRKFFQTLSRTLSPGASKSRSTFSNLIGDPATSAADLDASGAVSPPPSAPLSPVPGVNTKLASHSITTQLATYFTALANNPATREHKAWKRFVRVEADDFQSVRVERRVRKVRSDLAEHVKSSGHRATPMSGVAPAQSDLEEDGGPTEDDLDLDSADDSSRASGTPAGRISRATVVSRSGSLDTTSSDRRGVADDSRSTNTNIEMIPEEQHGEDFHEASTDRQGDAAKLHHNRSHRRRKGSNKVTVDDFEMIRVLGKGCAGKVLLVRHTSSRGLYAMKSIHKRHVLAHQELQHTLTEQAVLKRMAKDVLDPFVVRLWWSFHDRNNLYLVMDFHPGGDLATQLSRWGRLGRDRARFYAAEIVEGVEGLHKAGVIYRDLKPENVLIGADGHIVLSDFGLSKEFSSRSRSVGSITPPPTSPGRSHSSTSVNKQRSTHWMSASDDAADGSSRSSSSRWLDERETTTTFCGTAEYLAPEVLQGQAYSYEVDWWSFGTMLYEMLTGITPFWADTHADMYAKVLRDPLVFPEDRVLDQDTKSILRGLLQRNPQLRMKEPRIKKHPYFSMIEWDHIFHKRYIPPYIPPIDPDNEIDTQNFDETFLEMQPTVAHEQDVSVDMTSAAGEDVVGGTGFTHTANDPLKRTAGAAAAATPDQSMDDREASQHSNLFDGYSFRGRKDSGSIISSLSSDQLEEDVGNAALSASPVKKVAANGVKHQPKQLSPAPTVAKVSTAPVAAQATELQSQSQSASTQHPVVDASIIEEEEEEDDETAARNAAAVLAQLEQEANMEASSVAGTSATDGLIGDGMQPHSRDCTTTNSDSQSDRSVSQIQSSPASSYASRSAAPRKTVPSAVGRPSHGAIHEDDGEDDDWDMVELSGPDGALKSELNGGRGTNLFARGDWTPRGVVDTYRLLRRQESSRIPASSSHSSTSSRPFNRLGKRRNGQGLASMRSKASMGELPTANSLNTVTPTDAIPLNGDAEKEAAVEQAAAKLSATGGRASVLSASSHTELNRRSAASPSLSGSEENKHQARLKKIKRFTTFFENSSHR

SEQ ID NO: 94444 - protein, 400 aa, Glycine max
MACPAMANGNGSLKNLKLNDTKGKTITCKAAVVYGPGEPFVVENILVHPPQKMEVRIKILYTSICHTDLSAWRGVNEAQRAYPRIFGHEASGIVESVGEGVSEVEEGDIVVPIFNGECGECSMCKCEKTNLCERFGVDATKKVMEGDGTTRFSTVNGKPIFHFLNTSTFSEYTVVDSACVVKFLDSDHSLSHKNLTLLSCGVSTGVGGAWNTANVHSGSTVAIFGLGVVGLAVAEGARARGASKIIGVDINPDKFIKAQTMGVTDFINPDDEEKPVYERIREITDGGVHYSFECTGNVDVLRDAFLSSHEGWGLTVILGVHASPKLLPIHPMELLDGRNIVGCVFGGFKGRSQLPHFAKECGQGVVKLDNFITHELPFEEIDKAFDLLITGKSLRCLLHF

SEQ ID NO: 94445 - protein, 348 aa, Zea mays
  misc_feature (185)..(185): Xaa can be any naturally occurring amino acid
  misc_feature (261)..(261): Xaa can be any naturally occurring amino acid
MPLTKLHPSLAAASTLTPKHSLNANRVVALTPSASHRSGGLRVSAASVAAAQPTPASPAAGAAAALSRVDVLSEALPFIQRFKGKTVVVKYGGAAMKSPELQASVIRDLVLLSCVGLRPILVHGGGPEINSWLARVGVEPQFRNGLRVTDAVTMEVVEMVLVGKVNKQLVSLISLAGATAVGLCXGKDARLLTARPSPDAASLGFVGEVTRVDPAVLHPIIASGHIPVIATVAADEAGQAYNINADTAAGEIAAAVGAEKXLLLLTDVSGILADRDDPGSLVREVDVAGVRRMVAEEKVGGGMIPKVECCIRAIAQGVRTASIIDGRVPHSLLLEILTDEGTGTMITG

SEQ ID NO: 94446 - protein, 353 aa, Thermotoga maritima MSB8
MRHKIRLIDFILLRFIEERMKVARDVAKEKKKTDSPIVIRDIEEQKIKEILDRTDLNPVRMRRIFEEIMKLAKEEEYRLLGISKTVAVLGPMGSFSDEMAMKLIGSRIPLKYCSTTDEIIEMVEKGEVDYGIVPIENSTYGTVIPVLDALLNHEVEVFGEAKLEIHHCLVAKKKLDLKEIKRIYSHPQAISQSLGFINTYLSHAEIRYTSSTSDAVNLLDDESAAIMSESAAKMYGLLILRRSIQDLKEKNITRFYIIRRKTGKMEGKYTSLFFGVQDRPGSLKAVLDIFASRGINLRKLESRPARTFLGDYVFFVEVEAPLKEEDIRDLERVTAFYKIIGVFDEVEELDVFK

SEQ ID NO: 94447 - protein, 458 aa, Saccharophagus degradans 2-40
MTRHDTIGAPIAERLKPFRNYKLLDHLPTAQGRLTRMVGLTLEAVGLNVPVGSQCRVVLPHNKNIDAEVVGFNGDKTYLMPVQKVEGLQPGARVVPLDAHQHMAIGEHLRGRIINGIGQPLDGKGPLPGKSNVDMAPSAINPLSRHPIDAPLDVGVRAINGLLTVGRGQRIGLFAGSGVGKSVLLGMMTRFTTADIVVVGLIGERGREVKEFIDQILGDAGMSRAVVIASPADDAPLMRLRAAELCTRVAEFFRDQGLNCLLLMDSLTRYAQAQREISLAIGEPPATKGYPPSVFSKIPELVERAGNADKGGGSITAFYTVLTEGDDLQDPIADSARAILDGHIVLSRDLAEEGIYPAIDISASVSRVMPSIVTPDHLQKAQKFKALLSRYRANKDLISIGAYTPGTDPNIDGAIERYPHLNKYICQGMKEASGLVPSMEQLFNVIAPTERTERKLGG

SEQ ID NO: 94448 - protein, 550 aa, Oryza sativa
  misc_feature (14)..(14): Xaa can be any naturally occurring amino acid
  misc_feature (30)..(30): Xaa can be any naturally occurring amino acid
  misc_feature (40)..(40): Xaa can be any naturally occurring amino acid
  misc_feature (66)..(66): Xaa can be any naturally occurring amino acid
MSAAHLLRHSRKLXRSLHNALDCERSGPRXRYFSTASGSXFPTKGNVLLVSTGAEKRIGGARFPQXKQPGKELETSKLSLGLNGSYTCRRSPNNFIPNTITGLNGSLSCGQIASARSFSSSADLPPHQEIGMPSLSPTMTEGNIARWLKKEGDKVSPGEVLCEVETDKATVEMECMEEGYLAKIIHGDGSKEIKVGEIIAVTVEEEGDIKKFKDYKPSTLAAPVAPSELKAQSEPTEPKVEEREPSKASELKAPRTEEPSRSGDRIFSSPLARKLAEDNNVPLSSVKGTGPDGRILKADIEDYLAKGCRKEALAAPGLSYTDVPNAQIRKVTANRLLSSKQTIPHYYLTVDTRVDNLIKLRGELNPLQESSGGKKISINDLVIKAAALALRKVPQCNSSWMNDFIRQYHNVNINVAVQTEHGLFVPVIRDADKKGLGMIAEEVKQLAQRARDNSLKPDDYEGGTFTISNLGGPFGIKQFCAIINPPQSAILAIGSAERRVIPGSANGQYEFGSFMSATMSCDHRVIDGAIGAEFLKAFKGYIENPTSMLL

SEQ ID NO: 94449 - protein, 447 aa, Salmonella enterica subsp. enterica serovar Typhi str. CT18
MKKVKKLSLTDLVLYGLVFMVPIAPVSLYGVVYNLSHGMVALVYIIGAIAMFFTAYSYSTLSQHISSSGSAYAYAGVCINPAVGFLTGWILLLDYLLFPTLVAVLGGVAVHAILPQIPVWVWPLIYVAIGTGVNYLGIQQTAKFDKLLVFIQLGILAIFVLLIIRLMMQDSSQITLSFRPFFDSQWFTPGLIATAISVAALNFLGFDAISTLSEESEGGGRAVSKATLLALVLATVLFIIVVAFAAFATGNVDRFAEGNATNEAFFTIAGNVGGIWLKVAFSIIVAFVCAVGNIITAQTAVSRVLFSMGRDRMLPAFLAHVHTTRKTPDYAILFTGGVTLLLSYLFSGKIESISTLVNFGALFAFFVVNLCVFILFNFRMKAQRRIFAHVISPIMGMIVIGYVCLNMNIHALILGISWAAIGIAILCYRKAYNQNIAIDLEGKKLLD

SEQ ID NO: 94450 - protein, 496 aa, Magnaporthe grisea 70-15
MSLVTELKTPVTGAYQQPTGVFINNEWVEGVDKKTFETINPSTEEVICSVSEATEKDVDIAVKAARKAFEGEWKQTAPGQRSKLLTNLAELVEKNLDLLAAVESLDNGKSLAMAKGDVGAVAGCLRYYGGWADKIEGKTIDIAPDMFHYTRSEPIGVCGQIIPWNFPLLMLAWKLGPALATGNTIVLKTAEQTPLSALVFANLIKEAGFPAGVVNIISGFGKVAGAAISAHMDIDKVAFTGSTVVGRTIMKAAASSNLKKVTLELGGKSPNIIFNDADIEAAVSWVNFGIYYNHGQCCCAGSRIYVQEGVYDKFVAAFKERAEKNKVGDPFKEDTFQGPQVSELQFNRIMEYIKSGKEEGATVETGGERHGDKGYFIQPTIFSNVRPEMKIMKEEIFGPVVAMAKFKTEEEVIALANDTNYGLAAAVHTKDLNTSIRVSNALKAGTVWVNCYNMLHHQLPFGGFKESGIGRELGEAALANYTQNKSVAIRLGGPIF

SEQ ID NO: 94451 - protein, 288 aa, Staphylococcus aureus subsp. aureus MRSA252
MNEQWLEHLPLKDIKEISPVSGGDVNEAYRVETDTDTFFLLVQRGRKESFYAAEIAGLNEFERAGITAPRVIASGEVNGDAYLVMTYLEEGASGSQRQLGQLVAQLHSQQQEEGKFGFSLPYEGGDISFDNHWQDDWCTIFVDKRMDHLKDELLNRGLWDANDIKVYDKVRRQIVAELEKHQSKPSLLHGDLWGGNYMFLQDGRPALFDPAPLYGDREFDIGITTVFGGFTSEFYDAYNKHYPLAKGASYRLEFYRLYLLMVHLLKFGEMYRDSVTHSMDKILQDTTD

SEQ ID NO: 94452 - protein, 430 aa, Xylella fastidiosa Dixon
MVADKQGEPTLARIAVVGLGYVGLPLAVAFGRQRPTLGFDIDICRVQQLCAGHDITCEIELEELQAARHLRYSSDPRELSDCQIFIITVPTPIDVAEQPDLGPLRSASMLVASVLKPGDLVIYESTVYPGTTEEVCVPLLEAGSGLRFNVDFHCGYSPERINPGDRKRRLQDICKILSGSTPDITAVVDALYSQIIVAGTWCAPSIRVAEAAKVVENIQRDVNIALVNELALIFDRLGIDTLDVLEAAETKWNFLPFRPGLVGGHCIGVDPYYLLHKSESVGYYPDLIHTARRVNSRVSRHVVDRVVALLGELSVPMTRAVVLVLGVTFKEDCPDLRNSRALDLVRMFRNLGAQVDVCDPCADPQQALEHEAVTLCTEPKAGAYDAIVLAVAHAQYRMYDVATIAALGKPQAVVYDVKSVWPRAAVTDRL

SEQ ID NO: 94453 - protein, 322 aa, Shewanella sp. MR-4
MSKIFEDNSYTIGNTPLVRLNRVSQGKVLAKVEARNPSFSVKCRIGANMIWDAEKKGLLTKDHELIEPTSGNTGIALAYVAAARGYKLTLTMPNTMSLERRKLLKALGANLVLTEGAKGMKGAIDKAEEIRQSAPEKYIMLQQFNNPANPEIHEKTTGPEIWNDTDGAVDVFVAGVGTGGTITGVSRYLKKVAGKAITSVAVEPADSPVITQTLAGLPVQPGPHKIQGIGAGFIPGNLDLELIDRVETVTNDEAIDMARRLMQEEGILVGISSGAAVVAANRIAALPEFADKNIVVILPSAAERYLSSVLFQGQFGDEENIQ

SEQ ID NO: 94454 - protein, 129 aa, Arabidopsis thaliana
MGHHHHHHLEAEESRVPSSVSVTVAHDLLLAGHRYLDVRTPEEFSQGHACGAINVPYMNRGASGMSKNTDFLEQVSSHFGQSDNIIVGCQSGGRSIKATTDLLHAGFTGVKDIVGGYSAWAKNGLPTKA

SEQ ID NO: 94455 - protein, 355 aa, Arabidopsis thaliana
MADEKENCVRMTRAATKRKASMEAAIDKERINKKRVVLGELPNLSNIKKSRKATTKQKKKSVSIPTIETLNSDIDTRSDDPQMCGPYVTSIFEYLRQLEVKSRPLVDYIEKIQKDVTSNMRGVLVDWLVEVAEEYKLLSDTLYLAVSYIDRFLSLKTVNKQRLQLLGVTSMLIASKYEEITPPNVDDFCYITDNTYTKQEIVKMEADILLALQFELGNPTSNTFLRRFTRVAQEDFEMSHLQMEFLCSYLSELSMLDYQSVKFLPSTVAASAVFLARFIIRPKQHPWNVMLEEYTRYKAGDLKECVAMIHDLYLSRKCGALEAIREKYKQHKFKCVATMPVSPELPLTVFEDVNI

SEQ ID NO: 94456 - protein, 526 aa, Oculimacula yallundae
MGILDAVTVPLATQVSQRGLGVVIAAGFAAFLVVSVVLNVLSQILFKNPNEPPVVFHFFPIIGSTVTYGIDPYKFFFDNKAKYGNIFTFILLGKKTTVYLGPDGNEFILNGKIKDVNAEEIYTVLTTPVFGKDVVYDCPNSKLMEQKKFMKIGLTTDAFKTYVPIIQNEVETFIKRSPEFKGHSGTVNIPAQMAEITIYTASHALQGKDCRDKFDSSFAELYHALDMGFSPINFMLHWAPLPHNRARDHAQRTVAKTYMEIMEARRKDKKSLDNMDIMSQLMRSTYKNGVPVPDMEIAHMMIALLMAGQHSSSSSSSWIMLRLASRPDIMEELYQEQLEVLGSDLPPLQYEDLAKLTKHQNVLKEVLRLHTPIHSIMRKVKTPMPVAGTKFVVPTSHVLLASPGFSSRDDTYFPDAMKWEPHRWDPESGGVLGTDVEEESFDYGYGLISKGAKSPYLPFGAGRHRCIGEQFANVQLITITAVMVRYFKFKNLDNSGKVVETDYTSLFSRPLAPAVVEYERREKVKV

SEQ ID NO: 94457 - protein, 276 aa, Hevea brasiliensis
DKIVVDKPIYVKALMSKTAGSIVGAALRRDPHEAEFIQSVQEAVHGLERVIAKNTHYVNIMERLLEPERMLLFRVPWVDDRGETHVNRGFRVHFNQALGPCRGGIRFHPSMNLSIAKFLGFEQTLKNALSPYKLGGAAGGSDFDPKGKSDNEIMRFCQSFMNEIYRYLGPDKDLPAEEMGVGTREMGYLFGQYRRLVGHFQGSFTGPRIFWSGSSLRTEATGYGLVFFAQLMLADMNKELKGLRCVVSGSGKIAMHVLEKLIAYGAVPVTVSDSKG

SEQ ID NO: 94458 - protein, 754 aa, Aspergillus nidulans FGSC A4
MAPRSFTLRSLLVGIVIGALITFSNTYFGLQTGWISTMAMPSALIGFSVFKVFSKYLSYPFTPIENVLIQTVAGAVGTMPLGCGFVGVIPALEFLIRDGEDGPSGGEGTGEGGPLKLNFGKLVLWSLGVCLFGVVFAVPLRKEVIIREKLRFPSGTASALMLRVLHGSGQSEKGANSRIDQSMEDQRDAEDVQPLLAQGSAQTEAVLQQDMTSTDNLKRDWRSKMRLLIGAFVVSGVYTLFSYFVPQVRDIPILGLPLAQNWLWTLNPSPAYVGQGIIMGPSTCAHMLFGAVLGWGVLSPLAKSRGWAPGPVDSWENGSKAWIVWVSLAIMLADSIVSLGWLVLKPALVIAPKVLKRISNTRAGSWIASKSPKIVPRSYNYSALSPITEESSGPSSLAHAETRWRADEDEDAPPSQLISMRTVLFLLPLTLLLNVICMHIVFGDVISPLLSSLATLLAVLLSIMGVRALGETDLNPVSGISKLTQLLFSLATPSSHFSRRTALITNLLAGAVSESGALQAGDMMQDLKTGHLLGASPKAQFYGQIIGSLIGAVLSTAVYKMYVNVYPVPGPMFQTPTAYVWIFTARLVTGQGLPPMAWEASSVAGIIFVAITILRIVAASPIANGGRPVGTPAPWRSWIPGGIAVAVGIFNVPSFTLARAIGGLIAWWWSRAHTNHTKKDDGFKPATEPAQSVLSRRPVESENRKPTSPVAGNADDDADAASSSVVVLASGLILGEGIVSIVNLLLASGRVPHL

SEQ ID NO: 94459 - protein, 408 aa, Mycobacterium sp. MCS
MLPDTDRRTRSTWLLLGPAFVAAIAYVDPGNVAANVSAGAQFGFLLVWVIVLANVMAGLVQYLSAKLGLVTGRSLPESVAGRTRTPTRIAYWLQAELVAMATDLAEVVGGAIALYLLFDLPLLIGGVITGAVSLALLAVQNRRGQRHFERVISSLLLIIAIGFLTSVFVEPPPVADVAGGLIPLFEGTDSVLLATAMLGATVMPHAVYLHSGLARDRHGHAEPGARRRLLLKATRIDVGLAMLIAGAVNMSMLLVAATNLQGMSDTDTLEGAHAAVQQTLGPAVALCFAIGLLASGLASTSVGAYAGAMIMGGLLRRTYPLLVRRLVTLVPALAILAIGVDPTRALVLSQVVLSFGIPFALIPLIRLTSDRAVMGDDVNHRITTTLGWVVAGLISLLNVVLIYLTVTG

SEQ ID NO: 94460 - protein, 265 aa, Bacillus halodurans C-125
MMTTPIYVVDAFTNQAFKGNPAAVCVLPTSRDDIWMQHVASEMNLSETAFLHPYQDGYSLRWFTPNTEVDLCGHATLASAHILWELDHISAEQPITFYTKSGILTASKRGEWIELDFPSEQPKQENVYPNELIDGLGIQPLYVGRNRFDYLIEIDSEQRLKELNPNFSLLEQIDTRGIIVTSKSTSTEYDFISRCFFPAVGVNEDPVTGSAHCCLGPYWQEKLNKNEFLAYQASKRGGMLKIKLQHDRVFLLGQAVTVLRSELLL

SEQ ID NO: 94461 - protein, 395 aa, Magnaporthe grisea 70-15
MKGAMMTAAVLLGTAEAGVHKLKMKKIPLEDQLKTFDLNAQMRGLGQKYLGIRPESHQQAVFSNDAVQASGNHPVPISNFMNAQYFSEITIGTPPQNFKVILDTGSSNLWVPSSSCGSIACYLHNKYESSSSSTYKKNGTEFKIQYGSGSMEGFVSNDVMTIGDLKIKNLDFAEATKEPGLAFAFGRFDGILGMGFDRLSVNKIVPPFYAMVDQKLIDEPVFAFYLADEKSESEVVFGGVNKDHIDGKITEIPLRRKAYWEVDLDAIALGDEVAELDNTGVILDTGTSLIALPSQLAELLNSQIGAKKGYNGQYSIDCDKRKDLPDITFRLSGYDFPISAYDYILEVSGSCISTFMAMDIPEPVGPLAILGDAFLRRYYSIYDLGKGTVGLAKAK

SEQ ID NO: 94462 - protein, 457 aa, Mycobacterium sp. MCS
MSSTTPLNPSVGEGEGQLRRVLGVPSLVLFGLVYMVPLTVFTTYGIVTVESGGRVPLAYVVTLAAMIFTARSYARMAAAYPVAGSAYAYTQKTFGAPVGFLAGWSLLLDYLFLPMLNYLVIGLYLNAAVPAIPQWLIVVVTIAIVTVLNIIGIVSVARANLLIIAIQAIFIVVFIVMAVAAVSGSGSVDVMAPFRGDGTADGMAPVLAGAAILCLSFLGFDAVSTLSEEARDARRDVPKAIMLATIICGVLFIILSYVSQLVFPSNAFTDVDSGSLDVMQSAGGAFLAAFFTAAYVAGASGSALTSQASVARILYAMGRDGVLPRKVFGHVSVKFGTPTWAVLVISIVSLLALVIDLAILASVVSFGALVAFSAVNLTVIKHYFVDAGEKNVVNNLVLPLIGFVLTVWLWTSLSAESLTIGLIWLAIGFLWLLGVTRGFRRPTPVLDLEELPAQPAK

SEQ ID NO: 94463 - protein, 1566 aa, Ustilago maydis
MSAATPTSPGFPLTMGTGVMAAHFAAPSSNAGSPRSRPTTPLSAGLTPSGPTYDDLGRWDDADVASWLNAARLGHYASIFAEHDIRGSVILDVDQAALKEMGITMVKDRVRISAAIKLLNKRCADSAVARRPSVVSISPLLPLASHPLYAHEGEIEYLQHDHTADPSADGSGSNFGLNSMGMRRGQMRPPPLTLKQSTSRGMPGYASPAGSINQSQGFGLSAARGLTPGAARGSVWNTASSSSATSKPGTPDGALHRKVNSIGGVAAPLAVGASSSLSSSRHPYGHAVHSNRPSTATGASGYSNVPASQSLRSNHTSSSPTATSFGSNINAASARPSTATGAQSYTTNVPGTSSARDGYSPLTPISESNSLGNTPTTPSGIQQQQQSAGYAVGRGPFASSQRYAASSVPSQQQPSSGHTLRHVDSGEGYNLAGYQNPNPPTLEDLKRRTIKFISEEDNTTRIVNVSDCRDAYDVMARVLKKFGKPPSGNSYTPTADQGPTGDELGATETWGIFATSADGQNTKALSDNELLAICHAPQPHDPLRERGLTLRRIPNHLPGEDARKVPVRSGRNKLEAFFGERMPVAQMQPAGPGSGVNADEEDAGSVTISGKKMKRASTVSIMSGLGVGPFSSSSHNTGAGHTHGSTRAEGKLLSKKESKHMSPPPVTSKPSKIRNFFGQRPPSELINTNLADFFPSTDSKALQRTARRSIYGRASASTRSKRNSTWSFVADPDAPPLPNKGSMDGHPTPLERSSISIRERGTTPVIQIGYDSRSEDDHQSNARRTSSGTHSHLHPSLTGPPTLPPVVSRDSLDEWSRDLKAVGSPVTEENAMFQSSRHGHASGSQQHHAAMKHYPSHASGYADRPSISRRASGESARSRRSLASQVRHGLSAARERNADTASLLTVDEITQEVENRRESISLAGAGGGWVVDEDGVPIPIPGSSSPFSSSAAASTRPSSGISSSYVHNGHLEHDDSEGHSDEEANQSSDLEEATRTRKARGVPSKAASIRTVASKRASSVLQAPGDESDRHLGDPMAVARSTTSRASSVSELRRSVHDHGDPSDGESGSDFTDSDLDSDGSETDEDEQANDVYLPSAKPAPIKWHKGALIGAGSFGNVFLGMNAKTGLLMAVKQVELPSGDSHLDQRKKGMLEALEREIKLLKSLEHENIVQYLDSFADDSHLNIFLEYVPGGSIVALLRNYGAFEEPLVRNFVRQILNGLSFLHNRGIMHRDIKGANILVDNKGGIKISDFGISKKVESDLVLATNKGGAGGGGAGGAAHRPSLQGSVFWMAPEVVKQTSYTIKADIWSLGCLVVEMISGTHPWAELNQMQALFQIGMGRKPSLPDEISNECRDFLEKTFELDYNNRPSADELLNHAFMGTEMTFPPSSGADGSGGGDDDAGGSGDAGDGDASTMGMTNDAETGTTRETRETKDGKRPTRSKSTRRLEREKRHKEAAAAAAAATALDTGTPNTPTSHTAAAAAAAAAASASASASASPAVASTSPAPGDAETGSPTNGKSAVPPAGSTGGTPESILTVSIATARGNSTSTALSAADAAFSEEADS

SEQ ID NO: 94464 - protein, 354 aa, Sulfitobacter sp. EE-36
MSQFLPLLVTDIQRTIRDAVVLTLQPEDPKAFAFKQGQYLTFKQDFDGTELRRNYSICAGLDDGVLQVGIKRVDGGAFSTFANEVLKVGDTLHAMPPQGTFSAGLEPDRARNYLGFAGGSGITPVLSILKTVLKREPKSTFTLVYANRAVNTIMFREELEDLKNRYMGRLSVIHMLESGQDIDLFTGRVDQNKCAELFKTWIDVSDMDMAFICGPEPMMLAIADALKTHGLEPEQIKFELFSESQQGRLAKQEMAKRSEGQAQTQVTVKIDGAQHSFTMAKGQSVLDAALENNLDAPFACKAGVCSTCMCKVTEGEVEMLSNHALEDYEVERGYRLSCQSYPLSDTLFIDYDHH

SEQ ID NO: 94465 - protein, 365 aa, Arabidopsis thaliana
MLAGLAFKRKWQNKRKAEGKPYDKPNIVTGANVQVCWEKFARYFEVELKEVNLSEGYYVMDPDKAAEMVDENTICVAAILGSTLNGEFEDVKRLNDLLVKKNEETGWNTPIHVDAASGGFIAPFIYPELEWDFRLPLVKSINVSGHKYGLVYAGIGWVVWRAAEDLPEELIFHINYLGADQPTFTLNFSKGSSQIIAQYYQLIRLGFEGYKNVMENCIENMVVLKEGIEKTERFNIVSKDQGVPVVAFSLKDHSFHNEFEISEMLRRFGWIVPAYTMPADAQHITVLRVVIREDFSRTLAERLVADISKVLHELDTLPSKISKKMGIEGIAENVKEKKMEKEILMEVIVGWRKFVKERKKMNGVC

SEQ ID NO: 94466 - protein, 148 aa, Oceanobacillus iheyensis HTE831
MEKTFLMVKPDGVQRELIGEIVKRFETKGYKLAGAKLMQVSNQLAETHYSEHKERPFFGELVDFITSGPVFAMVWEGENVIATARKMMGKTNPLEADPSTIRGDFGISVGKNIIHGSDSAESAEREITLFFTENEIVSYEKQANNWIY

SEQ ID NO: 94467 - protein, 238 aa, Oceanobacillus iheyensis HTE831
MGKPSSKEERVHHVFENIYSKYDSMNSIISFQRHKSWRKDTMKRMNVQAGETALDVCCGTGDWSISLSEAVGQTGKVIGLDFSKNMLSIAKQKKQDLQLNQLELVHGNAMELPYEENSFDYVTIGFGLRNVPDYMTVLEEMYRVVKPGGKVVCIETSQPTLIGYRQAYYFYFKFIMPILGKLIAKSYKEYSWLQESAKDFPGKKELKEMFLNAGFDKVEMKSYTGGVAAMHMGFKASQ

SEQ ID NO: 94468 - protein, 543 aa, Magnaporthe grisea 70-15
MSSTTEQAAAPHQTYDTILTLDFGSQYTHLITRRLRECNVYSEMLPCTTKLSDLTWKPKGIILSGGPYSVYDKDAPHADPAFFDLGVPVLGICYGLQELAWRLGKDNVVAGTEREYGHADLTPQKNSQAEKLFKGMGDDSLQVWMSHGDKLSQLPTGFQTIATTANSPFAAIAHESQNIFGVQFHPEVTHTRRGLDLLRNFAVGICGAQQNWNMHNFIEQEISRIRNLIGDKAQVIGAVSGGVDSTVAAKLMKEAIGDRFHAVLVDQGVMRHNECAEVKKALQDHLGINLTVADASERFLSGLKGVEDPEQKRKFIGNTFIDIFEEEAIKIEKAAENTPNAGKVEWFLQGTLYPDVIESISFKGPSATIKTHHNVGGLPKRMMEGQGLRLIEPLRELFKDEVRAMGRELKINEELVMRHPFPGPGIAIRILGEVTRERVEIARKADHVFISMIKEAGIYNEISQAYAALDTSRAVGVMGDKREYGYIVILRAVVTTDFMTATVYHMKPELLDRISTRIVNEVDGVTCVTYNITSKPPGTIEMQ

SEQ ID NO: 94469 - protein, 260 aa, Pseudomonas fluorescens PfO-1
MSRTAPRRYWLTGASSGIGAALAEEILKTGAHLAVSSRQVAPLKVLSQRYPGQVLLVPGDLTNSQTVREIGEQIAADWGSLDSVILNAGTCEYVDARQFDASIVEHVVRTNLLASSYCIEAALPLLRKGTAPHLVGMASSVTYVPLPRAEAYGASKAGLRYLFESLRIDLAAEGIEVTVISPGFVDTPLTAKNDFPMPLSWPVDKAARHIFAKLKDRPLEIAFPALFIAALWPLSKMPARVQLAIGKRMVRSNPPLKDAT

SEQ ID NO: 94470 - protein, 470 aa, Salmonella enterica subsp. enterica serovar Typhi str. CT18
MKKTKIVCTIGPKTESEEMLSKMLDAGMNVMRLNFSHGDYAEHGQRIQNLRNVMSKTGKKAAILLDTKGPEIRTIKLEGGNDVSLKAGQTFTFTTDKSVVGNNEIVAVTYEGFTSDLSVGNTVLVDDGLIGMEVTAIEGNKVICKVLNNGDLGENKGVNLPGVSIALPALAEKDKQDLIFGCEQGVDFVAASFIRKRSDVVEIREHLKAHGGENIQIISKIENQEGLNNFDEILEASDGIMVARGDLGVEIPVEEVIFAQKMMIEKCIRARKVVITATQMLDSMIKNPRPTRAEAGDVANAILDGTDAVMLSGESAKGKYPLEAVSIMATICERTDRVMNSRLDYNNDSRKLRITEAVCRGAVETAEKLKAPLIVVATQGGKSARAVRKYFPDATILALTTNEVTARQLVLSKGVVSQLVKEINSTDDFYRLGKDVALQSGLAQKGDVVVMVSGALVPSGTTNTASVHVL

SEQ ID NO: 94471 - protein, 359 aa, Chlamydomonas reinhardtii
MLKTAGSALFSSAQAAASMTRGFASKSFEATLFPGDGIGPEIAASVREIFAAARIPVVWDEQHIGKTPDPRTNSMVTRENLDSVLKHKIGLKGPMATPIGKGFRSLNLTLRKELDLYANVRPCFNIPGYKTRYDGINLVTVRENTEGEYSGLEHEVVPGVVESLKIITRKASSRIAEFAFAYARENGRSKVTAVHKANIMKKADGLFLECCREVSAKYGDITYEEVIVDNACMQLVSNPLQFDVLVMPNLYGDIISDLCAGLVGGLGVTPSMNIGTNGLALAEAVHGTAPDIAGKNKANPTALLLSSAMMLRHLGRRQEGDNIQNAVLGVIAEGKYRTADLGGNATTSDFTKAVIDKLE

SEQ ID NO: 94472 - protein, 390 aa, Vibrio vulnificus YJ016
MFSINSIEVVMKKLSKLLISAAIALPLMFTLLAKVGVADTIDKTAPNLASLPVATLAGGCFWCTESDLEKLNGVYDVVSGYSGGEMANPTYRQVSSGKTGHIEVIQFRYDPNVVSYEAVLDYFLRHIDPTDDKGSFVDRGPQYRPAIFYHTAEQKQIAERFLKEVDEAKIYPKPIKTELIEYTAFYPAEQYHQDYYKKSSLKYKYYRHASGRDQYLDKVFGDDRIEQPKTLRQLIDEKALTKNAKTYSRPSDKEIKAQLTDLQYYVTQKEGTERPFNNEYWDNKEAGIYVDIVSGEPLFSSTDKYKSGTGWPSFTKPISSAYIVTKTDYKLLYPRTEVRSKFADSHLGHVFDDGPAPTGLRYCMNSAAMKFVPVAQMEKMGYGEYLTLFQ

SEQ ID NO: 94473 - protein, 267 aa, Bacteroides thetaiotaomicron VPI-5482
MNQYLNFSLKGKVALVTGASYGIGFAIASAYAEQGATVCFNDINQELVDKGMAAYAEKGIKAHGYVCDVTDEPAVQAMVATIEKEVGTIDILVNNAGIIRRVPMHEMEAADFRRVIDIDLNAPFIVSKAVLPAMMKKRAGKIINICSMMSELGRETVSAYAAAKGGLKMLTRNICSEYGEYNIQCNGIGPGYIATPQTAPLREKQADGSRHPFDSFICAKTPAGRWLDPEELTGPAVFLASEASNAVNGHVLYVDGGILAYIGKQPK

SEQ ID NO: 94474 - protein, 272 aa, Thermotoga maritima MSB8
MKKEKVEERIREILRPGWDLLTEEAMLYSATVGGKRIRPLLVLTLGEDLGVEEEKLLDVAVAVELFHTASLIHDDLPPIDNADFRRGKPSCHRTYGEDIALLAGDGLFFLAFSQISKIGNSKIFEEFSETAYKLLLGEAMDVEFERRKMEVSQEMVERMYAFKTGALFAFCFSAPFILKGKDHTKMKLLGEKFGVAFQIYDDLKDILGSFEKVGKDLGKDTEKVTLVKKVGIQKAREMADKYYEEVLKGIESEGLFRTLFLLKELKQMVEER

SEQ ID NO: 94475 - protein, 406 aa, Salmonella enterica subsp. enterica serovar Typhi str. CT18
MTFPVEKVRADFPILQREVNGLPLAYLDSAASAQKPNQVIDAESAFYRHGYAAVHRGIHTLSAQATESMENVRKQASRFINARSAEELVFVRGTTEGINLVANSWGTENIRAGDNIIISEMEHHANIVPWQMLCERKGAELRVIPLHPDGTLRLETLAALFDDRTRLLAITHVSNVLGTENPLPDMIALARQHGAKVLVDGAQAVMHHAVDVQALDCDFYVFSGHKLYGPTGIGILYVKEALLQEMPPWEGGGSMISTVSLTQGTTWAKAPWRFEAGTPNTGGIIGLGAAIDYVTSLGLDKIGDYEQMLMRYALEQLAQVPDITLYGPAQRLGVIAFNLGKHHAYDVGSFLDNYGIAVRTGHHCAMPLMAWYGVPAMCRASLAMYNTHEEVDRLVAGLTRIHRLLG

SEQ ID NO: 94476 - protein, 765 aa, Ostreococcus tauri
MQRLVDLTPGGFVRLIALAIAIYAAVDIRLYAVREYGRIIHEFDPWFNFRATVYLADNGWNKFKTWFDYMSWYPLGRPVGTTIYPGMQITAVALWRALNALGIEMSLNDVCVFFPAWFGAVATFLVAMLTKECSGSGTAAVAAALVMAIVPAHTMRSVAGGYDNESLAVTAMCLTFYTWCRSLRNPESWWIGGLAGLAYTYMVAAWGGYTFVLNMVGLHAAVLVIYKRYSSSLHKAYSLFFIVGTIGALQFPVVGTLPFTSAEQLGPMAVFLGFQVLELTERTMQPDLSKRAKWQRRIRMYALAVVAAVAALTALVVGGLYNINGLSVRVKSLFVKHTKTGNPLVDSVAEHQPGNADSYYRFLHFNYYIAPIGFIFSVVHFVFDGSAGAMFLPLYGLVAYYFANRMVRLIIFLGPVAACLVGVCVGYAVEDAIRIMKTSDETTEEPEKEKEVPLSAKKRAKQANKKKTENLTVMIKKELDMAYRSPVARTVRLVFIALGAVYIISKAPTFYTYSHAMAQGMSQPSIMFKGQLQDGTSVMVKDYVEAYDWLRTQTPEDARVMPGGTMVIKSLASAIARPSPMATRGTTNTSPTWRACSPPRKRRRTRLFDTWLTTCSFGLAVEVTTWPRVRTCSASAPRSAVVAPQLSRWKRSPARSASIVTVNRRRRWQRLLSPERFQEVYTSKYRKVRIYKVVNVDEESKAWIADPANRMCDNADGSGFCPGAYPPALRKYPSIIKPAYKIPAWIKEKRATEKSERKAAQKDEL

SEQ ID NO: 94477 - protein, 687 aa, Arabidopsis thaliana
MWIENLCYCCKICDFYVDLFCVKYPPPDVIDISETHHHKLTHIKKWTKFNCIAKCGKKFYGFPYKCLECHLMFDMDCVWNPPEAKNQSEVNISSHPLHPLKLHTSQPPDYSDEKCRLCTRKIEGLFYHCSSCNFSLDMRCVINPPPQFVMDLKVHDHELTLLPRLDSFTCNACGLKGDRSPYICVQCGFIIHQDCLSLPRLININRHAHRVSRTSVLGVVNSVCGVCHQKVDWTWGGYSCQRCPQYVVHSKCATRKDVWNGKELEGVPEEIEDIEPYVVIDDNTIQHFSHKEHYLRFHVNGLLWEENKRCSACTHPVRLQSFYACKDCDFILHQHCAESPKKEWHVLHNDRLTLVTCVANFFSCTACSRLSNGFMYQCDFMKLDVLCGLVSEPYIHPGHPHHPLYYIPQVEEKQCNGCNNREVRVLTCIESGCGYVLCFDCATLPQVVKHRVDGHPLSLCYGEEASGKYWCDICEKETYPKTWFYTCKDHRASLHTKILKHEKLFKACLVVVVKIALFFFLLLSFSQASFLQLKTLLAHVMAVPIQQRLTVTLLSLLHLPPTSSFPGPGQFSLLLPPLDPFPKTLPFKRFKIWVLLCDITCKDHRASLHTNCVLGRFAGLMPKSAISLSSRSYEVVLNYMELKRFGKNIRNEGTLLAKFQHRNLVRLLGFCLEGRRADICLEVSPEQ

SEQ ID NO: 94478 - protein, 145 aa, Brassica napus
RTRGPDWQQISNSTGLFLQKTNSIKDYLEGINEIPKPALVWASEIWGKDVDKLEGLKNEEKSTKAGQCLNEMVTNALIHVEDCLKSMAGLRDPAIFKSCAIPQIVAMGTLALCYNNVQVFRGAVKLMRGLIAKVIDRTKTMDDVY

SEQ ID NO: 94479 - protein, 449 aa, Geobacillus kaustophilus HTA426
MTHIRFDYSKALAFFGEHELTYLRDAVKVAHHSLHEKTGVGSDFLGWLDWPVDYDKEEFARIKEAAKKIQSDSDVLVVIGIGGSYLGARAAIEMLHHSFYNALPKEKRKTPQIIFVGNNISSTYMKDVIDFLEGKDFSINVISKSGTTTEPAIAFRIFRKLLEEKYGKEEARRRIYATTDSKRGALRTLANEEGYETFVIPDDIGGRYSVLTAVGLLPIAASGADINAMMEGAAKARDDFSSSELEENAAYQYAAIRNILYNKGKTIELLVNYEPALHYFAEWWKQLFGESEGKDQKGIYPASADFSTDLHSLGQYIQEGRRDLFETVLKLEEPRHELIIEAEENDLDGLNYLAGKTVDFVNTKAFEGTLLAHTDGGVPNLVITLPKLDEYTFGYLVYFFEKACAMSGYLLGVNPFDQPGVEAYKKNMFALLGKPGYEQLKEELEKRLK

SEQ ID NO: 94480 - protein, 208 aa, Xylella fastidiosa Dixon
MDDVTKALNLVPMVVEQTSRGERAYDIYSRLLKERLIFLVGPIDDYMANLIVAQLLFLEAENPEKDINIYINSPGGVVTAGMAIYDTMQYIKPAVSTICVGQAASMGALLLASGASGKRYALPNSRVMIHQPLGGFQGQATDVDIHAREILALRARLNEILAKHTGQSLETIAHDTERDNFKSAVDAQAYGLVDQVFGQRQEELIQSS

SEQ ID NO: 94481 - protein, 160 aa, Thermotoga sp. RQ2
MFIGFGYDRHPLVEGRRLILAGVEIDSPVGSLGHSDGDVLSHAIIDALLGAVGLGDIGTWFPETEEYRGAISLELLKKTMGMIEERGFKVINVDSTVVLSGVRMSAYRDRIVENLKSVLKTPHVNVKFKSGNTLGFEGEGRGISAYAVCLLEEKECTKST

SEQ ID NO: 94482 - protein, 536 aa, Magnaporthe grisea 70-15
MASNPDPGVLSPQEAIHASTQATSTVAASTVAASTQAPSPDLPISQPQPQPQQPSPPLPTSPSQLEQAHAFAEPEVPPPLLPTPKSATFARSTQGGSSRRRRRSRSRNRAGTATSANNPYFPGDQASTRRLRYSIDEYEDEGLRNEIGRHPDGRSMPRARPPRAYLNHPAYANLDSPAKPYTEDPKGHREFDYEVDPNTRQQYEEEYAYGTGVSHGPGMAGPQPFMRFGPTSNASHYGPDSQAPRINWKDLSREERTEVLRLPWTQWMNSNVKNHFVAMLGELIGTTMFLFFAFAGVEVANIGLPSSAPFNLAKQLYISLSFGFSLMVNVWIFFRISGAQFNPAVTLALWMTGAVDAVRGVCLVISQLCGGMLASVIVRFLFPQRFSVRTSLSQNTSLVQGVFIEALLTSELVFTILMLAKEKHKATYMAPVGIGLALWIDHMVGVPFTGAGINPARSFGPCVVTATFEPEHWIYWVGPGIGALIAVAFYKLIKVLEYEMANPGADGDADNDPTQNPAKRAELAAGRRFAGGFDAK

SEQ ID NO: 94483 - protein, 291 aa, Magnaporthe grisea 70-15
MAIIENWIPPTRENWETLLFVWKFFPILPSVQWLTPWYPMGKTSYPSIFNVPGRLAWFLMEIPGVSILLYNMSTLPAKHGIDDLPWQNKVLAGLFAIHYSYRAVMYPLMAPSMAPMNIVVASSAVFFQVMNGTCLGAWLAAYGPTTQEEWRAQLGAGGTLQFVVGISIFYLGLAANYYHDDELREIRRREERRRERVARDEGVRPETVERHYAIPQAGFFKFVLYPHYFLEWCEWFGYWMACGWSCTPAFLFLFNEFVSMLPRAVNGRKWYEERFGPEKIKGRKAVIPGLL

SEQ ID NO: 94484 - protein, 179 aa, Gluconobacter oxydans 621H
MSFQDPQPLDLKNYIREIPDFPKRGILFYDISTLIRSPDAWQVATARLARVIAAWQPDILAGIESRGFLTAAPLALRLGCGFTMLRKPGKLPGKTISLKYGLEYGEDELHIQADAIKPGQRVVVLDDLLATGGTLAASIDLLRKVGAEVVGASVLIELADLKGREKLDVPLNALMTYDE

SEQ ID NO: 94485 - protein, 212 aa, Pseudomonas putida
MSLKLGDIAPDFEQDSSEGKIRFHEWLGNSWGVLFSHPADFTPVCTTELGLTAKLKDDFAKRGVKPIALSVDPVDSHHRWIEDINETQNTVVNFPIIADADRKVSELYDLIHPNANDTLTVRSLFVIDPNKKVRLTITYPASTGRNFNEILRVIDSLQLTDNHKVATPGNWQDGDDVVIVPSLKDEEEIKQRFPKGYRAVKPYLRLTPQLNR

SEQ ID NO: 94486 - protein, 482 aa, Staphylococcus aureus subsp. aureus MRSA252
MGSFFNKIARKEDPAIYQNKDGHLKRTLRVRDFLALGVGTIVSTSIFTLPGIVAAEHAGPAVALSFLLAAIVAGLVAFTYAEMAAAMPFAGSAYSWVNVLFGEFFGWVAGWALLAEYFIAVAFVASGFSANLRGLVKPIGIELPAALSNPFGTNGGFIDIIAAIVILLTALLLSRGMSEAARMENILVILKVLAIILFVIVGLTAINVSNYVPFIPEHKVTATGDFGGWQGIYAGVSMIFLAYIGFDSIAANSAEALDPQKTMPRGILGSLSIAIVLFIAVALVLVGMFHYSQYANNAEPVGWALRQSGHGVVAAIVQAISVIGMFTALIGMMLAGSRLLYSFGRDGLLPSWLSHLNDKHLPNRALVILTIIGVLIGSMFPFAFLAQLISAGTLVAFMFVSLAMYRLRKREGKDLPIPAFKLPLYPVLPAVTFVLVLLVFWGLGFEAKLYTLIWFIVGIILYLSYGLRHSKKNDVAEYHPPK

SEQ ID NO: 94487 - protein, 344 aa, Oceanobacillus iheyensis HTE831
MEKVAVLGAGSWGTALAIVLADNGHEVRLWSHRKEHAETINETHRNHKYLDVDIPNEITAYSDMHQTVSGVDAVVIVVPTKAIREVCSELNKWMDSKTTVIHATKGIEPVSLKRVSEMIEEEMDIKYEDIVVLSGPSHAEEVALRHPTTVTTSSINLEKAKHAQDLFSSDSFRVYTSDDILGIELGGALKNIIALGAGISDGLGFGDNAKAALITRGLAEIARLGTSLGANPLSFLGLSGVGDLIVTCTSVHSRNWRAGNLLGKGNQLEDVLEQMGMVVEGVRTVKAAHQFAKDQNVDMPITSGIFQILFENKNPKDVVEQLMNRGKRDEMDDLAVLLKERYSE

SEQ ID NO: 94488 - protein, 358 aa, Populus trichocarpa
MGSFIESHIGQVDEAKDENFGYAMQLALSSVLPMTMYSAIQLGIFEIIAKAGPDAKLSASDVAAQLPTKNPDAPMMLDRILRLLASHDVLGCSVDGSERLYSLAPVSKHYVRNKDGVSLGPFMALIQDNVFLQSWSQLKDAVLEGGVAFDRVHGAHAFEYPGLDPRFNQVFNTAMYNQTTVVLENMLEAYTGFKNLKQLVEIGGGMGHTIKAIISKYPQIKGINFDLPHVIEHAPSCPGVEHVGGDMFESVPKGDAIFLKWILHDWSDDHCLKLLKNCYKAIPDNGKVIVMESVLSITAKTSPAARAISQLDVLMMTQNPGGKERTEHEFMALATGAGFRGIKYEAFVCNFWVMEFFK

SEQ ID NO: 94489 - protein, 365 aa, Triticum aestivum
  misc_feature (189)..(189): Xaa can be any naturally occurring amino acid
MGGAGGAKAYGAVVLIRVMYSGMHIMSKIALDQGMNPFVFVFYRHTTAALVLIPIAFALERQKTKPVTLKIAGKMFVHALYGVTACGVLFNLGLNYASATSSSALYNVQPVVTFILAVIIGMESMKLKKLHGNLKVAGILCCVAGVTVLAFYEGPMFRSFNHHRLFQHGSSSSSSGAGTYSKNQWVFGXIFLMTLSNILAGLWTVLQGPLIEDTSKLMNTTLQISCASVQAFVVAVAAERDFSKWKIGWNISLAAIIYSGVIVTALSYYMQMWTIAKRGPVFLAMSMPLTLIFTIIISSFVLGEAVSLGSIIAGILLIGGLYNVLWGKSMERKDDDTNKMGGGKPGQEVQDKEQARVPDDAAAKV

SEQ ID NO: 94490 - protein, 310 aa, Mannheimia succiniciproducens MBEL55E
MHMTNKIWVLGDAVVDLIPDGDNHYLRCAGGAPANVAVGVARLGVPSAFIGRVGKDPLGEFMRDTLNQENVNTDYMLLDPKQRTSTVVVGLTDGERSFTFMVNPSADQFLQISDLPQFQAGDWLHCCSIALINEPTRSATFTAMKNIRAAGGKVSFDPNLRESLWKSQDEMIDVVMEAVSLADVLKFSEEELTLLTHTDSLEKSFEKITALYPDKLIIVTLGKEGALYHLHGKKEVVAGKALKPVDTTGAGDAFVSGLLAGLSQTENWQQPEQLVTIIRQANASGALATTAKGAMSALPNQQQLAEFLAN

SEQ ID NO: 94491 - protein, 336 aa, Shewanella sp. MR-4
MSKRTITVIPGDGIGPSIIDSALKILDKAGCDFEYEFADAGLTALEKQGELLPQRTLELIEKNRITLKGPLTTPVGEGFTSINVTLRKKFGLYANVRPVLSFKGTQARYENIDIITVRENTEGMYSGHGQKVSEDGTTAEATSIVTRQGAEQIATFAYELARKENRKKVTIVHKANIMKSTSGLFLKVAREVSQRYPDIKTEEMIVDATCMKLVMNPENFDVIVTTNLFGDILSDLCAGLVGGLGMAPGANIGRDAAIFEAVHGSAPDIAGKNLANPTSVILASIQMLEYLGMADKADMIRKAVSAVIEEGDRTTRDLGGTHGTTDFTQAVLDRLS

SEQ ID NO: 94492 - protein, 294 aa, Triticum aestivum
  misc_feature (141)..(141): Xaa can be any naturally occurring amino acid
MGGLSLQHPWAFAFGLLGNVISFMTYLAPLPTFYRIYRSKSTQGFQSVPYVVALFSAMLWIYYALLKSDELLLITINTAGCVIETIYIVMYLTYAPKQAKMFTAKILLLLNVGMFGLILLLTLLLAEGEKRVVMLGWSALXFSVSVFVAPLSVIRLVVRTRSVEFMPFSLSLSLTVSAVVWFLYGLLIKDKYVALPNILGFAFGVIQMGLYALYRNAMPTPVPKQVDDVDAIKVPEHVVNIAKPSPTAAIELNTHNPIEPGMPPPTKDNSLACTRVVTKGEVDKVEKATLVEQV

SEQ ID NO: 94493 - protein, 857 aa, Oryza sativa
  misc_feature (299)..(299): Xaa can be any naturally occurring amino acid
MAARGGRRRRPWWWSSSCRCSPLLQLALIISSCLLLWPHQGVALAPSRAAATDTLAVGRPLSGGRRLVSKGGRFAVGFFQPDNALQRWYMGIWYHKTREHTKLWVANRQAPLTDPESSQLSISSDGNMVLLDRATRSPVWSTNITGIAAAANSTVGVILNTGNLVLADASNTSAVLWQSFDHLDNTWLPGSKLRRNKLTGEATRLVAWKGSNDPTPGMFSLELDAGGGGASQHLRLAWNGSHQYWRGGGGNWTTAPEESGPEGQSPYTFLYVDAENESYVVFEVKDEALLSRIVVGVAXGQIMLWGWVESAATWVLFWSEPTLCDVYSLCGSFSVCTDGSVPECGCLQGFVERQPRQWLYGDQTAGCARITGLQMPCGGGGQASGKTTKRDDTFFTMPKANSLPTGGVAAPSATASAHDDCELACLGNCSCTAYSYNGSCTLWYGDLINLRGANGSGTDGYRISIRLGVASDLSGTGNTKKMTIGLVVAGVVAAAVTLAVLVAVLVMRSRRAKALRRLEDSSSFLTVFTYRDLQLVTNNFSDKIGGGAFGSVFKGALPGDATPVAVKKLEGVGQGEKQFRAEVSTIGMIQHVNLIRLLGFCTDRTRRLLVYEHMPNGSLDRHLFGSGSGHGGGVLSWKTRYQIALGVARGLHYLHDKCRDRIIHCDVKPENILLDGAFAAKVADLGLAKLMGRDDSSRVLTTTRGTVGYLAPEWIAGTAVTAKADVYSYGMMLFEIVSGRRNVEQRRRQAEAADDDEYDSGAGGTVEADFFPLTAVRMLFDGDGDLRDAVDGNLGGEVDMGEVERACKVACWCVQDAESARPTMGMVVKALEGLVDVNFPPMPRLFMVGLSTGSSHT

SEQ ID NO: 94494 - protein, 390 aa, Geobacillus kaustophilus HTA426
MKPQTRKTYVSKTVAGLKPSGIRRFFDLASSMDGVISLGVGEPDFVTSWSIREASILSLEQGYTSYTANAGLLELRQEIAAYLRRKFHVDYCPETEILVTVGASQAIDLALRAIINPGDEVIIVEPSFVAYEPLVVLAGGKPVAVHTSGEDKFQLNPVHLERAITERTKAVIICSPNNPTGTVQSRTELEAIARLAEAHDLLVIADEIYAELTYEGEYTSMAAVSGMRERTILISGFSKGFAMTGWRLGFAAAPDEILQAMLKIHQYAMMCAPTMAQYGALEALRSGERDVAEMRNSYRRRRNYFVASLNEIGLPCHLPGGAFYAFPSIKPTGLTSEQFAERLLIEEKVAVVPGNVFGQSGEGYIRCSYASSLEQLQEAIKRMKRFLARL

SEQ ID NO: 94495 - protein, 503 aa, Ostreococcus tauri
MKRASSRLSRSLTAIARAPSARELAQRVELSVARASVASPSTRRSSATTLAWTRKAFFARSWSSDALPEHVIVPMPALSPTMTRGGIASWHVEVGQAIRAGDAIADVETDKATMAMEATEDGFMAAILVEAGAQDIEVGTPVCVTCENAEDVEAFKDYASTVAIKAESAAPVASAPSGPVESPSVAPVASAPSARATRAETRASGDRVFASPLAKRLAKERGVRLDNVRGTGPNGRVIAADVYEAHETGVNATEAAREVTVDHPLSKFFPDFEDVSVTAIKRVTAQRLTESKQQVPHFYLTVDVRLDNMISIRQTLNKQLADDKAAEGAKISVNDFIVKASAKALLAVPEVNSSWLGDKIRRYKKADISVAVQTERGLMVPIVRSACCLGLKTISSEVKALASRAREGSLTPQDMTGGTFTISNLGMFGVKSFAAIVNPPQAAILAVGGARKEVIKNESGGYEEITVMSATLSCDHRVVDGAVGAMWLQSFKGYIEDPMTMLL

SEQ ID NO: 94496 - protein, 792 aa, Salmonella enterica subsp. enterica serovar Typhi str. CT18
MSNNGSSPLVLWYNQLGMNDVDRVGGKNASLGEMITNLSGMGVSVPNGFATTADAFNQFLDQSGVNQRIYELLDKTDIDDVSQLAKAGAQIRQWIIDTPFQPALENAIRDAYAQLSSDDENASFAVRSSATAEDMPDASFAGQQETFLNVQGFDAVLVAVKHVFASLFNDRAISYRVHQGYDHRGVALSAGVQRMVRSDLASSGVMFSIDTESGFDQVVFITSAWGLGEMVVQGAVNPDEFYVHKPTLAAGRPAIVRRTMGSKKIRMVYAATQEHGKQVKIEDVPQEQRDIFSLTNEEVQELAKQAVQIEQHYGRPMDIEWAKDGHTGKLFIVQARPETVRSRGQVMERYTLHAQGKIIAEGRAIGHRIGAGTVKVIHDIGEMNRIEPGDVLVTDMTDPDWEPIMKKAAAIVTNRGGRTCHAAIIARELGIPAVVGCGDATERMKDGEKVTVSCAEGDTGYVYADMLDFSVKSSSVDTMPELPLKVMMNVGNPDRAFDFACLPNEGVGLARLEFIINRMIGVHPRALLEFDDQDAALQNDIREMMKGFDSPREFYVGRLTEGIATLGAAFYPKRIIVRLSDFKSNEYANLVGGERYEPHEENPMLGFRGAGRYVAESFRDCFALECEAVKRVRNDMGLTNVEIMIPFVRTVDQAKAVIEELARQGLKRGENGLKIIMMCEIPSNALLAEQFLEYFDGFSIGSNDMTQLALGLDRDSGVVSELFDERNDAVKALLSMAIRAAKKQGKYVGICGQGPSDHEDFAAWLMEEGIDSLSLNPDTVVQTWLSLAELKK

SEQ ID NO: 94497 - protein, 726 aa, Thermotoga maritima MSB8
MYVAALFFLIPLVALGFAAANFAAVVRKPEGTERMKEISSYIRSGADSFLAHETKAIFKVAIVIAILLMIFTTWQTGVAFLLGAVMSASAGIVGMKMATRANVRVAEAARTTKKIGPALKVAYQGGSVMGLSVGGFALLGLVLVYLIFGKWMGQVDNLNIYTNWLGINFVPFAMTVSGYALGCSIIAMFDRVGGGVYTKAADMAADLVGKTELNLPEDDPRNPATIADNVGDNVGDVAGLGADLLESFVGAIVSSIILASYMFPIYVQKIGENLVHQVPKETIQALISYPIFFALVGLGCSMLGILYVIVKKPSDNPQRELNISLWTSALLTVVLTAFLTYFYLKDLQGLDVVGFRFGAISPWFSAIIGIFSGILIGFWAEYYTSYRYKPTQFLSKSSIEGTGMVISNGLSLGMKSVFPPTLTLVLGILFADYFAGLYGVAIAALGMLSFVATSVSVDSYGPIADNAGGISEMCELDPEVRKITDHLDAVGNTTAAIGKGFAIGSAIFAALSLFASYMFSQISPSDIGKPPSLVLLLNMLDARVIAGALLGAAITYYFSGYLISAVTKAAMKMVDEIRRQAREIPGLLEGKAKPDYNRCIEITSDNALKQMGYPAFIAILTPLVTGFLLGAEFVGGVLIGTVLSGAMLAILTANSGGAWDNAKKYLEAGNLEGYGKGSEPHKALVIGDTVGDPLKDTVGPSLDILIKIMSVVSVIAVSIFKHVHLF

SEQ ID NO: 94498 - protein, 459 aa, Vibrio vulnificus YJ016
MTQNIKPTHFRSEGDVNTTPARQAWNASMDDERTQALLKRDSEVFLHQAMSTPCLDTLEAAEGIYIQDATGKKYMDFHGNNVHQLGYGHPHVIKRVQEQIAKLPFSPRRFTNETAIECAEKLTQICGGELNRVLFAPGGTSAVGMALKLARHVTGNYKVVSLWDSFHGASLDAISVGGEACFRQGMGPLMAGVERIPPAVSYRGAFPIADGSDVHYADYLEYVIEKEGGVGAFIAEAVRNTDVQVPSKAYWKRIREICDKHNVMLIIDDIPNGMGRSGEWFTYQAYDIEPDMLCIGKGLGGGLVPIAAMVTKDKYNTAEQISMGHYTHEKSPIGCAAALATMEAIEQDGLLDKVKVDSQFMREKLLEMKAKYPVIGDVRGIGMLWGIELVTDHESKARAYDEAEAVLYQCLNNGVSFKVSQGNVIQLSPPLIITREQLTEALAIFEEAIAKVCKDFNYF

SEQ ID NO: 94499 - protein, 969 aa, Ostreococcus tauri
MKTTAVLNAKVPFAVAASLVIATAGCATAALGWHARETALALASARVSATSVDLGPATRRIRVLEEQVEALQRNREDGRKSAERVVREALLDAQVKALGTQKGSKVAGLFKRDADTPALKKDLKAIETTLASLTKSQGAFATSAQLKELVDAVDALRKSSSGYASSDVVETLKVSVTELTNKTKSGSMKEVAALRKALEELASTQKSVDARATSEVKSLRDDITSLKTNIQETYASKSALQTLDVSSELKSLEAAIAGLSKDRDSYATATQLKLLDAQVKALGTQKGSKVAGLFKRDADTATLKKDLKAIETTLASLTKSQGAFATSAQLKELVDAVDALRKSSSGYASSDVVETLKVSVTELTNKTKSGSMKEVAALRKALEELASTQKSVDARATSEVKSLRDDITSLKTNIQETYASKSALQTLDVSSELKSLEAAIAGLSKDRDSYATATQLKLLDAQVKALGTQKGSKVAGLFKRDADTATLKKDLKAIETTLVSLTKSQGAFATSAQLKELVDAVDALRKSSSGYASSDVVETLKVSVTELTNKTKSGSMKEVAALRKALEELASTQKSVDARATSEVKSLRDDITSLKTNIQETYASKSALQTLDVSSELKSLEAAIAGLSKDRDSYATATQLKLLDAQVKALGTQKGSKVAGLFKRDADTATLKKDLKAIETTLVSLTKSQGAFATSAQLKELVDAVDALRKSSSGYASSDVVETLKVSVTELTDKTKSGSGSASKNLRDLEQQVMERIEGYINAIPKDTSMKLKKHIEKAATLWFADRTGRQDFALSTGGGRVVGHSQLTPFVARGDGPLMSAVSFLRSGVHPKSDEWMLTPSMEQPGDCLALHGSYGYVDVRLRQPVKVDAVTLEHTNSLNAYDMHSAPRDIQIFGWYAHGNNCKHSKPPKSLIAMGNYTYHTAGDSVQSFEVSAPHTVDHVRLIVKNNHGHARWTCIYRFRVHGIPSS

SEQ ID NO: 94500 - protein, 480 aa, Salmonella enterica subsp. enterica serovar Typhi str. CT18
MTLSFTARWRDELPATYTALLPTPLKNARLIWYNDELAQQLAIPASLFDATNGAGVWGGETLLPGMSPVAQVYSGHQFGIWAGQLGDGRGILLGEQLLADGSTLDWHLKGAGLTPYSRMGDGRAVLRSTIRESLASEAMHYLGIPTTRALSIVASDTPVQRETQETGAMLMRLAQSHMRFGHFEHFYYRREPEKVQQLADFAIRHYWPQWQDVAEKYALWFEEVAARTGRLIAEWQTVGFSHGVMNTDNMSILGLTIDYGPFGFLDDYDPGFIGNHSDHQGRYRFDNQPSVALWNLQRLAQTLTPFIEIDALNRALDRYQDALLTHYGQRMRQKLGFFTEQKDDNALLNELFSLMAREGSDYTRTFRMLSHTEQQSASSPLRDTFIDRAAFDAWFDRYRARLRTEAVDDALRQQQMQRVNPAIVLRNWLAQRAIDAAEQGDMAELHRLHEVLRQPFTDRDDDYASRPPEWGKRLEVSCSS

SEQ ID NO: 94501 - protein, 393 aa, Oryza sativa
  misc_feature (364)..(364): Xaa can be any naturally occurring amino acid
MHQPAIMQRALAVVALLAAAAAIAAAQGESPELLPFAVGAAPEGCDVGEGEWVFDEAARPWYAEEECPYIQPDLTCQAHGRPDAAYQRWRWQPRDCSLPSFNATGMLEMLRGKRMLFVGDSLLRGQYTSLLCLLHRGAPGGGGGSRSFETVDSLSIFRAKDYDATIEFYWAPMLAESNSDGAAVPDDRLIRGAPMNKHSSFWKGADVLVFNSYLWWMTGDKIQILRGADEDMSKDIVEMEAAEAYRLVLHQVTRWLEGNVDPKSARVFFVTASPSHAGAGGECYDQTTPVGAADAASYCGSTSRRMVQVAGEVLGASRVPVGVVNVTRMSELRRDAHTQVYREQRWAKPTAEQLAADPRSYADXTHWCLPGVPDAWNELLYWKLFFPARDEAI

SEQ ID NO: 94502 - protein, 332 aa, Chlamydomonas reinhardtii
MLAAVQAGQVVTFLKGLGLKDDMLAARVLCVWPELLGRDVDAQLRPVVTFLMSLGLEVAGVGRAVVLWPEILLKDVEGQLAPWVAYLRGLGCTTAQVAEVVCLCPHLLGFKPEEVFGGVLAALSDVGISAADVRDMVSASLAFLITPSASAAVRAAVDCLQQQGFTKEQIRAMALTRPELLAVKPHDLDRSLRFVRETIGGDNGTVLSCPLLLAKPLGQVLGPRYSFIQKQGLAHKYTKRDVVAGGADRTDGASGSGSDGSASSSGNSTGGFEFYKLLMAEDDAWCASLGLSVNEYQGFKLVWDEEYSLQLHQEAASEFQAELKKLGIYEGI

SEQ ID NO: 94503 - protein, 164 aa, Xylella fastidiosa Dixon
MHLIAHLDTVRGPIKINLFADKTPLTVANFVNLAKRGFYDGLNFHRVIANFMIQGGCPEGSGRGGPGYRFEDETNNGMCHERGSLSMANAGPNTNGSQFFITHVATPWLDGKHTVFGKVLDGQDVVDAIAQGDIINKITIEGDADGVLALKTDRIIEWNSILAT

SEQ ID NO: 94504 - protein, 327 aa, Sulfitobacter sp. EE-36
MANILVTGGAGYIGSHACKALAAAGHTPVTFDNLVTGWRDAVKFGPFVQGDLLNRAEIDAAFEQYQPVAVMHFAALSQVGDSMKQPGTYWRNNVEGSLNLIEATVAAGCKHFVFSSTCATYGDQDNVVLDENSAQHPINAYGASKRAIEDILRDFEAAYGLQSVIFRYFNVAGADPEGEVGEFHQPETHLIPLMLDAIDGKRDALTIFGTDYDTPDGTCIRDYVHVCDLVDAHVLGLNWLREDKGSRVFNLGTGTGFSVREVVEHSREVTNRVVPMTEGDRRPGDCTKLVSGSVRAETELGWRPSRSTLQQMITDAWRWHQTGHYSA

SEQ ID NO: 94505 - protein, 287 aa, Physcomitrella patens subsp. patens
MGATTIGMMDAAYFVGRNEILSWVNSTLELSLCKVEEAASGAVYCQLMDVVHPGMVSMHKVSFDAKSEYEMIQNYKVLQDVFNKLKIGRHIEVSKLVKGRPLDNLEFLQWMKRYCDQINNNHVNPTYNAAERRETCKGGKEMNRRALGTSSSSNNSQVSAKSASTVGAKANGGGARRVTENTNPNVNGGGRGGGDHVKQITELKLSVESLEKERDFYFTKLRDIEILCQAPELSYIPVVKAVQRILYAAEDDPSVIAEAKAMVEGESSLGILSPGSQYLDDNQDLLG

SEQ ID NO: 94506 - protein, 104 aa, Oryza sativa
  misc_feature (54)..(54): Xaa can be any naturally occurring amino acid
MEDLSVEELASNLSTYKEQLREVRKIIKEKNDDPGISEYLDMEKELQEEPCPTXVITLTEELLATANQSGNTQNDVGLSPPNYSSGLQSEALDDPSQSHEKFAV

SEQ ID NO: 94507 - protein, 427 aa, Methanosarcina barkeri str. Fusaro
MEKNSENNLEKDSGQGLEKHQEKSGDEHTSLYQESLAVHRRFGGVLEVASKVSLQTIHDLSVAYTPGVAEPCRKIIKDPELVYLYTMKRNTIAVVTDGSAVLGLGNIGPYAALPVMEGKAIIFKEFAGIDAFPICLDTQETEEVIKAVKHLAPAFGGINLEDISAPRCFEIEGRLREELDVPVMHDDQHGTAIVVFAGLLNALKIVNKKLNELHIVISGMGAAGVAIFRFLVRAGANPARILVCDSKGLVYEGRKNGMNPVKEEVARLTNPEKLKGGLENAFPDADLFIGVSVGGIVNEEMVRSMAKDAIVMAMANPLPEIMPDAAKRAGARVVATGRSDFPNQLNNCLSFPGVFKGALSTCARKITPEMEMAASHALAEVVTLNELSEDRIIPDPLDRRVVPAVAKAVASASLESCVARKSHEDMA

SEQ ID NO: 94508 - protein, 265 aa, Sulfitobacter sp. EE-36
MDYEQLVTVMRRLSIEAGDKIMEIYGADDFEVKTKSDESPVTIADEAADKIISDGLRAAFPDVMLVTEEQSATHSASGDTFLIVDPLDGTKEFINRRGDFTVNIALVEGGVPMRGVVYAPARSRMFFTLADGSAVEETGDFPKDSMGPVQPISVSTPDNAALMVVASKSHRDQATDDYIAKYNVRDMKSAGSSLKFCLIATGEADLYPRVGRTMEWDTAAGHAVLTGAGGAVVRFDDLTPLTYGKADFANPFFIAHAPGVDLKAS

SEQ ID NO: 94509 - protein, 385 aa, Streptococcus pyogenes M49 591
MKITVVGIGYVGLSIGLLLAKEHDVTFFDIDNKKIDLINKRQSPLKEAAINKLLCKAKNINATSSEELAYKDATFIILSLPTNLKVNKLDTSIIEISVSNILKINKKATIVIKSTVPIGFTEYLRNRFHYNDIIFSPEFLREGSTIHDQLYPSRTIVGNESRNSQLFLDILTDISVEKDSPSLLVGSSEAEAIKLFSNAYLAQKIAFFNELDTFAEMQNLDSKKIIEAMGYDQRIGNSHNNPSFGFGGYCLPKDIKQLEYHFKEIPAPIITSISESNLLRKIHIAKMILNSSAKTIGIYRINSKKDSDNCRESSTIDVAKLLKSSGKDVIIFEPLINQKKFLGCPLINDFNEFIKYSDIIVANRIDDALRKCNSKVFTRDIFQYD

SEQ ID NO: 94510 - protein, 428 aa, Pseudomonas fluorescens PfO-1
MAFLALGINHKTASVDVRERVAFTPEQLVEALQQLCRLTDSREAAILSTCNRSELYIEQDQLSADIVLRWLADYHHLSLDELRASAYVHEDDAAVRHMMRVASGLDSLVLGEPQILGQMKSAYAVAREAGTIGPLLGRLFQATFNAAKQVRTDTAIGENPVSVAFAAVSLAKQIFSDLQRSQALLIGAGETITLVARHLHELGVKRIVVANRTLERASLLAEQFGAHAVLLSDIPAELVRSDIVISSTASQLPILGKGAVESALKLRKHKPIFMVDIAVPRDIEPEVGELDDVYLYSVDDLHEVVAENLKSRQGAAQAAEEMVSVGADDFMVRLRELAAVDVLKAYRQQSERLRDEELQKALRLLANGGNAEDVLGQLARGLTNKLLHAPSVQLKKLSAEGRLDALAMAQELFALEGSPDSFSDKKPQ

SEQ ID NO: 94511 - protein, 99 aa, Prochlorococcus marinus str. MIT 9215
MASYNVTLISEGEGLNSTIEVPDDQYILDAAEEQGIDLPYSCRAGACSTCAGKVTSGSVDQSDQSFLDDDQLEAGFVLTCVAYPTSDVTITTHAEEELY

SEQ ID NO: 94512 - protein, 385 aa, Sulfitobacter sp. EE-36
MAKRDYYETLGVAKGASADEIKKGYRTKAKELHPDRNADNPNAEAQFKEANEAYEVLKDPEKKAAYDRYGHAAFEGGMGGGGGHRGGGFGGGGQGDFSSAFSDVFDDLFGDFMGGQRGGGGRRAARGADLRYNLGITLEDAYRGMQKSINVPTSVACDSCNGSGSEGGAEPTTCPTCSGMGKVRAQQGFFTVERTCPTCSGMGQIVKNPCKSCRGAGRVEKDRALSVNIPAGVETGTRIRLAGEGEAGMRGGPSGDLYIFIEVQDHKLFERDGPNLFCRVPVSMSTAALGGSIEVPTIDGGRGRVQIPAGSQSGRQMRLRGKGMPPLRGGGTGDMIIELAVETPVNLTSRQKELLQEFEKESSNNNPESSSFFSSVKSFWDSMKG

SEQ ID NO: 94513 - protein, 514 aa, Physcomitrella patens subsp. patens
MVAASALPSSQGVAETAALGAPAVSLEKVVADSSELVASDGSGSVLKNGIEGIRDMARRQRTGSSPTTFSAKFVPFSPGQETDEEYSLDEVIYRSKTGMLLDVQHDMEALKRAGDGNYWKNLFDSRVGKTTWPYGSGVWSKKEWVLPEIDDDDIVSLFEGNSNLFWAERFGKEQVLDMTDLWVKHCGISHTGSFKDLGMTVLVSQVNRLRRLGKPLLGVGCASTGDTSAALSAYCAATGIPALVFLPANKISIAQLVQPIANGALVLSMDTDFDGCMRLIRQVTSELPIYLANSLNSLRLEGQKTAAIEILQQFDWEVPDWVIVPGGNLGNIYAFYKGFYMCKELGLVDRMPRLVCAQAANANPLYRAFKNGWETFQPIKALPTFASAIQIGDPVSIDRAIYALSQADGIVEEATEQEIMDACAQADKSGMFTCPHTGVALVALQKLRQRGVIGRNDRTVVVSTAHGLKFTQSKVEYHSSGLPAITSQFANPPISVADDLDSIMDVLRQKLSLK

SEQ ID NO: 94514 - protein, 323 aa, Oceanobacillus iheyensis HTE831
MTKKILLLATGGTIASEKKPNSDRLESGVLTGEELLKQCDIPSGIEVEVHSIFQKASIHLTFQDLLVLKSKIDELLLNSSFDGIVITQGTDTLEESSYFMNLITDYHIPIVFTGSQRSPLEVGTDSFINIKNAVLTACSEELNEVGVTVVFNERIFHSRYVRKEHASNIQGFNAFGYGYLGIIDNNQVRVFQKPTYKDYYKLQKKLPEVDIIKVYMNTDGKYIKAARDNQVDGIVIEGVGRGQVSPTMMQEIKQCIEEGIAVVITTSAVEGEVYPTYDYQGSTYDLLQNGVILGKDYDSKKARIKLMVGLASEIPLQTLFHPF

SEQ ID NO: 94515 - protein, 310 aa, Pseudomonas fluorescens PfO-1
MMVFTGNANPDLARRVVRQLHIPLGDISVGKFSDGEITAEINENVRGKDVFIIQPTCAPTNDNLMELVVMADAFRRSSATRITAVIPYFGYARQDRRPRSARVAISAKVVADMLTVVGIDRVLTVDLHADQIQGFFDIPVDNIYGSPVLVDDIEDQRFENLMIVSPDIGGVVRARAVAKSLGVDLGIIDKRREKANHSEVMHIIGDVEGRTCILVDDMVDTAGTLCHAAKALKEHGAAKVFAYCTHPVLSGRAIENIENSVLDELVVTNTIPLSAAAQACARIRQLDIAPVVAEAVRRISNEESISAMFR

SEQ ID NO: 94516 - protein, 426 aa, Oceanobacillus iheyensis HTE831
MVADKAADSSNVNQENMDVLNTTQTIIKSALDKLGYPEEVFELLKEPMRILTVRIPVRMDDGNVKVFTGYRAQHNDAVGPTKGGIRFHPNVTETEVKALSIWMSLKSGIVDLPYGGAKGGIICDPREMSFRELEALSRGYVRAVSQIVGPTKDIPAPDVFTNSQIMAWMMDEYSKIDEFNNPGFITGKPIVLGGSHGRESATAKGVTIVLNEAAKKKGIDIKGARVVIQGFGNAGSFLAKFLHDAGAKVVAISDAYGALYDPEGLDIDYLLDRRDSFGTVTKLFNNTISNDALFELDCDIIVPAAVENQITRENAHNIKASIVVEAANGPTTMEATKILTERDILIVPDVLASAGGVTVSYFEWVQNNQGFYWSEEEIDNKLHEIMIKSFNNIYNMSKTRRIDMRLAAYMVGVRKMAEASRFRGWV

SEQ ID NO: 94517 - protein, 366 aa, Pseudomonas fluorescens PfO-1
MGFNCGIVGLPNVGKSTLFNALTKSGIAAENFPFCTIEPNSGIVPMPDPRLDALAAIVNPKRILPTTMEFVDIAGLVAGASKGEGLGNKFLANIRETDAIAHVVRCFEDENVIHVSNSVDPKRDIEIIDLELIFADLDSCEKQLQKVARNAKGGDKDAVAQKALLEQLIPHFSEGKPARSLMKNMSADEKAIIKGFHLLTTKPVMYIANVAEDGFENNPHLDVVKAIAEEEGAMVVPVCNKIEAEIAELDDGEEKDMFLEALGLEEPGLNRVIRAGYEMLHLQTYFTAGVEEVRAWTVRVGATAPQAAGVIHTDFEKGFIRAEVIAYNDFIQYKGEAGTKEAGKWRLEGKDYIVKDGDVMHFRFNV

SEQ ID NO: 94518 - protein, 201 aa, Oryza sativa Indica Group
ALRVNVLFKHIQRMIGGAEIGAVMAETGDSWFNCQKLRLPEGCGYEFQMQYGSIGWSVGALLGYAQAVQKRVVACIGDGSFQVTAQDVSTMLRCGQRSIIFLINNGGYTIEVEIHDGPYNVIKNWDYVGLVNAIHNGEGRCWATRVRCEEELEAAIATATGDKADSLCFIEVVAHKDDTSKELLEWGSRVSAANSRPPNPQ

SEQ ID NO: 94519 - protein, 365 aa, Yersinia pestis KIM
MLQQQALPGTPRQDGFFMPAEWAPQDAVWMLWPYRQDNWRGKAIPAQQTFAKVAEAISRATPVFMGVPAEFMAQAKATMPANVTLVEMASDDAWMRDTGPTMVINGAAERRAVDWQFNAWGGLNGGLYADWQQDEKVAVQVSDFLKNAHYSAPLILEGGSIHTDGEGTLLTTAECLLNPNRNPHLNQAQIEQLLCDYLGVTHFIWLQDGVYNDETDGHIDNMCCFVRPGEVALHWTDDQQDPQYARSVAAFEVLSNTVDAKGRKLKIWKLPAPGPLYNTEEETFDVLTSDAVPRTAGERLAGSYVNFLISNQQIIFPLLDSRTDGQANDLLQQMFPGYAIVGVPAREILLGGGNIHCITQQIPAA

SEQ ID NO: 94520 - protein, 293 aa, Shewanella sp. MR-4
MLVNAIKEYQLRVDDQLKQRFSTLEDTAPQLKAAMSHGALLGGKRIRPFLVYSVGQMFGVPLEKLDACAAAIECIHAYSLIHDDLPAMDDDDLRRGQPTVHIAFDEATAILAGDALQTLAFEIVTEAVTGISSEQHIAMVRALAKASGYRGMCGGQAIDLASTDKLIDLKALTQLHNMKTGALISCAVELALIAANAPKDEYQTMIEFAHAVGLAFQVQDDILDIIATTEELGKPQGSDAESNKSTFPQLLGLQGAKDTAAQLIQEALSALAKLPYNSQLIADFARYIIERRI

SEQ ID NO: 94521 - protein, 358 aa, Triticum aestivum
MSAYCGKYKDELIKNAAYIGTPGKGILAADESTGTIGKRFASINVENVEDNRRALRELLFCTPGALQYLSGVILFEETLYQSTKGGKPFVDILKEGNVLPGIKVDKGTVELAGTNGETTTQGFDDLGKRCAKYYEAGARFAKWRAVLKIGLTEPSQLSIDQNAQGLARYAIICQENGLVPIVEPEILVDGPHDIDRCAYVTEMVLAACYKALNDQHVLLEGTLLKPNMVTPGSDAKKVAPEVIAEYTVRTLQRTVPAAVPAIVFLSGGQSEEEATLNLNAMNKLQTKKPWNLSFSFGRALQQSTLKAWAGKAENEEKARKAFLVRCKANSEATLGTYKGDATLGEGASESLHVKDYKY

SEQ ID NO: 94522 - protein, 622 aa, Shewanella sp. MR-4
MSLDISQFPVLAQANTPNELRQLPQALLPQLADELREFLLKSVGMSSGHFASGLGTVELTVALHYVYNTPFDRLIWDVGHQAYPHKILTGRRDRMHTIRQKNGLHPFPWREESEYDTFSVGHSGTSISAALAMAVAAEKEQAGRKVVAVIGDGAMTGGMVFEAMNHAGDLHNDMLMVLNDNEMSISENVGALNNHLAQLMSGRLYTTIRESSKKVLKGMPVIKEMAKRTEEHLKGMVVPGTLFEELGFNYIGPIDGHDVDALVETLRNMRSLKGPQVLHIMTKKGRGYEPAEKDPIGWHAVPKFDPSQFKKPATKPGLPTFSQVFGKWLCDIAEQDEKVLGITPAMREGSGMVEFSQRFPKQYFDAAIAEQHAVTLGAGFACEGFKPVVAIYSTFLQRGYDQLIHDVALQRLPVLFAIDRGGIVGADGPTHQGAFDLSFMRCIPNMVIMAPSDENECRQMLYTGYCYDAGPSAVRYPRGSATGATQVEAMTALPIGKGVIKRLGKRIAMLNFGTTLAAALTAAESLDATVVDMRFVKPLDVDLVKEMAQTHDVLVTVEENAIMGGAGSGVLELLQKLKMPKPVLQIGLPDEFIKHGSPEEVTHDLQLDAEGMLAQINAFLAD

SEQ ID NO: 94523 - protein, 242 aa, Yersinia pestis KIM
MKSISNSWVHMSTIQQNLQDVRARIATAAHNCGRSPEEVTLLAVSKTKPVAAIEKAIAAGQYAFGENYVQEGVDKIHSFVDNKTLEWHFIGPLQSNKSRLVAENFAWCHTVDRLKIAQRLSAQRPAAMPALNVLIQINISDEQSKAGISLSELPALADSISTLPNLCLRGLMAIPAPEHDYQRQLAVFTQMNQAFLTLKARYPQIDTLSMGMTDDMDAAISAGSTLVRIGTAIFGARVYNAD

SEQ ID NO: 94524 - protein, 591 aa, Zea mays
MGGEAEGGERRLGRVLSFGIPDTALGLVMGYVEDPWDRDAISLVCRHWCRVDALSRKHVTVAMAYSTTPERLFGRFPCLESLKLKAKPRAAMFNLISDDWGGSASPWIRQLSATFHSLKKLHLRRMIVSNDDINTLVRAKAHMLVSLKLDRCSGFSTPSIALIARSCRKLETLFLEESMIDEKENDEWIRELATSNSVLETLNFFQTDLRASPEYLTLLVRNCQRLKTLKISECFMPDLVSLFRTAQTLQEFAGGSFEDQGQPVAGRNYENYYFPPLLHRLSLLYMGTNEMQILFPYAAALKKLDLQFTFLSTEDHCQIVQRCPNLETLEVRDVIGDRGLQVVAETCKKLQRLRVERGDDDQGGLEDEQGRISQVGMMAIAQGCPELTYWAIYVSDITNAALEAVGTCSRNLNDFRLVLLDREAHITELPLDNGVRALLRGCTKLRRFAFYVRPGVLSDVGLGYVGEFSKSIRYMLLGNVGESDNGIIQLSKGCPSLQKLELRGCLFSEHALAMAALELKSLRYLWVQGFRSSPTGTDLMAMVRPFWNIEYILPDQDEPCPEYKKQILAYYSLAGRRTDCPPSVTPLYPAV

SEQ ID NO: 94525 - protein, 133 aa, Triticum aestivum
  misc_feature (66)..(66): Xaa can be any naturally occurring amino acid
  misc_feature (79)..(79): Xaa can be any naturally occurring amino acid
  misc_feature (103)..(103): Xaa can be any naturally occurring amino acid
  misc_feature (111)..(112): Xaa can be any naturally occurring amino acid
  misc_feature (118)..(118): Xaa can be any naturally occurring amino acid
  misc_feature (124)..(124): Xaa can be any naturally occurring amino acid
  misc_feature (126)..(126): Xaa can be any naturally occurring amino acid
MGRKFFVGGNWKCNGTVEQVESIVNILNAGQIASTDVVEVVVSPPYVFLPTVKAKLRPEIQVAAQXNCWVKKGGAFNRXNPVLEMLVNSGVPWGILGTLPEKXDFNGENKXXLLGEKXVPYALXQXLRQLHFG

SEQ ID NO: 94526 - protein, 298 aa, Triticum aestivum
MVEIPVVDLRLAGAQPEESARLRDACERLGCFRVSGHGVPAALQAEMKAAVRALFDLPDEAKRRNADIIAGSGYVAPSPANPLYEAFGLLDAADPADVDAFCARLDAPPRARETVKSYAEAMHELIVDVAGKVAASLGLEGHPFQDWPCQFRINRYNYTEDTVGSSGVQIHTDSGFLTVLQEDDCVGGLEVLDPATAEFVRVDPVPGSFLVNIGDVGTAWSNGRLHTVKHRVQCVAAVPRISIAMFLLAPKDDRVCAPEAFVDAQHPRRFKAFNYDDYRKLRLSTGERAGEALARMAA

SEQ ID NO: 94527 - protein, 300 aa, Bacteroides thetaiotaomicron VPI-5482
MSPLNFTHILTQAVDELSESESYKGLFHQHKDGEPLPSAKVLYEIIELSRAILFPGYYGNSTINSRTINYHIGVNIEKLFDLLTEQILAGLCFSTAEGDCNVCSESRREEAARLAANFISKLPAMRRILATDVEAAYNGDPAAKSYGEVIFCYPAIKAISNYRIAHELLELGVPLIPRMITEMAHSETGIDIHPGAKIGSHFTIDHGTGVVIGATSIIGNNVKLYQGVTLGAKSFPLDADGKPIKGIPRHPILEDNVIVYSNATILGRITIGSDATVGGNIWVTENIPAGAKIVQTKAKK

SEQ ID NO: 94528 - protein, 298 aa, Saccharomyces cerevisiae
MSTNAKESAGKNIKYPWWYGGAAGIFATMVTHPLDLAKVRLQAAPMPKPTLFRMLESILANEGVVGLYSGLSAAVLRQCTYTTVRFGAYDLLKENVIPREQLTNMAYLLPCSMFSGAIGGLAGNFADVVNIRMQNDSALEAAKRRNYKNAIDGVYKIYRYEGGLKTLFTGWKPNMVRGILMTASQVVTYDVFKNYLVTKLDFDASKNYTHLTASLLAGLVATTVCSPADVMKTRIMNGSGDHQPALKILADAVRKEGPSFMFRGWLPSFTRLGPFTMLIFFAIEQLKKHRVGMPKEDK

SEQ ID NO: 94529 - protein, 631 aa, Bacillus cereus ATCC 14579
MKMLTVENLSKSYGEKPLFDGLSCSITEGQRVGIIGVNGTGKSTLLKIIAGLETPDTGDMTHSRGYTISYLSQQPEFDEKLTVLEQVFHGDTPLIRLLRDYEKALLNIEKDPSNEKVQEQLFAVQQRMDAMSAWEANANAKSLLTKLGITDFTAIVGNLSGGQKKRIAMAQCFIETPDLLILDEPTNHLDHETVEWLEEYLARYTGSVLLVTHDRYFLDRVTNRIFELDNGKLYSYEGNYSTFLEAKALREEQELAQESKRQNLYRRELAWIRRGAKARSTKQKARIQRFDELKAQEGPAAKQSVDIALSGSRLGKKVLELKDVTKKFGDKTVLHNFNHIVKPGDRIGIIGANGSGKSSLLNMLAGKLSPDSGEVEVGQTVKVAYYTQENEEMNLNQRMIEYIKEIAEVIHTTDGKVIGASQMLERFLFPTHSHGTPLGKLSGGERRRLYLLRILMGEPNVLLLDEPTNDLDTQTLTVLEDYLEDFPGVVLTVSHDRYFLDKVVDELFIFTGGGEVREFLGSYTDYLEMEKTRELMEKAEVQKEKKVVEEAPKQQRKRKLSYNEQREWETIEDTIAELEEKIESIGEELAKVGSDFTKAQELSEAQQKTEEELEKKMERWSELSDIVEGLK

SEQ ID NO: 94530 - protein, 457 aa, Mesorhizobium sp. BNC1
MQMTMIGAGYVGLTTGTCLANLGHNVRCFDIDAARIGRLQNFDIPIYEPGLQEAMRSAAKAGRLSFSDQLRESVAQADAVFIAVGTPSKPDGGIDLSHVLAAAQQMAPHLKRGSTVIIKSTVVVGTARRVREIIARERGAFDIRVASNPEFLREGSAMRDFMEPDRIVLGADDTRSRNALRAIYRSFERAGVPMVITTTGNAELIKYSANAFLALKIGFINDVADLCEKTGGDIGDVARGIGLDPRIGESFLLPGPGFGGSCFPKDTRAFAATGREFGAPQKLVETLITRNDQRKLLLARRILKEGRFTPGSAVTVLGLSFKANTDDVREAAALTIIPALQEAGLRVIAHDPKAMANARKRLRDVTWVNCPYSACKETSAVVVLTEWDEYRQLDLGRIARTLSGDALFDYRNLFEPRSVIQHGLRYFSLGRAASLRQKAGVSPIDTWDRRVAAPGHA

SEQ ID NO: 94531 - protein, 380 aa, Gluconobacter oxydans 621H
MATRIDYYESLEVSRTASQDELKKAFRKQAMRYHPDRNPGDDAAEQKFKEINEAYDVLKDEQKRAAYDRYGHDAFEGGMGGMGGGFGGGFAGAGGLGDIFDQMFGDMMGGRRDGGRRTGADVQVQVEITLMEAFTGVTKDVEVRTRVTCEACHGSGSADPKAGSSTCPTCHGAGKVRAQQGFFLVERPCPTCHGSGRTVANPCKVCHGTGTEAKTETISIDIPAGVEDGTRIRMAGKGEAGGEGVQPGDLYVHISVLSHDIFQRDGANIYCRVPLRMTQAALGTEVEVPVVDGGRSKVRIPAGTQTGETFRLRGKGFSVLRSSARGDMYIQVSVETPSHLTKRQRELLEEFEKEAGDDHAKGSPENSGFFAKVRDFFEGR

SEQ ID NO: 94532 - protein, 154 aa, Chlamydomonas reinhardtii
MKRVRRMCAVMVSASELTSLQSDLPVLTQYDRVALRDLADTGFEIDFICISYCRSGVDVREVRAFAESVPALAACGLVAKVETRQALFNFRILEAADGITISRGLLGLDCLPEKVALIQKSLISACNLVGKPVVVTRVLDSMADMPRPTRAEAT

SEQ ID NO: 94533 - protein, 352 aa, Betula pendula
MKRMLSTQPLADSDPSFAQRIRDLPKHVPGTNIKNEVSQLIGRTPLVYLNKVTEGCGAYIAVKQEMMQPTASIKDRPAYAMMMDAEKRNLITPGKTTLIEPTSGNMGISLAFMAAMKGYKMVLTMPSYTSLERRVTMRAFGADLVLTDPTKGMGGTVKKAYDLLESTPNAFMLQQFSNPVNTQGAFETTGPEIWEDTNGQVDIFVMGIGSGGTVSGVGQYLKSQNPNVKIYGVEPTESNVLNGGKPGPHQITGNGVGFKPDILDMDVMERVLEVSSEDSVNMARQLALKEGLLVGISSGANTIAALRLARMPENKGKLIVTVHPSFGERYLSSVLFEELRKEAENMQPVSVD

SEQ ID NO: 94534 - protein, 499 aa, Oryza sativa Indica Group
MADAWAASPPSPTAPSPFAADDLVDARLAPWPPFAPWPAPGQLHHNRRGGGHPNPLFTILPASALAIGVVLLVAVVVILVMTRRWKPGAVDGAGGASCNGDKPGGAPASSCGSSVRGYNNSRYYAAAAAGCIYGGRLGFSVQPRNRGAQVFTYRELESATDGFSECNVVGRGAYGVVFRGRLGDGTTAAIKRLKMDGRREGEREFRIEMGVAITAQVDLLSRMHSPYLVGLLGYCADQSHRLLVFEFMPNGSLKSHLHRRALAPAEQPPPLDWQTRLGIALDCARALEFLHEHSSPAVIHRDFKCSNILLDHNYRARVSDFGMAKLGSNKANGQVTTRVLGTTGYLAPEYASTGKLTTKSDVYSYGVVLLELLTGRVPVDTKRPPGQHVLVSWALPRLTNREKLVQMVDPALIGQFSLKDLVQVAAITAMCIQTKADYRPLMTDVVQSLIPIVKSPLMSCTSTPLRPAHGHHHVVYMSPSRGSSNGGALETRCVMHGLD

SEQ ID NO: 94535 - protein, 312 aa, Bacillus halodurans C-125
MENRRIVIITGANSGIGKEAAQRFANEGDHVIMACRNIAFSRKVQHDIIAASGNDHVDLLELDVSSFASIRTFCTTFNSQYKRLDILIHNAAYFNHGEPYRLSPDGIELTFATNVFGPYLLTSLLRDRLKQSEDPRILHAGSNIIKHFFDPKQTFDLDLLQGNHGTKSYSVYKMYCQSKMALMLLTFQMAEVFADDGIKVNALQINGAKMSKRTIQKVKPWWRPIAWGQNLFFPPPSYMADKYFTICTSDKYKQTTGKLFNDKLEIMEPSPTHYPGFFKQMKLLLGSNVYPAYENTNIREKLWALCKELVGE

SEQ ID NO: 94536 - protein, 343 aa, Magnaporthe grisea 70-15
MAAPAATAPLQLDPKYDGYDFPTVAPVPAPGHPGHLTAEQQAQVSQLRLMLESQGYTDRLDTLTLLRFLRARKFDVNLALKMFVDCEKWRKETKLDEILPTWDYPEKAEIFKYYPQYYHKTDKDGRPVYIEQLGNADITAMNKITTQERMLTNLAVEYERVADPRLPACSRKSGHLLETCCTIMDFKGVGISKASQVYGYVRAASNMSQNYYPERLGRLYLINTPWGFSGVWGIVKGWLDPVTVQKIHILGSGYQKELLAQIPAENLPKSLGGTCTCAGGCELSDAGPWNEKEWARPPKWETKHKQQAAAPAAAAAPAATEPAPAAAPAAPAAEAEAKQPAAA

SEQ ID NO: 94537 - protein, 610 aa, Pseudomonas fluorescens PfO-1
MLPALSLNRFRLPALTLIVSAIALTACNAPPSSTLPVAPEAASGYRTGLQASHAEKHMAAAANPLAAEAGREMLRQGGSAIDAAIAMQAVLTLVEPQSSGIGGGAMIVLWDGKQVRTYDGRETAPAGATEKLFLQADGKPMPFPQAQIGGRSVGTPGVMRALELAHKKHGRLPWAKLFEPAIKLAEQGFAISPRLHSLLESDPEIRRSPDMAKYFLNSDGSVKAVGTRLQNPALAAVLKRIANEGADTLYKGPIAEEIVDKVQGHANPGSLSLTDLQHYQAKERAPLCTDYKRWQVCGMPPPSSGGIAVAQILGTLQALETRDPRQALTPLKPVKTNKPAGIEPAPQAVHLIAEAERLAYADRAQYVADTDFVPVPVKGLVDPGYLASRASLISERSMGSAKPGTPPGIQVAYAPDRSPLRISTSQVVAVDDFGGAVSMTTTIEAAFGSHLMVQGFLLNNQMTDFSFLPEENGQKVANRVEPGKRPRSSMAPTLIFDRNSGEFVATVGSPGGSQIIEYVAKTTVGLLDWNLDPQSAISLPNFGSRNGPTELEQGQFSPTLIQALKDKGHTVSEIDMTSGTQAIVRVKDAAGKATLSGGADPRREGAALGD

SEQ ID NO: 94538 - protein, 368 aa, Thermotoga maritima MSB8
MTVLIVEDDDITREAMGQYLKLSGFNVIEAENGEKAVELSENVDVALVDVMLPGMSGIEVVNKIKAKNPSCVVFVVTAYDDTEIVKKCVEAGADDFIKKPVNLELLRLKITHALRNRVFHMYRNSYLKSLKKKLFLLEKTAEEFFTEYEDFLFEVLEILNMLSEYRDMETHRHTERVGWLSGRIAEEMGMSEVFVTEIQFAAPLHDIGKIGIPDRILLKPGILTPEEFEIMKQHTTIGFRILSRSNSPILQLGAEIALTHHERWDGSGYPRGLKEREIPISGLIVAVADSFDAMVSRRPYKNPKPLEEAFREIESLSGKLYSPEVVEAFLKLEKEITDVYRREKDEDTSHNGGRSHQSSPGEGVEGIR

SEQ ID NO: 94539 - protein, 231 aa, Populus trichocarpa
MASPSESWMQEFNEASKLGDEISAMISGKNSLPQSGPETQRQFSAARRKATILRTKLDILQSLLSALPSKQPLSGKEMNRRQEMLKNLSTKVNQMASALNMFSAANRENLLGPDSKTDDVINRASGFDNQGLVGFQRQIMREQDEGLEKLEETVISTKHIALAVNEELTLHTRLLDDLDEHVDVTNSRLQRVQKNLAILNKRTKGGCACWVFLVIAIVILIVVVWLLIKYL

SEQ ID NO: 94540 - protein, 2113 aa, Arabidopsis thaliana
MGRSCSEKNGEAERVRGLVIESLALSPKIFLGMIFHKPLKKLGISLFQKDIKSVSPKFDELLEKFLVEHEEKMEEDHYKANDMMDLLLEAMEMRMQSIKSQETISSPCSCNTKARKPPILFRYGKYSNNSLLLQELLVAGTDTSALATQWTMAELINNPTILERLREEIESVVGNTRLIQETDLSNLPYLQSVVKEGLRLHPPASISVRMSQERCELGGFYIPEKTLLVVNTYAIMRDPNFWEDPEEFKPERFITSSRSEQEDEMREEVLKYIPFSAGRRGCPGSNLAYVSLGIAIGVMVQCFDWRIKGEKVNMSETAGTIMLAMAQPLKCTPVPRTLNLLPSSLHIPRDENRLCLIDARVRGDLVVVPDYEVTLALSFPFQKAISTQDSRDQDDSESSPVETKKLFITAYRDENTEYKITRNHIKSVIVVNAPLLGGFVSEHYCFDLTKKRFGTDTLTQTIQWTMEELTNNPNILERLRIDFYTSEKTLRAAFEGFCELVEGTHDLLSNSKAMPFELEYTKKEAARAALKELNGKVMQPWGFEMLQAKKEKASNVIFHTRSSFMRLEKPKGSRAGRDLPPSPPSFPVIGHLHLLLSALVHKSFQNISSKYGPLLHLRVFHIPIVLASSASVAYEIFKAQDVNVSSRGHAPVGESLWFGSSSFFFAPYGDYFKFMRKLIATKLLGPQALERSRKIRADELDRFYKTLLDKAMKKESVEIGEEAAKLNNNIICKMIMGRSCSEENGEAEKFRHLVIESMALTKQIFFGMIFHKPLKKLGISLFQKDILSLSRKFDELLEKILFEHEEKKAEHNQANDMMDFLLEAYGDENAEYKITRNHIKSLFVDLVIAGTDTSVQATQWTMGELINNPKILQRLREEIESVVGNTRLIQENDLPNLPYLQAVVKEGLRLHPPGSISVRMFQERCELKGFYIPEKTLLVVNTYAIMRDPNFWEDPEEFKPERFIASSRSEQEDEVREEVLKYIPFSAGRRGCPGSNLAYISLGIVIGVMVQCFDWRIEGEKVNMNEAAETTALSMAQPLKCTPVSRTKNPLPSSLHIPMAGEIFRAHDMNVSSRGAAAIDESLVFGSSGVVYAPYGDNLKKPKDSRAGRDLPPSPPSFPVGSPQSNNLHLLLSALVHKSFQKISYKYGPLLHLRVFHVPIVLASSASVAYEIFKAQDVNVSSRGHAPAGESLLFGSSSFFFAPYGDYFKFMRKLIATKLLGPQALERSRKIRADELDRFYRNLLDKAMKKESVDIVEEAAKLNNNIICKMIMGRSCSEDNGEAERVRGLVIESTALTKQIFLGMIFDKPLKKLGISLFQKDIKSVSRFDELLEKILVEHEERMGKHYKANDMMDLLLEAYGDENAEYKITRNHIKSLFVDLVIAGTDTSAQTIEWTMAELINNPNILERLREEIESVVGNTRLVQETDLPNLPYLQAVVKEGLRLHPPGAVFLRTFQERCELKGFYIPEKTLLVVNVYAIMRDPKLWEDPEEFKPERFIASSRSGQEDEIREEVLKYMPFSTGRRGCPGSNLAYVSVGTAIGVMAQCFDWRIKGEKVNMNEAAGTLVLTMAQPLMCTPGPRTLNPLPSTTIMAALISVDFQHCFIFIILLCLFSLLCYSLFFKKPKDSRGCDLPPSPPSLPIIGHLHLLLSSLSHKSLQKISSKYGPLLHLRIFNVPIILVSSASVADEVFRIHDMNISSRGAAAIDESLVFGSSGVVYAPYGDYLKFVKKIIATKLLRPQVLERSRGLRAEELQRLYNRILDKAKMNENVEIGKEATMLMNNIFCRMSMGRSFSEENGEAERVRGLVAESYALAKKIFFASVLRRLLKKLRIPLFKKDIMDVSNRFNELLEKILVEHNEKLDEEHKDTDMMDVLLAAYADENAEYKITRNHIKSFFVELFVGGTDTSVQTTQWTMAEIINNSDVLERLREEIDSVVGTSRMIQETDIPNLPYLQAVVKEGLRLHPPFPLLTRKFEERCEIKGFYIPEKTFLIINAYAWMRDPDSWEDPNEFKPERFLGSSRLGQVDEREEAQKYIPFGGGRRGCPGANLASIFVGTAIGVMVQCFDWGIKGDKINMEETFEGLTLTMVHPIKCTPIPRTLPFVTSNLQSPSS

SEQ ID NO: 94541 - protein, 292 aa, Zea mays
MDRYHRVERARNQSTIEENEIRITAQGLIRNYVSYATFLLQERRIKEIVLKAMGQAISKSVAVAEIIKKRAPELHQDTNISSVSITDVWEPIEEGLVPLEMTRHVSMISITLSPRELDKHTPGYQAPAYVEHPRQQQVPPLQRQPRRPSGQQFQQLEYEDSYARGRGRGRGRGRGRGWARGGYGGYGNNQGGYNQGGGYYDNQGGYGGYDDQGGYGGGYGYNQGRYGNYQENGGYNRGRGGGMRGRGNWGYRGGYEGGRGGGYEGGRVGGGYEGGRGGGRGRGRMGGGGRAN

SEQ ID NO: 94542 - protein, 440 aa, Ostreococcus tauri
MHRRDRIHRRPRSSDARASVRRGRDGRVDGVIPLESIVDRIVTALVTMVGVLSAQRWLGGTAVRANDRARARRAGARRGIAPEARIYENILETVGDTPVIKINRLAPEGVEMYVKAEYFNPLSSVKDRLAVAVITDAERRGLLKPGDTVVEATSGNTGIAVAMACAQRGYRCVICMAEPFSVERRKIMRMLGAKVIVTPKAGKGTGMVAKAEELAAKHGWFLCRQFENEANPAYHASTTGPEIVRDFAGKKLDYFVTGYGTGGTFQGVSRVLRESRPDTKIVLLEPEAAALVSSGIKTERKDTGAPAGSHPAFAAHPVQGWTPDFIPLVLENGLNMNLYDELVKIEGGDAVQTAQALARNEGIFTGISGGATFAGALTVAKKAPKGSVILAMLPDTSERYMSTPLYETIDAEMNDEELEIAKSTPSFQLIPGQDPTLLVQ

SEQ ID NO: 94543 - protein, 176 aa, Bacteroides thetaiotaomicron VPI-5482
MIMSKETLIKSIREIPDFPIPGILFYDVTTLFKDPWCLQELSNIMFEMYKDKGITKVVGIESRGFIMGPILATRLNAGFIPIRKPGKLPAEVIEESYDKEYGTDTVQIHKDALDENDVVLLHDDLLATGGTMKAACELVKKLKPKKVYVNFIIELKDLNGKSVFGDDVEVESVLTL

SEQ ID NO: 94544 - protein, 346 aa, Burkholderia mallei ATCC 23344
MKALVYHGPGRKSLDERPMPELAAPTDVIVRVTRTTICGTDLHILKGDVPSCEPGRVLGHEGVGVVHRAGGAVSTFKEGDRVLISCISSCGQCEYCRRGMYSHCATGGWILGNRIDGTQAEYVRIPHAQTSLYRIAPGADEEALVMLSDILPTGFECGVLNGRVQPGGTVAIIGAGPIGLAALLTAQFYSPAQIVMIDPDPNRLALARRFGATACIDNGQVDAVAGVKALTGDGVDCAIEAVGIPASFELCQRIIAPGGVIANVGVHGMKADLHLETLWDRNITITTRLVDTSSTPMLLKTVGAGRLDPKQLITHRFSLADIGQAYETFGHAAHTRALKVIVEVSE

SEQ ID NO: 94545 - protein, 327 aa, Arabidopsis thaliana
MNEVAIKRINRSICNGGVGFGVRKVFGKGSFGSVRLFSYKRRCDGETLYATVKTSDDAKSLYEEFQILSKFKGCPRIVQCYGNGVKQRFNDKGYVEYMIPMEYATGGSLNNFMDRFNDRKLPDPMIRKFTRMLLEGLATIHRYGYVHYDIKPENILVFPGSVYKEGAWRYSYKLKISDFGLSKRDGDTKWWHPLKSYAGTRIYMSPESISHGEIGKGLDLWSLGCVVLEMYTGKRPWWHTNYELEDLMKCYEPLFPPNLPCDAKLFLMTCFAPEPDERKDALTLLRQSFFRRDVNKLTKLLKVDNRNDFTLELKKLRQMLSEIRSMR

SEQ ID NO: 94546 - protein, 422 aa, Candidatus Kuenenia stuttgartiensis
MLKYTEKEMGYVNGLKCRECGKEYPKEPLHVCSFCFGPLEVDYDYEGIKKVINREVIQSRSNTMWRYKELLPIDGEPTVGSQVGFTPLVKANNLAKILGVEELYVKNDSVNYPTFSFKDRVVSTALSKAKEFGYKIVGCATTGNLGNSVAAQAAQACLESYIIMPADLEQGKIIGTLIYNPNVIKVTGNYDQVNRLCSEIADKYGWAIVNVNIRPYYGEGSKTFGYEIMEQLGWKVPKHIVVPMAGGSLITKIGKAIKEFVQLGLIDGADTKLHGAQASGSSPITTAVKGKTDVIRPVKPNTIAQSIAIGNPADGFYSVKSINVSGGWAEDVTDDELVEGIKLLARTEGIFTETAGGVTVAVTKKLIEQGKIPRDESIVISITGNGLKTQEAVINKLYEPKIINPSLAEFDKVMEEKMANVR

SEQ ID NO: 94547 - protein, 436 aa, Saccharophagus degradans 2-40
MSIERSPLSEAEIMRIDAEHIWHPYSSFKSAVPVFPVKSAQGVYLHLHSGETLIDGMSSWWSTLHGYNATAISDAIAKQAQQLSHVMFGGLTHEPAAYLTKQLVKLSPDGLEKVFLSDSGSVAVEIAMKMAIQYWHAKGQPNKNKMLALRNGYHGDTIGAMSVCDPVTGMHHLFKNTLTQQVFTEQPACKFHEQWDESYLTDIKQQIANHKHELAAVILEPVVQGTGGMHFYSPEYVKAVKALCEANNLLLIADEIATGFGRTGKMFACEHAGITPDIMCLGKTLTGGTMTLAATLCTNKVADTICNAEPGVFMHGPTFMGNPLACTAASVNIDLLLNSNWQSNISRLQTGLLEGLLPCKHNAKVKDVRTLGAIGVVEMQEPVDMAKIQPMFVEHGVWLRPFGKLIYMMPAYIMQDEQLKTLTQAVCNVIEKYTAQ

SEQ ID NO: 94548 - protein, 356 aa, Ralstonia solanacearum
MTKIAVLPGDGIGTEIVAEAVKVLKTLGETFEMETAPVGGAGYEAKGHPLPEDTLKLAKEADAILFGAVGDWKYDTLPRELRPEQAILGLRKHLQLFANFRPAICYPELAGASSMKPEIVAGLDILIVRELTGDIYFGQPRGVRAAPDGLFAGAREGFDTMRYSEPEIRRIAHVAFQAAAKRGKKLCSVDKANVLETFQFWKDIVTDVHKEYPEVELSHMYVDNAAMQLVKAPKNFDVVVTGNMFGDILSDEAAMLTGSIGMLPSASLDANNKGLYEPSHGSAPDIAGKGIANPLATILSAAMMLRYTLGKAEQADRIENAVKKVLAQGYRTGDILTPGCKQVGTVEMGDAVVAAL

SEQ ID NO: 94549 - protein, 432 aa, Saccharophagus degradans 2-40
MTGNTFNNQDLIQFLQDSPTPFHAVLSMSQRMQAAGFVELNENEDWSLQPGGKYFVVRSGTAIAAFIHGVESSVDHGIRVVGAHTDSPCLKVKPMPSKLSNGYQQLSIEVYGGVLLAPWFDRDLSLAGRVVYRDTSGALKSALINFKRAIGSVPSLAIHLDRAANEGRKINPHVEMDVVLGQSAQKLDFKLLLQEQMQLEGYDNIAEILDFNLSFYDVQPPAVLGLNNEFLASARLDNLLSCYIGINSLIQADTTYTSVVICNDHEEVGSRSEVGAQGPMLKDVLSRINPDPQANQKAIRRSLMLSVDNAHGIHPNYASKHDENHGPIINAGPVIKFDACQGYATNSDSAAFVRWLATKGEPIALQSFVMRADMRCGSTIGPITATELGIQTVDIGLATFGMHSVRELGGVKDGEQLNNLLMRFMSTETLKL

SEQ ID NO: 94550 - protein, 280 aa, Haloarcula marismortui ATCC 43049
MEYLERRRDRVEERLEAVLDSVEPEELADEVRHVALSGGKRVRPTVTVLVCEALGGEPADAVDFAVGIELVHNASLVIDDIIDESELRRGSPAAWEAFGHGPAIIASDGLLGEAFNLFSTDERAMQTVSESMVELGEGEAMELVAEPSNEKEYMELARRKTGALFRAAAELGAIAADSDPYTVEAVGQYAERVGVAFQMRDDVLDATADAETLGKPAGTDAEMERPSLVEVTELTTEEANERARAESDAALESLSTIDAPESQSMEYLRDLAEFVVVRER

SEQ ID NO: 94551 - protein, 451 aa, Neisseria meningitidis FAM18
MSEYTPQTAKQGLPALAKSTIWMLSFGFLGVQTAFTLQSSQMSRIFQTLGADPHNLGWFFILPPLAGMLVQPIVGHYSDRTWKPRLGGRRLPYLFYGTLIAVIVMILMPNSGSFGFGYASLAALSFGALMIALLDVSSNMAMQPFKMMVGDMVNEEQKSYAYGIQSFLANTGAVVAAILPFVFAYIGLANTAEKGVVPQTVVVAFYVGAALLIITSAFTIFKVKEYDPETYARYHGIDVAANQEKANWFELLKTAPKAFWTVTLVQFFCWFAFQYMWTYSAGAIAENVWHTTDASSVGYQEAGNWYGVLAAVQSVAAVICSFVLAKVPNKYHKAGYFGCLALGALGFFSVFFIGNQYALVLSYTLIGIAWAGIITYPLTIVTNALSGKHMGTYLGLFNGSICMPQIVASLLSFVLFPMMGGLQATMFLVGGVVLLLGAFSVFLIKETHGGV

SEQ ID NO: 94552 - protein, 210 aa, Triticum aestivum
  misc_feature (170)..(170): Xaa can be any naturally occurring amino acid
  misc_feature (175)..(175): Xaa can be any naturally occurring amino acid
  misc_feature (178)..(178): Xaa can be any naturally occurring amino acid
MKLNIAYPRNGTVKQSDCSDDHIRRGNLFDHRLGQDVNGALFSPEFAGYLFRLKGGSDKDGFPMVQGVLANARVALLLRRGAVNFNAFRGRNGERRRKSVRGCIVAADIACLNAVVVKVGEKPIEGVTDTTLPRRLGPKRASKIRKLFNLGHDDNLRRYVVRRKVEKKDXKIRFXGPXIHRLVSFKTRAAPVKKIKARKVSLVALFRRAP

SEQ ID NO: 94553 - protein, 713 aa, Oryza sativa Japonica Group
MEAKLSFSQDSPPISIISAAKVAGVSLSIDPSLAAGSAPVLCFSSGESLRGINPILEYIAQSSPSLHGRDAIESGHVVEWLEYAPTFLLGSEFEVACSFVDGYLMSRTFLVGHVLTIADITVWSNLAGIGQRWESLRKSKKYQNLVRWFNGIDSDYKDTLNEVIAAYVGKRGIGKSPAPNLKEKVNDSKDPSAPEVDLPGAKFGEVCVRFAPEPSGYLHIGHAKAALLNKYFAERYQGRLIVRFDDTNPSKESNEFVENLLKDIETLGIKYDAVTYTSDYFPKLMEMAEKLIKQGKAYVDDTPKEQMRSERMDGVESKCRNNTVEENLSLWKEMINGSERGMQCCVRGKLDMQDPNKSLRDPVYYRCNTDPHHRIGSKYKVYPTYDFACPFVDALEGVTHALRSSEYHDRNAQYYRILQDMGMRRVEIYEFSRLNMVYTLLSKRKLLWFVQNKKVEDWTDPRFPTVQGIVRRGLKVEALIQFILQQGASKNLNLMEWDKLWTINKKIIDPVCARHTAVLKDQRVIFRLTNGPEKSFVQILPRHKKFDGAGKKATTFTNRIWLDYADASAISKGEEVTLMDWGNAIIKEIKMENGVITELIGELHLEGSVKTTKLKVTWLPDIDDLVPLSLVEFDYLISKKKLEEDENFLDNLNPCTRKETLALGDANMRNLLRGEVIQLERKGYYRCDAPFVRSSKPVVLFAIPDGRQQASLN

SEQ ID NO: 94554 - protein, 436 aa, Methanosarcina barkeri str. Fusaro
MTSEIEYFVIAFAVLLFVFGLVSRKISGTVVTAPMIFVAAGMLLSPEGLDLVSFSSSSTPVLNVAELALVLTLFSDASKIELQSLLREEKLPGRLLIIGTPLTIAFGAIIAAFLLKNITLAEAGLIGAMLSPTDAGLGQAIVNNKKVPAKIRQALNVESGLNDGGAIPFFLFFLILAGGEALEQPVGTLIVLAFEQIGIGMLVGAVVGLAGGWLSSKAVRVGWMSGLYRKIGFMSLAVISWLVADLIGGSGFIAAFTGGLITQAAGKIKATEEEIILTEAEGSILSFAVFFIFGITVAARIFSISWPIFIYAVLSLTLIRMIPVAISLIGMKLHTKTVLFLGWFGPRGLASVVLLLIAMEETGGIGGSETLSLAVTTTVFLSVFVQGATAGPGSEWYSRIVAALPADAPEKKKVGESSTSPDNLDYQTQLLGYKRK

SEQ ID NO: 94555 - protein, 464 aa, Sulfitobacter sp. EE-36
MPSTVKKQPRKAAAKKPAKSSVVPDMLDANVSVETNAQLIARREQAVPRGVASAAPIYAKYAENAELWDVDGNRYIDFVGGIGVLNTGHRHPKVIAAAKAQEDQYTHTSFQVVPYAPYIELAEKLNALAPGDAPKKTLLVTTGAEAVENAVKIARAATGRPGVIAFTGGYHGRTLLTLGMTGKISPYKKDVGPFPSDIFRAPFPSPRDGITVEDAITGLKNLFLTDAQPERVAAIIIEPVLGEGGYTPVPFEMMHQLREICDQHGIMLIADEVQAGFGRTGKWFAIEHSGVTPDLITVAKSMAGGYPLAGVIGRADVMDAMIPGGLGGTYGGNPVACAAALAAIEAIEEEGLLQRSLDMGDHLKARFAEIGARSAPFRMWDIRGLGAMVAVEFVTDFDTATPDGDFTKRVIAHALKRGLLLLSCGMQGNAVRVMVPLTASDAIIEEGLGIFEASVAAAVAEEAK

SEQ ID NO: 94556 - protein, 526 aa, Mannheimia succiniciproducens MBEL55E
MIISIALLTISAYNTAQFFLHGCFLVFSSNMKKGYLNQTNKIFTEYLMSRRLRRTKIVCTMGPATDKGNNLEKIIAAGANVVRMNFSHGTPEDHIGRAEKVREIAHKLGKHVAILGDLQGPKIRVSTFKEGKIFLNIGDKFILDAEMPKGEGNQEAVGLDYKTLPQDVVPGDILLLDDGRVQLKVLATEGAKVFTEVTVGGPLSNNKGINKLGGGLSADALTEKDKADIITAARIGVDYLAVSFPRSSADLNYARQLAKDAGLDAKIVAKVERAETVETDEAMDDIINAADVIMVARGDLGVEIGDPELVGVQKKLIRRSRQLNRVVITATQMMESMISNPMPTRAEVMDVANAVLDGTDAVMLSAETAAGQYPAETVAAMAKVALGAEKMPSINVSKHRMNVQFESIEESVAMSAMYAANHMRGVAAIITLTSSGRTARLMSRISSGLPIFALSRNESTLNLCALYRGVTPVHFDKDSRTSEGAKAAVQLLKDEGFLVSGDLVLLTQGDASSSSGTNLCRTLIVE

SEQ ID NO: 94557 - protein, 171 aa, Oryza sativa Indica Group
MNIERLKQLVDLVGKHRLVLDLSCRKKDGRYAIVTDRWQKFSDVFVDEPTLKHLAAYADEFLVHGVDVEGKRLGIDEELVELLGRYSPIPVTYAGGVSTMDDLERIKRAGNSRVDVTVGSALDIFGGDLPYKDVVLWHKEQNMYFHKESHFQCVSRTRLQVQRHIVKSWRN

SEQ ID NO: 94558 - protein, 638 aa, Ostreococcus tauri
MRLSSFLPPLIVALVVLSHPLEVLAQVCRECDDATRPCASCTVDVTYVTEPLPVEANATTVEESLFLGSFVLKSVRPETLASWQVTWSFPDGQSLYNGVTDAVLINPGGPGGQPARVVNRLDATVDKAEQKFSFVGHAEDGQDVLGATRIRVNGVLCSQANAENIQVSFTDASCLVREWRFCCGSKIMPPSPSPPFPPPAPPLESLAPPVVVQRGALSSAAQSSTSWLRNGSTMSALVVACIISLVLTIEVCRRVRSFIAGEEAPLADLDLEDVFAPKRKNTLLLPGQCFKARSDDLEGIVVQDDDTARMNAGVLHRHDLFNASFATYVENAGDVIEETSTGEDVVEIQLSSIKLGRLLGRGAHGAVYAGKWNKRTVAVKKLHAMSSVPQNDLKTFVREVQVLSKIAHPKIVRMFGACLKQPHLCIVEEMMDGGSLHTLLHEDKRLTDLDDIARIAMDVALAMSYLHSEHIVHRDLKSHNVLLNSHGAKVADFGIARALEQTIGQTLGTKTNASGAIGGTPAYMAPECFHGDVEAVTTKCDVYSYSVLLWEMLSRRVPWEEYANHMQIIFAVAIQSQRLPLDVLGEDDVVTRTLVDKVMVPAWQTDPDARPDFHEVVDVLRKLLNDRVEARDAVMKEC

SEQ ID NO: 94559 - protein, 326 aa, Zea mays
MASPIPREWVGLQQFPPATQTELHELLGKLKEEDVSTLTILVMGKGGVGKSSTVNSIVGERIATVSAFQSEGLRPMMWSRTRAGFTLNIIDTPGLIEGGYINEQAVDIIKRFLLGKTIDVLLYVDRLDAYRMDTLDGQVIRAITNSFGKDIWRRSLVVLTHAQLSPPDGIEYNDFFTRRSEALLRYIHSGAGIKKREYGDFPLPIALVENSGRCKTNEHGEKILPDGTPWVPKLMKEITVVISNGSKPIHVDQKLIDGPNPNNRWKMFIPIILAVEYFLVVKGIRRAIHADIANGKVDDWEQRYRDLVGSRDPVEQKGSTTRNRKA

SEQ ID NO: 94560 - protein, 183 aa, Chlamydomonas reinhardtii
MAMPPAAPSSWSTGFCDCCAPPGGFGICLYAWCCGCCMYGTTVEMMPPVVCCGGSCVGACCAYLGMTFIGCPCILQMMSRGWLRAKYGIPGDGCTDCCLTCWCSPCAMCQEYRECKIRGLGPGGVELNKQQPAVAPQQQMVAVPAPYPYPPGQQYPPQQGYPPQQGYPPQQAYPPQQAYLPQQ

SEQ ID NO: 94561 - protein, 403 aa, Ustilago maydis 521
MSAAARIAPQSAAVAAPAPATTAASAIAKAPSADVQSELDRAALEALELDSDVITSVRLDGLALTKIVKHCRDAHPASASGALLGMDLGGTLEISNVFALPNPGRSNSERDEEEDRSSRNATRYTSDMVRLLRDVNADANPVGLYQGCFLGAFLNSSVIDGLAAITGLVERDGAGSRGKGVLIVHDLAQSAQGNTSVKAYRLSPSFVDAHKKGKFHTQSLIDHKLTFSNILIEIPVSLRNTALLDAFLSSISTPSAPGPSIVQPSTSDLLRNPPSAALAPSYTSLNLALEPVLASSLESTLEIMDEHAAEAGNVGFQARQLAREKAKADAYLARKKAENAAREAQGLAPLPIEDVNRLFKIPAEPSRLEATLLLGQIDSSARRLAETAALGVIQLNAAKTGAV

SEQ ID NO: 94562 - protein, 231 aa, Burkholderia mallei ATCC 23344
MTQFRIAPSILSADFARLGEEVRNVVAAGADWIHFDVMDNHYVPNLTIGPLVCEAIRPHVQVPIDVHLMVRPVDRIVPDFAKAGANLISFHPEASDHIDRTLGLIRDHGCKAGLVFNPATPLNYLDHVMDRVDLVLIMSVNPGFGGQSFIPEALNKLREARARIDAYTARTGREIHLEIDGGVKAENIAEIAAAGADTFVAGSAIFGKPDYRQVIGEMRDALATVGRACAR

SEQ ID NO: 94563 - protein, 151 aa, Chlamydomonas reinhardtii
MAMPPPAQNSWSTGMCDWCAPPGGCGICLLACLCPCCMYGKYGELMPPTVCCGGSCGGSCCAMYGLSILGVPCVLQMQARGHLRMKYNIPGSACNDCCLTCWCSPCTMCQEYRECHIRGLGPGGVEKGSAVAMGGPPPPQAMDPAAPANKQ

SEQ ID NO: 94564 - protein, 241 aa, Brassica napus
  misc_feature (107)..(107): Xaa can be any naturally occurring amino acid
  misc_feature (138)..(138): Xaa can be any naturally occurring amino acid
MGSMSNPNPWSPYDSYNDCSQGVCNIYCPQWCYLIFPPPPPSFLDDEDEDSPSSFSPLLIALIVTLVTAFILVSYYTLVSKYCRRPSRETSSSELSGGVSSSSALAXGDGLNDALIKSITAYKYRKGDGHVHGSDCSXCLSEFEENESLRLLPKCNHAFHLPCIDTWLRSHSNCPLCRAFVTGINNPITQSNAVHPIATESVNRGGGGAAEVNLTAAGYDHRTGDSVVVVEDLEIGLRSQP

SEQ ID NO: 94565 - protein, 388 aa, Vibrio sp. Ex25
MNLHEYQAKQLFAEFGLPVPEGYACDTPQEAFEAAGRISTEKKVVKCQVHAGGRGKAGGVELHDTKEGVKEFAQKWLGKNLVTYQTDANGQPVTKILVEEASNIANELYLGAVVDRASRKIVFMASTEGGVEIEKVAEETPELIHKAAIDPLVGPQAYQGRELAFKLGLEGDQIKQFVKIFMGLGTMFAQYDLALLEINPLVVTGEGNLLCLDGKINIDSNALYRQPKLREMHDPSQEDEREAHAAQWELNYVALDGNVGCMVNGAGLAMGTMDIVNLHGGKPANFLDVGGGATKERVAEAFKIILSDDNVKAVLVNIFGGIVRCDMIAEGIIGAVKEVGVSVPVVVRLEGTNADLGREVLANSDVDIIAAESLTDAAQKVVAAAEAK

SEQ ID NO: 94566 - protein, 486 aa, Vibrio vulnificus YJ016
MEVTAHYIGGKPFVGDTGESFATLNPATGEVLAHIEQADERVLAHAIESAKLGFSVWSSMSAAERSRCLLKAAQLIRDHNDELAELEVRDTGKPIQEASVVDIATGADVIEYFAGLVNGLGGEQQSLGSNQFFYTRREPLGICAGIGAWNYPIQIAMWKAAPALAAGNAMIFKPSEETPLSALKLAELFTQAGVPDGVFNVVQGDYRVGQMLTAHPEIAKVSFTGESGTGKKVMADSAATLKPVTMELGGKSPLIIFDDADLDDAVSAAMVANFYTQGEVCTHGTRVYVQRAMYDAFVEQLKERTEKLIVGDPMNMETQIGSLISKSHLEKVLGAISSAKESGATLLTGGFQVTERGLEKGCFVAPTVFVDCRDEMPHVQNEIFGPVMSVLVFDDEDEVIARANNTQYGLAAGVFTQNLSKAHRVIHQLQAGICWINTWGNSPAEMPVGGYKLSGIGRENGQETLLHYTQTKSVFVELGAFDSPYA

SEQ ID NO: 94567 - protein, 353 aa, Geobacillus kaustophilus HTA426
MAWKGLLDAYGDFLPLSAATPRLSLCEGNTPLIPLPRLSEELGIALYVKVEGANPTGSFKDRGMVMAVAKAKEEGSHTIICASTGNTSASAAAYAARAGMRCLVVVPNGKIALGKLAQAAMYGAEIFAIDGNFDEALKMVRRLSETAPITLVNSVNPYRIEGQKTAAFEVCDQLGRAPDVLAIPVGNAGNITAYWKGFKEYHEAKGTGLPQMRGFEAEGAAAIVRNRVIEQPETVATAIRIGNPASWDKAVEAASESRGKIDEVSDAEILAAYKRLARTEGIFAEPASCAAIAGVIKQRERNEIERGSLVVAVLTGNGLKDPAIALETAAIEPIVLPNDEQVVLEHLQGVVRA

SEQ ID NO: 94568 - protein, 402 aa, Vibrio sp. Ex25
MTIEILVPDLPESVADATVATWHKQPGDAVERDEVLVDIETDKVVLEVPAPEAGVLEAIVEEEGATVLSKQIIAKLKPGAVAGEPTADKTEGTEASPDKRHKAALSEESNDALSPAVRRLLAEHSLEASQVKGTGVGGRITREDIEAHLANAKAATKEEAPAVVDVPAAARSQKRVPMTRLRKTVANRLLEAKNNTAMLTTFNEVNMKPIMDLRKQYKDQFEERHGIRLGFMSFYVKAVTEALKRYPEVNASIDGDDIVYHNYFDISMAVSTPRGLVTPVLKDCDKLGFADVEKGIKELAIKGRDGKLTVDELMGGNFTITNGGVFGSLMSTPIINPPQSAILGMHKIQERPMAVDGKVEILPMMYLALSYDHRLIDGRESVGFLVTIKELLEDPARLLLDV

SEQ ID NO: 94569 - protein, 597 aa, Ustilago maydis 521
MSTTLSNKLVRWASSHPFVAAFLALVLVSTLYLAWKRASAKPSVWLNLPGPERTSFLTGYSRDPKKKLGVKNPTAPDREPIIGDDGVDITETPGVAIARLYDEYQCDHLVFPRPIGGELLITRDAATMNHILNDSYNYTRSTAGTKATKIIIGNGVVAVFGDEHKKQRKMLAPAFSVDSLRGLMPIFTQATAQMMDRFGKDTSLEKRWGRDVKDSVKWFGRVTLDIIGRAGFDYDFGAVEQGPNGLAVRSTFHDAMTSTMNVSPIDAVVGAFMFFVVPSLLYILPLTENVRKLREMRSELIKCSHKIVAAKAKQIRKELEAGVDAKETFAGKKDILHLLMRANMSPEIRPQDRLTDETLAGQIVTFIFAGHETSGNTMSWCTFFLALDVEYQQKLRQHIQKALKEMGKDGDAITELTWADVNSEEMRPLDLCIQETLRLRPPITTTFRYSTKDDQLPVTTPFKTKDGRTLSTIPITAGQEIAISVTGNNMDPKYFGADPHRFRPDRWNNLPDLHAKSKLPSPYGSFVFNGGPKVCIGSKFAMTEMKVILVNVLAKYRIEPVEGLKYKSVEAVVQRPAVIGFEKEGSQLPLRFVHDPL

SEQ ID NO: 94570 - protein, 447 aa, Burkholderia mallei ATCC 23344
MTSRDERLHRGLEERHINLMALGATIGVGLFLGSATAIRAAGPAILLTYILGGVAIFLIMRALGEMAIDNPVAGAFSRYARDYIGPLAGYLTGWTYWFMWIVTCMAEITAVGVYMHMWFPDVPNWIWTFAALIVMGAVNFIAVKLYGEFEFWFALIKIVTIVLMIAGGALMIVAGVGNGGVPTGVSNLWAYGGFLPNGWPGVVDALPIVMFAYLGVEMLGLTAGEARNPEKSLAKAVNSVFWRVVIFYVGALFVIMSVYPWNQIGTQGSPFVMTFSRLGIPAAAGIINFVVLTAALSSCNSGIFSTARMLFNLAEQGQAPERLASVNRRGVPVHGVLISVALLFVGVVLNYFAPQKVFVWLTSVSTFGAIWTWCVILIAQLRFRRRVSAERLARLPLRVPCYPLSSFVALAFLAFVVVLMAFSPDTRVALVIGPLWIAALTVYYYAS

SEQ ID NO: 94571 - protein, 1391 aa, Oryza sativa Japonica Group
MEDKKQQQQQQREEAEAEEEAPVVPSSLRAAATCRSLSSLSSSLRWDHRGDDDEEEAELRWAAIERLPTLDRMRTSVLSSEAVDVRRLGAAQRRVLVERLVADIQRDNLRLLRKQRRRMERVGVRQPTVEVVSGKPLPTLLNTVLATARGLSRRPHARIPILNDVTGILKPSRLTLLLGPPGCGKTTLLLALAGKLDKNLKVTGEVEYNGANLNTFVPEKTSAYISQYDLHVPEMTVRETLDFSARFQGVGTRAEIMKEVIRREKEAGITPDPDIDTYMKAISVEGLERSMQTDYIMKIMGLDICADIIVGDIMRRGISGGEKKRLTTGEMIVGPSRALFMDEISTGLDSSTTFQIVSCLQQVAHISESTILVSLLQPAPETYDLFDDIILMAEGKIVYHGSKSCIMNFFESCGFKCPERKGAADFLQEVLSKKDQQQYWSRTEETYNFVTIDHFCEKFKASQVGQNLVEELANPFDKSEVYNNALSLNIYSLTKWDLLKACFAREILLMRRNAFIYITKVVQLGLLAVITGTVFLRTHMGVDRAHADYYMGSLFYALILLLVNGFPELAIAVSRLPVFYKQRDYYFYPAWAYAIPSFILKIPLSLVESITWTSISYYLIGYTPEASRFFCQLLILFLVHTGALSLFRCVASYCQTMVASSVGGTMSFLVILLFGGFIIPRLSMPNWLKWGFWISPLSYAEIGLTGNEFLAPRWLKFHSLKRYSDTIWTSATGTSRAIISRDKFSTFDRRGKDMSKDMDNRMPKLQVGNALAPNKTGTMVLPFSPLTISFQDVNYYVDTPVEMREQGYKERKLQLLHNITGAFQPGVLSALMGVTGAGKTTLLDVLAGRKTGGVIEGDIRVGGYPKIQQTFARISGYCEQTDVHSPQITVEESVAYSAWLRLPTEVDSKTRREFVDEVIQTIELDDIRDALVGLPGVSGLSTEQRKRLTIAVELVSNPSVIFMDEPTSGLDARAAAIVMRAVKNVADTGRTVVCTIHQPSIEIFEAFDELMLMKRGGELIYAGPLGLHSCNVIHYFETIPGVPKIKDNYNPSTWMLEVTCASMEAQLGVDFAQIYRESTMCKDKDALVKSLSKPALGTSDLHFPTRFPQKFREQLKACIWKQCLSYWRSPSYNLVRILFITISCIVFGVLFWQQGDINHINDQQGLFTILGCMYGTTLFTGINNCQSVIPFISIERSVVYRERFAGMYSPWAYSLAQVAMEIPYVLVQILLIMFIAYPMIGYAWTAAKFFWFMYTIACTLLYFLYFGMMIVSLTPNIQVASILASMFYTLQNLMSGFIVPAPQIPRWWIWLYYTSPLSWTLNVFFTTQFGDEHQKEISVFGETKSVAAFIKDYFGFRHDLLPLAAIILAMFPILFAILFGLSISKLNFQRR

SEQ ID NO: 94572 - protein, 296 aa, Saccharophagus degradans 2-40
MEYPTIEAIIGNTPLVRLQRLPGCEKNTVLVKLEGNNPGGSVKDRPALSMIQRAEAAGAIKPGDTIIEATSGNTGIALAMVAAVKGYNMILIMPDHMTEERKAAMTAYGAKLILVSKAEGMEGARDLAQAMASRGEGVVLDQFSNTDNPLAHFTGTGPEIWQQTGGTVTHFVSSMGTTGTIVGTSKFLKSQNPNVQVVGLQPAEGAAIPGIRAWPQEYMPTIFTDENIDSVVQMSQQKAEETMRLLAKKEGVFCGVSSGGAVAAALDIAASTEGAVIVAIICDRGDRYLSSGVFNS

SEQ ID NO: 94573 - protein, 480 aa, Triticum aestivum
  misc_feature (246)..(246): Xaa can be any naturally occurring amino acid
MADKVVATYYYPPMEVAAAELGHTAGSKLDDDGRNKRTGTMWTASSHIITAVIGSGVLSLGWAIAQLGWVAGPAVMLLFSLVTYFTSSLLADCYRSGDQSTGKRNYTYMDAVNANLSGVKVQICGVLQYANIVGVSIGYTIAASISMLAIKRANCFHGNGHADPCKVSSVPYMIIFGVAQVFFSQIPDFDQISWLSMLAAAMSFTYSSIGLGLGIVQVIANGGVKGSLAGISIGTVTPMQKVCRSXQASGDMPFAYSYSLILIEIQDTIRAPPPSESTVMKRATMVSVAVTTVFYMLCGCMGYAAFGDAAPGNLLTGFGFYEPFWLLDVANAAIVVHLVGAYQVYCQPLFAFVEKWAAKRWPESTFVTGEVEVPLFRTYKVNMFRATWRTAFVVATTVVSMMLPFFNDVVGFLGALGFWPLTVYFPVEMYVVQKKVPKWSTQWVCLQMLSLGCLAISLAAAAGSIAGIKSDLKVYHPFKT

SEQ ID NO: 94574 - protein, 320 aa, Oryza sativa Japonica Group
MAVTNGVIHASSREPLFSFGVIADVQYADIPDGRSFLGVPRYYRHSISVLQRAVSTWNKQHNIKFSINFGDIIDGYCPKDKSLWAVQKVLDEFEKFDGPTYHMFGNHCLYNLPRGKLVSLLKMPTDSDRAYYDFSPCPEYRFVVLDAYDFSALGWPRDHPVTAEAMKFLEEKNPNSDKNSPDGLVGVDRRFVMFNGGVGKEQLSWLNDVLQDASARRQNVILCSHLPMDPGSASFAALMWNYDEVMAIVRQYKCVKACFAGHDHKGGHSVDSHGVHHRTLEAALECPPGTSAFGHIEVYPDKLLLVGSDKMADTEMCFEP

SEQ ID NO: 94575 - protein, 125 aa, Oryza sativa
MAKTEQKACLIVIDGWGIPSAESPKDGDAITNANTPVMDEFAKSKTGYVELEASSLAVGLPEGLMGNSEVGHLNIGAGRVVWQDVVRIDQAVKTGSFATNEVIKKTMEVAKNGNGRLHLCGLVSH

SEQ ID NO: 94576 - protein, 182 aa, Shewanella sp. MR-4
MPFNLPIALTLFRLFLLPIFVVLFYLPYSWTPFVAAFVFWLAAITDALDGYAARKLKQLTRFGAFLDPVADKLMVITALVLLVDQYADIWLTLPALFMIGREIVISALREWMAELGKRGTVAVSWIGKYKTAAQMVAIIGLIWQYNPLMIQAAFVLLYIAAVLTFWSMMSYILAAWKDLTAE

SEQ ID NO: 94577 - protein, 234 aa, Zea mays
MAGREADKDPELKVLGVWSSPFVIRARVALNLKGLAYRYVEDNLDSKSELLLASNHVHGKVPVLLHDGRPVCESWVIVEYIDEAFPASGPCLLPADPYRRAVDRFWASYVDDKLFPTWIPVYNGRTSEDRVAAARQVVAVLEKFERAFDECSGGKAFFGGDAAGLVDVVLGGFLGWLRASEVMCGVRVIDPAKTPLLAAWADRFAALDGVREVIPDVQRLLEYNKIRRARRGLP

SEQ ID NO: 94578 - protein, 300 aa, uncultured haloarchaeon
MGEFRSHLVSGLSVVSMSEENGSDRSWIAQAHDHSIDAEATAIQEGSAANPRDWPRDAVVSGQMDSEAEYYARLQEAALHAAQSAVTAASTANDNQLIHAIRMYDDLERTANELAERVTEWRLAVEPFSDTDARDIEALASSTPESPAETRLIAVAKQVIKLREERNKESSFIETHASAVCPNLAEMAGPLLAARLLSHAGGLEPLAKTTAGTVQVLGAEDALFAHLNGQASSPKHGIIYIHPAIQQAVESERGSAARALAGKLVIAARVDHYSGEFTPSIHSDLETRMETIHSREAAEE

SEQ ID NO: 94579 - protein, 420 aa, Shewanella sp. MR-4
MSNVRYISNLTRETYALILAGGRGSRLHELTDWRAKPALYFGGKFRIIDFPLSNCINSGIRRVGVVTQYKSHSLIRHVMRGWGHFKKELGESVEILPASQRYSENWYQGTADAVFQNIDIIRHELPKYVMVLSGDHVYRMDYAGLLAAHAESGADMTVSCLEVPVAEAAGAFGVMEVDDEMRILGFEEKPKHPKHSPGNPEKCLASMGNYVFNTEFLFDQLKKDAQNANSDRDFGKDIIPSIIEKHKVFAYPFKSAFPNEQAYWRDVGTLDSFWQANMELLSPTPALNLYDAKWPIWTYQEQLPPAKFVFDDDDRRGMAVDSIISGGCIISGATVRRSVLFNEVRVCSYSVVEDSVVLPDVVVLRHCKIKNAIIDRGCIIPEGTVIGYNHDHDRAKGFRVSEKGITLVTRDMLGLPVGYE

SEQ ID NO: 94580 - protein, 590 aa, Arabidopsis thaliana
MVNSNEEDERRILDVEESLLTQEEVNNHLTGLSSTAEDGSIDIYGNPPSKKKTGNWKACPFILGNECCERLAYYGIAKNLITYYTSELHESNVSAASDVMIWQGTCYITPLIGAVIADSYWGRYWTIASFSAIYFIGMALLTLSASLPVLKPAACAGVAAALCSPATTVQYAVFFTGLYLIALGTGGIKPCVSSFGADQFDDTDPRERVRKASFFNWFYFSINIGSFISSTLLVWVQENVGWGLGFLIPTVFMGVSIASFFIGTPLYRFQKPGGSPITRVCQVLVAAYRKLKLNLPEDISFLYETREKNSMIAGSRKIQHTDGYKFLDKAAVISEYESKSGAFSNPWKLCTVTQVEEVKTLIRMFPIWASGIVYSVLYSQISTLFVQQGRSMNRIIRSFEIPPASFGVFDTLIVLISIPIYDRFLVPFVRRFTGIPKGLTDLQRMGIGLFLSVLSIAAAAIVETVRLQLAQDFVAMSIFWQIPQYILMGIAEVFFFIGRVEFFYDESPDAMRSVCSALALLNTAVGSYLSSLILTLVAYFTALGGKDGWVPDDLNKGHLDYFFWLLVSLGLVNIPVYALICVKHTKKKAL

SEQ ID NO: 94581 - protein, 466 aa, Thermotoga maritima MSB8
MRSTKIVCTVGPRTDSYEMIEKMIDLGVNVFRINTSHGDWNEQEQKILKIKDLREKKKKPVAILIDLAGPKIRTGYLEKEFVELKEGQIFTLTTKEILGNEHIVSVNLSSLPKDVKKGDTILLSDGEIVLEVIETTDTEVKTVVKVGGKITHRRGVNVPTADLSVESITDRDREFIKLGTLHDVEFFALSFVRKPEDVLKAKEEIRKHGKEIPVISKIETKKALERLEEIIKVSDGIMVARGDLGVEIPIEEVPIVQKEIIKLSKYYSKPVIVATQILESMIENPFPTRAEVTDIANAIFDGADALLLTAETAVGKHPLEAIKVLSKVAKEAEKKLEFFRTIEYDTSDISEAISHACWQLSESLNAKLIITPTISGSTAVRVSKYNVSQPIVALTPEEKTYYRLSLVRKVIPVLAEKCSQELEFIEKGLKKVEEMGLAEKGDLVVLTSGVPGKVGTTNTIRVLKVD

SEQ ID NO: 94582 - protein, 471 aa, Ostreococcus tauri
  misc_feature (1)..(1): Xaa can be any naturally occurring amino acid
XSPTGLEALERGSEQWNEGSDVESALGDQRKTPLKGCKKNRMDQAGTLRIRDVDTGKEFVMHKAEASALLTAHHATRKIVKDATTGTPLSVDRFVNEVGLPNGKPHVHVHAKGGQKEFKDLRVIQTLNAHEGAIWTLEFSKDGKFLATAGQDRIVRVWKTSLDSKKRGDNLFDDAPVRLYKGHRGDILDLCWSHTDWLLSSSMDKTVRLWYTTMEECLRIFTHQDFVTSISFNPVDDKYFMSGSLDGKIRLWNIPDLKVVDWVDIGEMVTSCTFTPDGTRAFVGTHKGSCHSYGTEGFKFEYSHQIQIKNARSSKGVGRKITGLDVKLFGEEERLLVTSNDSRLRLFDSEAVPPRVLCKFKGHHNQNAQIQATFSSDGEFLISGSEQPDVFIWRANMMGVQGCCAGPTQKQRAYEKFRTEEQHVTVAKFVPDEVRNSRAFPLEQLTGALGRIIVSTGYTGKVHVFENLSAK

SEQ ID NO: 94583 - protein, 804 aa, Vibrio vulnificus YJ016
MPIPTKAAMFLEKDMQKNTLWFNSLSMEDVDKVGGKNASLGEMVSNLANAGVSVPNGFATTSYAFNQFLDYEGLDERIHQLLDELDVDDVDALRKTGATIRQWVLEAPFPADLEQDIRENYSTLTDGNDEISVAVRSSATAEDLPDASFAGQQETFLNVRGIDAVLEATKHVYASLFNDRAISYRVHQGFDHRGIALSAGIQRMVRSDKAASGVMFTLDTESGFDKVVFITSAWGLGEMVVQGAVNPDEFYVHKPLLEAGQAPIVKKTFGSKLSKMIYANSQVIGKQVEIVDTSEAERNQFSLTDAEIVELAKQAMIIEKHYQRPMDIEWAKDGIDGQLYIVQARPETVCSQSDANVIERYELSHKAEVLIEGRAIGQRIGSGVVRLVDSLDQMSLVQTGDVLVTDMTDPDWEPVMKKASAIVTNRGGRTCHAAIIARELGIPAIVGCGNATSQLTDGDLVTVSCAEGETGYVYQGQLDFEVRRSSVDELPMLPTKVMMNVGNPDRAFDFAQIPNEGVGLARLEFIINKMIGIHPKALLNFDQQSESLKAEISQRIRGYQDPIDFYVSKLTEGIATIASAFWPKRVIVRMSDFKSNEYSNLVGGKAYEPHEENPMLGFRGASRYISPVFEDCFELETQAIKRVRNEMGLKNVEIMIPFVRTPSEAAQVVDLLAKFDLRRGEQGLKVIMMCELPSNAVLADEFLKYFDGFSIGSNDMTQLTLGLDRDSGDVAHLFDERNPAVKAMLKMAIDAATKAGKYVGICGQGPSDHEDFAEWLMEQGISSVSLNPDTVIDTWIQLGKANQK

SEQ ID NO: 94584 - protein, 454 aa, Populus sieboldii x Populus grandidentata
DLNHRNLTDLAKKFGDILLLRMGQRNLVVVSSPDLAKEVLHTQGVEFGSRTRNVVFDIFTGKGQDMVFTVYGEHWRKMRRIMTVPFFTNKVVQQYRHGWEEEAAQVVEDVKKNPEAATHGIVLRRRLQLMMYNNMYRIMFDRRFESEEDPLFNKLKALNGERSRLAQSFDYNYGDFIPILRPFLRGYLKICKEVKERRLQLFKDYFVEERKKLGSTKSMSNEGLKCAIDHILDAQKKGEINEDNVLYIVENINVAAIETTLWSIEWGIAELVNHPEIQKKLRDELDTVLGPGHQITEPDTYKLPYLNAVIKETLRLRMAIPLLVPHMNLHDAKLGGFDIPAESKILVNAWWLANNPAKWKNPEEFRPERFFEEEAKVEANGNDFRYLPFGVGRRSCPGIILALPILGITLGRLVQNFELLPPPGQSKIDTSEKGGQFSLHILKHSTIVAKPRSF

SEQ ID NO: 94585 - protein, 515 aa, Oryza sativa
MRDAILVVVVGVLFLMVAVVVMTRLGDGGAAPSPPAMPVLGHLHLIKKPLHRSLAEVAARVGAAPVVSLRLGARRALLVSTHAAAEECFTACDAAVAGRPRLLAGDVLGYGHTTVVWASHGDHWRALRRLLGVELFSNARLAALAADRRAEVASLVDAVLRDAAAGGGGGGTVTLRPRLFELVLNVMLRAVTARRHAGDETRRFQEIVEETFAASGSPTVGDFFPALRWVDRLRGVVATLQSLQKRRDAFVAGLVDDHRRTRRAAAAAADKDQKKNGIIDALLTLQETDPDHYTDNVVKGIVLVLLTAGTDTSALTTEWAMAQLVAHPEAMTKVRAEIDANVGAARLVEEADMASLPYLQCVVKETLRLRPVGPVIPAHEAMEDCKVGGYHVRRGTMILVNAWAIHRDGDVWGSPEEFRPERFMDDGAGAGAVTAVTAPMLPFGLGRRRCPGEGLAVRLVGLTVAALVQCFDWEIGEGGAVDMAEGGGLTMPMATPLAAVCRPREFVKTVVSDCF

SEQ ID NO: 94586 - protein, 210 aa, Neorickettsia sennetsu str. Miyayama
MFSTVEEVIHQLKERNKPFVLVDSSDRENEGDIVVPVQILTSEIMNFVVTHCRGLPCVCVTKSLCEKLGLDLIKRSDSCESSNVARFVTTIEAKEGVSTGISVRDRVRTMRLLANDNVDKDSFVSPGHVFPLMIEEGGLMVRSGHTEGAATFARLAGFKSESMLCEILDEAGDAARLPYLTDFARKYDLCLTSIDLLITYLKEKGTSILF

SEQ ID NO: 94587 - protein, 317 aa, Xylella fastidiosa Dixon
MHSVVVVGSFSIDHVWRCDTLPTPGATIAGRYSRGPGGKGFNQAVAACRAGARTYFICALGNDTDGNMARDIATKDGFTLIGESSTEPTGTGGIYVDSHGHNTIVTGAGANAVLSTHFITEQRALITSAWIVLAQLESPIETLETALRMAREAGRLTILNAAPANATATINLLKLADVLTLNETEFVALLSRHVGERISPDNVATTDGNTLHALCNKLLSSSTVVITLGSAGVFVSHSEENLRGDTQPYYRVAAEQAHTVDTTGAGDAFNGALAASLARQPNTAFIQHIRLANSYAARSTETEGGAVSMPILTTTSD

SEQ ID NO: 94588 - protein, 488 aa, Chlamydomonas reinhardtii
MATLAESFLADLEDLDEDEPEQESGSEEEAAEADDGMDDIETLNFDDLKACAKLTSEPRYSDVLTRVRAAVAAAAEDGGAGERKQDVPLEEDPTYKLLVECNRLAVDIDNEIAVVHNFIRDKYRPKFPELESLVHHPLDYARVVQRVGNEMDLTLVPLDDMLPAATVMVVTVTATTTSGKPLDEDALGRVMQGCDMAIQLDEDKRTILHFVESKMNKVAPNLSALVGTEIAAKLMGVAGGLLALSRMPSCNVQVLGAKRRTLAGFSSTTAQPHQGFIFSCPIMATTPPPLKNKAVRLIAAKSTLLARKDAYGEDPSGAYGAGMHAEVVRKIEKWQEPPPAKQIKPLPVPDAEQKKRRGGRRLRKMKERYGLTDVRKAANRMMFNQAEEEFVDGEDTIGLGVLGKEGSGRLRVVASQQKQKLSAKAQKKFKSRAYGSSGATSGLSSSLAFTPVQGIELENPQARFGEMDAKDGTQSYFSQFGGFRSIKK

SEQ ID NO: 94589 - protein, 168 aa, Avena sterilis subsp. ludoviciana
VMASSATSVAPFQGLKSTAGLPVSRRSNAGLGSVSNGGRIRCMQVWPIEGIKKFETLSYLPPLTEEALLKQIDFLIRSKWVPCLEFSQGGFIFREHGSTPGYYDGRYWTMWKLPMFGCTDASQVIKEVEEVKKEYPDAYVRIIGFDNIRQVQCVSFIAFKPPGCEESG

SEQ ID NO: 94590 - protein, 363 aa, Anabaena variabilis ATCC 29413
MTLSLSVAKSHRQPWPGLIEAYREYLPVSEQTPVVTLLEGNTPLIPVPAIAERIGRQVSVFVKYDGLNPTGSFKDRGMTMAISKAKEAGAKAVICASTGNTSAAAAAYARRGGMKAFVLIPDGYVALGKLAQALLYGAEVLAIKGNFDRALEIVREMAETYPITLVNSVNPYRLEGQKTGAFEVVDALGNAPDWLCIPVGNAGNITAYWMGFCQYHQAGKCDRLPQMMGFQAAGAAPLVNGQPVSHPETIATAIRIGNPASWDKAIAAQSASQGSFNAVTDEEILDAYRLLASSEGIFCEPASAASVAGLLKVKDQVPTGATVVCVLTGNGLKDPDTAIKHSHSQFKQGLEADLKDVAKAMGF

SEQ ID NO: 94591 - protein, 888 aa, Chlamydomonas reinhardtii
MAPIRRIYGFARGSSDGNKSMKELLGGKGAYLCEMARCGLNVPPGFTITTEVCEEFYANGGMLPEALKTEVKAAVAVVEADMGLKFGDVNTPLLVSVRSGAAVSMPGMMDTVLNLGLNDAIVEGFAAKYGARFAMDCYRRLMQMFGDVVLEIPHEAFEAKLAALKGRKGVQYDVQLDADDLRELIAAYKQVYAEHKQELPQDPWQQLYLGINAVFKSWNIPRAIKYREINKITGLKGTAVNVQTMVYGNMGESSGTGVCFTRNPANGASELFGEFLINAQGEDVVAGIRTPMPIKLMADVMPPIYAELVANTTMLEKHMKDMQDVEFTVQEGRLFMLQCRSGKRTGTAALRIALELQAEGIIDRDEAVLMVEPRHLDQLLHPQFESDKGYAKDVITRGLAASPGAAVGRLVFSAAEAEEWKARGERVILCRHETSPEDVGGMHAAEGIVTCRGGMTSHAAVVARGWGKPCVCGCEHLHIDLKTKLHGAEVRLREGDWVSLNGTSGEVINGAQPLKAPEVTGGDLGKLMAWVDKARRLRVLANVDTPEDAAIARANGAQGIGLCRTEHMFFSTHERIAAMRRMIAEEELASSHKLEALEALKAFQREDFEGIFKAMDGLPVTIRLLDPPLHEFLPQEGPAMAALCRQLAGELGASVERVEARLNGLREVNPMMGLRGCRLGIVHPEITDMQATAILEAATRVAAAGGHVHPHIMVPLVATTDEMDHQLHVIHAAAKRVAAATGEKVPYKVGTMIEVPRAALQAGPLAERADFFSFGTNDLTQMTYGISRDDAQAKFLTTYTHNGILQSDPFDTLDVVGVGEMVRIAVERGRAAKPDLELGICGEHGGDPNSIAFFNKVGLDYVSCSPLRVPIARLAAAQAAIKAAAKAK

SEQ ID NO: 94592 - protein, 354 aa, Glycine max
MAMHGTSCLVPSVLELAKQPIIEVPERYVHANQDPHILSNTISLPQVPIIDLHQLLSEDPSELEKLDHACKEWGFFQLINHGVDPPVVENMKIGVQEFFNLPMEEKQKFWQTPEDMQGFGQLFVVSEEQKLEWADMFYAHTFPLHSRNPHLIPKIPQPFRENLENYCLELRKMCITIIGLMKKALKIKTNELSELFEDPSQGIRMNYYPPCPQPERVIGINPHSDSGALTILLQVNEVEGLQIRKDGKWIPVKPLSNAFVINVGDMLEILTNGIYRSIEHRGIVNSEKERISIAMFHRPQMSRVIGPAPSLVTPERPALFKRIGVADYLNGFLKRELKGKSYMDVIRIQNEIGK

SEQ ID NO: 94593 - protein, 436 aa, Marinobacter sp. ELB17
MSNNTNHLLDDAQSRMADIYERLEVADDSRHRLGQPKRIHQASLSVRMDDGSLRVFPAWRVQYDDTRGPTKGGIRFHPNVTEDEVATLSLWMTLKCAAVDLPFGGAKGGICVDPKTLSRLELERLSRGYIRAFHDVIGPDRDIPAPDVNTNAIVMGWMVDEYAQIARRHVPGVITGKPLGLGGSIGREEATGAGALQVLDLWAKRQNKEPHELSVAIQGFGNAGQNFARLAHHAGYKIVALSDSQGAIYNEDGLDPEPILRHKNRTRELKGMVYCGDSVCDAAETETQTLSGDELLQLDVDVLVLAALENQITDANADHIRAKTIVEIANGPISTGGDQILQGRDITVIPDIVANAGGVIVSHLEWVQNRMGDYWSGDTVEKQLRQRLEREANACFDLADEKAVPLRTAAYLQGVRRIVDAMAQQGTQGYFNDRRG

SEQ ID NO: 94594 - protein, 379 aa, Mycobacterium smegmatis str. MC2 155
MSHSQIFPTPTDTRTISAALVRATGEPFVITDLALTGPRADEILVRVDAVGICHADTQAQTGALPVPAPMVAGHEGTGIVEEVGSDVQHLKCGDRVILTFDSCGGCDRCRSGIPTQCREFVNRNFTAGARPDGTARLHLDTNAVNGSFFGQSSFATYALATERNAVAVSTQLPPELLAPVGCAIQTGVGTVLDVLAPPPAAPVVVFGAGAVGLSAVMAAAATGHEVVAVDTKPERLDLARKLGATHVVDPARADVTRAITAIMPGGAPHVFESSGAPVALIAGVEALAPGGTIAVVGTSAAGVTVGIDVVDLVNKSKHIVGVVEGASRPHESIPRLVKMIEDGALPVHEIVTTFPLEDIAAAIDAAKSGRVVKPVLLPH

SEQ ID NO: 94595 - protein, 467 aa, Marinobacter sp. ELB17
MSDNNVHIAVIGSGGSAMAAALKATERGARVTLIERGTIGGTCVNIGCVPSKIMIRAAHIAHLRRKSPFDEGITATEPMVDRSLLLAQQQARVDELRHAKYERILEDNPDITVVQGEARFMDARTLLVKGTDGKAHEIGFDRAFIGTGARPTIPPIPGLSGTPYWTSTTALASDTLPDRLIVIGASVVAVELAQAFARLGSEVTILARSRLLSREDPAVGEAIQTAFQAERISVLNDTQASQVSYTNDEFIVASNAGELRADRLLVAVGRTPNTEGLNLDAIDVETDHGAVIVNEQLQTRVPGIYAAGDCTNQPQFVYVAAAGGSRAAVNMTGGDARLDLSAMPAVIFTDPQIATAGLSEAEAEARGYATDSRTLTLDNVPRALVNFDTGGFIKIVAERDSGQLLGVQAVAGEAGELIQTAVMALRARMTVQEIGNELFPYLTMVEGLKLCAQTFTKDVTQLSCCAG

SEQ ID NO: 94596 - protein, 579 aa, Arabidopsis thaliana
MAQVVATRSIQGSMLSPNGGSVSTRSEKLLKPASFAVKVLGNEAKRSGRVSVRSRRVVDTTVRSARVETEVIPVSPEDVPNREEQLERLLEMQQFGDTSVGMWSKPTVRRKTKIVCTVGPSTNTREMIWKLAEAGMNVARMNMSHGDHASHKKVIDLVKEYNAQTKDNTIAIMLDTKGPEVRSGDLPQPIMLDPGQEFTFTIERGVSTPSCVSVNYDDFVNDVEAGDMLLVDGGMMSFMVKSKTKDSVKCEVVDGGELKSRRHLNVRGKSATLPSITEKDWEDIKFGVENKVDFYAVSFVKDAQVVHELKKYLQNSGADIHVIVKIESADSIPNLHSIITASDGAMVARGDLGAELPIEEVPILQEEIINLCRSMGKAVIVATNMLESMIVHPTPTRAEVSDIAIAVREGADAVMLSGETAHGKFPLKAAGVMHTVALRTEATITSGEMPPNLGQAFKNHMSEMFAYHATMMSNTLGTSTVVFTRTGFMAILLSHYRPSGTIYAFTNEKKIQQRLALYQGVCPIYMEFTDDAEETFANALATLLKQGMVKKGEEIAIVQSGTQPIWRSQSTHNIQVRKV

SEQ ID NO: 94597 - protein, 358 aa, Oryza sativa Indica Group
MSAYCGKYKDELIKNAAYIGTPGKGILAADESTGTIGKRFASINVENVEENRRSLRELLFCTPGALQYLSGVILFEETLYQKTKDGKLFVDVLKEGGVLPGIKVDKGTIEVAGTEKETTTQGHDDLGKRCAKYYEAGARFAKWRAVLKIGPNEPSQLAIDLNAQGLARYAIICQENGLVPIVEPEILVDGPHDIDRCAYVSEVVLAACYKALNEHHVLLEGTLLKPNMVTPGSDAKKVSPEVIAEYTVRTLQRTVPAAVPAIVFLSGGQSEEEATLNLNAMNKLSTKKPWSLSFSFGRALQQSTLKAWSGKAENIEKARAAFLTRCKANSEATLGTYKGDAVLGEGASESLHVKDYKY

SEQ ID NO: 94598 - protein, 803 aa, Methanosarcina barkeri str. Fusaro
MSDSKNKYIRWFEETTIDDVPIVGGKNASLGEMYRELTSKGVKIPNGFSVTAEAYWHILEAGGILEKLKSMMEGLDTSNIADLARRGKAARDLILGAGIPDDLWQEIKSGYDRLCEQYGEDTDVAVRSSATAEDLPTASFAGQQETYLNIRGYPGLRDACIRCFASLFTDRAISYRVTNKFDHFKVALSIGIMKMVRSDLASSGVIFTLDTETGFRDVVFITGAYGLGENIVQGQVNPDEFYVFKPTFRQGFKPIVKKKVGSKEIKMIYGRGDSKVLTRNVEVPEADRLRFCLSDEEVLKLSGYAIAIEDHYSEKYGESRPMDIEWAKDGITDELFIVQARPETVQSQRRKDILETYVLEKRSEILARGRSVGDKIASGKAHVIPDISDLPSFKPGEILIADTTTPDWEPVMKNAAAIVTNKGGRTCHAAIVSRELGIPAVVGAGNATEVLETGREITVSCAEGEEGLVYDGILPFHKDTLSLKDMKRPKTDIMMNLGNPEEAFGFSMIPNDGIGLARLEFIITSYIKVHPMALVHPEKVKDLKVLQEIEQLTRGYRREDYFVEQLAQGVSTIAAAFYPKPVVVRMSDFKTNEYASLLGGSYFEMEESNPMIGFRGASRYFDERYREGYALECRAMKKVRDEMGLTNLILMIPFCRTVEEARKVIDEMEKNGLKRGENGLQVYVMCEIPNNVLLIDEFSDFFDGFSIGSNDLTQLTLGVDRDSELLAAEFDERDPGVMKIMSMAVQGAKRNGRHSGICGQAPSDFPEIAEFLVKEKINSISLNPDSVMKITLKVLETEKELGR

SEQ ID NO: 94599 - protein, 334 aa, Mycobacterium smegmatis str. MC2 155
MAIDDFPRYPLTFGPSPIHPLERLTKHLGGAQIWAKREDVNSGLAYGGNKTRKLEYLIPDALAQGADTLVSIGGVQSNHTRQVAAVAAKLGMKAVLVQEKWVDWPDSVNDKVGNILLSRVMGADVRLDASGFGIEFKDSWRNAIEDVKNAGGTPYAIPAGASDHPLGGLGFANWAYEVQRQEQELGVFFDTIVVCTVTGSTHAGMIAGFAGQNRPRRVIGIDASATIDKTREQVTRIARNTADRIGLGRDLHDDEITVLEGWAGELYGIPVQSTIDAIKLTGRLEGVILDPVYEGKSMAGLIDLVRSGEIPPSSTVLYAHLGGQPALNAYSGIF

SEQ ID NO: 94600 - protein, 376 aa, Glycine max
MSFSRLLRVQNPGLCLLFNYSQPLTSSSSSSLPLTRDRAALTFTTKVSYSSDMVKAIRVHELGGPQVLKWEDVEIGDPKEGEVRVRNKAIGVNFIDVYFRKGVYKAPSFPFTPGMEAVGVVTAVGAGLTGRQVGDLVAYAGQPMGSYAEEQILPANKVVPVPSSIDPAVAASIILKGMTTQFLLRRCFQVEPGHTILVHAAAGGVGSLLCQWANALGATVIGTVSNKEKAAQAKEDGCHHVIIYKEEDFVARVNEITSGNGVEVVYDSVGKDTFEGSLACLKLRGYMVSFGQSSGSPDPVPLSSLAAKSLFLTRPSLMQYVVTRDELLEAAGEVFANVASGVLKVRVNHTYPLSEAAKAHEDLENRKTSGSVVLIP

SEQ ID NO: 94601 - protein, 496 aa, Legionella pneumophila str. Lens
MLLKAESKYPCDLILFGTLGDLSCRKLLPALYQLELANLLHEKTRIIGCAREELDFSAYVDLIKNKIQQFLFDEIDEAVWLRFVKKLAYCKLDLNQSDDYQKLTDYVNPSERVVISYLAIPPSLYSQTCRSLARLNLTQKPSRVVLEKPIGHDLPSSVATNEQVACFFAEDQIYRIDHYLGKETVLNLLVLRFANSIFSTNWDNRVIDRVEISVAEEIGVEGRWEYYDKSGQVRDMLQNHLLQILSLVAMEPPLSLSAESIRSEKLKVLKSLRFINKSNVHDHTVRAQYVANTLANGKKIPGYLEEVGANQASTTETFVAIKAYVDNWRWSGVPFYMLTGKRLPKKQSEVVIYFKPQPYNIFHPLNEELYPNQLIIRLQPDEGVEVRIMNKIPGLGERMMLHDSKLDLNFHHSFKTQRIADAYERLLLEVMLGNQYLFVSREEIEQAWQWIDSIVSAWEEDNIPLYTYPACTWGPKEVIRLFNGQAHVWGDHNAVS

SEQ ID NO: 94602 - protein, 376 aa, Brassica napus
MGWIPCSGKSSGKTKKRSDSDENLSRNCSVSASERSKAKSSVSESRSRGSDNIVAQTFTFSELATATRNFRKECLIGEGGFGRVYKGYLASTGQTAAIKQLDHNGLQGNREFLVEVLMLSLLHHPNLVNLIGYCADGDQRLLVYEYMPLGSLEDHLHDISPSKQPLDWNTRMKIAAGAAKGLEYLHDKTMPPVIYRDLKCSNILLGDDYFPKLSDFGLAKLGPVGDKSHVSTRVMGTYGYCAPEYAMTGQLTLKSDVYSFGVVLLEIITGRKAIDNSRCTGEQNLVAWARPLFKDRRKFSQMADPMIQGQYPPRGLYQALAVAAMCVQEQPNLRPVIADVVTALTYLASQRFDPMSQPVQGSLFGPGTPPRSKRVV

SEQ ID NO: 94603 - protein, 438 aa, Thermotoga maritima MSB8
MKDILKELKKKLSEEDFNKFNGRVTRVVGLTVESKGPDAFLGEMCKISLQNGKNALAEVVGFREESVILMPYEDVSGLKMGCEVIRTNKVLEVGVSRKMIGRVFDGLGRPIDGKPFVPEDRYPLINNPPNPLKRRRIKDPLPVGIRSIDGFITIGKGQRIGIFAGSGVGKSTLLGMIARNTTADINVLALIGERGREVREFIERDLGEEGLKRSILVVSTSDQPALARVKSLLTATSIAEFFRDLGYDVLLMVDSLTRWAMAQREVGLAVGEPPTTRGYPPSVFAGLPKILERAGNSDKGSITAIYTVLVEADDFNEPISDTVRSIVDGHIILSRRLAESNHYPAVDVLASVSRLMNDIVTEEHREAANRLRSLMSAYESAKDLIEIGAYKSGTNPLVDKAVEMKDEIDSFLKQGVFEKASFEETLQKLLDLYLRSLD

SEQ ID NO: 94604 - protein, 162 aa, Malassezia pachydermatis
MSNVFFDITKNGSPLDPIKFKLFDDVVPKTTANFRALCTGEKGFGYAGSHFHRVIPNFMLQGGDFTAGNGTGGKSIYGAKFADENFQLKHSKPGLLSMANAGPNTNGSQFFITTVVAPWLDGKHVVFGEVIEGMDVVKAIEAEGSNSGKTSSRIEIAKCGAC

SEQ ID NO: 94605 - protein, 251 aa, Shewanella oneidensis MR-1
MSEGESKSTHFGYKTVEADKKADLVAGVFHSVAAKYDIMNDVMSFGIHRFWKRYTIEVSGARPGMKVLDLAGGTGDLTAKFSHLVGDKGEVVLADINDSMLKVGRTKLRDRGIVSNVSYVQANAEALPFPDNHFDIITIAFGLRNVTDKDAALRSMNRVLKPGGKLLVLEFSKPQHEVMRKVYDLYSFKVLPKMGQLITKDADSYEYLAESIRMHPDQDTLKQMMVDAGFEQVDYTNMTDGIVALHRGYKF

SEQ ID NO: 94606 - protein, 408 aa, Salmonella enterica subsp. enterica serovar Typhi str. CT18
MSLSVTRENFDEWMVPVYVPAPFIPVRGEGSRLWDQQGKEYIDFAGGIAVNALGHAHPALREALNEQANRFWHTGNGYTNEPALRLAKKLIDATFAERVFFCNSGAEANEAALKLARKYAHDRVGNHKSGIVAFKNAFHGRTLFTVSAGGQPTYSQDFAPLPPDIRHAAYNDLNSASALIDDNTCAVIVEPVQGEGGVIPATNAFLQGLRELCDRHQALLIFDEVQTGVGRTGELYAYMHYGVTPDILTTAKALGGGFPIGAMLTTQDYASVMTPGTHGTTYGGNPLATAVAGKVLDIINTPEMQNGVRQRHDAFIERLNTINVRFGMFSEIRGLGLLLGCVLQTEFAGKAKLIAQEAAKAGVMVLIAGGDVVRFAPALNVSDEEIATGLDRFALACERLQAGGASCG

SEQ ID NO: 94607 - protein, 501 aa, Brassica napus
MDPHKKVTLETEFFTEYGEASRYQIQEVIGKGSYGVVASAIDTHTGEKVAIKKINDVFEHVSDATRILREIKLLRLLRHPDIVEIKHVMLPPSRREFRDIYVVFELMESDLHQVIKANDDLTPEHYQFFLYQLLRGLKFIHTANVFHRDLKPKNILANSDCKLKICDFGLARVSFNDAPSAIFWTDYVATRWYRAPELCGSFFSKYTPAIDIWSIGCIFAEMLTGKPLFPGKNVVHQLDIMTDLLGTPSPEAISRIRNEKARRYLGNMRRKPPVPFTHKFPHVDPLALRLLHRLLAFDPKDRPTAEEALADPYFYGLANVDREPSTQPIPKLEFEFERRKIMKEDVRELIYREILEYHPRMLQEYLRGGEQTSFMYPSGVDRFKRQFAHLEEHYGKGERSAPLQQRHASLPRERVPAPKEENRPAATLATTPESPQSSQHEGSNYMNGMSQTGYSARSLLKSASISASKCIGVKQRNQSEHGESNSDATDALSQKAAALHT

SEQ ID NO: 94608 - protein, 312 aa, Thermotoga maritima MSB8
MRIDLSLKPTPVQFLKRLSEKYGFNIYVKRDDLTELVGSGNKIRKLEYLLWEALKKGATTVFTCGGLQSNHARATAYVSRRYGLKPVLFLRKGEKVLNGNLLLDILLGAEIVEVSPEEYERIDEIFDVHKKMREKKGEKVYVIPEGGSNSLGAFGYFNAVLEMKDQLNLESFDAIVCAVGSGGTIAGLSAGISFLEYHVPVVGVNVTTKNSDYFVGKVKRIISGMEEYGLRVNETVFEVVDDYRGPGYAIPSSEDVEILKEVASIEGIILDPVYTAKAFRGMIEMFRNSEKNVLFIHTGGIFGLFAQSRRLV

SEQ ID NO: 94609 - protein, 447 aa, Salmonella enterica subsp. enterica serovar Typhi str. CT18
MDQTCSLESFLNHVQKRDPHQTEFAQAVREVMTTLWPFLEQNPRYRHMSLLERLVEPERVIQFRVVWLDDKNQVQVNRAWRVQFNSAIGPYKGGMRFHPSVNLSILKFLGFEQTFKNALTTLPMGGGKGGSDFDPKGKSEGEVMRFCQALMTELYRHLGPDTDVPAGDIGVGGREVGFMAGMMRKLSNNSACVFTGKGLSFGGSLIRPEATGYGLVYFTEAMLKRHGLGFEGMRVAVSGSGNVAQYAIEKAMAFGARVVTASDSSGTVVDESGFTPEKLARLCEIKASRDGRVADYAREFGLTYLEGQQPWSVPVDIALPCATQNELDVDAARVLIANGVKAVAEGANMPTTIEATDLFLEAGVLFAPGKAANAGGVATSGLEMAQNAARLSWKAEKVDARLHHIMLDIHHACVKYGGDNKHTNYVQGANIAGFVKVADAMLAQGVI

SEQ ID NO: 94610 - protein, 194 aa, Brassica napus
MGEMIVSLDDDIPLDSTRARFSNLLKRHQQLTDRLTRDSDKMIFDRLSKEFEAARASQSQEVCLDGEEWNDGLLATLRERVHMEADKKDSGSSGFAPVSHPEERIAYRVGNKVIYCLEGARIGIQYETSFAGETYEIYHCVLESKSFLEKMNVLEHTIPFFLPLRDLENDLLSSNAKKFIDNVGDLLHAYVGKE

SEQ ID NO: 94611 - protein, 581 aa, Vibrio sp. Ex25
MDADTINSFFLIGALLIALSVLLSPVSSKLGIPILLVFLAVGMLAGEDGLGGILFDNFSIAYLVSNLALAIILLDGGMRTRVASFRVALWPSVSLATFGVAITTILTGLMATWLFDLDLLQGILVGAIVGSTDAAAVFSLLKGRSLNERVGSTLEIESGTNDPMAVFLTVTLIAILANPDADLSVGFLALSFLKQFGIGALLGFAGGWILWKVINRNQLPDGLYSILTVSGGLLIFALSNALGGSGILSIYLVGLLLGNRPTRSRHSILHVLDGMTWLAQIGMFLVLGLLVTPSNLLSIALPGLALAFGMILFARPISVWIGLLPFKSFTPREKWFVSWVGLRGAVPIILAVFPMMAGLPDAQLYFNLAFFVVMVSLIVQGGTLTKAMSLAKVELPSKPEPISRTGVEIYPTSEWELFIYKLKADKWCIGEPLRSLSMPDGTRIAAVFRNKALLHPSGSTRLEEDDTLCVLAQEKDLDALSLLFSEAPEKASLARFFGDFFLDIEVNLADIAMMYGLNLGDESLDKSLRHLVEEQLGTTPVLGDQFEWQGLQWIIADVVDQQVTKVGIRLPSEQSLLADEE

SEQ ID NO: 94612 - protein, 339 aa, Chlamydomonas reinhardtii
MGLVYSRADDAKAPPAKAGPGGDSSPPPMPNFSFASQAAAVAKEIKESERPNYLELPQPVRYEDIQREGIISLKPDTFEGLRFEINKPLNQHFFLSHNLFMGNMELQTGGRQIIKTPVGTYEFGATTVSESQNLVLMGRLASDGRLSGRIKYDVANWLGFKVQAQLANAANQSQVMLDTDVKGGDWNAQLKLGAPGFVGLNYFQSLTPKLSAGGEFFYLPSNPKSGVGLALRHQGDKHVATCQVATTGLMNMQYTHKVTEKVTLAADFMWHLLSRDVTATVGYDVVLRQCRIRGKADTNGVITTLLEERFSPGINFVLSAEMDHWQSNYKFGFGIVAGE

SEQ ID NO: 94613 - protein, 364 aa, Burkholderia mallei ATCC 23344
MSLKCGIVGLPNVGKSTLFNALTKAGIAAENYPFCTIEPNVGVVEVPDARLKALAEIIKPERVVPAVVEFVDIAGLVAGASKGEGLGNQFLANIRETDAITHVVRCFEDENVIHVAGKVSPLDDIEVINTELALADLGTVEKALARYSKAAKSGNDKEAAKLVAVLDKARAHLDQGKAVRGLDLSDDERALLKPFCLITAKPAMYVANVKEDGFENNPHLDAVRRYAESEKSPVVAVCAAIEAEIADLDDADKEAFLADMGMDEPGLDRVIRAGFKLLGLQTYFTAGVKEVRAWTIHIGDTAPQAAGVIHTDFERGFIRAQTIAYDDFIAYKGEQGAKEAGKMRAEGKEYVVHDGDVMNFLFNV

SEQ ID NO: 94614 - DNA, 11722 bp, Zea mays
cgcgcctgcctgcaggtactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggagcttaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagctccctccctccgcttccaaagaaacgccccccatcgccactatatacatacccccccctctcctcccatccccccaacccttctagaaccatcttccacacactcaagccacactattggagaacacacagggacaacacaccataagatccaagggaggcctccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaagcggaccggtcgcgcctcagcagtcgctgtcgttaacccagcggtactcgctgaggcgatcgcgggcccggtaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgacctgcaggatttaaatccatcgttctggggcctaacgggccaagcttactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccaccaccaccacctccacctcctcccccctcgctgccggacgacgagctcctcccccctccccctccgccgccgccgcgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaagtgatcaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgcttcacggtgcaagcagccggcccgcaaccgcccgcaaatcctctggcctttccggaaccgtccgcattcccggcgacaagtcgatctcccaccggtccttcatgttcggcggtctcgcgagcggtgaaacgcgcatcaccggccttctggaaggcgaggacgtcatcaatacgggcaaggccatgcaggcgatgggcgcccgcatccgtaaggaaggcgacacctggatcatcgatggcgtcggcaatggcggcctcctggcgcctgaggcgccgctcgatttcggcaatgccgccacgggctgccgcctgacgatgggcctcgtcggggtctacgatttcgacagcaccttcatcggcgacgcctcgctcacaaagcgcccgatgggccgcgtgttgaacccgctgcgcgaaatgggcgtgcaggtgaaatcggaagacggtgaccgtcttcccgttaccttgcgcgggccgaagacgccgacgccgatcacctaccgcgtgccgatggcctccgcacaggtgaagtccgccgtgctgctcgccggcctcaacacgcccggcatcacgacggtcatcgagccgatcatgacgcgcgatcatacggaaaagatgctgcagggctttggcgccaaccttaccgtcgagacggatgcggacggcgtgcgcaccatccgcctggaaggccgcggcaagctcaccggccaagtcatcgacgtgccgggcgacccgtcctcgacggccttcccgctggttgcggccctgcttgttccgggctccgacgtcaccatcctcaacgtgctgatgaaccccacccgcaccggcctcatcctgacgctgcaggaaatgggcgccgacatcgaagtcatcaacccgcgccttgccggcggcgaagacgtggcggacctgcgcgttcgctcctccacgctgaagggcgtcacggtgccggaagaccgcgcgccttcgatgatcgacgaatatccgattctcgctgtcgccgccgccttcgcggaaggggcgaccgtgatgaacggtctggaagaactccgcgtcaaggaaagcgaccgcctctcggccgtcgccaatggcctcaagctcaatggcgtggattgcgatgagggcgagacgtcgctcgtcgtgcgtggccgccctgacggcaaggggctcggcaacgcctcgggcgccgccgtcgccacccatctcgatcaccgcatcgccatgagcttcctcgtcatgggcctcgtgtcggaaaaccctgtcacggtggacgatgccacgatgatcgccacgagcttcccggagttcatggacctgatggccgggctgggcgcgaagatcgaactctccgatacgaaggctgcctgatgagctcgaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatgggggatccactagtgatatccgtcgactggtacctacgcgtagctagcccgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgg

SEQ ID NO: 94615 - DNA, 9769 bp, Glycine max
ggtccgatgtgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggaccaggtggtaccggcgcgcctcagcagtcgctgtcgttaacccagcggtactcgctgaggcgatcgcgggccctgatcacctgtcgtacagtatttctacatttgatgtgtgatttgtgaagaacatcaaacaaaacaagcactggctttaatatgatgataagtattatggtaattaattaattggcaaaaacaacaatgaagctaaaattttatttattgagccttgcggttaatttcttgtgatgatctttttttttattttctaattatatatagtttcctttgctttgaaatgctaaaggtttgagagagttatgctctttttttcttcctctttcttttttaactttatcatacaaattttgaataaaaatgtgagtacattgagctcatttaaataagcttgatggggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcggaggaccgaaggagctaaccgcttttttgcacaacatgggggatcatgtaactcgccttgatcgttgggaaccggagctgaatgaagccataccaaacgacgagcgtgacaccacgatgcctgcagcatctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgacctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgatcgaccctttccgacgctcaccgggctggttgccctcgccgctgggctggcggccgtctatggccctgcaaacgcgccagaaacgccgtcgaagccgtgtgcgagacaccgcggccggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagccaagctaggaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgcggccaccactcgagaagcttactagtcaacaattggccaatctttgttctaaattgctaataaacgaccatttccgtcaattctccttggttgcaacagtctacccgtcaaatgtttactaatttataagtgtgaagtttgaattatgaaagacgaaatcgtattaaaaattcacaagaataaacaactccatagattttcaaaaaaacagtcacgagaaaaaaaccacagtccgtttgtctgctcttctagtttttattatttttctattaatagttttttgttatttcgagaataaaatttgaacgatgtccgaaccacaaaagccgagccgataaatcctaagccgagcctaactttagccgtaaccatcagtcacggctcccgggctaattcatttgaaccgaatcataatcaacggtttagatcaaactcaaaacaatctaacggcaacatagacgcgtcggtgagctaaaaagagtgtgaaagccaggtcaccatagcattgtctctcccagattttttatttgggaaataatagaagaaatagaaaaaaataaaagagtgagaaaaatcgtagagctatatattcgcacatgtactcgtttcgctttccttagtgttagctgctgccgctgttgtttctcctccatttctctatctttctctctcgctgcttctcgaatcttctgtatcatcttcttcttcttcaaggtgagtctctagatccgttcgcttgattttgctgctcgttagtcgttattgttgattctctatgccgatttcgctagatctgtttagcatgcgttgtggttttatgagaaaatctttgttttgggggttgcttgttatgtgattcgatccgtgcttgttggatcgatctgagttaattcttaaggtttatgtgttagatctatggagtttgaggattcttctcgcttctgtcgatctctcgctgttatttttgtttttttcagtgaagtgaagttgtttagttcgaaatgacttcgtgtatgctcgattgatctggttttaatcttcgatctgttaggtgttgatgtttacaagtgaattctagtgttttctcgttgagatctgtgaagtttgaacctagttttctcaataatcaacatatgaagcgatgtttgagtttcaataaacgctgctaatcttcgaaactaagttgtgatctgattcgtgtttacttcatgagcttatccaattcatttcggtttcattttactttttttttagtgaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgcttcatggagcttcatctaggccagctactgccaggaagtctagcgggctcagtggcaccgtgcgcatccctggcgataaaagtatttcacacaggagcttcatgttcggaggacttgctagtggagagacgagaatcactggtttgcttgagggcgaagatgttatcaacaccggtaaggcgatgcaagcaatgggtgccagaatccgaaaagagggcgatacgtggatcatcgacggtgttggtaacggaggattgctcgctcccgaagcgccacttgactttgggaacgcagctacggggtgccgtcttactatgggactggtaggcgtgtatgactttgactctaccttcatcggtgacgcgagcctcactaagagaccaatgggacgagtgctgaatcccctgagggagatgggtgtccaggtgaaatctgaggatggtgatcgtcttccggttactctgcgaggccccaagacccccacgccaatcacgtacagggttccgatggcgtcagcacaggtcaagtcagcggtactcctggcgggcctcaacacacctggaatcacaaccgtgattgaacccatcatgactagagaccacacggagaagatgttgcagggtttcggcgctaatctaacggtcgaaaccgacgccgacggcgtgaggacaatccgcttggagggcagaggtaaactgactggccaagtcatcgatgtgcctggagatccctcgtccacagcgtttcccctcgtagctgcgttgctcgtccctggatctgatgtgacgatcctgaatgtcctcatgaatccaactagaaccggcctcatcctcacattgcaggagatgggtgctgacatcgaggttatcaatcctaggttggcaggtggagaggatgtggccgatctgcgcgtgcgttctagtacactcaaaggcgtgaccgtccctgaggatcgcgctccatccatgatcgacgagtaccccattctcgccgttgctgctgcgtttgccgagggcgcaactgtaatgaacggccttgaggagttgagggttaaggagagtgacaggctgtccgcggtggcgaatggcctgaagctaaacggcgtggactgcgacgaaggtgaaacgtcccttgtagtccgtggtcgcccagacgggaaggggttggggaatgcttcgggagctgctgtggcgacgcaccttgatcatagaatcgccatgtcatttctggtgatgggacttgtctccgagaatccggtgaccgttgacgatgctaccatgatcgccacctcctttcctgagttcatggacctcatggcaggcttgggggccaagatcgagctgtctgatactaaggccgcttgaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatcccacgtgcggaccgcctgcaggccgcgttatcaagctaactgca

SEQ ID NO: 94616 - DNA, 8504 bp, Gossypium hirsutum
aggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatccccatcaagcttggccagcttctgcaggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacagaaaaatttgctacattgtttcacaaacttcaaatattattcatttatttgtcagctttcaaactctttgtttcttgtttgttgattagatctggtaccctcagcagtcgctgtgcgatcgccagcggtactcgctgaggtcgacgtagttagttaattcagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgcggccgccactcgagtggaagctagctttccgatcctacctgtcacttcatcaaaaggacagtagaaaaggaaggtggcacctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgatacttccactgacgtaagggatgacgcacaatcccactatccttcgcaagacccttcctctatataaggaagttcatttcatttggagaggacacgctgaaatcaccagtctctctctacaagatcggggatctctagctagacgatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgatccccaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatcgggccactcgagtggtggccgcatcgatcgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcg

SEQ ID NO: 94617 - protein, 129 aa, artificial
  consensus sequence
  misc_feature (6)..(6): Xaa can be any naturally occurring amino acid
  misc_feature (23)..(24): Xaa can be any naturally occurring amino acid
  misc_feature (48)..(49): Xaa can be any naturally occurring amino acid
  misc_feature (52)..(52): Xaa can be any naturally occurring amino acid
  misc_feature (55)..(55): Xaa can be any naturally occurring amino acid
  misc_feature (57)..(58): Xaa can be any naturally occurring amino acid
  misc_feature (60)..(60): Xaa can be any naturally occurring amino acid
  misc_feature (64)..(64): Xaa can be any naturally occurring amino acid
  misc_feature (70)..(71): Xaa can be any naturally occurring amino acid
  misc_feature (73)..(75): Xaa can be any naturally occurring amino acid
  misc_feature (77)..(77): Xaa can be any naturally occurring amino acid
  misc_feature (79)..(79): Xaa can be any naturally occurring amino acid
  misc_feature (86)..(88): Xaa can be any naturally occurring amino acid
  misc_feature (90)..(94): Xaa can be any naturally occurring amino acid
  misc_feature (96)..(98): Xaa can be any naturally occurring amino acid
  misc_feature (108)..(108): Xaa can be any naturally occurring amino acid
  misc_feature (114)..(114): Xaa can be any naturally occurring amino acid
  misc_feature (119)..(119): Xaa can be any naturally occurring amino acid
  misc_feature (123)..(123): Xaa can be any naturally occurring amino acid
  misc_feature (128)..(128): Xaa can be any naturally occurring amino acid
MQMLRXLSTRTRSRRGGYERVSXXDDSTFSLLGAKLRRSTSVPYYAPXXSIXLGXGXXPXILEXLPRQKXXKXXXTXKXSHPIFSXXXGXXXXXKXXXTAKPEFSRYXEYLKEXGMWDXRSNXPVIYXK

SEQ ID NO: 94618 - protein, 2670 aa, artificial
  consensus sequence
  misc_feature (1)..(254): Xaa can be any naturally occurring amino acid
  misc_feature (260)..(262): Xaa can be any naturally occurring amino acid
  misc_feature (264)..(265): Xaa can be any naturally occurring amino acid
  misc_feature (267)..(280): Xaa can be any naturally occurring amino acid
  misc_feature (282)..(284): Xaa can be any naturally occurring amino acid
  misc_feature (286)..(290): Xaa can be any naturally occurring amino acid
  misc_feature (296)..(301): Xaa can be any naturally occurring amino acid
  misc_feature (305)..(305): Xaa can be any naturally occurring amino acid
  misc_feature (308)..(309): Xaa can be any naturally occurring amino acid
  misc_feature (311)..(312): Xaa can be any naturally occurring amino acid
  misc_feature (316)..(316): Xaa can be any naturally occurring amino acid
  misc_feature (319)..(319): Xaa can be any naturally occurring amino acid
  misc_feature (324)..(348): Xaa can be any naturally occurring amino acid
  misc_feature (350)..(350): Xaa can be any naturally occurring amino acid
  misc_feature (353)..(390): Xaa can be any naturally occurring amino acid
  misc_feature (392)..(392): Xaa can be any naturally occurring amino acid
  misc_feature (395)..(416): Xaa can be any naturally occurring amino acid
  misc_feature (418)..(619): Xaa can be any naturally occurring amino acid
  misc_feature (623)..(660): Xaa can be any naturally occurring amino acid
  misc_feature (663)..(664): Xaa can be any naturally occurring amino acid
  misc_feature (666)..(666): Xaa can be any naturally occurring amino acid
  misc_feature (669)..(669): Xaa can be any naturally occurring amino acid
  misc_feature (671)..(671): Xaa can be any naturally occurring amino acid
  misc_feature (673)..(673): Xaa can be any naturally occurring amino acid
  misc_feature (676)..(680): Xaa can be any naturally occurring amino acid
  misc_feature (684)..(684): Xaa can be any naturally occurring amino acid
  misc_feature (686)..(686): Xaa can be any naturally occurring amino acid
  misc_feature (688)..(690): Xaa can be any naturally occurring amino acid
  misc_feature (692)..(692): Xaa can be any naturally occurring amino acid
  misc_feature (694)..(694): Xaa can be any naturally occurring amino acid
  misc_feature (696)..(697): Xaa can be any naturally occurring amino acid
  misc_feature (700)..(700): Xaa can be any naturally occurring amino acid
  misc_feature (702)..(702): Xaa can be any naturally occurring amino acid
  misc_feature (705)..(705): Xaa can be any naturally occurring amino acid
  misc_feature (709)..(711): Xaa can be any naturally occurring amino acid
  misc_feature (713)..(715): Xaa can be any naturally occurring amino acid
  misc_feature (717)..(733): Xaa can be any naturally occurring amino acid
  misc_feature (738)..(738): Xaa can be any naturally occurring amino acid
  misc_feature (741)..(741): Xaa can be any naturally occurring amino acid
  misc_feature (743)..(745): Xaa can be any naturally occurring amino acid
  misc_feature (747)..(748): Xaa can be any naturally occurring amino acid
  misc_feature (751)..(778): Xaa can be any naturally occurring amino acid
  misc_feature (781)..(781): Xaa can be any naturally occurring amino acid
  misc_feature (783)..(783): Xaa can be any naturally occurring amino acid
  misc_feature (787)..(787): Xaa can be any naturally occurring amino acid
  misc_feature (793)..(793): Xaa can be any naturally occurring amino acid
  misc_feature (795)..(800): Xaa can be any naturally occurring amino acid
  misc_feature (803)..(804): Xaa can be any naturally occurring amino acid
  misc_feature (807)..(807): Xaa can be any naturally occurring amino acid
  misc_feature (809)..(809): Xaa can be any naturally occurring amino acid
  misc_feature (812)..(812): Xaa can be any naturally occurring amino acid
  misc_feature (817)..(818): Xaa can be any naturally occurring amino acid
  misc_feature (822)..(824): Xaa can be any naturally occurring amino acid
  misc_feature (827)..(861): Xaa can be any naturally occurring amino acid
  misc_feature (863)..(863): Xaa can be any naturally occurring amino acid
  misc_feature (865)..(867): Xaa can be any naturally occurring amino acid
  misc_feature (872)..(873): Xaa can be any naturally occurring amino acid
  misc_feature (877)..(892): Xaa can be any naturally occurring amino acid
  misc_feature (899)..(899): Xaa can be any naturally occurring amino acid
  misc_feature (903)..(2670): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFLRNIXXXTXXSXXXXXXXXXXXXXXPXXXRXXXXXGPIFEXXXXXXDGPXFDXXFXXFHGXDGXVPLSXXXXXXXXXXXXXXXXXXXXXXXXXFXPLXXXXXXXXXXXXXXXXXXXXXXXXXXXXXXXXXXXXXXAXAAXXXXXXXXXXXXXXXXXXXXXXFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHEAXXXXXXXXXXXXXXXXXXXXXXXXXXXXXXXXXXXXXXWLXXGXCPXAXSXRAXXXXXPLVXKXLXXXPXGXKXXCPXAXVAXRAAXXXTXXXKXXXXXXXXXXXXXXXXXLRPQXLPXKXXXIXXLGXXXXXXXXXXXXXXXXXXXXXXXXXXXXMAXNXPLGXWREHTXKXXXXXXFSXXWFXAXHAXVPFIXXLRKXXXMPXXXXXXXXXXXXXXXXXXXXXXXXXXXXXXXXXXXKXAXXXTIAAXXLGQXXXXXXXXXXXXXXXXGSRAERXRLKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94619 - protein, 290 aa, artificial
  consensus sequence
  misc_feature (1)..(102): Xaa can be any naturally occurring amino acid
  misc_feature (105)..(110): Xaa can be any naturally occurring amino acid
  misc_feature (113)..(123): Xaa can be any naturally occurring amino acid
  misc_feature (126)..(127): Xaa can be any naturally occurring amino acid
  misc_feature (130)..(132): Xaa can be any naturally occurring amino acid
  misc_feature (135)..(135): Xaa can be any naturally occurring amino acid
  misc_feature (137)..(140): Xaa can be any naturally occurring amino acid
  misc_feature (145)..(149): Xaa can be any naturally occurring amino acid
  misc_feature (151)..(151): Xaa can be any naturally occurring amino acid
  misc_feature (153)..(154): Xaa can be any naturally occurring amino acid
  misc_feature (158)..(158): Xaa can be any naturally occurring amino acid
  misc_feature (162)..(163): Xaa can be any naturally occurring amino acid
  misc_feature (166)..(166): Xaa can be any naturally occurring amino acid
  misc_feature (170)..(170): Xaa can be any naturally occurring amino acid
  misc_feature (174)..(174): Xaa can be any naturally occurring amino acid
  misc_feature (179)..(202): Xaa can be any naturally occurring amino acid
  misc_feature (205)..(205): Xaa can be any naturally occurring amino acid
  misc_feature (208)..(230): Xaa can be any naturally occurring amino acid
  misc_feature (233)..(233): Xaa can be any naturally occurring amino acid
  misc_feature (235)..(290): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMAXXXXXXEIXXXXXXXXXXXKVXXVPXXXKPXLXXXXVKKSXXXXXDXYXXKYIXTSSXXPLXHVCXGGMXFSYLXXXXXXXXXXXXXXXXXXXXXXXXLPXERXXXXXXXXXXXXXXXXXXXXXXXHLXHXXXXXXXXXXXXXXXXXXXXXXXXXXXXXXXXXXXXXXXXXXXXXXXXXXXXXXXX

SEQ ID NO: 94620 - protein, 438 aa, artificial
  consensus sequence
  misc_feature (1)..(199): Xaa can be any naturally occurring amino acid
  misc_feature (201)..(209): Xaa can be any naturally occurring amino acid
  misc_feature (211)..(223): Xaa can be any naturally occurring amino acid
  misc_feature (225)..(230): Xaa can be any naturally occurring amino acid
  misc_feature (232)..(234): Xaa can be any naturally occurring amino acid
  misc_feature (236)..(240): Xaa can be any naturally occurring amino acid
  misc_feature (247)..(247): Xaa can be any naturally occurring amino acid
  misc_feature (254)..(258): Xaa can be any naturally occurring amino acid
  misc_feature (260)..(262): Xaa can be any naturally occurring amino acid
  misc_feature (264)..(266): Xaa can be any naturally occurring amino acid
  misc_feature (268)..(268): Xaa can be any naturally occurring amino acid
  misc_feature (270)..(272): Xaa can be any naturally occurring amino acid
  misc_feature (278)..(279): Xaa can be any naturally occurring amino acid
  misc_feature (283)..(283): Xaa can be any naturally occurring amino acid
  misc_feature (287)..(287): Xaa can be any naturally occurring amino acid
  misc_feature (290)..(311): Xaa can be any naturally occurring amino acid
  misc_feature (314)..(438): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXXXXXXKXXXXXXXXXXXXXSXXXXXXSXXXSXXXXXEYRALRXKYLLLEXXXXXLXXXLXXXEXEXXXLEDEKXXLLDXLVVXEGXXXXXXXXXXXXXXXXXXXXXXLVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94621 - protein, 231 aa, artificial
  consensus sequence
  misc_feature (1)..(46): Xaa can be any naturally occurring amino acid
  misc_feature (50)..(51): Xaa can be any naturally occurring amino acid
  misc_feature (54)..(63): Xaa can be any naturally occurring amino acid
  misc_feature (66)..(67): Xaa can be any naturally occurring amino acid
  misc_feature (71)..(74): Xaa can be any naturally occurring amino acid
  misc_feature (82)..(83): Xaa can be any naturally occurring amino acid
  misc_feature (85)..(96): Xaa can be any naturally occurring amino acid
  misc_feature (98)..(112): Xaa can be any naturally occurring amino acid
  misc_feature (121)..(121): Xaa can be any naturally occurring amino acid
  misc_feature (124)..(126): Xaa can be any naturally occurring amino acid
  misc_feature (129)..(131): Xaa can be any naturally occurring amino acid
  misc_feature (134)..(136): Xaa can be any naturally occurring amino acid
  misc_feature (142)..(143): Xaa can be any naturally occurring amino acid
  misc_feature (145)..(145): Xaa can be any naturally occurring amino acid
  misc_feature (147)..(149): Xaa can be any naturally occurring amino acid
  misc_feature (151)..(152): Xaa can be any naturally occurring amino acid
  misc_feature (156)..(156): Xaa can be any naturally occurring amino acid
  misc_feature (159)..(169): Xaa can be any naturally occurring amino acid
  misc_feature (172)..(174): Xaa can be any naturally occurring amino acid
  misc_feature (176)..(177): Xaa can be any naturally occurring amino acid
  misc_feature (179)..(181): Xaa can be any naturally occurring amino acid
  misc_feature (183)..(183): Xaa can be any naturally occurring amino acid
  misc_feature (185)..(185): Xaa can be any naturally occurring amino acid
  misc_feature (187)..(187): Xaa can be any naturally occurring amino acid
  misc_feature (190)..(190): Xaa can be any naturally occurring amino acid
  misc_feature (195)..(195): Xaa can be any naturally occurring amino acid
  misc_feature (199)..(199): Xaa can be any naturally occurring amino acid
  misc_feature (202)..(231): Xaa can be any naturally occurring amino acid
XXXXXXXXXXXXXXXXXXXXXXXXXXXXXXXXXXXXXXXXXXXXXXYVAXXPLXXXXXXXXXXMSXXYSLXXXXLQHFMVLXXPXXXXXXXXXXXXPXXXXXXXXXXXXXXXLVFDFQPRXPEXXXAAXXXLSXXXIPGVVXXRXLXXXPXXRCWXVGXXXXXXXXXXXDAXXXAXXFXXXWXTXLXVGXHDCRXYTNXLVXXXXXXXXXXXXXXXXXXXXXXXXXXXXXX

SEQ ID NO: 94622 - protein, 54 aa, artificial
  consensus sequence
  misc_feature (3)..(3): Xaa can be any naturally occurring amino acid
  misc_feature (8)..(8): Xaa can be any naturally occurring amino acid
  misc_feature (14)..(14): Xaa can be any naturally occurring amino acid
  misc_feature (21)..(21): Xaa can be any naturally occurring amino acid
  misc_feature (25)..(25): Xaa can be any naturally occurring amino acid
  misc_feature (28)..(28): Xaa can be any naturally occurring amino acid
  misc_feature (33)..(33): Xaa can be any naturally occurring amino acid
  misc_feature (36)..(36): Xaa can be any naturally occurring amino acid
  misc_feature (39)..(39): Xaa can be any naturally occurring amino acid
  misc_feature (41)..(41): Xaa can be any naturally occurring amino acid
  misc_feature (43)..(43): Xaa can be any naturally occurring amino acid
  misc_feature (46)..(46): Xaa can be any naturally occurring amino acid
  misc_feature (52)..(53): Xaa can be any naturally occurring amino acid
MFXGMFMXKPDKAXALKQLRXHVAXFGXWVVVXRVXPYXLXYXSDXKDELKXXF

SEQ ID NO: 94623 - protein, 111 aa, artificial
  consensus sequence
  misc_feature (4)..(4): Xaa can be any naturally occurring amino acid
  misc_feature (11)..(11): Xaa can be any naturally occurring amino acid
  misc_feature (14)..(14): Xaa can be any naturally occurring amino acid
  misc_feature (39)..(39): Xaa can be any naturally occurring amino acid
  misc_feature (44)..(44): Xaa can be any naturally occurring amino acid
  misc_feature (46)..(46): Xaa can be any naturally occurring amino acid
  misc_feature (48)..(49): Xaa can be any naturally occurring amino acid
  misc_feature (53)..(53): Xaa can be any naturally occurring amino acid
  misc_feature (60)..(61): Xaa can be any naturally occurring amino acid
  misc_feature (68)..(70): Xaa can be any naturally occurring amino acid
MATXTFSSRGXQTXNTMFVKPMLRKSIHKKSASHDIVRXTVKTXGXSXXGEEXKTMRGFXXAGETSSXXXSSWVPHEGTGIYYPKGQEKVMQDVPPPPAGSHADELVNWFS

SEQ ID NO: 94624 - protein, 910 aa, artificial
  consensus sequence
  misc_feature (1)..(309): Xaa can be any naturally occurring amino acid
  misc_feature (311)..(322): Xaa can be any naturally occurring amino acid
  misc_feature (325)..(325): Xaa can be any naturally occurring amino acid
  misc_feature (328)..(357): Xaa can be any naturally occurring amino acid
  misc_feature (359)..(361): Xaa can be any naturally occurring amino acid
  misc_feature (363)..(365): Xaa can be any naturally occurring amino acid
  misc_feature (367)..(458): Xaa can be any naturally occurring amino acid
  misc_feature (461)..(461): Xaa can be any naturally occurring amino acid
  misc_feature (466)..(466): Xaa can be any naturally occurring amino acid
  misc_feature (468)..(469): Xaa can be any naturally occurring amino acid
  misc_feature (471)..(520): Xaa can be any naturally occurring amino acid
  misc_feature (522)..(524): Xaa can be any naturally occurring amino acid
  misc_feature (526)..(527): Xaa can be any naturally occurring amino acid
  misc_feature (529)..(529): Xaa can be any naturally occurring amino acid
  misc_feature (531)..(532): Xaa can be any naturally occurring amino acid
  misc_feature (534)..(534): Xaa can be any naturally occurring amino acid
  misc_feature (537)..(560): Xaa can be any naturally occurring amino acid
  misc_feature (562)..(563): Xaa can be any naturally occurring amino acid
  misc_feature (565)..(910): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXXXXXXXXXYKXQLXXXXXXXXXXXXXXXXXXXXXXXXXXXXXXEXXXMXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVIXLTEEXLXXAXXXXXXXXXXXXXXXXXXXXXXXXXXXXXXXXXXXXXXXXXXXXXXXXXXKXXXGXXVXAXXSXDGXXXXXXXXXXXXXXXXXXXXXXXXGXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94625 - protein, 539 aa, artificial
  consensus sequence
  misc_feature (1)..(103): Xaa can be any naturally occurring amino acid
  misc_feature (105)..(170): Xaa can be any naturally occurring amino acid
  misc_feature (172)..(173): Xaa can be any naturally occurring amino acid
  misc_feature (175)..(176): Xaa can be any naturally occurring amino acid
  misc_feature (179)..(180): Xaa can be any naturally occurring amino acid
  misc_feature (183)..(183): Xaa can be any naturally occurring amino acid
  misc_feature (186)..(187): Xaa can be any naturally occurring amino acid
  misc_feature (190)..(288): Xaa can be any naturally occurring amino acid
  misc_feature (290)..(296): Xaa can be any naturally occurring amino acid
  misc_feature (298)..(302): Xaa can be any naturally occurring amino acid
  misc_feature (305)..(306): Xaa can be any naturally occurring amino acid
  misc_feature (309)..(310): Xaa can be any naturally occurring amino acid
  misc_feature (313)..(316): Xaa can be any naturally occurring amino acid
  misc_feature (318)..(321): Xaa can be any naturally occurring amino acid
  misc_feature (323)..(324): Xaa can be any naturally occurring amino acid
  misc_feature (327)..(328): Xaa can be any naturally occurring amino acid
  misc_feature (331)..(331): Xaa can be any naturally occurring amino acid
  misc_feature (333)..(342): Xaa can be any naturally occurring amino acid
  misc_feature (344)..(539): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXXXXXXXXXXXXXXXXXXXXXXXXXXXXXXXXXXXXXXXXXXXXXXXXXXXXXXXXXXXXXXXLXXIXXALXXLEXQLXXLQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQXXXXXXXLXXXXXSRXXLLXXKLXXXXGXXXXVXXEAXXFAXEXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94626 - protein, 858 aa, artificial
  consensus sequence
  misc_feature (1)..(196): Xaa can be any naturally occurring amino acid
  misc_feature (199)..(201): Xaa can be any naturally occurring amino acid
  misc_feature (203)..(207): Xaa can be any naturally occurring amino acid
  misc_feature (209)..(216): Xaa can be any naturally occurring amino acid
  misc_feature (218)..(225): Xaa can be any naturally occurring amino acid
  misc_feature (227)..(229): Xaa can be any naturally occurring amino acid
  misc_feature (231)..(235): Xaa can be any naturally occurring amino acid
  misc_feature (238)..(245): Xaa can be any naturally occurring amino acid
  misc_feature (247)..(248): Xaa can be any naturally occurring amino acid
  misc_feature (250)..(260): Xaa can be any naturally occurring amino acid
  misc_feature (262)..(266): Xaa can be any naturally occurring amino acid
  misc_feature (268)..(272): Xaa can be any naturally occurring amino acid
  misc_feature (274)..(290): Xaa can be any naturally occurring amino acid
  misc_feature (292)..(500): Xaa can be any naturally occurring amino acid
  misc_feature (502)..(506): Xaa can be any naturally occurring amino acid
  misc_feature (508)..(515): Xaa can be any naturally occurring amino acid
  misc_feature (517)..(519): Xaa can be any naturally occurring amino acid
  misc_feature (522)..(522): Xaa can be any naturally occurring amino acid
  misc_feature (525)..(525): Xaa can be any naturally occurring amino acid
  misc_feature (527)..(530): Xaa can be any naturally occurring amino acid
  misc_feature (533)..(533): Xaa can be any naturally occurring amino acid
  misc_feature (535)..(535): Xaa can be any naturally occurring amino acid
  misc_feature (539)..(539): Xaa can be any naturally occurring amino acid
  misc_feature (541)..(541): Xaa can be any naturally occurring amino acid
  misc_feature (543)..(543): Xaa can be any naturally occurring amino acid
  misc_feature (545)..(551): Xaa can be any naturally occurring amino acid
  misc_feature (553)..(553): Xaa can be any naturally occurring amino acid
  misc_feature (555)..(559): Xaa can be any naturally occurring amino acid
  misc_feature (562)..(562): Xaa can be any naturally occurring amino acid
  misc_feature (564)..(564): Xaa can be any naturally occurring amino acid
  misc_feature (566)..(566): Xaa can be any naturally occurring amino acid
  misc_feature (569)..(570): Xaa can be any naturally occurring amino acid
  misc_feature (574)..(574): Xaa can be any naturally occurring amino acid
  misc_feature (576)..(576): Xaa can be any naturally occurring amino acid
  misc_feature (584)..(584): Xaa can be any naturally occurring amino acid
  misc_feature (588)..(589): Xaa can be any naturally occurring amino acid
  misc_feature (591)..(595): Xaa can be any naturally occurring amino acid
  misc_feature (597)..(597): Xaa can be any naturally occurring amino acid
  misc_feature (606)..(610): Xaa can be any naturally occurring amino acid
  misc_feature (614)..(615): Xaa can be any naturally occurring amino acid
  misc_feature (626)..(627): Xaa can be any naturally occurring amino acid
  misc_feature (629)..(629): Xaa can be any naturally occurring amino acid
  misc_feature (636)..(636): Xaa can be any naturally occurring amino acid
  misc_feature (638)..(638): Xaa can be any naturally occurring amino acid
  misc_feature (640)..(640): Xaa can be any naturally occurring amino acid
  misc_feature (644)..(644): Xaa can be any naturally occurring amino acid
  misc_feature (646)..(646): Xaa can be any naturally occurring amino acid
  misc_feature (649)..(649): Xaa can be any naturally occurring amino acid
  misc_feature (651)..(651): Xaa can be any naturally occurring amino acid
  misc_feature (653)..(654): Xaa can be any naturally occurring amino acid
  misc_feature (656)..(660): Xaa can be any naturally occurring amino acid
  misc_feature (665)..(666): Xaa can be any naturally occurring amino acid
  misc_feature (669)..(669): Xaa can be any naturally occurring amino acid
  misc_feature (671)..(671): Xaa can be any naturally occurring amino acid
  misc_feature (674)..(675): Xaa can be any naturally occurring amino acid
  misc_feature (677)..(678): Xaa can be any naturally occurring amino acid
  misc_feature (681)..(682): Xaa can be any naturally occurring amino acid
  misc_feature (684)..(684): Xaa can be any naturally occurring amino acid
  misc_feature (688)..(688): Xaa can be any naturally occurring amino acid
  misc_feature (690)..(690): Xaa can be any naturally occurring amino acid
  misc_feature (692)..(692): Xaa can be any naturally occurring amino acid
  misc_feature (694)..(698): Xaa can be any naturally occurring amino acid
  misc_feature (700)..(701): Xaa can be any naturally occurring amino acid
  misc_feature (703)..(707): Xaa can be any naturally occurring amino acid
  misc_feature (710)..(710): Xaa can be any naturally occurring amino acid
  misc_feature (712)..(712): Xaa can be any naturally occurring amino acid
  misc_feature (717)..(722): Xaa can be any naturally occurring amino acid
  misc_feature (724)..(725): Xaa can be any naturally occurring amino acid
  misc_feature (727)..(730): Xaa can be any naturally occurring amino acid
  misc_feature (733)..(734): Xaa can be any naturally occurring amino acid
  misc_feature (738)..(766): Xaa can be any naturally occurring amino acid
  misc_feature (768)..(769): Xaa can be any naturally occurring amino acid
  misc_feature (771)..(771): Xaa can be any naturally occurring amino acid
  misc_feature (773)..(773): Xaa can be any naturally occurring amino acid
  misc_feature (775)..(775): Xaa can be any naturally occurring amino acid
  misc_feature (777)..(777): Xaa can be any naturally occurring amino acid
  misc_feature (779)..(858): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDRXXXSXXXXXWXXXXXXXXRXXXXXXXXYXXXPXXXXXRFXXXXXXXXKXXPXXXXXXXXXXXLXXXXXGXXXXXWXXXXXXXXXXXXXXXXXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCXXXXXLXXXXXXXXRXXXGDXGLXVXXXXCKXLXRLRXEXGXDXXXXXXXEXGXXXXXGLXAXAXGCXXLEYXAXYVSDITNXALEXXGXXXXXLXDFRLVLLDXXXXXTDLXXPLDNGVRALLXXCXKLRRFAXYXRXGGLXDXGLXYXGXXSXXXXXMLLGXXGEXDXGLXXFXXGCXXLXKLEXRXCXFXXXXXLXXAXXXXXSLXYXWVQGXXXXXXGXXLXXXXRPXXNIEXXXXXXXXXXXXXXXXXXXXXXXXXXXXXYXXLXGXRXDXPXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94627 - protein, 556 aa, artificial
  consensus sequence
  misc_feature (1)..(103): Xaa can be any naturally occurring amino acid
  misc_feature (105)..(174): Xaa can be any naturally occurring amino acid
  misc_feature (176)..(177): Xaa can be any naturally occurring amino acid
  misc_feature (179)..(184): Xaa can be any naturally occurring amino acid
  misc_feature (186)..(198): Xaa can be any naturally occurring amino acid
  misc_feature (200)..(201): Xaa can be any naturally occurring amino acid
  misc_feature (204)..(226): Xaa can be any naturally occurring amino acid
  misc_feature (228)..(229): Xaa can be any naturally occurring amino acid
  misc_feature (231)..(235): Xaa can be any naturally occurring amino acid
  misc_feature (237)..(238): Xaa can be any naturally occurring amino acid
  misc_feature (241)..(247): Xaa can be any naturally occurring amino acid
  misc_feature (251)..(266): Xaa can be any naturally occurring amino acid
  misc_feature (268)..(279): Xaa can be any naturally occurring amino acid
  misc_feature (281)..(334): Xaa can be any naturally occurring amino acid
  misc_feature (336)..(336): Xaa can be any naturally occurring amino acid
  misc_feature (339)..(345): Xaa can be any naturally occurring amino acid
  misc_feature (347)..(355): Xaa can be any naturally occurring amino acid
  misc_feature (357)..(360): Xaa can be any naturally occurring amino acid
  misc_feature (362)..(366): Xaa can be any naturally occurring amino acid
  misc_feature (372)..(372): Xaa can be any naturally occurring amino acid
  misc_feature (374)..(375): Xaa can be any naturally occurring amino acid
  misc_feature (377)..(377): Xaa can be any naturally occurring amino acid
  misc_feature (379)..(379): Xaa can be any naturally occurring amino acid
  misc_feature (381)..(387): Xaa can be any naturally occurring amino acid
  misc_feature (390)..(394): Xaa can be any naturally occurring amino acid
  misc_feature (397)..(397): Xaa can be any naturally occurring amino acid
  misc_feature (400)..(402): Xaa can be any naturally occurring amino acid
  misc_feature (404)..(409): Xaa can be any naturally occurring amino acid
  misc_feature (411)..(413): Xaa can be any naturally occurring amino acid
  misc_feature (415)..(416): Xaa can be any naturally occurring amino acid
  misc_feature (419)..(430): Xaa can be any naturally occurring amino acid
  misc_feature (433)..(434): Xaa can be any naturally occurring amino acid
  misc_feature (437)..(556): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMXXXXXXXXXXXXXXXXXXXXXXXXXXXXXXXXXXXXXXXXXXXXXXXXXXXXXXXXXXXXXXXXXXXXXXLXXFXXXXXXRXXXXXXXXXXXXXEXXRLXXXXXXXXXXXXXXXXXXXXXXXCXXYXXXXXGXXEPXXXXXXXFLLXXXXXXXXXXXXXXXXNXXXXXXXXXXXXPXXXXXXXXXXXXXXXXXXXXXXXXXXXXXXXXXXXXXXXXXXXXXXXXXXXXXXCXYPXXXXXXXLXXXXXXXXXYXXXXGXXXXXLVINKXLXXRXYXLXXXXXXXLPXXXXXLGXSVXXXPXXXXXXEXXXFXXFLXXXXXXXXXXXXLVXXPVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94628 - protein, 373 aa, artificial
  consensus sequence
  misc_feature (3)..(26): Xaa can be any naturally occurring amino acid
  misc_feature (28)..(29): Xaa can be any naturally occurring amino acid
  misc_feature (31)..(38): Xaa can be any naturally occurring amino acid
  misc_feature (40)..(44): Xaa can be any naturally occurring amino acid
  misc_feature (46)..(46): Xaa can be any naturally occurring amino acid
  misc_feature (48)..(50): Xaa can be any naturally occurring amino acid
  misc_feature (52)..(53): Xaa can be any naturally occurring amino acid
  misc_feature (59)..(59): Xaa can be any naturally occurring amino acid
  misc_feature (63)..(64): Xaa can be any naturally occurring amino acid
  misc_feature (67)..(68): Xaa can be any naturally occurring amino acid
  misc_feature (71)..(72): Xaa can be any naturally occurring amino acid
  misc_feature (75)..(87): Xaa can be any naturally occurring amino acid
  misc_feature (89)..(91): Xaa can be any naturally occurring amino acid
  misc_feature (94)..(99): Xaa can be any naturally occurring amino acid
  misc_feature (101)..(102): Xaa can be any naturally occurring amino acid
  misc_feature (104)..(105): Xaa can be any naturally occurring amino acid
  misc_feature (107)..(107): Xaa can be any naturally occurring amino acid
  misc_feature (111)..(111): Xaa can be any naturally occurring amino acid
  misc_feature (113)..(115): Xaa can be any naturally occurring amino acid
  misc_feature (117)..(117): Xaa can be any naturally occurring amino acid
  misc_feature (119)..(134): Xaa can be any naturally occurring amino acid
  misc_feature (136)..(136): Xaa can be any naturally occurring amino acid
  misc_feature (141)..(142): Xaa can be any naturally occurring amino acid
  misc_feature (144)..(148): Xaa can be any naturally occurring amino acid
  misc_feature (150)..(150): Xaa can be any naturally occurring amino acid
  misc_feature (154)..(166): Xaa can be any naturally occurring amino acid
  misc_feature (168)..(175): Xaa can be any naturally occurring amino acid
  misc_feature (178)..(179): Xaa can be any naturally occurring amino acid
  misc_feature (181)..(182): Xaa can be any naturally occurring amino acid
  misc_feature (184)..(373): Xaa can be any naturally occurring amino acid
MNXXXXXXXXXXXXXXXXXXXXXXXXCXXCXXXXXXXXQXXXXXHXVXXXGXXRRLCTXCLLXXHRXXFCXXCFXXXXXXXXXXXXXDXXXPPXXXXXXCXXCXXSXTHLXCXXXPXSXXXXXXXXXXXXXXXXFXCPPCXXPXXXXXFXFFPXXXXXXXXXXXXXLXXXXXXXXALXXAXXIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94629 - protein, 1380 aa, artificial
  consensus sequence
  misc_feature (1)..(456): Xaa can be any naturally occurring amino acid
  misc_feature (458)..(458): Xaa can be any naturally occurring amino acid
  misc_feature (468)..(472): Xaa can be any naturally occurring amino acid
  misc_feature (475)..(476): Xaa can be any naturally occurring amino acid
  misc_feature (478)..(514): Xaa can be any naturally occurring amino acid
  misc_feature (517)..(518): Xaa can be any naturally occurring amino acid
  misc_feature (520)..(520): Xaa can be any naturally occurring amino acid
  misc_feature (523)..(523): Xaa can be any naturally occurring amino acid
  misc_feature (525)..(526): Xaa can be any naturally occurring amino acid
  misc_feature (528)..(528): Xaa can be any naturally occurring amino acid
  misc_feature (530)..(532): Xaa can be any naturally occurring amino acid
  misc_feature (534)..(600): Xaa can be any naturally occurring amino acid
  misc_feature (602)..(617): Xaa can be any naturally occurring amino acid
  misc_feature (622)..(628): Xaa can be any naturally occurring amino acid
  misc_feature (631)..(634): Xaa can be any naturally occurring amino acid
  misc_feature (636)..(636): Xaa can be any naturally occurring amino acid
  misc_feature (638)..(683): Xaa can be any naturally occurring amino acid
  misc_feature (686)..(686): Xaa can be any naturally occurring amino acid
  misc_feature (688)..(689): Xaa can be any naturally occurring amino acid
  misc_feature (691)..(691): Xaa can be any naturally occurring amino acid
  misc_feature (696)..(696): Xaa can be any naturally occurring amino acid
  misc_feature (698)..(730): Xaa can be any naturally occurring amino acid
  misc_feature (736)..(757): Xaa can be any naturally occurring amino acid
  misc_feature (759)..(760): Xaa can be any naturally occurring amino acid
  misc_feature (764)..(915): Xaa can be any naturally occurring amino acid
  misc_feature (918)..(953): Xaa can be any naturally occurring amino acid
  misc_feature (955)..(1380): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXSGKGGVGKSXXXXXLAXXLXXXXXXXXXXXXXXXXXXXXXXXXXXXXXXXXXXXXXVGXXDXDIXGXXSXPXXXGXXXXXXXXXXXXXXXXXXXXXXXXXXXXXXXXXXXXXXXXXXXXXXXXXXXXXXXXXXXXXXXXXXXSXXXXXXXXXXXXXXXXWRGPXXXXXXXQFXXXXVXWXXXXXXXXXXXXXXXXXXXXXXXXXXXXXXXXXXXXXXXXXXXXXXLDXLXXDXPPGTXDXXXXXXXXXXXXXXXXXXXXXXXXXXXXXXXXXVTTPQXXXXXXXXXXXXXXXXXXXXXXGXXENMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGGXXXXXXXXXXXXXXXXXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94630 - protein, 394 aa, artificial
  consensus sequence
  misc_feature (1)..(171): Xaa can be any naturally occurring amino acid
  misc_feature (174)..(180): Xaa can be any naturally occurring amino acid
  misc_feature (182)..(183): Xaa can be any naturally occurring amino acid
  misc_feature (185)..(198): Xaa can be any naturally occurring amino acid
  misc_feature (200)..(200): Xaa can be any naturally occurring amino acid
  misc_feature (202)..(270): Xaa can be any naturally occurring amino acid
  misc_feature (274)..(274): Xaa can be any naturally occurring amino acid
  misc_feature (285)..(303): Xaa can be any naturally occurring amino acid
  misc_feature (306)..(306): Xaa can be any naturally occurring amino acid
  misc_feature (309)..(309): Xaa can be any naturally occurring amino acid
  misc_feature (319)..(319): Xaa can be any naturally occurring amino acid
  misc_feature (322)..(328): Xaa can be any naturally occurring amino acid
  misc_feature (330)..(331): Xaa can be any naturally occurring amino acid
  misc_feature (334)..(334): Xaa can be any naturally occurring amino acid
  misc_feature (337)..(339): Xaa can be any naturally occurring amino acid
  misc_feature (341)..(341): Xaa can be any naturally occurring amino acid
  misc_feature (344)..(394): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMAXXXXXXXSXXSXXXXXXXXXXXXXXLXSXXXXXXXXXXXXXXXXXXXXXXXXXXXXXXXXXXXXXXXXXXXXXXXXXXXXXXXXXXXXXXXXXXXXXRRGXHVELGAREKAXXXXXXXXXXXXXXXXXXXLLXEDXALKRFKSYKXSVXXXXXXXGXXLTXVVXXXCXYEXXXXXXXXXXXXXXXXXXXXXXXXXXXXXXXXXXXXXXXXXXXXXXXXXXX

SEQ ID NO: 94631 - protein, 260 aa, artificial
  consensus sequence
  misc_feature (1)..(44): Xaa can be any naturally occurring amino acid
  misc_feature (46)..(111): Xaa can be any naturally occurring amino acid
  misc_feature (119)..(153): Xaa can be any naturally occurring amino acid
  misc_feature (172)..(172): Xaa can be any naturally occurring amino acid
  misc_feature (177)..(177): Xaa can be any naturally occurring amino acid
  misc_feature (181)..(190): Xaa can be any naturally occurring amino acid
  misc_feature (196)..(196): Xaa can be any naturally occurring amino acid
  misc_feature (198)..(198): Xaa can be any naturally occurring amino acid
  misc_feature (204)..(226): Xaa can be any naturally occurring amino acid
  misc_feature (233)..(247): Xaa can be any naturally occurring amino acid
  misc_feature (249)..(249): Xaa can be any naturally occurring amino acid
  misc_feature (251)..(251): Xaa can be any naturally occurring amino acid
  misc_feature (255)..(260): Xaa can be any naturally occurring amino acid
XXXXXXXXXXXXXXXXXXXXXXXXXXXXXXXXXXXXXXXXXXXXLXXXXXXXXXXXXXXXXXXXXXXXXXXXXXXXXXXXXXXXXXXXXXXXXXXXXXXXXXXXXXXXXXXHTAKWMQXXXXXXXXXXXXXXXXXXXXXXXXXXXXXXXXXXXTSKKSPMELINEVPPIKVXGRIAXCEGXXXXXXXXXXLGHPIXEXICLDLXXXXXXXXXXXXXXXXXXXXXXXVCKYCGXXXXXXXXXXXXXXXYXQXHHHXXXXXX

SEQ ID NO: 94632 - protein, 1084 aa, artificial
  consensus sequence
  misc_feature (1)..(277): Xaa can be any naturally occurring amino acid
  misc_feature (279)..(279): Xaa can be any naturally occurring amino acid
  misc_feature (281)..(281): Xaa can be any naturally occurring amino acid
  misc_feature (284)..(284): Xaa can be any naturally occurring amino acid
  misc_feature (286)..(299): Xaa can be any naturally occurring amino acid
  misc_feature (301)..(306): Xaa can be any naturally occurring amino acid
  misc_feature (311)..(312): Xaa can be any naturally occurring amino acid
  misc_feature (314)..(318): Xaa can be any naturally occurring amino acid
  misc_feature (320)..(322): Xaa can be any naturally occurring amino acid
  misc_feature (324)..(367): Xaa can be any naturally occurring amino acid
  misc_feature (370)..(370): Xaa can be any naturally occurring amino acid
  misc_feature (373)..(373): Xaa can be any naturally occurring amino acid
  misc_feature (376)..(376): Xaa can be any naturally occurring amino acid
  misc_feature (379)..(395): Xaa can be any naturally occurring amino acid
  misc_feature (397)..(400): Xaa can be any naturally occurring amino acid
  misc_feature (402)..(436): Xaa can be any naturally occurring amino acid
  misc_feature (440)..(442): Xaa can be any naturally occurring amino acid
  misc_feature (444)..(451): Xaa can be any naturally occurring amino acid
  misc_feature (453)..(453): Xaa can be any naturally occurring amino acid
  misc_feature (455)..(491): Xaa can be any naturally occurring amino acid
  misc_feature (495)..(522): Xaa can be any naturally occurring amino acid
  misc_feature (524)..(633): Xaa can be any naturally occurring amino acid
  misc_feature (638)..(732): Xaa can be any naturally occurring amino acid
  misc_feature (735)..(735): Xaa can be any naturally occurring amino acid
  misc_feature (737)..(739): Xaa can be any naturally occurring amino acid
  misc_feature (742)..(743): Xaa can be any naturally occurring amino acid
  misc_feature (745)..(758): Xaa can be any naturally occurring amino acid
  misc_feature (760)..(760): Xaa can be any naturally occurring amino acid
  misc_feature (763)..(763): Xaa can be any naturally occurring amino acid
  misc_feature (765)..(767): Xaa can be any naturally occurring amino acid
  misc_feature (770)..(770): Xaa can be any naturally occurring amino acid
  misc_feature (772)..(1084): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXLXAVXKXXXXXXXXXXXXXXGXXXXXXFGENXXQXXXXXEXXXKXXXXXXXXXXXXXXXXXXXXXXXXXXXXXXXXXXXXXXXXXXXXWHXIGXLQXNKXXXXXXXXXXXXXXXXXDXXXXAXXXXXXXXXXXXXXXXXXXXXXXXXXXXXXXXXXXQVNXXXEXXXXXXXXKXGXXXXXXXXXXXXXXXXXXXXXXXXXXXXXXXXXXXXXGLMXXXXXXXXXXXXXXXXXXXXXXXXXXXXFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLSMGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMSXDXXXAIXXGXXXXXXXXXXXXXXTXVRXGXXXFGXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94633 - protein, 212 aa, artificial
  consensus sequence
  misc_feature (7)..(7): Xaa can be any naturally occurring amino acid
  misc_feature (9)..(9): Xaa can be any naturally occurring amino acid
  misc_feature (11)..(11): Xaa can be any naturally occurring amino acid
  misc_feature (13)..(28): Xaa can be any naturally occurring amino acid
  misc_feature (30)..(35): Xaa can be any naturally occurring amino acid
  misc_feature (37)..(52): Xaa can be any naturally occurring amino acid
  misc_feature (54)..(71): Xaa can be any naturally occurring amino acid
  misc_feature (73)..(88): Xaa can be any naturally occurring amino acid
  misc_feature (90)..(90): Xaa can be any naturally occurring amino acid
  misc_feature (95)..(123): Xaa can be any naturally occurring amino acid
  misc_feature (126)..(158): Xaa can be any naturally occurring amino acid
  misc_feature (162)..(167): Xaa can be any naturally occurring amino acid
  misc_feature (173)..(173): Xaa can be any naturally occurring amino acid
  misc_feature (180)..(182): Xaa can be any naturally occurring amino acid
  misc_feature (184)..(192): Xaa can be any naturally occurring amino acid
  misc_feature (194)..(196): Xaa can be any naturally occurring amino acid
  misc_feature (198)..(200): Xaa can be any naturally occurring amino acid
  misc_feature (202)..(212): Xaa can be any naturally occurring amino acid
MGVAVLXPXDXLXXXXXXXXXXXXXXXXPXXXXXXPXXXXXXXXXXXXXXXXSXXXXXXXXXXXXXXXXXXPXXXXXXXXXXXXXXXXVXILKRXXXXXXXXXXXXXXXXXXXXXXXXXXXXXPDXXXXXXXXXXXXXXXXXXXXXXXXXXXXXXXXXYAGXXXXXXSPPPSXVPLPAFXXXKXXXXXXXXXAXXXLXXXLXXXXXXXXXXX

SEQ ID NO: 94634 - protein, 530 aa, artificial
  consensus sequence
  misc_feature (1)..(4): Xaa can be any naturally occurring amino acid
  misc_feature (7)..(9): Xaa can be any naturally occurring amino acid
  misc_feature (13)..(13): Xaa can be any naturally occurring amino acid
  misc_feature (18)..(18): Xaa can be any naturally occurring amino acid
  misc_feature (21)..(23): Xaa can be any naturally occurring amino acid
  misc_feature (28)..(42): Xaa can be any naturally occurring amino acid
  misc_feature (46)..(46): Xaa can be any naturally occurring amino acid
  misc_feature (48)..(55): Xaa can be any naturally occurring amino acid
  misc_feature (57)..(59): Xaa can be any naturally occurring amino acid
  misc_feature (61)..(62): Xaa can be any naturally occurring amino acid
  misc_feature (64)..(65): Xaa can be any naturally occurring amino acid
  misc_feature (67)..(69): Xaa can be any naturally occurring amino acid
  misc_feature (71)..(71): Xaa can be any naturally occurring amino acid
  misc_feature (74)..(79): Xaa can be any naturally occurring amino acid
  misc_feature (81)..(81): Xaa can be any naturally occurring amino acid
  misc_feature (91)..(91): Xaa can be any naturally occurring amino acid
  misc_feature (96)..(96): Xaa can be any naturally occurring amino acid
  misc_feature (99)..(100): Xaa can be any naturally occurring amino acid
  misc_feature (103)..(103): Xaa can be any naturally occurring amino acid
  misc_feature (105)..(105): Xaa can be any naturally occurring amino acid
  misc_feature (108)..(109): Xaa can be any naturally occurring amino acid
  misc_feature (112)..(112): Xaa can be any naturally occurring amino acid
  misc_feature (114)..(116): Xaa can be any naturally occurring amino acid
  misc_feature (121)..(121): Xaa can be any naturally occurring amino acid
  misc_feature (123)..(123): Xaa can be any naturally occurring amino acid
  misc_feature (125)..(126): Xaa can be any naturally occurring amino acid
  misc_feature (128)..(128): Xaa can be any naturally occurring amino acid
  misc_feature (131)..(133): Xaa can be any naturally occurring amino acid
  misc_feature (135)..(136): Xaa can be any naturally occurring amino acid
  misc_feature (144)..(145): Xaa can be any naturally occurring amino acid
  misc_feature (147)..(148): Xaa can be any naturally occurring amino acid
  misc_feature (152)..(153): Xaa can be any naturally occurring amino acid
  misc_feature (161)..(161): Xaa can be any naturally occurring amino acid
  misc_feature (164)..(164): Xaa can be any naturally occurring amino acid
  misc_feature (167)..(167): Xaa can be any naturally occurring amino acid
  misc_feature (169)..(170): Xaa can be any naturally occurring amino acid
  misc_feature (174)..(175): Xaa can be any naturally occurring amino acid
  misc_feature (181)..(182): Xaa can be any naturally occurring amino acid
  misc_feature (189)..(191): Xaa can be any naturally occurring amino acid
  misc_feature (193)..(193): Xaa can be any naturally occurring amino acid
  misc_feature (195)..(195): Xaa can be any naturally occurring amino acid
  misc_feature (200)..(530): Xaa can be any naturally occurring amino acid
XXXXMAXXXDFRXLDEGXGGXXXKRKRXXXXXXXXXXXXXXXSMDXDXXXXXXXXPXXXKXXAXXSXXXPXKPXXXXXXGXPTYDGVIAGXVSGRXWKXXRTXRXSAXXVSXKXXXLEQRXRXKXXKXAYXXXRXXELKEEIRXXKXXKRKXXEEREKRKXENXLRXGXXKLQXXTNPKTXXKIAKSKXXXKXLXVVPDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94635 - protein, 184 aa, artificial
  consensus sequence
  misc_feature (1)..(79): Xaa can be any naturally occurring amino acid
  misc_feature (85)..(87): Xaa can be any naturally occurring amino acid
  misc_feature (89)..(91): Xaa can be any naturally occurring amino acid
  misc_feature (98)..(99): Xaa can be any naturally occurring amino acid
  misc_feature (111)..(111): Xaa can be any naturally occurring amino acid
  misc_feature (116)..(124): Xaa can be any naturally occurring amino acid
  misc_feature (136)..(136): Xaa can be any naturally occurring amino acid
  misc_feature (140)..(145): Xaa can be any naturally occurring amino acid
  misc_feature (154)..(155): Xaa can be any naturally occurring amino acid
  misc_feature (160)..(160): Xaa can be any naturally occurring amino acid
  misc_feature (169)..(169): Xaa can be any naturally occurring amino acid
  misc_feature (174)..(184): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXAVGDVXXXGXXXYLIAGAXXAVALVGTAFPIXFSRKXXXXXXXXXDTCPECDGAGFXVRKXXXXXXRANAARKDXXQIVCXNCNGLGKLXQIDKXXXXXXXXXXX

SEQ ID NO: 94636 - protein, 361 aa, artificial
  consensus sequence
  misc_feature (1)..(44): Xaa can be any naturally occurring amino acid
  misc_feature (47)..(47): Xaa can be any naturally occurring amino acid
  misc_feature (51)..(51): Xaa can be any naturally occurring amino acid
  misc_feature (54)..(55): Xaa can be any naturally occurring amino acid
  misc_feature (58)..(59): Xaa can be any naturally occurring amino acid
  misc_feature (62)..(62): Xaa can be any naturally occurring amino acid
  misc_feature (66)..(66): Xaa can be any naturally occurring amino acid
  misc_feature (68)..(72): Xaa can be any naturally occurring amino acid
  misc_feature (74)..(74): Xaa can be any naturally occurring amino acid
  misc_feature (76)..(81): Xaa can be any naturally occurring amino acid
  misc_feature (83)..(85): Xaa can be any naturally occurring amino acid
  misc_feature (90)..(90): Xaa can be any naturally occurring amino acid
  misc_feature (92)..(93): Xaa can be any naturally occurring amino acid
  misc_feature (95)..(102): Xaa can be any naturally occurring amino acid
  misc_feature (104)..(109): Xaa can be any naturally occurring amino acid
  misc_feature (111)..(111): Xaa can be any naturally occurring amino acid
  misc_feature (114)..(114): Xaa can be any naturally occurring amino acid
  misc_feature (116)..(117): Xaa can be any naturally occurring amino acid
  misc_feature (119)..(131): Xaa can be any naturally occurring amino acid
  misc_feature (133)..(133): Xaa can be any naturally occurring amino acid
  misc_feature (136)..(139): Xaa can be any naturally occurring amino acid
  misc_feature (141)..(143): Xaa can be any naturally occurring amino acid
  misc_feature (145)..(147): Xaa can be any naturally occurring amino acid
  misc_feature (149)..(150): Xaa can be any naturally occurring amino acid
  misc_feature (152)..(152): Xaa can be any naturally occurring amino acid
  misc_feature (154)..(154): Xaa can be any naturally occurring amino acid
  misc_feature (156)..(161): Xaa can be any naturally occurring amino acid
  misc_feature (163)..(176): Xaa can be any naturally occurring amino acid
  misc_feature (178)..(178): Xaa can be any naturally occurring amino acid
  misc_feature (180)..(181): Xaa can be any naturally occurring amino acid
  misc_feature (183)..(183): Xaa can be any naturally occurring amino acid
  misc_feature (186)..(190): Xaa can be any naturally occurring amino acid
  misc_feature (193)..(196): Xaa can be any naturally occurring amino acid
  misc_feature (198)..(208): Xaa can be any naturally occurring amino acid
  misc_feature (211)..(213): Xaa can be any naturally occurring amino acid
  misc_feature (215)..(220): Xaa can be any naturally occurring amino acid
  misc_feature (222)..(226): Xaa can be any naturally occurring amino acid
  misc_feature (228)..(229): Xaa can be any naturally occurring amino acid
  misc_feature (232)..(232): Xaa can be any naturally occurring amino acid
  misc_feature (235)..(251): Xaa can be any naturally occurring amino acid
  misc_feature (254)..(277): Xaa can be any naturally occurring amino acid
  misc_feature (279)..(279): Xaa can be any naturally occurring amino acid
  misc_feature (282)..(285): Xaa can be any naturally occurring amino acid
  misc_feature (287)..(290): Xaa can be any naturally occurring amino acid
  misc_feature (292)..(292): Xaa can be any naturally occurring amino acid
  misc_feature (294)..(297): Xaa can be any naturally occurring amino acid
  misc_feature (299)..(299): Xaa can be any naturally occurring amino acid
  misc_feature (301)..(302): Xaa can be any naturally occurring amino acid
  misc_feature (304)..(361): Xaa can be any naturally occurring amino acid
XXXXXXXXXXXXXXXXXXXXXXXXXXXXXXXXXXXXXXXXXXXXCRXSCGXIPXXYPXXIDXGCGXPXXXXXLXCXXXXXXLXXXTPSGXYXXVXXXXXXXXYXXXXXXVXDPXMXXCXXXXXXXXXXXXXFXLDXXXXFXXXPXXXNXXLXFXCXXXXXXVXXXXXXXXXXXXXXPXRXXSXCDXXXXXCRXXXXCXXXXXXXXXXXCCXXXPXXXXXXRXXXXXCXXYTXVYXXXXXXXXXXXXXXXXXYGXXXXXXXXXXXXXXXXXXXXXXXXGXCGXXXXTXXXXCXCXXXXNXTXXCXXXXXXXXXXXXXXXXXXXXXXXXXXXXXXXXXXXXXXXXXXXXXXXXXXXXXXXXXX

SEQ ID NO: 94637 - protein, 132 aa, artificial
  consensus sequence
  misc_feature (1)..(5): Xaa can be any naturally occurring amino acid
  misc_feature (7)..(7): Xaa can be any naturally occurring amino acid
  misc_feature (10)..(10): Xaa can be any naturally occurring amino acid
  misc_feature (13)..(13): Xaa can be any naturally occurring amino acid
  misc_feature (16)..(17): Xaa can be any naturally occurring amino acid
  misc_feature (21)..(21): Xaa can be any naturally occurring amino acid
  misc_feature (24)..(26): Xaa can be any naturally occurring amino acid
  misc_feature (30)..(31): Xaa can be any naturally occurring amino acid
  misc_feature (33)..(34): Xaa can be any naturally occurring amino acid
  misc_feature (36)..(36): Xaa can be any naturally occurring amino acid
  misc_feature (39)..(72): Xaa can be any naturally occurring amino acid
  misc_feature (74)..(74): Xaa can be any naturally occurring amino acid
  misc_feature (80)..(82): Xaa can be any naturally occurring amino acid
  misc_feature (91)..(95): Xaa can be any naturally occurring amino acid
  misc_feature (97)..(98): Xaa can be any naturally occurring amino acid
  misc_feature (101)..(102): Xaa can be any naturally occurring amino acid
  misc_feature (105)..(114): Xaa can be any naturally occurring amino acid
  misc_feature (116)..(116): Xaa can be any naturally occurring amino acid
  misc_feature (118)..(118): Xaa can be any naturally occurring amino acid
  misc_feature (121)..(121): Xaa can be any naturally occurring amino acid
  misc_feature (125)..(132): Xaa can be any naturally occurring amino acid
XXXXXFXSKXIHXLIXXLLLXTFXXXTESXXPXXHXELXXXXXXXXXXXXXXXXXXXXXXXXXXXXXXXXXXMXYYKPNXXXIGTPSSTSXXXXXGXXGRXXMSXXXXXXXXXXGXSXSGXGGGXXXXXXXX

SEQ ID NO: 94638 - protein, 572 aa, artificial
  consensus sequence
  misc_feature (1)..(250): Xaa can be any naturally occurring amino acid
  misc_feature (252)..(253): Xaa can be any naturally occurring amino acid
  misc_feature (255)..(257): Xaa can be any naturally occurring amino acid
  misc_feature (259)..(260): Xaa can be any naturally occurring amino acid
  misc_feature (263)..(263): Xaa can be any naturally occurring amino acid
  misc_feature (265)..(265): Xaa can be any naturally occurring amino acid
  misc_feature (269)..(269): Xaa can be any naturally occurring amino acid
  misc_feature (271)..(271): Xaa can be any naturally occurring amino acid
  misc_feature (273)..(273): Xaa can be any naturally occurring amino acid
  misc_feature (276)..(285): Xaa can be any naturally occurring amino acid
  misc_feature (287)..(289): Xaa can be any naturally occurring amino acid
  misc_feature (291)..(291): Xaa can be any naturally occurring amino acid
  misc_feature (294)..(295): Xaa can be any naturally occurring amino acid
  misc_feature (298)..(298): Xaa can be any naturally occurring amino acid
  misc_feature (302)..(302): Xaa can be any naturally occurring amino acid
  misc_feature (304)..(305): Xaa can be any naturally occurring amino acid
  misc_feature (307)..(321): Xaa can be any naturally occurring amino acid
  misc_feature (323)..(323): Xaa can be any naturally occurring amino acid
  misc_feature (330)..(330): Xaa can be any naturally occurring amino acid
  misc_feature (334)..(335): Xaa can be any naturally occurring amino acid
  misc_feature (337)..(339): Xaa can be any naturally occurring amino acid
  misc_feature (344)..(344): Xaa can be any naturally occurring amino acid
  misc_feature (351)..(351): Xaa can be any naturally occurring amino acid
  misc_feature (355)..(357): Xaa can be any naturally occurring amino acid
  misc_feature (359)..(361): Xaa can be any naturally occurring amino acid
  misc_feature (363)..(363): Xaa can be any naturally occurring amino acid
  misc_feature (366)..(368): Xaa can be any naturally occurring amino acid
  misc_feature (370)..(370): Xaa can be any naturally occurring amino acid
  misc_feature (372)..(372): Xaa can be any naturally occurring amino acid
  misc_feature (374)..(380): Xaa can be any naturally occurring amino acid
  misc_feature (382)..(382): Xaa can be any naturally occurring amino acid
  misc_feature (384)..(385): Xaa can be any naturally occurring amino acid
  misc_feature (387)..(389): Xaa can be any naturally occurring amino acid
  misc_feature (399)..(400): Xaa can be any naturally occurring amino acid
  misc_feature (402)..(402): Xaa can be any naturally occurring amino acid
  misc_feature (405)..(405): Xaa can be any naturally occurring amino acid
  misc_feature (407)..(413): Xaa can be any naturally occurring amino acid
  misc_feature (415)..(415): Xaa can be any naturally occurring amino acid
  misc_feature (417)..(418): Xaa can be any naturally occurring amino acid
  misc_feature (422)..(422): Xaa can be any naturally occurring amino acid
  misc_feature (424)..(424): Xaa can be any naturally occurring amino acid
  misc_feature (427)..(429): Xaa can be any naturally occurring amino acid
  misc_feature (431)..(434): Xaa can be any naturally occurring amino acid
  misc_feature (436)..(447): Xaa can be any naturally occurring amino acid
  misc_feature (449)..(449): Xaa can be any naturally occurring amino acid
  misc_feature (451)..(451): Xaa can be any naturally occurring amino acid
  misc_feature (454)..(454): Xaa can be any naturally occurring amino acid
  misc_feature (457)..(458): Xaa can be any naturally occurring amino acid
  misc_feature (460)..(460): Xaa can be any naturally occurring amino acid
  misc_feature (462)..(464): Xaa can be any naturally occurring amino acid
  misc_feature (466)..(471): Xaa can be any naturally occurring amino acid
  misc_feature (473)..(474): Xaa can be any naturally occurring amino acid
  misc_feature (476)..(476): Xaa can be any naturally occurring amino acid
  misc_feature (478)..(478): Xaa can be any naturally occurring amino acid
  misc_feature (480)..(484): Xaa can be any naturally occurring amino acid
  misc_feature (486)..(486): Xaa can be any naturally occurring amino acid
  misc_feature (490)..(491): Xaa can be any naturally occurring amino acid
  misc_feature (493)..(499): Xaa can be any naturally occurring amino acid
  misc_feature (502)..(502): Xaa can be any naturally occurring amino acid
  misc_feature (504)..(510): Xaa can be any naturally occurring amino acid
  misc_feature (512)..(512): Xaa can be any naturally occurring amino acid
  misc_feature (515)..(516): Xaa can be any naturally occurring amino acid
  misc_feature (518)..(523): Xaa can be any naturally occurring amino acid
  misc_feature (525)..(527): Xaa can be any naturally occurring amino acid
  misc_feature (530)..(534): Xaa can be any naturally occurring amino acid
  misc_feature (537)..(537): Xaa can be any naturally occurring amino acid
  misc_feature (539)..(550): Xaa can be any naturally occurring amino acid
  misc_feature (552)..(572): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXLXXXAXXMLXLXFLGXLXSXLGXXXXXXXXXXVXXXWXLVXXTFXLCGXFXXLXXXXXXXXXXXXXXXVXDTCVAMXEWVXXPXXXTALDXILPCVDXATAXXXLXXXKXVTXXXVXVXNXXXXXXXNXNXXPXXXPLYYNQSGPXXPXLCXPXXXXXXXRXCXXGEVXLXNAXXXWXXXXCXXXXXXXXXXXXCXTXGRXTPXXYXQXXXAXXXXXXLXXYXPXLXXXXXCXFVRXXFXXXXXXXCPXLXXXXXXXYXGLXXVXXXXXXSXXXWVXXXXXRRXRXXXXXXXXXXXXYXXXXXXXXXXXXXXXXXXXXX

SEQ ID NO: 94639 - protein, 302 aa, artificial
  consensus sequence
  misc_feature (1)..(126): Xaa can be any naturally occurring amino acid
  misc_feature (128)..(130): Xaa can be any naturally occurring amino acid
  misc_feature (132)..(133): Xaa can be any naturally occurring amino acid
  misc_feature (135)..(148): Xaa can be any naturally occurring amino acid
  misc_feature (150)..(154): Xaa can be any naturally occurring amino acid
  misc_feature (156)..(157): Xaa can be any naturally occurring amino acid
  misc_feature (159)..(159): Xaa can be any naturally occurring amino acid
  misc_feature (161)..(163): Xaa can be any naturally occurring amino acid
  misc_feature (165)..(170): Xaa can be any naturally occurring amino acid
  misc_feature (173)..(178): Xaa can be any naturally occurring amino acid
  misc_feature (180)..(181): Xaa can be any naturally occurring amino acid
  misc_feature (184)..(186): Xaa can be any naturally occurring amino acid
  misc_feature (188)..(189): Xaa can be any naturally occurring amino acid
  misc_feature (193)..(195): Xaa can be any naturally occurring amino acid
  misc_feature (197)..(197): Xaa can be any naturally occurring amino acid
  misc_feature (200)..(200): Xaa can be any naturally occurring amino acid
  misc_feature (202)..(210): Xaa can be any naturally occurring amino acid
  misc_feature (212)..(212): Xaa can be any naturally occurring amino acid
  misc_feature (214)..(214): Xaa can be any naturally occurring amino acid
  misc_feature (216)..(218): Xaa can be any naturally occurring amino acid
  misc_feature (220)..(223): Xaa can be any naturally occurring amino acid
  misc_feature (225)..(228): Xaa can be any naturally occurring amino acid
  misc_feature (230)..(233): Xaa can be any naturally occurring amino acid
  misc_feature (236)..(302): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYXXXTXXVXXXXXXXXXXXXXXPXXXXXAXXEXRXXXNXXXXXXYRXXXXXXGXXSFXXXMXXALNXXXGXHYXSXXXXXXXXXPXPXKXXXRXXXXEXXXXEXXXXRGXXXXXXXXXXXXXXXXXXXXXXXXXXXXXXXXXXXXXXXXXXXXXXXXXXXXXXXXXXXXXXXXXXX

SEQ ID NO: 94640 - protein, 657 aa, artificial
  consensus sequence
  misc_feature (1)..(77): Xaa can be any naturally occurring amino acid
  misc_feature (80)..(80): Xaa can be any naturally occurring amino acid
  misc_feature (82)..(82): Xaa can be any naturally occurring amino acid
  misc_feature (85)..(85): Xaa can be any naturally occurring amino acid
  misc_feature (89)..(90): Xaa can be any naturally occurring amino acid
  misc_feature (93)..(93): Xaa can be any naturally occurring amino acid
  misc_feature (96)..(97): Xaa can be any naturally occurring amino acid
  misc_feature (99)..(99): Xaa can be any naturally occurring amino acid
  misc_feature (101)..(101): Xaa can be any naturally occurring amino acid
  misc_feature (111)..(116): Xaa can be any naturally occurring amino acid
  misc_feature (120)..(120): Xaa can be any naturally occurring amino acid
  misc_feature (127)..(128): Xaa can be any naturally occurring amino acid
  misc_feature (131)..(132): Xaa can be any naturally occurring amino acid
  misc_feature (145)..(155): Xaa can be any naturally occurring amino acid
  misc_feature (158)..(172): Xaa can be any naturally occurring amino acid
  misc_feature (177)..(177): Xaa can be any naturally occurring amino acid
  misc_feature (179)..(181): Xaa can be any naturally occurring amino acid
  misc_feature (189)..(189): Xaa can be any naturally occurring amino acid
  misc_feature (194)..(253): Xaa can be any naturally occurring amino acid
  misc_feature (272)..(272): Xaa can be any naturally occurring amino acid
  misc_feature (274)..(275): Xaa can be any naturally occurring amino acid
  misc_feature (279)..(280): Xaa can be any naturally occurring amino acid
  misc_feature (290)..(290): Xaa can be any naturally occurring amino acid
  misc_feature (292)..(326): Xaa can be any naturally occurring amino acid
  misc_feature (335)..(340): Xaa can be any naturally occurring amino acid
  misc_feature (363)..(363): Xaa can be any naturally occurring amino acid
  misc_feature (374)..(374): Xaa can be any naturally occurring amino acid
  misc_feature (382)..(414): Xaa can be any naturally occurring amino acid
  misc_feature (416)..(449): Xaa can be any naturally occurring amino acid
  misc_feature (451)..(511): Xaa can be any naturally occurring amino acid
  misc_feature (513)..(520): Xaa can be any naturally occurring amino acid
  misc_feature (522)..(523): Xaa can be any naturally occurring amino acid
  misc_feature (525)..(657): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXSKXAXGMXALHXXLRXVCXXSXWXYSVFWTIRPXXXXXXRPRXRGGNGCXXGDXXGSLMLMWEDGFCXXXXXXXXXXXCLXXXXXXXXXXXXXXXRKAFXKXXXMSIQLYNXYGEGXXXXXXXXXXXXXXXXXXXXXXXXXXXXXXXXXXXXXXXXXXXXXXXXXXXXXXXXXXXXLMGKVASDKCHKWVFKEPXEXXEPNXXNYWQSSFDAXPXXXXXXXXXXXXXXXXXXXXXXXXXXXXXXXXXXXTIAVIQAGXXXXXXLLQLGSCKIIPEDLHFVLRMRHXFESLGYQSGFXLSQLFSSXXXXXXXXXXXXXXXXXXXXXXXXXXXXXXXXXWXXXXXXXXXXXXXXXXXXXXXXXXXXXXXXXXXXPXXXXXXXXXXXXXXXXXXXXXXXXXXXXXXXXXXXXXXXXXXXXXXXXXXXXXXXXXXXXXNXXXXXXXXLXXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94641 - protein, 176 aa, artificial
  consensus sequence
  misc_feature (1)..(2): Xaa can be any naturally occurring amino acid
  misc_feature (4)..(32): Xaa can be any naturally occurring amino acid
  misc_feature (34)..(72): Xaa can be any naturally occurring amino acid
  misc_feature (75)..(75): Xaa can be any naturally occurring amino acid
  misc_feature (79)..(79): Xaa can be any naturally occurring amino acid
  misc_feature (81)..(81): Xaa can be any naturally occurring amino acid
  misc_feature (83)..(83): Xaa can be any naturally occurring amino acid
  misc_feature (93)..(93): Xaa can be any naturally occurring amino acid
  misc_feature (105)..(105): Xaa can be any naturally occurring amino acid
  misc_feature (108)..(108): Xaa can be any naturally occurring amino acid
  misc_feature (116)..(116): Xaa can be any naturally occurring amino acid
  misc_feature (122)..(122): Xaa can be any naturally occurring amino acid
  misc_feature (124)..(125): Xaa can be any naturally occurring amino acid
  misc_feature (127)..(128): Xaa can be any naturally occurring amino acid
  misc_feature (133)..(139): Xaa can be any naturally occurring amino acid
  misc_feature (142)..(143): Xaa can be any naturally occurring amino acid
  misc_feature (145)..(158): Xaa can be any naturally occurring amino acid
  misc_feature (160)..(162): Xaa can be any naturally occurring amino acid
  misc_feature (164)..(164): Xaa can be any naturally occurring amino acid
  misc_feature (166)..(176): Xaa can be any naturally occurring amino acid
XXMXXXXXXXXXXXXXXXXXXXXXXXXXXXXXSXXXXXXXXXXXXXXXXXXXXXXXXXXXXXXXXXXXXXXXAPXEEKXTXRXPLDFPIEWEXPKPGRRPDIFPXFSXPMKTPLPXPLPADXPXXDXXEEEEXXXXXXXEEXXEXXXXXXXXXXXXXXEXXXPXKXXXXXXXXXXX

SEQ ID NO: 94642 - protein, 277 aa, artificial
  consensus sequence
  misc_feature (1)..(41): Xaa can be any naturally occurring amino acid
  misc_feature (44)..(45): Xaa can be any naturally occurring amino acid
  misc_feature (47)..(47): Xaa can be any naturally occurring amino acid
  misc_feature (50)..(50): Xaa can be any naturally occurring amino acid
  misc_feature (56)..(56): Xaa can be any naturally occurring amino acid
  misc_feature (58)..(62): Xaa can be any naturally occurring amino acid
  misc_feature (64)..(67): Xaa can be any naturally occurring amino acid
  misc_feature (69)..(69): Xaa can be any naturally occurring amino acid
  misc_feature (75)..(75): Xaa can be any naturally occurring amino acid
  misc_feature (77)..(78): Xaa can be any naturally occurring amino acid
  misc_feature (82)..(83): Xaa can be any naturally occurring amino acid
  misc_feature (85)..(90): Xaa can be any naturally occurring amino acid
  misc_feature (92)..(92): Xaa can be any naturally occurring amino acid
  misc_feature (96)..(96): Xaa can be any naturally occurring amino acid
  misc_feature (102)..(103): Xaa can be any naturally occurring amino acid
  misc_feature (105)..(105): Xaa can be any naturally occurring amino acid
  misc_feature (107)..(108): Xaa can be any naturally occurring amino acid
  misc_feature (110)..(112): Xaa can be any naturally occurring amino acid
  misc_feature (115)..(116): Xaa can be any naturally occurring amino acid
  misc_feature (120)..(127): Xaa can be any naturally occurring amino acid
  misc_feature (129)..(130): Xaa can be any naturally occurring amino acid
  misc_feature (132)..(132): Xaa can be any naturally occurring amino acid
  misc_feature (134)..(135): Xaa can be any naturally occurring amino acid
  misc_feature (137)..(141): Xaa can be any naturally occurring amino acid
  misc_feature (144)..(146): Xaa can be any naturally occurring amino acid
  misc_feature (149)..(151): Xaa can be any naturally occurring amino acid
  misc_feature (153)..(153): Xaa can be any naturally occurring amino acid
  misc_feature (156)..(159): Xaa can be any naturally occurring amino acid
  misc_feature (164)..(164): Xaa can be any naturally occurring amino acid
  misc_feature (167)..(169): Xaa can be any naturally occurring amino acid
  misc_feature (171)..(182): Xaa can be any naturally occurring amino acid
  misc_feature (184)..(185): Xaa can be any naturally occurring amino acid
  misc_feature (187)..(190): Xaa can be any naturally occurring amino acid
  misc_feature (192)..(212): Xaa can be any naturally occurring amino acid
  misc_feature (214)..(214): Xaa can be any naturally occurring amino acid
  misc_feature (216)..(219): Xaa can be any naturally occurring amino acid
  misc_feature (221)..(222): Xaa can be any naturally occurring amino acid
  misc_feature (224)..(237): Xaa can be any naturally occurring amino acid
  misc_feature (240)..(241): Xaa can be any naturally occurring amino acid
  misc_feature (244)..(246): Xaa can be any naturally occurring amino acid
  misc_feature (249)..(251): Xaa can be any naturally occurring amino acid
  misc_feature (253)..(266): Xaa can be any naturally occurring amino acid
  misc_feature (268)..(277): Xaa can be any naturally occurring amino acid
XXXXXXXXXXXXXXXXXXXXXXXXXXXXXXXXXXXXXXXXXEMXXAXYFXFVMLIXMXXXXXPXXXXNXTFLMPXDXXLSTXXIXXXXXXVXEFLXRHSIPXXLXFXXLXXXPNXXIVPXXXXXXXXTXXIXNXXRXXXXXNNXXXISXXXCXLGXXXXCHGIXGIXXXPXXXXXXXXXXXXHXXPXXXXPXXXXXXXXXXXXXXXXXXXXXNXSXXXXSXXPXXXXXXXXXXXXXXSPXXQPXXXSPXXXDXXXXXXXXXXXXXXLXXXXXXXXXX

SEQ ID NO: 94643 - protein, 586 aa, artificial
  consensus sequence
  misc_feature (1)..(88): Xaa can be any naturally occurring amino acid
  misc_feature (90)..(180): Xaa can be any naturally occurring amino acid
  misc_feature (182)..(182): Xaa can be any naturally occurring amino acid
  misc_feature (186)..(189): Xaa can be any naturally occurring amino acid
  misc_feature (191)..(199): Xaa can be any naturally occurring amino acid
  misc_feature (201)..(201): Xaa can be any naturally occurring amino acid
  misc_feature (203)..(204): Xaa can be any naturally occurring amino acid
  misc_feature (207)..(208): Xaa can be any naturally occurring amino acid
  misc_feature (211)..(212): Xaa can be any naturally occurring amino acid
  misc_feature (217)..(256): Xaa can be any naturally occurring amino acid
  misc_feature (258)..(325): Xaa can be any naturally occurring amino acid
  misc_feature (327)..(336): Xaa can be any naturally occurring amino acid
  misc_feature (338)..(338): Xaa can be any naturally occurring amino acid
  misc_feature (340)..(586): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXWRFXXXXEXXXXXXXXXNXAXXRYXXQNXXLLEEXXXXXXXXXXXXXXXXXXXXXXXXXXXXXXXXXXXXXXXXLXXXXXXXXXXXXXXXXXXXXXXXXXXXXXXXXXXXXXXXXXXXXXXXXXXXXXXXXXXXXXXXXXXXXKXXXXXXXXXXKXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94644 - protein, 149 aa, artificial
  consensus sequence
  misc_feature (1)..(3): Xaa can be any naturally occurring amino acid
  misc_feature (5)..(7): Xaa can be any naturally occurring amino acid
  misc_feature (9)..(17): Xaa can be any naturally occurring amino acid
  misc_feature (20)..(22): Xaa can be any naturally occurring amino acid
  misc_feature (25)..(28): Xaa can be any naturally occurring amino acid
  misc_feature (33)..(33): Xaa can be any naturally occurring amino acid
  misc_feature (41)..(47): Xaa can be any naturally occurring amino acid
  misc_feature (49)..(49): Xaa can be any naturally occurring amino acid
  misc_feature (51)..(51): Xaa can be any naturally occurring amino acid
  misc_feature (54)..(55): Xaa can be any naturally occurring amino acid
  misc_feature (57)..(57): Xaa can be any naturally occurring amino acid
  misc_feature (68)..(68): Xaa can be any naturally occurring amino acid
  misc_feature (72)..(73): Xaa can be any naturally occurring amino acid
  misc_feature (76)..(76): Xaa can be any naturally occurring amino acid
  misc_feature (78)..(79): Xaa can be any naturally occurring amino acid
  misc_feature (83)..(83): Xaa can be any naturally occurring amino acid
  misc_feature (86)..(86): Xaa can be any naturally occurring amino acid
  misc_feature (89)..(89): Xaa can be any naturally occurring amino acid
  misc_feature (92)..(93): Xaa can be any naturally occurring amino acid
  misc_feature (96)..(97): Xaa can be any naturally occurring amino acid
  misc_feature (101)..(103): Xaa can be any naturally occurring amino acid
  misc_feature (105)..(107): Xaa can be any naturally occurring amino acid
  misc_feature (112)..(112): Xaa can be any naturally occurring amino acid
  misc_feature (115)..(115): Xaa can be any naturally occurring amino acid
  misc_feature (119)..(136): Xaa can be any naturally occurring amino acid
  misc_feature (138)..(142): Xaa can be any naturally occurring amino acid
  misc_feature (144)..(149): Xaa can be any naturally occurring amino acid
XXXDXXXPXXXXXXXXXRWXXXRRXXXXRRRKXQVVRLGGXXXXXXXRXGXSLXXMXRRMKLRWLKLXYVRXXKKXKXXYRNXVKXFVXAGXXLEXXQQRXXXEXXXFAVPXLGXSFSXXXXXXXXXXXXXXXXXXHXXXXXRXXXXXX

SEQ ID NO: 94645 - protein, 323 aa, artificial
  consensus sequence
  misc_feature (1)..(65): Xaa can be any naturally occurring amino acid
  misc_feature (69)..(70): Xaa can be any naturally occurring amino acid
  misc_feature (78)..(79): Xaa can be any naturally occurring amino acid
  misc_feature (84)..(86): Xaa can be any naturally occurring amino acid
  misc_feature (88)..(89): Xaa can be any naturally occurring amino acid
  misc_feature (91)..(97): Xaa can be any naturally occurring amino acid
  misc_feature (100)..(116): Xaa can be any naturally occurring amino acid
  misc_feature (121)..(128): Xaa can be any naturally occurring amino acid
  misc_feature (131)..(132): Xaa can be any naturally occurring amino acid
  misc_feature (134)..(185): Xaa can be any naturally occurring amino acid
  misc_feature (187)..(212): Xaa can be any naturally occurring amino acid
  misc_feature (215)..(218): Xaa can be any naturally occurring amino acid
  misc_feature (220)..(223): Xaa can be any naturally occurring amino acid
  misc_feature (225)..(225): Xaa can be any naturally occurring amino acid
  misc_feature (227)..(228): Xaa can be any naturally occurring amino acid
  misc_feature (230)..(231): Xaa can be any naturally occurring amino acid
  misc_feature (235)..(236): Xaa can be any naturally occurring amino acid
  misc_feature (239)..(239): Xaa can be any naturally occurring amino acid
  misc_feature (242)..(244): Xaa can be any naturally occurring amino acid
  misc_feature (248)..(248): Xaa can be any naturally occurring amino acid
  misc_feature (250)..(259): Xaa can be any naturally occurring amino acid
  misc_feature (261)..(323): Xaa can be any naturally occurring amino acid
XXXXXXXXXXXXXXXXXXXXXXXXXXXXXXXXXXXXXXXXXXXXXXXXXXXXXXXXXXXXXXXXXNPYXXRGLDKFSXXLSELXXXRXXIXXXXXXXGGXXXXXXXXXXXXXXXXXVRFVXXXXXXXXPIXXKXXXXXXXXXXXXXXXXXXXXXXXXXXXXXXXXXXXXXXXXXXXXXXXXXXXXPXXXXXXXXXXXXXXXXXXXXXXXXXXRPXXXXPXXXXLXLXXLXXFGRXXAIXCTXXXWYLXPXXXXXXXXXXGXXXXXXXXXXXXXXXXXXXXXXXXXXXXXXXXXXXXXXXXXXXXXXXXXXXXXXXXXXXXXXX

SEQ ID NO: 94646 - protein, 294 aa, artificial
  consensus sequence
  misc_feature (1)..(6): Xaa can be any naturally occurring amino acid
  misc_feature (10)..(17): Xaa can be any naturally occurring amino acid
  misc_feature (48)..(48): Xaa can be any naturally occurring amino acid
  misc_feature (70)..(70): Xaa can be any naturally occurring amino acid
  misc_feature (100)..(104): Xaa can be any naturally occurring amino acid
  misc_feature (106)..(113): Xaa can be any naturally occurring amino acid
  misc_feature (115)..(117): Xaa can be any naturally occurring amino acid
  misc_feature (120)..(128): Xaa can be any naturally occurring amino acid
  misc_feature (130)..(130): Xaa can be any naturally occurring amino acid
  misc_feature (132)..(132): Xaa can be any naturally occurring amino acid
  misc_feature (135)..(150): Xaa can be any naturally occurring amino acid
  misc_feature (154)..(154): Xaa can be any naturally occurring amino acid
  misc_feature (156)..(156): Xaa can be any naturally occurring amino acid
  misc_feature (161)..(161): Xaa can be any naturally occurring amino acid
  misc_feature (173)..(173): Xaa can be any naturally occurring amino acid
  misc_feature (175)..(175): Xaa can be any naturally occurring amino acid
  misc_feature (178)..(178): Xaa can be any naturally occurring amino acid
  misc_feature (186)..(186): Xaa can be any naturally occurring amino acid
  misc_feature (194)..(195): Xaa can be any naturally occurring amino acid
  misc_feature (197)..(198): Xaa can be any naturally occurring amino acid
  misc_feature (200)..(200): Xaa can be any naturally occurring amino acid
  misc_feature (203)..(203): Xaa can be any naturally occurring amino acid
  misc_feature (207)..(211): Xaa can be any naturally occurring amino acid
  misc_feature (213)..(215): Xaa can be any naturally occurring amino acid
  misc_feature (219)..(219): Xaa can be any naturally occurring amino acid
  misc_feature (223)..(223): Xaa can be any naturally occurring amino acid
  misc_feature (225)..(227): Xaa can be any naturally occurring amino acid
  misc_feature (231)..(235): Xaa can be any naturally occurring amino acid
  misc_feature (242)..(247): Xaa can be any naturally occurring amino acid
  misc_feature (253)..(254): Xaa can be any naturally occurring amino acid
  misc_feature (256)..(256): Xaa can be any naturally occurring amino acid
  misc_feature (265)..(265): Xaa can be any naturally occurring amino acid
  misc_feature (267)..(274): Xaa can be any naturally occurring amino acid
  misc_feature (279)..(279): Xaa can be any naturally occurring amino acid
  misc_feature (282)..(282): Xaa can be any naturally occurring amino acid
  misc_feature (285)..(285): Xaa can be any naturally occurring amino acid
  misc_feature (287)..(294): Xaa can be any naturally occurring amino acid
XXXXXXLSEXXXXXXXXNSNMSPRISFSRDFCQSDAIPIEKRPLRSSXNSKPSSLNSSIDFDFCIPGGVXSGESFDQGSWSADELFSNGKILPTEIKKKXXXXXKXXXXXXXXPXXXKPXXXXXXXXXSXKXRKXXXXXXXXXXXXXXXXEEKXNXKSFWXFKRSSSLNCGSXYXRSXLCPLPLLXRSNSTGSXXSXXKXSSXSRKXXXXXKXXXSSSXSSSXSXXXSLSXXXXXKPPLKKXXXXXXYGSHGXXGXRVSPVINVXPXXXXXXXXNLFGXGSXFSXNXXXXXXXX

SEQ ID NO: 94647 - protein, 550 aa, artificial
  consensus sequence
  misc_feature (1)..(17): Xaa can be any naturally occurring amino acid
  misc_feature (19)..(22): Xaa can be any naturally occurring amino acid
  misc_feature (24)..(44): Xaa can be any naturally occurring amino acid
  misc_feature (46)..(46): Xaa can be any naturally occurring amino acid
  misc_feature (48)..(62): Xaa can be any naturally occurring amino acid
  misc_feature (64)..(88): Xaa can be any naturally occurring amino acid
  misc_feature (92)..(100): Xaa can be any naturally occurring amino acid
  misc_feature (102)..(103): Xaa can be any naturally occurring amino acid
  misc_feature (106)..(107): Xaa can be any naturally occurring amino acid
  misc_feature (109)..(109): Xaa can be any naturally occurring amino acid
  misc_feature (111)..(112): Xaa can be any naturally occurring amino acid
  misc_feature (114)..(122): Xaa can be any naturally occurring amino acid
  misc_feature (125)..(129): Xaa can be any naturally occurring amino acid
  misc_feature (131)..(275): Xaa can be any naturally occurring amino acid
  misc_feature (281)..(342): Xaa can be any naturally occurring amino acid
  misc_feature (344)..(344): Xaa can be any naturally occurring amino acid
  misc_feature (357)..(357): Xaa can be any naturally occurring amino acid
  misc_feature (362)..(362): Xaa can be any naturally occurring amino acid
  misc_feature (365)..(365): Xaa can be any naturally occurring amino acid
  misc_feature (368)..(384): Xaa can be any naturally occurring amino acid
  misc_feature (387)..(388): Xaa can be any naturally occurring amino acid
  misc_feature (393)..(394): Xaa can be any naturally occurring amino acid
  misc_feature (397)..(397): Xaa can be any naturally occurring amino acid
  misc_feature (399)..(399): Xaa can be any naturally occurring amino acid
  misc_feature (401)..(402): Xaa can be any naturally occurring amino acid
  misc_feature (404)..(405): Xaa can be any naturally occurring amino acid
  misc_feature (412)..(412): Xaa can be any naturally occurring amino acid
  misc_feature (416)..(418): Xaa can be any naturally occurring amino acid
  misc_feature (421)..(421): Xaa can be any naturally occurring amino acid
  misc_feature (425)..(448): Xaa can be any naturally occurring amino acid
  misc_feature (451)..(452): Xaa can be any naturally occurring amino acid
  misc_feature (454)..(454): Xaa can be any naturally occurring amino acid
  misc_feature (461)..(464): Xaa can be any naturally occurring amino acid
  misc_feature (469)..(483): Xaa can be any naturally occurring amino acid
  misc_feature (485)..(486): Xaa can be any naturally occurring amino acid
  misc_feature (488)..(489): Xaa can be any naturally occurring amino acid
  misc_feature (491)..(492): Xaa can be any naturally occurring amino acid
  misc_feature (495)..(550): Xaa can be any naturally occurring amino acid
XXXXXXXXXXXXXXXXXKXXXXPXXXXXXXXXXXXXXXXXXXXXPXPXXXXXXXXXXXXXXXGXXXXXXXXXXXXXXXXXXXXXXXXXSSEXXXXXXXXXWXXDLXXEXPXXPXXXXXXXXXHRXXXXXSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKRAKQXXXXXXXXXXXXXXXXXXXXXXXXXXXXXXXXXXXXXXXXXXXXXXXXXXXXXXXXXXXXXXQXAQRSRVRKLQYIXELERXVQXLQXXXXXXXXXXXXXXXXXEGXXVSAEXXFLXQXNXXLXXENKALKXRLEXXXQEXLIKXXXXXXXXXXXXXXXXXXXXXXXXQEXXEXEIGRLRXXXXQQQQXXXXXXXXXXXXXXXRXXSXXLXXQFXXXXXXXXXXXXXXXXXXXXXXXXXXXXXXXXXXXXXXXXXXXXXXXXXXXXXXXX

SEQ ID NO: 94648 - protein, 488 aa, artificial
  consensus sequence
  misc_feature (1)..(8): Xaa can be any naturally occurring amino acid
  misc_feature (10)..(57): Xaa can be any naturally occurring amino acid
  misc_feature (59)..(81): Xaa can be any naturally occurring amino acid
  misc_feature (83)..(95): Xaa can be any naturally occurring amino acid
  misc_feature (97)..(97): Xaa can be any naturally occurring amino acid
  misc_feature (99)..(101): Xaa can be any naturally occurring amino acid
  misc_feature (104)..(119): Xaa can be any naturally occurring amino acid
  misc_feature (122)..(122): Xaa can be any naturally occurring amino acid
  misc_feature (124)..(125): Xaa can be any naturally occurring amino acid
  misc_feature (128)..(129): Xaa can be any naturally occurring amino acid
  misc_feature (131)..(142): Xaa can be any naturally occurring amino acid
  misc_feature (144)..(144): Xaa can be any naturally occurring amino acid
  misc_feature (147)..(147): Xaa can be any naturally occurring amino acid
  misc_feature (150)..(150): Xaa can be any naturally occurring amino acid
  misc_feature (154)..(155): Xaa can be any naturally occurring amino acid
  misc_feature (159)..(160): Xaa can be any naturally occurring amino acid
  misc_feature (162)..(170): Xaa can be any naturally occurring amino acid
  misc_feature (172)..(172): Xaa can be any naturally occurring amino acid
  misc_feature (174)..(197): Xaa can be any naturally occurring amino acid
  misc_feature (206)..(206): Xaa can be any naturally occurring amino acid
  misc_feature (208)..(227): Xaa can be any naturally occurring amino acid
  misc_feature (229)..(231): Xaa can be any naturally occurring amino acid
  misc_feature (233)..(244): Xaa can be any naturally occurring amino acid
  misc_feature (246)..(257): Xaa can be any naturally occurring amino acid
  misc_feature (261)..(261): Xaa can be any naturally occurring amino acid
  misc_feature (263)..(263): Xaa can be any naturally occurring amino acid
  misc_feature (265)..(268): Xaa can be any naturally occurring amino acid
  misc_feature (270)..(271): Xaa can be any naturally occurring amino acid
  misc_feature (275)..(275): Xaa can be any naturally occurring amino acid
  misc_feature (278)..(278): Xaa can be any naturally occurring amino acid
  misc_feature (281)..(282): Xaa can be any naturally occurring amino acid
  misc_feature (284)..(285): Xaa can be any naturally occurring amino acid
  misc_feature (287)..(488): Xaa can be any naturally occurring amino acid
XXXXXXXXPXXXXXXXXXXXXXXXXXXXXXXXXXXXXXXXXXXXXXXXXXXXXXXXXWXXXXXXXXXXXXXXXXXXXXXXXKXXXXXXXXXXXXXWXGXXXAPXXXXXXXXXXXXXXXXGSXKXXIHXXGXXXXXXXXXXXXLXLLXRVXPSEXXLKSXXKXXXXXXXXXPXSXXXXXXXXXXXXXXXXXXXXXXXXLVRRRLRHXAXXXXXXXXXXXXXXXXXXXXGXXXHXXXXXXXXXXXXPXXXXXXXXXXXXLPNXPXFXXXXRXXSHWXALXGSXXLXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94649 - protein, 806 aa, artificial
  consensus sequence
  misc_feature (1)..(149): Xaa can be any naturally occurring amino acid
  misc_feature (151)..(153): Xaa can be any naturally occurring amino acid
  misc_feature (155)..(160): Xaa can be any naturally occurring amino acid
  misc_feature (162)..(167): Xaa can be any naturally occurring amino acid
  misc_feature (169)..(183): Xaa can be any naturally occurring amino acid
  misc_feature (185)..(190): Xaa can be any naturally occurring amino acid
  misc_feature (192)..(193): Xaa can be any naturally occurring amino acid
  misc_feature (195)..(198): Xaa can be any naturally occurring amino acid
  misc_feature (200)..(201): Xaa can be any naturally occurring amino acid
  misc_feature (204)..(206): Xaa can be any naturally occurring amino acid
  misc_feature (208)..(219): Xaa can be any naturally occurring amino acid
  misc_feature (221)..(223): Xaa can be any naturally occurring amino acid
  misc_feature (225)..(227): Xaa can be any naturally occurring amino acid
  misc_feature (229)..(231): Xaa can be any naturally occurring amino acid
  misc_feature (233)..(235): Xaa can be any naturally occurring amino acid
  misc_feature (237)..(238): Xaa can be any naturally occurring amino acid
  misc_feature (240)..(240): Xaa can be any naturally occurring amino acid
  misc_feature (245)..(246): Xaa can be any naturally occurring amino acid
  misc_feature (249)..(250): Xaa can be any naturally occurring amino acid
  misc_feature (253)..(254): Xaa can be any naturally occurring amino acid
  misc_feature (256)..(256): Xaa can be any naturally occurring amino acid
  misc_feature (260)..(261): Xaa can be any naturally occurring amino acid
  misc_feature (264)..(303): Xaa can be any naturally occurring amino acid
  misc_feature (307)..(307): Xaa can be any naturally occurring amino acid
  misc_feature (309)..(311): Xaa can be any naturally occurring amino acid
  misc_feature (314)..(316): Xaa can be any naturally occurring amino acid
  misc_feature (318)..(318): Xaa can be any naturally occurring amino acid
  misc_feature (320)..(334): Xaa can be any naturally occurring amino acid
  misc_feature (338)..(341): Xaa can be any naturally occurring amino acid
  misc_feature (344)..(347): Xaa can be any naturally occurring amino acid
  misc_feature (349)..(368): Xaa can be any naturally occurring amino acid
  misc_feature (370)..(387): Xaa can be any naturally occurring amino acid
  misc_feature (390)..(806): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYXXXSXXXXXXLXXXXXXLXXXXXXXXXXXXXXXAXXXXXXGXXYXXXXAXXSPXXXKXXXXXXXXXXXXLXXXSXXXDXXXGXXXGXXLXVGGFXXFMXXGSXXAXRFGXXLGXXXXXXXXXXXXXXXXXXXXXXXXXXXXXXXXXXXXXXXXALLXLXXXSLXXXRXGXXXXXXXXXXXXXXXKGQXXXXAIXXXXFXXXXXXXXXXXXXXXXXXXXLXXXXXXXXXXXXXXXXXXFYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94650 - protein, 774 aa, artificial
  consensus sequence
  misc_feature (1)..(424): Xaa can be any naturally occurring amino acid
  misc_feature (426)..(427): Xaa can be any naturally occurring amino acid
  misc_feature (429)..(431): Xaa can be any naturally occurring amino acid
  misc_feature (433)..(433): Xaa can be any naturally occurring amino acid
  misc_feature (442)..(442): Xaa can be any naturally occurring amino acid
  misc_feature (452)..(463): Xaa can be any naturally occurring amino acid
  misc_feature (468)..(468): Xaa can be any naturally occurring amino acid
  misc_feature (472)..(476): Xaa can be any naturally occurring amino acid
  misc_feature (478)..(478): Xaa can be any naturally occurring amino acid
  misc_feature (481)..(489): Xaa can be any naturally occurring amino acid
  misc_feature (507)..(507): Xaa can be any naturally occurring amino acid
  misc_feature (510)..(531): Xaa can be any naturally occurring amino acid
  misc_feature (533)..(535): Xaa can be any naturally occurring amino acid
  misc_feature (537)..(539): Xaa can be any naturally occurring amino acid
  misc_feature (541)..(553): Xaa can be any naturally occurring amino acid
  misc_feature (555)..(558): Xaa can be any naturally occurring amino acid
  misc_feature (560)..(560): Xaa can be any naturally occurring amino acid
  misc_feature (562)..(563): Xaa can be any naturally occurring amino acid
  misc_feature (565)..(566): Xaa can be any naturally occurring amino acid
  misc_feature (568)..(581): Xaa can be any naturally occurring amino acid
  misc_feature (583)..(596): Xaa can be any naturally occurring amino acid
  misc_feature (598)..(599): Xaa can be any naturally occurring amino acid
  misc_feature (601)..(616): Xaa can be any naturally occurring amino acid
  misc_feature (618)..(620): Xaa can be any naturally occurring amino acid
  misc_feature (624)..(624): Xaa can be any naturally occurring amino acid
  misc_feature (640)..(640): Xaa can be any naturally occurring amino acid
  misc_feature (642)..(642): Xaa can be any naturally occurring amino acid
  misc_feature (644)..(644): Xaa can be any naturally occurring amino acid
  misc_feature (647)..(654): Xaa can be any naturally occurring amino acid
  misc_feature (656)..(664): Xaa can be any naturally occurring amino acid
  misc_feature (666)..(702): Xaa can be any naturally occurring amino acid
  misc_feature (704)..(705): Xaa can be any naturally occurring amino acid
  misc_feature (707)..(714): Xaa can be any naturally occurring amino acid
  misc_feature (716)..(717): Xaa can be any naturally occurring amino acid
  misc_feature (719)..(730): Xaa can be any naturally occurring amino acid
  misc_feature (741)..(745): Xaa can be any naturally occurring amino acid
  misc_feature (747)..(747): Xaa can be any naturally occurring amino acid
  misc_feature (749)..(760): Xaa can be any naturally occurring amino acid
  misc_feature (765)..(774): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMXXSXXXPXSSPGRTEKXPPPLMRFLRXXXXXXXXXXXXSRSRXRSRXXXXXFXRKXXXXXXXXXTQEPSSPKVTCMGQVRVXRSXXXXXXXXXXXXXXXXXXXXXXRXXXWXXXAXXXXXXXXXXXXXPXXXXPXWXXWXXFXXXXXXXXXXXXXXSXXXXXXXXXXXXXXEXXEXXXXXXXXXXXXXXXXSXXXTPPXNALLLTRCRSAPYRSXSXAXRFXXXXXXXXEXXXXXXXXXEXXXXXXXXXXXXXXXXXXXXXXXXXXXXXXXXXXXXXSXXEXXXXXXXXEXXKXXXXXXXXXXXXLTRCKSEPARXXXXXLXPXXXXXXXXXXXXRLGFXXXXXXXXXX

SEQ ID NO: 94651 - protein, 767 aa, artificial
  consensus sequence
  misc_feature (1)..(570): Xaa can be any naturally occurring amino acid
  misc_feature (572)..(573): Xaa can be any naturally occurring amino acid
  misc_feature (575)..(575): Xaa can be any naturally occurring amino acid
  misc_feature (580)..(580): Xaa can be any naturally occurring amino acid
  misc_feature (582)..(583): Xaa can be any naturally occurring amino acid
  misc_feature (586)..(587): Xaa can be any naturally occurring amino acid
  misc_feature (589)..(593): Xaa can be any naturally occurring amino acid
  misc_feature (597)..(600): Xaa can be any naturally occurring amino acid
  misc_feature (605)..(607): Xaa can be any naturally occurring amino acid
  misc_feature (609)..(610): Xaa can be any naturally occurring amino acid
  misc_feature (612)..(613): Xaa can be any naturally occurring amino acid
  misc_feature (618)..(624): Xaa can be any naturally occurring amino acid
  misc_feature (626)..(627): Xaa can be any naturally occurring amino acid
  misc_feature (634)..(634): Xaa can be any naturally occurring amino acid
  misc_feature (638)..(638): Xaa can be any naturally occurring amino acid
  misc_feature (644)..(650): Xaa can be any naturally occurring amino acid
  misc_feature (652)..(652): Xaa can be any naturally occurring amino acid
  misc_feature (654)..(654): Xaa can be any naturally occurring amino acid
  misc_feature (656)..(656): Xaa can be any naturally occurring amino acid
  misc_feature (658)..(658): Xaa can be any naturally occurring amino acid
  misc_feature (660)..(661): Xaa can be any naturally occurring amino acid
  misc_feature (666)..(705): Xaa can be any naturally occurring amino acid
  misc_feature (707)..(707): Xaa can be any naturally occurring amino acid
  misc_feature (715)..(715): Xaa can be any naturally occurring amino acid
  misc_feature (717)..(734): Xaa can be any naturally occurring amino acid
  misc_feature (738)..(738): Xaa can be any naturally occurring amino acid
  misc_feature (740)..(740): Xaa can be any naturally occurring amino acid
  misc_feature (742)..(744): Xaa can be any naturally occurring amino acid
  misc_feature (746)..(767): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXHXDEEGXKXXEKXXVXXXXXPDTXXXXERKLXXXGXXRXXRHPAXXXXXXXIXXPPPKSGXGGKXTWEGPXXXXXXXLXPXPXAXDXXDPNYXXXXXXXXXXXXXXXXXXXXXXXXXXXXXXXXXXXXXXXXVXGEVEVAKXAXXXXXXXXXXXXXXXXXXGVAXVXVXXXLXXXXXXXXXXXXXXXXXXXXXX

SEQ ID NO: 94652 - protein, 275 aa, artificial
  consensus sequence
  misc_feature (1)..(41): Xaa can be any naturally occurring amino acid
  misc_feature (43)..(93): Xaa can be any naturally occurring amino acid
  misc_feature (95)..(95): Xaa can be any naturally occurring amino acid
  misc_feature (97)..(97): Xaa can be any naturally occurring amino acid
  misc_feature (101)..(104): Xaa can be any naturally occurring amino acid
  misc_feature (109)..(109): Xaa can be any naturally occurring amino acid
  misc_feature (112)..(112): Xaa can be any naturally occurring amino acid
  misc_feature (118)..(118): Xaa can be any naturally occurring amino acid
  misc_feature (120)..(120): Xaa can be any naturally occurring amino acid
  misc_feature (123)..(123): Xaa can be any naturally occurring amino acid
  misc_feature (126)..(127): Xaa can be any naturally occurring amino acid
  misc_feature (130)..(131): Xaa can be any naturally occurring amino acid
  misc_feature (134)..(134): Xaa can be any naturally occurring amino acid
  misc_feature (137)..(151): Xaa can be any naturally occurring amino acid
  misc_feature (158)..(158): Xaa can be any naturally occurring amino acid
  misc_feature (160)..(160): Xaa can be any naturally occurring amino acid
  misc_feature (162)..(163): Xaa can be any naturally occurring amino acid
  misc_feature (167)..(168): Xaa can be any naturally occurring amino acid
  misc_feature (171)..(171): Xaa can be any naturally occurring amino acid
  misc_feature (174)..(175): Xaa can be any naturally occurring amino acid
  misc_feature (178)..(179): Xaa can be any naturally occurring amino acid
  misc_feature (183)..(183): Xaa can be any naturally occurring amino acid
  misc_feature (187)..(187): Xaa can be any naturally occurring amino acid
  misc_feature (198)..(198): Xaa can be any naturally occurring amino acid
  misc_feature (201)..(203): Xaa can be any naturally occurring amino acid
  misc_feature (206)..(207): Xaa can be any naturally occurring amino acid
  misc_feature (209)..(226): Xaa can be any naturally occurring amino acid
  misc_feature (228)..(232): Xaa can be any naturally occurring amino acid
  misc_feature (234)..(235): Xaa can be any naturally occurring amino acid
  misc_feature (241)..(242): Xaa can be any naturally occurring amino acid
  misc_feature (244)..(245): Xaa can be any naturally occurring amino acid
  misc_feature (248)..(248): Xaa can be any naturally occurring amino acid
  misc_feature (250)..(250): Xaa can be any naturally occurring amino acid
  misc_feature (253)..(253): Xaa can be any naturally occurring amino acid
  misc_feature (256)..(256): Xaa can be any naturally occurring amino acid
  misc_feature (260)..(263): Xaa can be any naturally occurring amino acid
  misc_feature (265)..(269): Xaa can be any naturally occurring amino acid
  misc_feature (271)..(272): Xaa can be any naturally occurring amino acid
XXXXXXXXXXXXXXXXXXXXXXXXXXXXXXXXXXXXXXXXXMXXXXXXXXXXXXXXXXXXXXXXXXXXXXXXXXXXXXXXXXXXXXXXXXXXXEXAXQALXXXXQLHFXKTXEKKRAXDXQKXELXXLFXXFFXFLXXXXXXXXXXXXXXXRLQCRHXWXPXXLLSXXHLXFYXXVAXXLRCXNGFXYQRRCHKLTLXLAXXXLRXXKXXXXXXXXXXXXXXXXXXVXXXXXEXXYQEPPXXYXXKFXRXWAXHFXFLIXXXXFXXXXXVXXLCF

SEQ ID NO: 94653 - protein, 1081 aa, artificial
  consensus sequence
  misc_feature (1)..(703): Xaa can be any naturally occurring amino acid
  misc_feature (705)..(969): Xaa can be any naturally occurring amino acid
  misc_feature (971)..(972): Xaa can be any naturally occurring amino acid
  misc_feature (974)..(974): Xaa can be any naturally occurring amino acid
  misc_feature (977)..(978): Xaa can be any naturally occurring amino acid
  misc_feature (981)..(982): Xaa can be any naturally occurring amino acid
  misc_feature (984)..(985): Xaa can be any naturally occurring amino acid
  misc_feature (987)..(988): Xaa can be any naturally occurring amino acid
  misc_feature (991)..(994): Xaa can be any naturally occurring amino acid
  misc_feature (996)..(998): Xaa can be any naturally occurring amino acid
  misc_feature (1001)..(1002): Xaa can be any naturally occurring amino acid
  misc_feature (1006)..(1006): Xaa can be any naturally occurring amino acid
  misc_feature (1008)..(1009): Xaa can be any naturally occurring amino acid
  misc_feature (1012)..(1013): Xaa can be any naturally occurring amino acid
  misc_feature (1016)..(1016): Xaa can be any naturally occurring amino acid
  misc_feature (1018)..(1018): Xaa can be any naturally occurring amino acid
  misc_feature (1021)..(1022): Xaa can be any naturally occurring amino acid
  misc_feature (1026)..(1026): Xaa can be any naturally occurring amino acid
  misc_feature (1028)..(1081): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXLXWTXXEEXXLXXGXXKFXXXXNXXXPWXXILEXGXXVFXXTRXPXDLXXKWRXMXXXXXXXXXXXXXXXXXXXXXXXXXXXXXXXXXXXXXXXXXXXXXXXXXXXXXX

SEQ ID NO: 94654 - protein, 1069 aa, artificial
  consensus sequence
  misc_feature (1)..(664): Xaa can be any naturally occurring amino acid
  misc_feature (666)..(778): Xaa can be any naturally occurring amino acid
  misc_feature (780)..(780): Xaa can be any naturally occurring amino acid
  misc_feature (783)..(784): Xaa can be any naturally occurring amino acid
  misc_feature (786)..(792): Xaa can be any naturally occurring amino acid
  misc_feature (794)..(797): Xaa can be any naturally occurring amino acid
  misc_feature (799)..(852): Xaa can be any naturally occurring amino acid
  misc_feature (854)..(856): Xaa can be any naturally occurring amino acid
  misc_feature (858)..(858): Xaa can be any naturally occurring amino acid
  misc_feature (861)..(862): Xaa can be any naturally occurring amino acid
  misc_feature (864)..(869): Xaa can be any naturally occurring amino acid
  misc_feature (871)..(887): Xaa can be any naturally occurring amino acid
  misc_feature (889)..(901): Xaa can be any naturally occurring amino acid
  misc_feature (903)..(924): Xaa can be any naturally occurring amino acid
  misc_feature (926)..(942): Xaa can be any naturally occurring amino acid
  misc_feature (944)..(946): Xaa can be any naturally occurring amino acid
  misc_feature (948)..(950): Xaa can be any naturally occurring amino acid
  misc_feature (952)..(954): Xaa can be any naturally occurring amino acid
  misc_feature (956)..(976): Xaa can be any naturally occurring amino acid
  misc_feature (980)..(981): Xaa can be any naturally occurring amino acid
  misc_feature (983)..(984): Xaa can be any naturally occurring amino acid
  misc_feature (987)..(988): Xaa can be any naturally occurring amino acid
  misc_feature (991)..(1069): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFXYGXXVXXXXXXXEXXXXLXXXXXXXXXXXXXXXXXXXXXXXXXXXXXXXXXXXXXXXXXXXXXXXXXXXXXXIXXXLXQSXXLXXXXXXVXXXXXXXXXXXXXXXXXGXXXXXXXXXXXXXGXXXXXXXXXXXXXXXXXXXXXXWXXXXXXXXXXXXXXXXXEXXXRXXXLXXXLXXXXXXXXXXXXXXXXXXXXXLEWXXIXXLIXXEIXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94655 - protein, 985 aa, artificial
  consensus sequence
  misc_feature (1)..(123): Xaa can be any naturally occurring amino acid
  misc_feature (130)..(130): Xaa can be any naturally occurring amino acid
  misc_feature (135)..(135): Xaa can be any naturally occurring amino acid
  misc_feature (138)..(138): Xaa can be any naturally occurring amino acid
  misc_feature (146)..(146): Xaa can be any naturally occurring amino acid
  misc_feature (149)..(155): Xaa can be any naturally occurring amino acid
  misc_feature (157)..(158): Xaa can be any naturally occurring amino acid
  misc_feature (161)..(161): Xaa can be any naturally occurring amino acid
  misc_feature (165)..(204): Xaa can be any naturally occurring amino acid
  misc_feature (206)..(210): Xaa can be any naturally occurring amino acid
  misc_feature (212)..(253): Xaa can be any naturally occurring amino acid
  misc_feature (255)..(277): Xaa can be any naturally occurring amino acid
  misc_feature (279)..(280): Xaa can be any naturally occurring amino acid
  misc_feature (282)..(284): Xaa can be any naturally occurring amino acid
  misc_feature (289)..(985): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVWDCGSXLYDSXELXSFKRQLDXAIXXXXXXXRXXSMXHLPXXXXXXXXXXXXXXXXXXXXXXXXXXXXXXXXXXXXXXXXRXXXXXLXXXXXXXXXXXXXXXXXXXXXXXXXXXXXXXXXXXXXXXXXXSXXXXXXXXXXXXXXXXXXXXXXXSXXRXXXSERFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94656 - protein, 216 aa, artificial
  consensus sequence
  misc_feature (1)..(16): Xaa can be any naturally occurring amino acid
  misc_feature (18)..(29): Xaa can be any naturally occurring amino acid
  misc_feature (31)..(31): Xaa can be any naturally occurring amino acid
  misc_feature (33)..(41): Xaa can be any naturally occurring amino acid
  misc_feature (44)..(44): Xaa can be any naturally occurring amino acid
  misc_feature (46)..(46): Xaa can be any naturally occurring amino acid
  misc_feature (54)..(54): Xaa can be any naturally occurring amino acid
  misc_feature (56)..(58): Xaa can be any naturally occurring amino acid
  misc_feature (65)..(66): Xaa can be any naturally occurring amino acid
  misc_feature (70)..(71): Xaa can be any naturally occurring amino acid
  misc_feature (73)..(73): Xaa can be any naturally occurring amino acid
  misc_feature (79)..(79): Xaa can be any naturally occurring amino acid
  misc_feature (88)..(88): Xaa can be any naturally occurring amino acid
  misc_feature (90)..(94): Xaa can be any naturally occurring amino acid
  misc_feature (101)..(101): Xaa can be any naturally occurring amino acid
  misc_feature (106)..(106): Xaa can be any naturally occurring amino acid
  misc_feature (109)..(109): Xaa can be any naturally occurring amino acid
  misc_feature (113)..(113): Xaa can be any naturally occurring amino acid
  misc_feature (116)..(117): Xaa can be any naturally occurring amino acid
  misc_feature (120)..(120): Xaa can be any naturally occurring amino acid
  misc_feature (127)..(133): Xaa can be any naturally occurring amino acid
  misc_feature (135)..(152): Xaa can be any naturally occurring amino acid
  misc_feature (154)..(163): Xaa can be any naturally occurring amino acid
  misc_feature (165)..(167): Xaa can be any naturally occurring amino acid
  misc_feature (169)..(216): Xaa can be any naturally occurring amino acid
XXXXXXXXXXXXXXXXAXXXXXXXXXXXXGXGXXXXXXXXXLRXRXGMGLPVGXHXXXVPDKPLXXNDEXXLXWDNGTXFPEPCIDRXAXXXXXGKYEALXWLCGXGLXFFAXLGXXAVXNDKASKXXXXXXXPXXXXXXXXXXXXXXXXXXPXXXXXXXXXXLXXXLXXXXXXXXXXXXXXXXXXXXXXXXXXXXXXXXXXXXXXXXXXXXXXXX

SEQ ID NO: 94657 - protein, 365 aa, artificial
  consensus sequence
  misc_feature (1)..(124): Xaa can be any naturally occurring amino acid
  misc_feature (127)..(133): Xaa can be any naturally occurring amino acid
  misc_feature (151)..(151): Xaa can be any naturally occurring amino acid
  misc_feature (154)..(154): Xaa can be any naturally occurring amino acid
  misc_feature (156)..(157): Xaa can be any naturally occurring amino acid
  misc_feature (160)..(160): Xaa can be any naturally occurring amino acid
  misc_feature (162)..(162): Xaa can be any naturally occurring amino acid
  misc_feature (166)..(166): Xaa can be any naturally occurring amino acid
  misc_feature (169)..(173): Xaa can be any naturally occurring amino acid
  misc_feature (180)..(181): Xaa can be any naturally occurring amino acid
  misc_feature (183)..(183): Xaa can be any naturally occurring amino acid
  misc_feature (186)..(186): Xaa can be any naturally occurring amino acid
  misc_feature (188)..(189): Xaa can be any naturally occurring amino acid
  misc_feature (191)..(193): Xaa can be any naturally occurring amino acid
  misc_feature (196)..(198): Xaa can be any naturally occurring amino acid
  misc_feature (201)..(201): Xaa can be any naturally occurring amino acid
  misc_feature (204)..(204): Xaa can be any naturally occurring amino acid
  misc_feature (206)..(206): Xaa can be any naturally occurring amino acid
  misc_feature (208)..(208): Xaa can be any naturally occurring amino acid
  misc_feature (210)..(210): Xaa can be any naturally occurring amino acid
  misc_feature (212)..(215): Xaa can be any naturally occurring amino acid
  misc_feature (218)..(218): Xaa can be any naturally occurring amino acid
  misc_feature (220)..(234): Xaa can be any naturally occurring amino acid
  misc_feature (236)..(240): Xaa can be any naturally occurring amino acid
  misc_feature (244)..(244): Xaa can be any naturally occurring amino acid
  misc_feature (247)..(248): Xaa can be any naturally occurring amino acid
  misc_feature (253)..(255): Xaa can be any naturally occurring amino acid
  misc_feature (258)..(265): Xaa can be any naturally occurring amino acid
  misc_feature (267)..(281): Xaa can be any naturally occurring amino acid
  misc_feature (283)..(290): Xaa can be any naturally occurring amino acid
  misc_feature (293)..(338): Xaa can be any naturally occurring amino acid
  misc_feature (340)..(344): Xaa can be any naturally occurring amino acid
  misc_feature (346)..(347): Xaa can be any naturally occurring amino acid
  misc_feature (350)..(350): Xaa can be any naturally occurring amino acid
  misc_feature (353)..(365): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQRXXXXXXXGRPSGTDGSDFSYRMVVXSRXYXXVAXGXSRLXRLXXXXXILVQALXXVXGGXLXXLXXXKGXXXNKXAVXSXAXGXLXXXXGEXGXXXXXXXXXXXXXXXRXXXXXLLRXYTXXSSIAXXXSVXXXXXXXXLXXXXXXXXXXXXXXXEXXXXXXXXLGXXXXXXXXXXXXXXXXXXXXXXXXXXXXXXXXXXXXXXXXXXXXXXIXXXXXLXXNMXPPXXXXXXXXXXXXX

SEQ ID NO: 94658 - protein, 349 aa, artificial
  consensus sequence
  misc_feature (1)..(187): Xaa can be any naturally occurring amino acid
  misc_feature (189)..(199): Xaa can be any naturally occurring amino acid
  misc_feature (201)..(205): Xaa can be any naturally occurring amino acid
  misc_feature (207)..(207): Xaa can be any naturally occurring amino acid
  misc_feature (212)..(217): Xaa can be any naturally occurring amino acid
  misc_feature (219)..(221): Xaa can be any naturally occurring amino acid
  misc_feature (223)..(223): Xaa can be any naturally occurring amino acid
  misc_feature (226)..(226): Xaa can be any naturally occurring amino acid
  misc_feature (228)..(228): Xaa can be any naturally occurring amino acid
  misc_feature (230)..(230): Xaa can be any naturally occurring amino acid
  misc_feature (234)..(234): Xaa can be any naturally occurring amino acid
  misc_feature (236)..(239): Xaa can be any naturally occurring amino acid
  misc_feature (243)..(243): Xaa can be any naturally occurring amino acid
  misc_feature (245)..(247): Xaa can be any naturally occurring amino acid
  misc_feature (249)..(255): Xaa can be any naturally occurring amino acid
  misc_feature (260)..(260): Xaa can be any naturally occurring amino acid
  misc_feature (266)..(268): Xaa can be any naturally occurring amino acid
  misc_feature (270)..(270): Xaa can be any naturally occurring amino acid
  misc_feature (272)..(272): Xaa can be any naturally occurring amino acid
  misc_feature (275)..(275): Xaa can be any naturally occurring amino acid
  misc_feature (277)..(301): Xaa can be any naturally occurring amino acid
  misc_feature (303)..(349): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXXXXXXXXGXXXXXVXHVSAXXXXXXGXXXWXTFXAXDXASSXPXXXXYQAXVXXXGXXXXXXXIFRLXPTDEEXXXVXVXPPXPXXXXXXXXXXXXXXXXXXXXXXXXXFXXXXXXXXXXXXXXXXXXXXXXXXXXXXXXXXXXXXXXXXXXXXXXX

SEQ ID NO: 94659 - protein, 513 aa, artificial
  consensus sequence
  misc_feature (1)..(74): Xaa can be any naturally occurring amino acid
  misc_feature (76)..(87): Xaa can be any naturally occurring amino acid
  misc_feature (89)..(89): Xaa can be any naturally occurring amino acid
  misc_feature (91)..(94): Xaa can be any naturally occurring amino acid
  misc_feature (97)..(365): Xaa can be any naturally occurring amino acid
  misc_feature (367)..(367): Xaa can be any naturally occurring amino acid
  misc_feature (369)..(369): Xaa can be any naturally occurring amino acid
  misc_feature (371)..(371): Xaa can be any naturally occurring amino acid
  misc_feature (373)..(373): Xaa can be any naturally occurring amino acid
  misc_feature (377)..(377): Xaa can be any naturally occurring amino acid
  misc_feature (379)..(379): Xaa can be any naturally occurring amino acid
  misc_feature (381)..(382): Xaa can be any naturally occurring amino acid
  misc_feature (384)..(384): Xaa can be any naturally occurring amino acid
  misc_feature (398)..(398): Xaa can be any naturally occurring amino acid
  misc_feature (400)..(400): Xaa can be any naturally occurring amino acid
  misc_feature (403)..(403): Xaa can be any naturally occurring amino acid
  misc_feature (410)..(412): Xaa can be any naturally occurring amino acid
  misc_feature (415)..(415): Xaa can be any naturally occurring amino acid
  misc_feature (418)..(418): Xaa can be any naturally occurring amino acid
  misc_feature (421)..(423): Xaa can be any naturally occurring amino acid
  misc_feature (426)..(426): Xaa can be any naturally occurring amino acid
  misc_feature (428)..(429): Xaa can be any naturally occurring amino acid
  misc_feature (431)..(444): Xaa can be any naturally occurring amino acid
  misc_feature (449)..(450): Xaa can be any naturally occurring amino acid
  misc_feature (455)..(455): Xaa can be any naturally occurring amino acid
  misc_feature (459)..(513): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXMXXXXXXXXXXXXLXLXXXXLPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXAXKXQXAEQXRXAXXEXAYAERVRELARREXEXAEXEFARARXXXWEXARXEVXXXERXKXXAXXXXXXXXXXXXXXLEITXXCHACXQRFXXXXXXXXXXXXXXXXXXXXXXXXXXXXXXXXXXXXXXXXXXXXXXXXXXXXXXX

SEQ ID NO: 94660 - protein, 1038 aa, artificial
  consensus sequence
  misc_feature (1)..(241): Xaa can be any naturally occurring amino acid
  misc_feature (243)..(245): Xaa can be any naturally occurring amino acid
  misc_feature (247)..(258): Xaa can be any naturally occurring amino acid
  misc_feature (261)..(262): Xaa can be any naturally occurring amino acid
  misc_feature (264)..(264): Xaa can be any naturally occurring amino acid
  misc_feature (266)..(273): Xaa can be any naturally occurring amino acid
  misc_feature (276)..(276): Xaa can be any naturally occurring amino acid
  misc_feature (278)..(278): Xaa can be any naturally occurring amino acid
  misc_feature (281)..(282): Xaa can be any naturally occurring amino acid
  misc_feature (285)..(287): Xaa can be any naturally occurring amino acid
  misc_feature (290)..(291): Xaa can be any naturally occurring amino acid
  misc_feature (293)..(294): Xaa can be any naturally occurring amino acid
  misc_feature (296)..(298): Xaa can be any naturally occurring amino acid
  misc_feature (300)..(302): Xaa can be any naturally occurring amino acid
  misc_feature (305)..(307): Xaa can be any naturally occurring amino acid
  misc_feature (309)..(309): Xaa can be any naturally occurring amino acid
  misc_feature (311)..(311): Xaa can be any naturally occurring amino acid
  misc_feature (314)..(315): Xaa can be any naturally occurring amino acid
  misc_feature (317)..(323): Xaa can be any naturally occurring amino acid
  misc_feature (325)..(436): Xaa can be any naturally occurring amino acid
  misc_feature (439)..(439): Xaa can be any naturally occurring amino acid
  misc_feature (442)..(442): Xaa can be any naturally occurring amino acid
  misc_feature (444)..(456): Xaa can be any naturally occurring amino acid
  misc_feature (458)..(476): Xaa can be any naturally occurring amino acid
  misc_feature (480)..(480): Xaa can be any naturally occurring amino acid
  misc_feature (484)..(484): Xaa can be any naturally occurring amino acid
  misc_feature (492)..(494): Xaa can be any naturally occurring amino acid
  misc_feature (498)..(522): Xaa can be any naturally occurring amino acid
  misc_feature (524)..(526): Xaa can be any naturally occurring amino acid
  misc_feature (528)..(530): Xaa can be any naturally occurring amino acid
  misc_feature (532)..(535): Xaa can be any naturally occurring amino acid
  misc_feature (538)..(538): Xaa can be any naturally occurring amino acid
  misc_feature (540)..(540): Xaa can be any naturally occurring amino acid
  misc_feature (543)..(543): Xaa can be any naturally occurring amino acid
  misc_feature (547)..(563): Xaa can be any naturally occurring amino acid
  misc_feature (565)..(565): Xaa can be any naturally occurring amino acid
  misc_feature (567)..(592): Xaa can be any naturally occurring amino acid
  misc_feature (594)..(631): Xaa can be any naturally occurring amino acid
  misc_feature (633)..(720): Xaa can be any naturally occurring amino acid
  misc_feature (722)..(722): Xaa can be any naturally occurring amino acid
  misc_feature (724)..(726): Xaa can be any naturally occurring amino acid
  misc_feature (728)..(767): Xaa can be any naturally occurring amino acid
  misc_feature (769)..(770): Xaa can be any naturally occurring amino acid
  misc_feature (774)..(775): Xaa can be any naturally occurring amino acid
  misc_feature (777)..(779): Xaa can be any naturally occurring amino acid
  misc_feature (782)..(782): Xaa can be any naturally occurring amino acid
  misc_feature (786)..(791): Xaa can be any naturally occurring amino acid
  misc_feature (793)..(1038): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIXXXPXXXXXXXXXXXXLDXXYXTXXXXXXXXIVXSXPVXXYPXXXYRXXLXXLXXXLXXXHGXXXWXIXNFXXEXXXXXXXDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDHXPPXFXXXXXXXXXXXXXLXXXXXXXXXXXXXXXXXXXVAVXHCKXGKGRSGTXXXAYLXXXXXXXXXXXXXXXXXXXXXXXXXFXXXRXXXGXXXXGVXIXSQXRYLXXXXXXXXXXXXXXXXXYXEXXXXXXXXXXXXXXXXXXXXXXXXXXIXXXXXXXXXXXXXXXXXXXXXXXXXXXXXXXXXXXXXXKXXXXXXXXXXXXXXXXXXXXXXXXXXXXXXXXXXXXXXXXXXXXXXXXXXXXXXXXXXXXXXXXXXXXXXXXXXXXXXXXXXXXXXXXWXNXXXEXXXXXXXXXXXXXXXXXXXXXXXXXXXXXXXXXXXXXXXXWXXLDGXXGXXXKGXKLFXXXXXXWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94661 - protein, 473 aa, artificial
  consensus sequence
  misc_feature (1)..(19): Xaa can be any naturally occurring amino acid
  misc_feature (21)..(21): Xaa can be any naturally occurring amino acid
  misc_feature (23)..(23): Xaa can be any naturally occurring amino acid
  misc_feature (25)..(25): Xaa can be any naturally occurring amino acid
  misc_feature (27)..(27): Xaa can be any naturally occurring amino acid
  misc_feature (29)..(29): Xaa can be any naturally occurring amino acid
  misc_feature (31)..(31): Xaa can be any naturally occurring amino acid
  misc_feature (38)..(62): Xaa can be any naturally occurring amino acid
  misc_feature (67)..(67): Xaa can be any naturally occurring amino acid
  misc_feature (69)..(72): Xaa can be any naturally occurring amino acid
  misc_feature (74)..(75): Xaa can be any naturally occurring amino acid
  misc_feature (77)..(77): Xaa can be any naturally occurring amino acid
  misc_feature (80)..(81): Xaa can be any naturally occurring amino acid
  misc_feature (84)..(84): Xaa can be any naturally occurring amino acid
  misc_feature (88)..(88): Xaa can be any naturally occurring amino acid
  misc_feature (90)..(90): Xaa can be any naturally occurring amino acid
  misc_feature (92)..(92): Xaa can be any naturally occurring amino acid
  misc_feature (94)..(94): Xaa can be any naturally occurring amino acid
  misc_feature (96)..(96): Xaa can be any naturally occurring amino acid
  misc_feature (98)..(117): Xaa can be any naturally occurring amino acid
  misc_feature (123)..(124): Xaa can be any naturally occurring amino acid
  misc_feature (126)..(126): Xaa can be any naturally occurring amino acid
  misc_feature (128)..(143): Xaa can be any naturally occurring amino acid
  misc_feature (152)..(152): Xaa can be any naturally occurring amino acid
  misc_feature (166)..(166): Xaa can be any naturally occurring amino acid
  misc_feature (168)..(181): Xaa can be any naturally occurring amino acid
  misc_feature (183)..(184): Xaa can be any naturally occurring amino acid
  misc_feature (186)..(197): Xaa can be any naturally occurring amino acid
  misc_feature (204)..(205): Xaa can be any naturally occurring amino acid
  misc_feature (207)..(208): Xaa can be any naturally occurring amino acid
  misc_feature (210)..(212): Xaa can be any naturally occurring amino acid
  misc_feature (214)..(215): Xaa can be any naturally occurring amino acid
  misc_feature (217)..(219): Xaa can be any naturally occurring amino acid
  misc_feature (221)..(222): Xaa can be any naturally occurring amino acid
  misc_feature (225)..(225): Xaa can be any naturally occurring amino acid
  misc_feature (227)..(227): Xaa can be any naturally occurring amino acid
  misc_feature (230)..(261): Xaa can be any naturally occurring amino acid
  misc_feature (263)..(265): Xaa can be any naturally occurring amino acid
  misc_feature (268)..(268): Xaa can be any naturally occurring amino acid
  misc_feature (271)..(271): Xaa can be any naturally occurring amino acid
  misc_feature (275)..(275): Xaa can be any naturally occurring amino acid
  misc_feature (277)..(277): Xaa can be any naturally occurring amino acid
  misc_feature (279)..(281): Xaa can be any naturally occurring amino acid
  misc_feature (283)..(286): Xaa can be any naturally occurring amino acid
  misc_feature (288)..(290): Xaa can be any naturally occurring amino acid
  misc_feature (293)..(293): Xaa can be any naturally occurring amino acid
  misc_feature (295)..(295): Xaa can be any naturally occurring amino acid
  misc_feature (297)..(299): Xaa can be any naturally occurring amino acid
  misc_feature (301)..(308): Xaa can be any naturally occurring amino acid
  misc_feature (310)..(311): Xaa can be any naturally occurring amino acid
  misc_feature (313)..(314): Xaa can be any naturally occurring amino acid
  misc_feature (317)..(323): Xaa can be any naturally occurring amino acid
  misc_feature (326)..(327): Xaa can be any naturally occurring amino acid
  misc_feature (330)..(336): Xaa can be any naturally occurring amino acid
  misc_feature (338)..(389): Xaa can be any naturally occurring amino acid
  misc_feature (392)..(392): Xaa can be any naturally occurring amino acid
  misc_feature (395)..(396): Xaa can be any naturally occurring amino acid
  misc_feature (399)..(400): Xaa can be any naturally occurring amino acid
  misc_feature (402)..(409): Xaa can be any naturally occurring amino acid
  misc_feature (411)..(413): Xaa can be any naturally occurring amino acid
  misc_feature (415)..(417): Xaa can be any naturally occurring amino acid
  misc_feature (419)..(422): Xaa can be any naturally occurring amino acid
  misc_feature (424)..(425): Xaa can be any naturally occurring amino acid
  misc_feature (428)..(429): Xaa can be any naturally occurring amino acid
  misc_feature (431)..(437): Xaa can be any naturally occurring amino acid
  misc_feature (439)..(440): Xaa can be any naturally occurring amino acid
  misc_feature (443)..(444): Xaa can be any naturally occurring amino acid
  misc_feature (446)..(473): Xaa can be any naturally occurring amino acid
XXXXXXXXXXXXXXXXXXXEXYXRXNXDXEXDYAFQVXXXXXXXXXXXXXXXXXXXXXXXXXLRPSXFXXXXPXXFXKSXXPGXLTEXGXLXFXYXAXXXXXXXXXXXXXXXXXXXXWPGQLXXPXWXXXXXXXXXXXXXXXXWLYTDLPDXISPTPGICLTNQLXRXXXXXXXXXXXXXXAXXLXXXXXXXXXXXXAQWLFFXXHXXKXXXIXXFXXXGXXNPXSXNPXXXXXXXXXXXXXXXXXXXXXXXXXXXXXXXXLXXXGWXGAXRATXDXYXXXYXXXXIXXXGGXVXAXXXGXXXXXXXXGXXLXXGEXXXXXXXGFXXPLXXXXXXXTXXXXXXXXXXXXXXXXXXXXXXXXXXXXXXXXXXXXXXXXXXXXXXXXXXXXKFXLSXXYFXXLXXXXXXXXEXXXGXXXKXXXXIXXFRXXGXXXXXXXLXXLVXXRXXXXXXXXXXXXXXXXXXXXXXXXXXXX

SEQ ID NO: 94662 - protein, 1304 aa, artificial
  consensus sequence
  misc_feature (1)..(386): Xaa can be any naturally occurring amino acid
  misc_feature (388)..(440): Xaa can be any naturally occurring amino acid
  misc_feature (442)..(446): Xaa can be any naturally occurring amino acid
  misc_feature (448)..(450): Xaa can be any naturally occurring amino acid
  misc_feature (452)..(459): Xaa can be any naturally occurring amino acid
  misc_feature (461)..(463): Xaa can be any naturally occurring amino acid
  misc_feature (465)..(468): Xaa can be any naturally occurring amino acid
  misc_feature (474)..(474): Xaa can be any naturally occurring amino acid
  misc_feature (479)..(479): Xaa can be any naturally occurring amino acid
  misc_feature (482)..(482): Xaa can be any naturally occurring amino acid
  misc_feature (484)..(486): Xaa can be any naturally occurring amino acid
  misc_feature (488)..(488): Xaa can be any naturally occurring amino acid
  misc_feature (490)..(491): Xaa can be any naturally occurring amino acid
  misc_feature (493)..(504): Xaa can be any naturally occurring amino acid
  misc_feature (506)..(517): Xaa can be any naturally occurring amino acid
  misc_feature (519)..(530): Xaa can be any naturally occurring amino acid
  misc_feature (533)..(533): Xaa can be any naturally occurring amino acid
  misc_feature (535)..(748): Xaa can be any naturally occurring amino acid
  misc_feature (754)..(755): Xaa can be any naturally occurring amino acid
  misc_feature (758)..(759): Xaa can be any naturally occurring amino acid
  misc_feature (761)..(765): Xaa can be any naturally occurring amino acid
  misc_feature (767)..(770): Xaa can be any naturally occurring amino acid
  misc_feature (774)..(777): Xaa can be any naturally occurring amino acid
  misc_feature (780)..(780): Xaa can be any naturally occurring amino acid
  misc_feature (783)..(783): Xaa can be any naturally occurring amino acid
  misc_feature (788)..(788): Xaa can be any naturally occurring amino acid
  misc_feature (790)..(1042): Xaa can be any naturally occurring amino acid
  misc_feature (1044)..(1304): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAXXXXXXXXXXXXXXXXXXXXXXXXXXXXXXXXXXXXXXXXXXXXXXXXXXXXXKXXXXXDXXXFXXXXXXXXYXXXGXXXXRGYLLXGPPGXGKXSXXXAXAXXLXXXXXXXXXXXXLXXXXXXXXXXXXLXXXXXXXXXXXXEDXDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSGLLNXXDGXXSXXXXXRXXXXTTNXXXXLDXALXRPGRXDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94663 - protein, 2250 aa, artificial
  consensus sequence
  misc_feature (1)..(1418): Xaa can be any naturally occurring amino acid
  misc_feature (1420)..(1439): Xaa can be any naturally occurring amino acid
  misc_feature (1441)..(1441): Xaa can be any naturally occurring amino acid
  misc_feature (1443)..(1450): Xaa can be any naturally occurring amino acid
  misc_feature (1454)..(1454): Xaa can be any naturally occurring amino acid
  misc_feature (1459)..(1475): Xaa can be any naturally occurring amino acid
  misc_feature (1477)..(1501): Xaa can be any naturally occurring amino acid
  misc_feature (1503)..(1507): Xaa can be any naturally occurring amino acid
  misc_feature (1509)..(1510): Xaa can be any naturally occurring amino acid
  misc_feature (1514)..(1515): Xaa can be any naturally occurring amino acid
  misc_feature (1517)..(1518): Xaa can be any naturally occurring amino acid
  misc_feature (1520)..(1646): Xaa can be any naturally occurring amino acid
  misc_feature (1648)..(1675): Xaa can be any naturally occurring amino acid
  misc_feature (1678)..(1714): Xaa can be any naturally occurring amino acid
  misc_feature (1716)..(1727): Xaa can be any naturally occurring amino acid
  misc_feature (1729)..(1729): Xaa can be any naturally occurring amino acid
  misc_feature (1731)..(1744): Xaa can be any naturally occurring amino acid
  misc_feature (1746)..(1747): Xaa can be any naturally occurring amino acid
  misc_feature (1749)..(1754): Xaa can be any naturally occurring amino acid
  misc_feature (1756)..(1758): Xaa can be any naturally occurring amino acid
  misc_feature (1760)..(1796): Xaa can be any naturally occurring amino acid
  misc_feature (1798)..(1799): Xaa can be any naturally occurring amino acid
  misc_feature (1801)..(1803): Xaa can be any naturally occurring amino acid
  misc_feature (1805)..(1829): Xaa can be any naturally occurring amino acid
  misc_feature (1831)..(1909): Xaa can be any naturally occurring amino acid
  misc_feature (1911)..(1942): Xaa can be any naturally occurring amino acid
  misc_feature (1947)..(2250): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKXXXXXXXXXXXXXXXXXXXXRXDXXXXXXXXGNKXRKLEXXXXXXXXXXXXXXXXXAXXXXXXXXXXXXXXXXXXXXXXXXXDXXXXXGXXQSNXXRXXAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXXXXXGNXXXXXXXXXXXXXXXXXXXXXXXXXXXXXXXXXXXXXGXXXXXXXXXXXXPXGXXXXXXXXXXXXXXGXXGXXXXXXEXXXQXXXXXXXXXXXXXXXXXXXXXXXXXXXXXXXXXXXXXTXXGXXXGXXXXXXXXXXXXXXXXXXXXXXXXXGXXXXXXXXXXXXXXXXXXXXXXXXXXXXXXXXXXXXXXXXXXXXXXXXXXXXXXXXXXXXXXXXXXXXXXXXXXXXXXXYXXXXXXXXXXXXXXXXXXXXXXXXXXXXXXXXDPVYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94664 - protein, 240 aa, artificial
  consensus sequence
  misc_feature (1)..(13): Xaa can be any naturally occurring amino acid
  misc_feature (15)..(32): Xaa can be any naturally occurring amino acid
  misc_feature (35)..(35): Xaa can be any naturally occurring amino acid
  misc_feature (37)..(64): Xaa can be any naturally occurring amino acid
  misc_feature (68)..(70): Xaa can be any naturally occurring amino acid
  misc_feature (73)..(84): Xaa can be any naturally occurring amino acid
  misc_feature (87)..(87): Xaa can be any naturally occurring amino acid
  misc_feature (91)..(91): Xaa can be any naturally occurring amino acid
  misc_feature (93)..(93): Xaa can be any naturally occurring amino acid
  misc_feature (95)..(95): Xaa can be any naturally occurring amino acid
  misc_feature (98)..(118): Xaa can be any naturally occurring amino acid
  misc_feature (121)..(121): Xaa can be any naturally occurring amino acid
  misc_feature (124)..(124): Xaa can be any naturally occurring amino acid
  misc_feature (138)..(174): Xaa can be any naturally occurring amino acid
  misc_feature (179)..(179): Xaa can be any naturally occurring amino acid
  misc_feature (181)..(185): Xaa can be any naturally occurring amino acid
  misc_feature (187)..(210): Xaa can be any naturally occurring amino acid
  misc_feature (212)..(232): Xaa can be any naturally occurring amino acid
  misc_feature (234)..(234): Xaa can be any naturally occurring amino acid
  misc_feature (236)..(237): Xaa can be any naturally occurring amino acid
  misc_feature (240)..(240): Xaa can be any naturally occurring amino acid
XXXXXXXXXXXXXMXXXXXXXXXXXXXXXXXXKRXRXXXXXXXXXXXXXXXXXXXXXXXXXXXXDLLXXXDDXXXXXXXXXXXXDLXSVMXSXEXEIXXXXXXXXXXXXXXXXXXXXXQPXLGXLLEASDDELGLPPXXXXXXXXXXXXXXXXXXXXXXXXXXXXXXXXXXXXXGFEDXIXXXXXFXXXXXXXXXXXXXXXXXXXXXXXXFXXXXXXXXXXXXXXXXXXXXXRXEXXPAX

SEQ ID NO: 94665 - protein, 162 aa, artificial
  consensus sequence
  misc_feature (2)..(12): Xaa can be any naturally occurring amino acid
  misc_feature (14)..(14): Xaa can be any naturally occurring amino acid
  misc_feature (17)..(25): Xaa can be any naturally occurring amino acid
  misc_feature (27)..(29): Xaa can be any naturally occurring amino acid
  misc_feature (31)..(32): Xaa can be any naturally occurring amino acid
  misc_feature (34)..(36): Xaa can be any naturally occurring amino acid
  misc_feature (38)..(39): Xaa can be any naturally occurring amino acid
  misc_feature (42)..(44): Xaa can be any naturally occurring amino acid
  misc_feature (47)..(48): Xaa can be any naturally occurring amino acid
  misc_feature (52)..(52): Xaa can be any naturally occurring amino acid
  misc_feature (55)..(56): Xaa can be any naturally occurring amino acid
  misc_feature (58)..(58): Xaa can be any naturally occurring amino acid
  misc_feature (60)..(61): Xaa can be any naturally occurring amino acid
  misc_feature (64)..(67): Xaa can be any naturally occurring amino acid
  misc_feature (70)..(71): Xaa can be any naturally occurring amino acid
  misc_feature (73)..(74): Xaa can be any naturally occurring amino acid
  misc_feature (77)..(78): Xaa can be any naturally occurring amino acid
  misc_feature (81)..(81): Xaa can be any naturally occurring amino acid
  misc_feature (85)..(89): Xaa can be any naturally occurring amino acid
  misc_feature (91)..(93): Xaa can be any naturally occurring amino acid
  misc_feature (95)..(97): Xaa can be any naturally occurring amino acid
  misc_feature (100)..(101): Xaa can be any naturally occurring amino acid
  misc_feature (103)..(104): Xaa can be any naturally occurring amino acid
  misc_feature (106)..(106): Xaa can be any naturally occurring amino acid
  misc_feature (108)..(110): Xaa can be any naturally occurring amino acid
  misc_feature (112)..(112): Xaa can be any naturally occurring amino acid
  misc_feature (114)..(123): Xaa can be any naturally occurring amino acid
  misc_feature (125)..(125): Xaa can be any naturally occurring amino acid
  misc_feature (129)..(129): Xaa can be any naturally occurring amino acid
  misc_feature (131)..(154): Xaa can be any naturally occurring amino acid
  misc_feature (156)..(162): Xaa can be any naturally occurring amino acid
MXXXXXXXXXXXHXAVXXXXXXXXXAXXXLXXVXXXLXXEFXXXYPXXANPXKLXXRXKXXQEXXXXLKXXCXXLLXXKQXLIDXXXXXLXXXRXXXQRXXAXXGXPXXXDXDXXXXXXXXXXIXEWTXQXXXXXXXXXXXXXXXXXXXXXXXXFXXXXXXX

SEQ ID NO: 94666 - protein, 485 aa, artificial
  consensus sequence
  misc_feature (1)..(23): Xaa can be any naturally occurring amino acid
  misc_feature (25)..(35): Xaa can be any naturally occurring amino acid
  misc_feature (37)..(51): Xaa can be any naturally occurring amino acid
  misc_feature (53)..(62): Xaa can be any naturally occurring amino acid
  misc_feature (65)..(71): Xaa can be any naturally occurring amino acid
  misc_feature (73)..(95): Xaa can be any naturally occurring amino acid
  misc_feature (97)..(99): Xaa can be any naturally occurring amino acid
  misc_feature (102)..(102): Xaa can be any naturally occurring amino acid
  misc_feature (108)..(108): Xaa can be any naturally occurring amino acid
  misc_feature (112)..(114): Xaa can be any naturally occurring amino acid
  misc_feature (118)..(118): Xaa can be any naturally occurring amino acid
  misc_feature (125)..(125): Xaa can be any naturally occurring amino acid
  misc_feature (128)..(129): Xaa can be any naturally occurring amino acid
  misc_feature (134)..(134): Xaa can be any naturally occurring amino acid
  misc_feature (136)..(139): Xaa can be any naturally occurring amino acid
  misc_feature (141)..(142): Xaa can be any naturally occurring amino acid
  misc_feature (144)..(146): Xaa can be any naturally occurring amino acid
  misc_feature (148)..(149): Xaa can be any naturally occurring amino acid
  misc_feature (151)..(152): Xaa can be any naturally occurring amino acid
  misc_feature (154)..(154): Xaa can be any naturally occurring amino acid
  misc_feature (157)..(485): Xaa can be any naturally occurring amino acid
XXXXXXXXXXXXXXXXXXXXXXXTXXXXXXXXXXXDXXXXXXXXXXXXXXXSXXXXXXXXXXRRXXXXXXXVXXXXXXXXXXXXXXXXXXXXXXXEXXXKIXALQRIXPGGXXXGVDXLFEETAXYIXXLQCQXKXXXXLXXFXXXLXXEXXKXGGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94667 - protein, 548 aa, artificial
  consensus sequence
  misc_feature (1)..(9): Xaa can be any naturally occurring amino acid
  misc_feature (12)..(23): Xaa can be any naturally occurring amino acid
  misc_feature (25)..(25): Xaa can be any naturally occurring amino acid
  misc_feature (30)..(30): Xaa can be any naturally occurring amino acid
  misc_feature (33)..(33): Xaa can be any naturally occurring amino acid
  misc_feature (38)..(42): Xaa can be any naturally occurring amino acid
  misc_feature (47)..(48): Xaa can be any naturally occurring amino acid
  misc_feature (52)..(54): Xaa can be any naturally occurring amino acid
  misc_feature (56)..(56): Xaa can be any naturally occurring amino acid
  misc_feature (58)..(86): Xaa can be any naturally occurring amino acid
  misc_feature (89)..(89): Xaa can be any naturally occurring amino acid
  misc_feature (92)..(92): Xaa can be any naturally occurring amino acid
  misc_feature (94)..(95): Xaa can be any naturally occurring amino acid
  misc_feature (97)..(97): Xaa can be any naturally occurring amino acid
  misc_feature (101)..(101): Xaa can be any naturally occurring amino acid
  misc_feature (110)..(110): Xaa can be any naturally occurring amino acid
  misc_feature (112)..(117): Xaa can be any naturally occurring amino acid
  misc_feature (119)..(126): Xaa can be any naturally occurring amino acid
  misc_feature (128)..(128): Xaa can be any naturally occurring amino acid
  misc_feature (134)..(136): Xaa can be any naturally occurring amino acid
  misc_feature (138)..(144): Xaa can be any naturally occurring amino acid
  misc_feature (146)..(166): Xaa can be any naturally occurring amino acid
  misc_feature (168)..(168): Xaa can be any naturally occurring amino acid
  misc_feature (170)..(548): Xaa can be any naturally occurring amino acid
XXXXXXXXXMAXXXXXXXXXXXXEXKFRLXDGXDIGPXXXXXATTVXXLKEXXXAXWXXXXXXXXXXXXXXXXXXXXXXXXXXXXXKEXGPXTXXDXKLIXAGKILENNXTXXXXXXPXXXXXXXXVXTMHVVXXXPXXXXXXXKXXXXXXXXXXXXXXXXXXXXXCXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94668 - protein, 464 aa, artificial
  consensus sequence
  misc_feature (1)..(235): Xaa can be any naturally occurring amino acid
  misc_feature (237)..(254): Xaa can be any naturally occurring amino acid
  misc_feature (256)..(256): Xaa can be any naturally occurring amino acid
  misc_feature (258)..(260): Xaa can be any naturally occurring amino acid
  misc_feature (267)..(268): Xaa can be any naturally occurring amino acid
  misc_feature (270)..(271): Xaa can be any naturally occurring amino acid
  misc_feature (277)..(277): Xaa can be any naturally occurring amino acid
  misc_feature (301)..(301): Xaa can be any naturally occurring amino acid
  misc_feature (303)..(335): Xaa can be any naturally occurring amino acid
  misc_feature (342)..(342): Xaa can be any naturally occurring amino acid
  misc_feature (346)..(355): Xaa can be any naturally occurring amino acid
  misc_feature (359)..(359): Xaa can be any naturally occurring amino acid
  misc_feature (365)..(464): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMXXXXXXXXXXXXXXXXXXKXPXXXSCRKKKXXDXXTFLEDXKDHIDEFIHASMDEHKTCFKKTIXKXXXXXXXXXXXXXXXXXXXXXXXXXXXXXXXXXMFGMSKXVAEXXXXXXXXXXVESXLPLQTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94669 - protein, 963 aa, artificial
  consensus sequence
  misc_feature (1)..(702): Xaa can be any naturally occurring amino acid
  misc_feature (704)..(737): Xaa can be any naturally occurring amino acid
  misc_feature (739)..(739): Xaa can be any naturally occurring amino acid
  misc_feature (741)..(750): Xaa can be any naturally occurring amino acid
  misc_feature (752)..(752): Xaa can be any naturally occurring amino acid
  misc_feature (754)..(754): Xaa can be any naturally occurring amino acid
  misc_feature (756)..(759): Xaa can be any naturally occurring amino acid
  misc_feature (762)..(764): Xaa can be any naturally occurring amino acid
  misc_feature (770)..(773): Xaa can be any naturally occurring amino acid
  misc_feature (776)..(776): Xaa can be any naturally occurring amino acid
  misc_feature (783)..(783): Xaa can be any naturally occurring amino acid
  misc_feature (785)..(786): Xaa can be any naturally occurring amino acid
  misc_feature (790)..(790): Xaa can be any naturally occurring amino acid
  misc_feature (807)..(808): Xaa can be any naturally occurring amino acid
  misc_feature (810)..(811): Xaa can be any naturally occurring amino acid
  misc_feature (813)..(819): Xaa can be any naturally occurring amino acid
  misc_feature (822)..(827): Xaa can be any naturally occurring amino acid
  misc_feature (829)..(829): Xaa can be any naturally occurring amino acid
  misc_feature (832)..(833): Xaa can be any naturally occurring amino acid
  misc_feature (836)..(837): Xaa can be any naturally occurring amino acid
  misc_feature (840)..(963): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKXXXXXXXXXXXXXXXXXXXXXXXXXXXXXXXXXXKXGXXXXXXXXXXKXKXKXXXXKKXXXPPRPPXXXXLDXADQKLIXEXXELAXLKRARIERMKALKKMKXXKXXSXXXXXXXGNXXXXXXTXIFXXVIXXQGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94670 - protein, 1212 aa, artificial
  consensus sequence
  misc_feature (1)..(62): Xaa can be any naturally occurring amino acid
  misc_feature (64)..(66): Xaa can be any naturally occurring amino acid
  misc_feature (68)..(89): Xaa can be any naturally occurring amino acid
  misc_feature (91)..(315): Xaa can be any naturally occurring amino acid
  misc_feature (318)..(319): Xaa can be any naturally occurring amino acid
  misc_feature (322)..(324): Xaa can be any naturally occurring amino acid
  misc_feature (328)..(328): Xaa can be any naturally occurring amino acid
  misc_feature (330)..(336): Xaa can be any naturally occurring amino acid
  misc_feature (338)..(342): Xaa can be any naturally occurring amino acid
  misc_feature (344)..(354): Xaa can be any naturally occurring amino acid
  misc_feature (356)..(356): Xaa can be any naturally occurring amino acid
  misc_feature (358)..(366): Xaa can be any naturally occurring amino acid
  misc_feature (377)..(377): Xaa can be any naturally occurring amino acid
  misc_feature (382)..(382): Xaa can be any naturally occurring amino acid
  misc_feature (385)..(387): Xaa can be any naturally occurring amino acid
  misc_feature (389)..(422): Xaa can be any naturally occurring amino acid
  misc_feature (424)..(430): Xaa can be any naturally occurring amino acid
  misc_feature (432)..(435): Xaa can be any naturally occurring amino acid
  misc_feature (437)..(452): Xaa can be any naturally occurring amino acid
  misc_feature (455)..(455): Xaa can be any naturally occurring amino acid
  misc_feature (457)..(458): Xaa can be any naturally occurring amino acid
  misc_feature (460)..(462): Xaa can be any naturally occurring amino acid
  misc_feature (466)..(466): Xaa can be any naturally occurring amino acid
  misc_feature (468)..(468): Xaa can be any naturally occurring amino acid
  misc_feature (471)..(474): Xaa can be any naturally occurring amino acid
  misc_feature (476)..(476): Xaa can be any naturally occurring amino acid
  misc_feature (480)..(485): Xaa can be any naturally occurring amino acid
  misc_feature (487)..(488): Xaa can be any naturally occurring amino acid
  misc_feature (490)..(492): Xaa can be any naturally occurring amino acid
  misc_feature (495)..(496): Xaa can be any naturally occurring amino acid
  misc_feature (498)..(502): Xaa can be any naturally occurring amino acid
  misc_feature (505)..(506): Xaa can be any naturally occurring amino acid
  misc_feature (508)..(510): Xaa can be any naturally occurring amino acid
  misc_feature (514)..(515): Xaa can be any naturally occurring amino acid
  misc_feature (518)..(518): Xaa can be any naturally occurring amino acid
  misc_feature (521)..(522): Xaa can be any naturally occurring amino acid
  misc_feature (524)..(524): Xaa can be any naturally occurring amino acid
  misc_feature (528)..(528): Xaa can be any naturally occurring amino acid
  misc_feature (531)..(531): Xaa can be any naturally occurring amino acid
  misc_feature (533)..(533): Xaa can be any naturally occurring amino acid
  misc_feature (535)..(537): Xaa can be any naturally occurring amino acid
  misc_feature (542)..(544): Xaa can be any naturally occurring amino acid
  misc_feature (546)..(546): Xaa can be any naturally occurring amino acid
  misc_feature (549)..(551): Xaa can be any naturally occurring amino acid
  misc_feature (553)..(577): Xaa can be any naturally occurring amino acid
  misc_feature (579)..(580): Xaa can be any naturally occurring amino acid
  misc_feature (582)..(590): Xaa can be any naturally occurring amino acid
  misc_feature (593)..(598): Xaa can be any naturally occurring amino acid
  misc_feature (600)..(602): Xaa can be any naturally occurring amino acid
  misc_feature (604)..(621): Xaa can be any naturally occurring amino acid
  misc_feature (623)..(624): Xaa can be any naturally occurring amino acid
  misc_feature (626)..(637): Xaa can be any naturally occurring amino acid
  misc_feature (639)..(664): Xaa can be any naturally occurring amino acid
  misc_feature (666)..(669): Xaa can be any naturally occurring amino acid
  misc_feature (671)..(671): Xaa can be any naturally occurring amino acid
  misc_feature (673)..(1212): Xaa can be any naturally occurring amino acid
XXXXXXXXXXXXXXXXXXXXXXXXXXXXXXXXXXXXXXXXXXXXXXXXXXXXXXXXXXXXXXIXXXLXXXXXXXXXXXXXXXXXXXXXXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDGXXVNXXXGLKXYXXXXXXXEXXXXXSXXXXXXXXXXXGXLXXXXXXXXXKRPMKGHGREXIQLGXPIXXXPXXXXXXXXXXXXXXXXXXXXXXXXXXXXXXXXXXVXXXXXXXPXXXXDXXXXXXXXXXXXXXXXPDXCXXDXXXEGDXSXPHXXXXWXGRPXXXXXXLXXCXXXFGXXIXXXXXGDXXGXXXLSLXXGSXLVXXGXSADXAKXAXPXXXKQRIXXXFXKSXXXKXXXXXXXXXXXXXXXXXXXXXXXXXRXXNXXXXXXXXXPKXXXXXXPXXXVXXXXXXXXXXXXXXXXXXQXXFXXXXXXXXXXXXFXXXXXXXXXXXXXXXXXXXXXXXXXXPXXXXGXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94671 - protein, 184 aa, artificial
  consensus sequence
  misc_feature (1)..(95): Xaa can be any naturally occurring amino acid
  misc_feature (104)..(104): Xaa can be any naturally occurring amino acid
  misc_feature (108)..(108): Xaa can be any naturally occurring amino acid
  misc_feature (110)..(110): Xaa can be any naturally occurring amino acid
  misc_feature (115)..(115): Xaa can be any naturally occurring amino acid
  misc_feature (119)..(119): Xaa can be any naturally occurring amino acid
  misc_feature (122)..(123): Xaa can be any naturally occurring amino acid
  misc_feature (127)..(127): Xaa can be any naturally occurring amino acid
  misc_feature (130)..(134): Xaa can be any naturally occurring amino acid
  misc_feature (137)..(137): Xaa can be any naturally occurring amino acid
  misc_feature (139)..(139): Xaa can be any naturally occurring amino acid
  misc_feature (146)..(146): Xaa can be any naturally occurring amino acid
  misc_feature (148)..(184): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFDPWPVFFXREWXRXWPFLXGFAXTGXXITKXTAXXXXXEDXKXNSKFVQXHXXXXXXXXXXXXXXXXXXXXXXXXXXXXXXXXXXXXX

SEQ ID NO: 94672 - protein, 1155 aa, artificial
  consensus sequence
  misc_feature (1)..(178): Xaa can be any naturally occurring amino acid
  misc_feature (180)..(186): Xaa can be any naturally occurring amino acid
  misc_feature (188)..(188): Xaa can be any naturally occurring amino acid
  misc_feature (190)..(202): Xaa can be any naturally occurring amino acid
  misc_feature (204)..(204): Xaa can be any naturally occurring amino acid
  misc_feature (206)..(265): Xaa can be any naturally occurring amino acid
  misc_feature (270)..(276): Xaa can be any naturally occurring amino acid
  misc_feature (278)..(287): Xaa can be any naturally occurring amino acid
  misc_feature (289)..(291): Xaa can be any naturally occurring amino acid
  misc_feature (293)..(320): Xaa can be any naturally occurring amino acid
  misc_feature (322)..(325): Xaa can be any naturally occurring amino acid
  misc_feature (327)..(327): Xaa can be any naturally occurring amino acid
  misc_feature (329)..(331): Xaa can be any naturally occurring amino acid
  misc_feature (334)..(334): Xaa can be any naturally occurring amino acid
  misc_feature (337)..(338): Xaa can be any naturally occurring amino acid
  misc_feature (340)..(342): Xaa can be any naturally occurring amino acid
  misc_feature (344)..(355): Xaa can be any naturally occurring amino acid
  misc_feature (357)..(361): Xaa can be any naturally occurring amino acid
  misc_feature (363)..(364): Xaa can be any naturally occurring amino acid
  misc_feature (367)..(402): Xaa can be any naturally occurring amino acid
  misc_feature (405)..(405): Xaa can be any naturally occurring amino acid
  misc_feature (408)..(409): Xaa can be any naturally occurring amino acid
  misc_feature (412)..(413): Xaa can be any naturally occurring amino acid
  misc_feature (415)..(415): Xaa can be any naturally occurring amino acid
  misc_feature (417)..(428): Xaa can be any naturally occurring amino acid
  misc_feature (431)..(432): Xaa can be any naturally occurring amino acid
  misc_feature (434)..(434): Xaa can be any naturally occurring amino acid
  misc_feature (436)..(438): Xaa can be any naturally occurring amino acid
  misc_feature (440)..(452): Xaa can be any naturally occurring amino acid
  misc_feature (454)..(460): Xaa can be any naturally occurring amino acid
  misc_feature (462)..(483): Xaa can be any naturally occurring amino acid
  misc_feature (485)..(491): Xaa can be any naturally occurring amino acid
  misc_feature (493)..(576): Xaa can be any naturally occurring amino acid
  misc_feature (578)..(580): Xaa can be any naturally occurring amino acid
  misc_feature (582)..(584): Xaa can be any naturally occurring amino acid
  misc_feature (586)..(607): Xaa can be any naturally occurring amino acid
  misc_feature (610)..(611): Xaa can be any naturally occurring amino acid
  misc_feature (613)..(794): Xaa can be any naturally occurring amino acid
  misc_feature (796)..(1155): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXXXXPXEXXXXXXXXXXXXXEXEXXXXXXXXXXXXXXXXXXXXXXXXXXXXXXXXXXXXXXXXXXXXXXXXXXXXXXXXXXXXLKRKXXXXXXXEXXXXXXXXXXRXXXLXXXXXXXXXXXXXXXXXXXXXXXXXXXXWXXXXLXRXXXDYXLRXXYXXXAXXXXXXXXXXXXLXXXXXIXXLVXXXXXXXXXXXXXXXXXXXXXXXXXXXXXXXXXXXXALXWCXXNKXXLXKXXXXXXXXXXXXEFXXRXQXXXEXXXXXXXXXXXXXAXXXXXXXLXXXXXXXXXXXXXXXXXXXXXXEXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXWXXXLXXXFXXXXXXXXXXXXXXXXXXXXXXGLXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94673 - protein, 740 aa, artificial
  consensus sequence
  misc_feature (1)..(68): Xaa can be any naturally occurring amino acid
  misc_feature (70)..(83): Xaa can be any naturally occurring amino acid
  misc_feature (85)..(85): Xaa can be any naturally occurring amino acid
  misc_feature (88)..(88): Xaa can be any naturally occurring amino acid
  misc_feature (90)..(90): Xaa can be any naturally occurring amino acid
  misc_feature (92)..(92): Xaa can be any naturally occurring amino acid
  misc_feature (94)..(94): Xaa can be any naturally occurring amino acid
  misc_feature (96)..(96): Xaa can be any naturally occurring amino acid
  misc_feature (100)..(108): Xaa can be any naturally occurring amino acid
  misc_feature (113)..(113): Xaa can be any naturally occurring amino acid
  misc_feature (116)..(116): Xaa can be any naturally occurring amino acid
  misc_feature (119)..(120): Xaa can be any naturally occurring amino acid
  misc_feature (122)..(122): Xaa can be any naturally occurring amino acid
  misc_feature (124)..(124): Xaa can be any naturally occurring amino acid
  misc_feature (128)..(128): Xaa can be any naturally occurring amino acid
  misc_feature (131)..(131): Xaa can be any naturally occurring amino acid
  misc_feature (133)..(135): Xaa can be any naturally occurring amino acid
  misc_feature (138)..(142): Xaa can be any naturally occurring amino acid
  misc_feature (144)..(149): Xaa can be any naturally occurring amino acid
  misc_feature (151)..(152): Xaa can be any naturally occurring amino acid
  misc_feature (154)..(167): Xaa can be any naturally occurring amino acid
  misc_feature (170)..(171): Xaa can be any naturally occurring amino acid
  misc_feature (174)..(189): Xaa can be any naturally occurring amino acid
  misc_feature (192)..(193): Xaa can be any naturally occurring amino acid
  misc_feature (195)..(195): Xaa can be any naturally occurring amino acid
  misc_feature (197)..(197): Xaa can be any naturally occurring amino acid
  misc_feature (200)..(200): Xaa can be any naturally occurring amino acid
  misc_feature (202)..(202): Xaa can be any naturally occurring amino acid
  misc_feature (206)..(206): Xaa can be any naturally occurring amino acid
  misc_feature (209)..(209): Xaa can be any naturally occurring amino acid
  misc_feature (214)..(214): Xaa can be any naturally occurring amino acid
  misc_feature (218)..(218): Xaa can be any naturally occurring amino acid
  misc_feature (221)..(221): Xaa can be any naturally occurring amino acid
  misc_feature (224)..(322): Xaa can be any naturally occurring amino acid
  misc_feature (325)..(333): Xaa can be any naturally occurring amino acid
  misc_feature (335)..(337): Xaa can be any naturally occurring amino acid
  misc_feature (339)..(341): Xaa can be any naturally occurring amino acid
  misc_feature (344)..(358): Xaa can be any naturally occurring amino acid
  misc_feature (362)..(369): Xaa can be any naturally occurring amino acid
  misc_feature (371)..(372): Xaa can be any naturally occurring amino acid
  misc_feature (376)..(402): Xaa can be any naturally occurring amino acid
  misc_feature (404)..(405): Xaa can be any naturally occurring amino acid
  misc_feature (407)..(407): Xaa can be any naturally occurring amino acid
  misc_feature (415)..(419): Xaa can be any naturally occurring amino acid
  misc_feature (423)..(423): Xaa can be any naturally occurring amino acid
  misc_feature (431)..(431): Xaa can be any naturally occurring amino acid
  misc_feature (443)..(444): Xaa can be any naturally occurring amino acid
  misc_feature (446)..(446): Xaa can be any naturally occurring amino acid
  misc_feature (449)..(449): Xaa can be any naturally occurring amino acid
  misc_feature (452)..(452): Xaa can be any naturally occurring amino acid
  misc_feature (455)..(455): Xaa can be any naturally occurring amino acid
  misc_feature (460)..(461): Xaa can be any naturally occurring amino acid
  misc_feature (467)..(468): Xaa can be any naturally occurring amino acid
  misc_feature (470)..(471): Xaa can be any naturally occurring amino acid
  misc_feature (474)..(474): Xaa can be any naturally occurring amino acid
  misc_feature (476)..(740): Xaa can be any naturally occurring amino acid
XXXXXXXXXXXXXXXXXXXXXXXXXXXXXXXXXXXXXXXXXXXXXXXXXXXXXXXXXXXXXXXXXXXXMXXXXXXXXXXXXXXFXLPXEXLXVXPXDPYXXXXXXXXXEQLDXARXITXXAXAXRVSXLEXEXXXLRXXXXXKXXXXXXLXXRXXXXXXXXXXXXXXRLXXALXXXXXXXXXXXXXXXXKLXXEXDXLAXTXKKLXRDXAKLEXFKRXLMXSLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSPXXXXXXXXXPXXXSXXXSPXXXXXXXXXXXXXXXPSSXXXXXXXXAXXSPPXXXXXXXXXXXXXXXXXXXXXXXXXXXRXXRXDGKEFFRXXXXXQARXRLSYEQFXAFLANIKELNAXXQXREXTLXKAXEIFGXXNKDLYXXFXXLLXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94674 - protein, 164 aa, artificial
  consensus sequence
  misc_feature (1)..(29): Xaa can be any naturally occurring amino acid
  misc_feature (31)..(31): Xaa can be any naturally occurring amino acid
  misc_feature (34)..(35): Xaa can be any naturally occurring amino acid
  misc_feature (42)..(44): Xaa can be any naturally occurring amino acid
  misc_feature (46)..(51): Xaa can be any naturally occurring amino acid
  misc_feature (54)..(54): Xaa can be any naturally occurring amino acid
  misc_feature (58)..(58): Xaa can be any naturally occurring amino acid
  misc_feature (62)..(62): Xaa can be any naturally occurring amino acid
  misc_feature (65)..(66): Xaa can be any naturally occurring amino acid
  misc_feature (68)..(68): Xaa can be any naturally occurring amino acid
  misc_feature (71)..(76): Xaa can be any naturally occurring amino acid
  misc_feature (78)..(79): Xaa can be any naturally occurring amino acid
  misc_feature (81)..(86): Xaa can be any naturally occurring amino acid
  misc_feature (93)..(94): Xaa can be any naturally occurring amino acid
  misc_feature (97)..(97): Xaa can be any naturally occurring amino acid
  misc_feature (99)..(99): Xaa can be any naturally occurring amino acid
  misc_feature (101)..(101): Xaa can be any naturally occurring amino acid
  misc_feature (104)..(105): Xaa can be any naturally occurring amino acid
  misc_feature (108)..(108): Xaa can be any naturally occurring amino acid
  misc_feature (115)..(115): Xaa can be any naturally occurring amino acid
  misc_feature (121)..(125): Xaa can be any naturally occurring amino acid
  misc_feature (128)..(131): Xaa can be any naturally occurring amino acid
  misc_feature (134)..(140): Xaa can be any naturally occurring amino acid
  misc_feature (142)..(142): Xaa can be any naturally occurring amino acid
  misc_feature (144)..(145): Xaa can be any naturally occurring amino acid
  misc_feature (147)..(164): Xaa can be any naturally occurring amino acid
XXXXXXXXXXXXXXXXXXXXXXXXXXXXXKXPTXXELISHYXXXGXXXXXXASXKVIXDLQXALXXVXSSXXXXXXKXXLXXXXXXRKIDAIXXRLXVXDXKLXXKPXYVETFAXGLASGXXXXXGIXXXXPHXXXXXXXQXWXXVXXXXXXXXXXXXXXXXXX

SEQ ID NO: 94675 - protein, 488 aa, artificial
  consensus sequence
  misc_feature (3)..(6): Xaa can be any naturally occurring amino acid
  misc_feature (8)..(8): Xaa can be any naturally occurring amino acid
  misc_feature (10)..(10): Xaa can be any naturally occurring amino acid
  misc_feature (12)..(13): Xaa can be any naturally occurring amino acid
  misc_feature (15)..(22): Xaa can be any naturally occurring amino acid
  misc_feature (25)..(27): Xaa can be any naturally occurring amino acid
  misc_feature (30)..(32): Xaa can be any naturally occurring amino acid
  misc_feature (34)..(35): Xaa can be any naturally occurring amino acid
  misc_feature (37)..(77): Xaa can be any naturally occurring amino acid
  misc_feature (79)..(95): Xaa can be any naturally occurring amino acid
  misc_feature (97)..(109): Xaa can be any naturally occurring amino acid
  misc_feature (111)..(113): Xaa can be any naturally occurring amino acid
  misc_feature (115)..(115): Xaa can be any naturally occurring amino acid
  misc_feature (120)..(121): Xaa can be any naturally occurring amino acid
  misc_feature (124)..(124): Xaa can be any naturally occurring amino acid
  misc_feature (126)..(126): Xaa can be any naturally occurring amino acid
  misc_feature (129)..(131): Xaa can be any naturally occurring amino acid
  misc_feature (133)..(138): Xaa can be any naturally occurring amino acid
  misc_feature (140)..(143): Xaa can be any naturally occurring amino acid
  misc_feature (148)..(148): Xaa can be any naturally occurring amino acid
  misc_feature (150)..(154): Xaa can be any naturally occurring amino acid
  misc_feature (156)..(156): Xaa can be any naturally occurring amino acid
  misc_feature (159)..(159): Xaa can be any naturally occurring amino acid
  misc_feature (161)..(161): Xaa can be any naturally occurring amino acid
  misc_feature (163)..(163): Xaa can be any naturally occurring amino acid
  misc_feature (166)..(167): Xaa can be any naturally occurring amino acid
  misc_feature (169)..(169): Xaa can be any naturally occurring amino acid
  misc_feature (171)..(172): Xaa can be any naturally occurring amino acid
  misc_feature (174)..(229): Xaa can be any naturally occurring amino acid
  misc_feature (231)..(254): Xaa can be any naturally occurring amino acid
  misc_feature (256)..(256): Xaa can be any naturally occurring amino acid
  misc_feature (258)..(276): Xaa can be any naturally occurring amino acid
  misc_feature (278)..(278): Xaa can be any naturally occurring amino acid
  misc_feature (280)..(280): Xaa can be any naturally occurring amino acid
  misc_feature (288)..(288): Xaa can be any naturally occurring amino acid
  misc_feature (296)..(320): Xaa can be any naturally occurring amino acid
  misc_feature (322)..(324): Xaa can be any naturally occurring amino acid
  misc_feature (326)..(326): Xaa can be any naturally occurring amino acid
  misc_feature (337)..(358): Xaa can be any naturally occurring amino acid
  misc_feature (362)..(362): Xaa can be any naturally occurring amino acid
  misc_feature (368)..(368): Xaa can be any naturally occurring amino acid
  misc_feature (374)..(374): Xaa can be any naturally occurring amino acid
  misc_feature (376)..(376): Xaa can be any naturally occurring amino acid
  misc_feature (379)..(379): Xaa can be any naturally occurring amino acid
  misc_feature (382)..(382): Xaa can be any naturally occurring amino acid
  misc_feature (387)..(388): Xaa can be any naturally occurring amino acid
  misc_feature (390)..(390): Xaa can be any naturally occurring amino acid
  misc_feature (392)..(410): Xaa can be any naturally occurring amino acid
  misc_feature (414)..(416): Xaa can be any naturally occurring amino acid
  misc_feature (418)..(427): Xaa can be any naturally occurring amino acid
  misc_feature (429)..(429): Xaa can be any naturally occurring amino acid
  misc_feature (432)..(432): Xaa can be any naturally occurring amino acid
  misc_feature (434)..(434): Xaa can be any naturally occurring amino acid
  misc_feature (438)..(438): Xaa can be any naturally occurring amino acid
  misc_feature (440)..(450): Xaa can be any naturally occurring amino acid
  misc_feature (452)..(452): Xaa can be any naturally occurring amino acid
  misc_feature (454)..(456): Xaa can be any naturally occurring amino acid
  misc_feature (459)..(467): Xaa can be any naturally occurring amino acid
  misc_feature (469)..(471): Xaa can be any naturally occurring amino acid
  misc_feature (473)..(476): Xaa can be any naturally occurring amino acid
  misc_feature (478)..(479): Xaa can be any naturally occurring amino acid
  misc_feature (481)..(488): Xaa can be any naturally occurring amino acid
MDXXXXSXHXRXXSXXXXXXXXLSXXXENXXXKXXEXXXXXXXXXXXXXXXXXXXXXXXXXXXXXXXXXXXXXXXXXNXXXXXXXXXXXXXXXXXHXXXXXXXXXXXXXKXXXRXGTPSXXSEXSXNSXXXLXXXXXXNXXXXKQRKXNXXXXXFXGFXCXGXCSXXKXVXXDXXXXXXXXXXXXXXXXXXXXXXXXXXXXXXXXXXXXXXXXXXXXXXXXXXXXXXXXRXXXXXXXXXXXXXXXXXXXXXXXXKXAXXXXXXXXXXXXXXXXXXXDXAXNLERKLSXLTWDAIPXXXXXXXXXXXXXXXXXXXXXXXXXEXXXSXASSDLFEIENXXXXXXXXXXXXXXXXXXXXXXYEPXSEASIXWSVVTXSXADXSVXSDFDXXKXVXXXXXXXXXXXXXXXXXXXKTKXXXGXXXXXXXXXXLXGCXSXKAVXVXXXXXXXXXXXKXDXXXHHXXXXXXXXXKXXXEXXXXDXXFXXXXXXXX

SEQ ID NO: 94676 - protein, 551 aa, artificial
  consensus sequence
  misc_feature (2)..(26): Xaa can be any naturally occurring amino acid
  misc_feature (28)..(31): Xaa can be any naturally occurring amino acid
  misc_feature (36)..(36): Xaa can be any naturally occurring amino acid
  misc_feature (44)..(44): Xaa can be any naturally occurring amino acid
  misc_feature (46)..(49): Xaa can be any naturally occurring amino acid
  misc_feature (51)..(51): Xaa can be any naturally occurring amino acid
  misc_feature (54)..(55): Xaa can be any naturally occurring amino acid
  misc_feature (58)..(58): Xaa can be any naturally occurring amino acid
  misc_feature (60)..(60): Xaa can be any naturally occurring amino acid
  misc_feature (62)..(62): Xaa can be any naturally occurring amino acid
  misc_feature (67)..(92): Xaa can be any naturally occurring amino acid
  misc_feature (94)..(96): Xaa can be any naturally occurring amino acid
  misc_feature (99)..(100): Xaa can be any naturally occurring amino acid
  misc_feature (102)..(102): Xaa can be any naturally occurring amino acid
  misc_feature (108)..(108): Xaa can be any naturally occurring amino acid
  misc_feature (115)..(115): Xaa can be any naturally occurring amino acid
  misc_feature (117)..(119): Xaa can be any naturally occurring amino acid
  misc_feature (122)..(123): Xaa can be any naturally occurring amino acid
  misc_feature (127)..(172): Xaa can be any naturally occurring amino acid
  misc_feature (181)..(182): Xaa can be any naturally occurring amino acid
  misc_feature (184)..(187): Xaa can be any naturally occurring amino acid
  misc_feature (189)..(190): Xaa can be any naturally occurring amino acid
  misc_feature (193)..(196): Xaa can be any naturally occurring amino acid
  misc_feature (198)..(201): Xaa can be any naturally occurring amino acid
  misc_feature (203)..(203): Xaa can be any naturally occurring amino acid
  misc_feature (205)..(205): Xaa can be any naturally occurring amino acid
  misc_feature (207)..(551): Xaa can be any naturally occurring amino acid
MXXXXXXXXXXXXXXXXXXXXXXXXXEXXXXKFRLXDGSDIGPXRXXXXAXTVXXLKXRXVXDWPKXXXXXXXXXXXXXXXXXXXXXXXXXXKXXXPKXXNXVKLISXGKILENXKXXXQCXXPFGXXXXXXXXXXXXXXXXXXXXXXXXXXXXXXXXXXXXXXXXXXXXXXMHVVVQPSXXKXXXXKXXKKXXXXPXXXXCXCXIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94677 - protein, 214 aa, artificial
  consensus sequence
  misc_feature (4)..(12): Xaa can be any naturally occurring amino acid
  misc_feature (15)..(23): Xaa can be any naturally occurring amino acid
  misc_feature (26)..(26): Xaa can be any naturally occurring amino acid
  misc_feature (28)..(29): Xaa can be any naturally occurring amino acid
  misc_feature (31)..(40): Xaa can be any naturally occurring amino acid
  misc_feature (42)..(50): Xaa can be any naturally occurring amino acid
  misc_feature (52)..(53): Xaa can be any naturally occurring amino acid
  misc_feature (55)..(59): Xaa can be any naturally occurring amino acid
  misc_feature (61)..(61): Xaa can be any naturally occurring amino acid
  misc_feature (66)..(80): Xaa can be any naturally occurring amino acid
  misc_feature (83)..(165): Xaa can be any naturally occurring amino acid
  misc_feature (167)..(169): Xaa can be any naturally occurring amino acid
  misc_feature (171)..(171): Xaa can be any naturally occurring amino acid
  misc_feature (179)..(179): Xaa can be any naturally occurring amino acid
  misc_feature (181)..(181): Xaa can be any naturally occurring amino acid
  misc_feature (184)..(186): Xaa can be any naturally occurring amino acid
  misc_feature (189)..(189): Xaa can be any naturally occurring amino acid
  misc_feature (192)..(192): Xaa can be any naturally occurring amino acid
  misc_feature (194)..(194): Xaa can be any naturally occurring amino acid
  misc_feature (196)..(202): Xaa can be any naturally occurring amino acid
  misc_feature (204)..(205): Xaa can be any naturally occurring amino acid
  misc_feature (207)..(207): Xaa can be any naturally occurring amino acid
  misc_feature (210)..(210): Xaa can be any naturally occurring amino acid
  misc_feature (212)..(212): Xaa can be any naturally occurring amino acid
METXXXXXXXXXKQXXXXXXXXXFKXPXXRXXXXXXXXXXRXXXXXXXXXLXXPXXXXXSXGSSPXXXXXXXXXXXXXXXPPXXXXXXXXXXXXXXXXXXXXXXXXXXXXXXXXXXXXXXXXXXXXXXXXXXXXXXXXXXXXXXXXXXXXXXXXXXXXXXXXXXXAXXXLXPPPSSLPXPXFSXXXKLXCNXEXAXXXXXXXAXXNXRRXLXLR
